United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 35

SEQ ID NO: 151453 - protein, 291 aa, Glycine max
  Coding DNA Sequence Number=SeqID_34675
  Gene Ontology: Mol. function=DNA binding; Cellular component =intracellular
  Homolog annotation: Hit_ID=Q2HUC6; Match level="QueryCoverage=96%, HitCoverage=43%, E-value=1e-102, Identity=67%"; Hit description =ELM2; AT-rich interaction region; Homeodomain-related
  Pfam annotation: Domain name=ELM2; Domain location=83-138; Score =22.6; E_value=0.00062; Accession=PF01448.14; Description=ELM2 domain
  Pfam annotation: Domain name=Myb_DNA-binding; Domain location=183 -233; Score=31.1; E_value=3.9e-06; Accession=PF00249.21; Description =Myb-like DNA-binding domain
  Pfam module annotation: Pfam domain module=ELM2::Myb_DNA-binding; Domain location=83-138::183-233
GQKMHPSMYDDRVGAMYNLRQRLKCDKRVLLGKTTSGGVSLASSGGTHVDLERTPSSHAEDRAEKLLPDSGTAHSSLDRCARVHIPLGPNHQAEVPEWTVITYEVDSKWLGTQIWPPKTVNSKCRLFERDPIGEGRQNSCGCQVQGSVECVRFHIAKRRAKVKLELGEAFHQWNLHKVGEEVGGSWTEQEEKKFKDVVKSNPASLDKCFWDHLFKTFPKKSREDLVSYYFNVFLLQRRAYQNRHTPDNIDSDDDESEFTPLRKVFGHQTPKPRSFTLLSPKKATFKRENNK

SEQ ID NO: 151454 - protein, 47 aa, Glycine max
  Coding DNA Sequence Number=SeqID_34676
MAVTATVNSSYAVGNNHNGDCRIVMVLIIITTRKENDLLMKIINLNH

SEQ ID NO: 151455 - protein, 104 aa, Glycine max
  Coding DNA Sequence Number=SeqID_34677
MSLHSSSSVNGRHRSHLRPHYHGRQKERKPQEANINLPYFHGKDNVEVNLDWEIRAEQQLKRKTTLKFYGSHSYSKIDQGQGILGVTPSKPKDDKGKTIEKQPP

SEQ ID NO: 151456 - protein, 150 aa, Glycine max
  Coding DNA Sequence Number=SeqID_34678
CVRWQAETKFGHSAPKIRGDTLRLSAPLCHPEALCPMASRDQRLSLVILHPRYAEIPYGYLHPFARQTQLCPMASRDQRPSLVILHPRYAEIPYGYLHPFARQTQLCPMASRDQRPSLVILHPRYAEIPYGYLHPFARQTQLCPMASRDQ

SEQ ID NO: 151457 - protein, 394 aa, Glycine max
  Coding DNA Sequence Number=SeqID_34679
  Gene Ontology: Mol. function=drug transporter activity; Cellular component=membrane; Biological process=multidrug transport
  Homolog annotation: Hit_ID=UPI000034F09A; Match level="QueryCoverage =97%, HitCoverage=71%, E-value=1e-161, Identity=71%"; Hit description= antiporter/ drug transporter/ transporter
  Pfam annotation: Domain name=MatE; Domain location=1-113; Score=21.6; E_value=0.00013; Accession=PF01554.9; Description=MatE
  Pfam annotation: Domain name=MatE; Domain location=172-335; Score =134.3; E_value=3.3e-37; Accession=PF01554.9; Description=MatE
  Pfam module annotation: Pfam domain module=MatE::MatE; Domain location=1-113::172-335
MASALETLCGQAFGAGQVEMIGVYMQRSWLILLGACICLTPIYIYAEPILLLLGQEPEIAELAGAFTIQSIPQMFSLAINFPTQKFLQAQTKVGFLAWLGFGAFIFHVILLWILLKVFSLGTTGAAVAYCTTAWIIALAQTAYVIGWCKDGWRGFSWLAFKDLWAFVKLSVASAVMLCLEIWYFMILIVLTGHLDNAVIAVGSLSICMTINGFEGMLFIGINAAISVRVSNELGSGRPRAAKYSVIVTIIESLIIGLISAAIILATKDHFAIIFTESKEMIKAVSKLAGLLGITMILNSVQPVISGVAVGGGWQALVAYINLFCYYIMGLPLGFLLGYKLGYRVEGIWVGMICGTMLQTLILLYIVYKTNWNKEVEQASERMRKWTGQEIEINL

SEQ ID NO: 151458 - protein, 96 aa, Glycine max
  Coding DNA Sequence Number=SeqID_34680
  Gene Ontology: Mol. function=DNA binding; Biological process=DNA integration
  Homolog annotation: Hit_ID=Q1SLU3; Match level="QueryCoverage=79%, HitCoverage=5%, E-value=4e-14, Identity=46%"; Hit description =Integrase, catalytic region
MVVLLQSSHLSHDSFSPQHKAYSLSISLDTKPSTYTQAIKHQHWIHTMNAELQALEANGTWVIIEKPAAVIPIGSKWVYIIKRQIALLKGIIQSGT

SEQ ID NO: 151459 - protein, 115 aa, Glycine max
  Coding DNA Sequence Number=SeqID_34681
  Homolog annotation: Hit_ID=Q9FHN3; Match level="QueryCoverage=65%, HitCoverage=44%, E-value=6e-13, Identity=50%"; Hit description =Arabidopsis thaliana genomic DNA, chromosome 5, TAC clone:K17N15
MQHRKLTSGRPSGTDGSDYSYRMVVDSRYQLVAKGKKYLSLHFITEAVLLLIGATLAYLPGIEADAPNTVAYSSVIVEDEAGPHLLLKVNMSVFDRRFYKKNFINYQDRNTTAKK

SEQ ID NO: 151460 - protein, 67 aa, Glycine max
  Coding DNA Sequence Number=SeqID_34682
SSLSQTGMRFRDCNHIVEFVFVKFVSATYRLRSKKSRKGKSPGKVRVCDLSIESIVVGFKPPREAIE

SEQ ID NO: 151461 - protein, 533 aa, Glycine max
  Coding DNA Sequence Number=SeqID_34683
  Homolog annotation: Hit_ID=UPI0000E21E9D; Match level="QueryCoverage =49%, HitCoverage=26%, E-value=3e-13, Identity=23%"; Hit description =PREDICTED: chromosome 9 open reading frame 127
MDSYLLQNFKQLKIWNFNFLLKGEKLKFSSYSLLQETPSEFVEYRSGTFVRRGSTPFESYYLPVVGGASYDSANFPLEPLLDDSSYSGEPDNIWTYFLLNIPRGAAGGNIHIQLSSDMKISYEVYARFGGLPSLDSWDYYYANKTRRSDPSMFFTLYDSSDNKVNFYIMYAREGTWGIGLRHLNTSSDSMKGLTIMSISLERCPKRCSSHGECKFSFDASGLTSYRHEPRKSSAKTFLVLDTLVMIETHGKKIECRIVDFSGCIFCSCDRNHGGFDCSIEIVTHQGHVRQSIFLIVSNAAAILPAYWALRKKALAEWVLYTSSGISSGLYHACDVGTWCALNYNVLQFMDFWLSFMAVISTFLYLATIDEVLKRAIHTAVAILTALMAATKATRSSNVILVIVIGALGLFIGWLIEISTKYRSLSFSIGISFNFSHCFQTIKQWLYNLVKTLLRRYHWAFALAGFLALAMAAISWTLETSETYWFWHSIWHITIYTSSFFFLCSKANIEDTENQLPTNGNYELTHQDSLPRTG

SEQ ID NO: 151462 - protein, 264 aa, Glycine max
  Coding DNA Sequence Number=SeqID_34684
  Gene Ontology: Mol. function=calcium ion binding; Biological process =morphogenesis of a branching structure
  Homolog annotation: Hit_ID=Q01705; Match level="QueryCoverage=45%, HitCoverage=4%, E-value=4e-12, Identity=32%"; Hit description =Neurogenic locus notch homolog protein 1 precursor (Notch 1) (Motch A) (mT14) (p300) ...
  Homolog annotation: Hit description=[Contains: Notch 1 extracellular truncation; Notch 1 intracellular domain]
  Pfam annotation: Domain name=EGF; Domain location=116-147; Score=4.4; E_value=2.9; Accession=PF00008.17; Description=EGF-like domain
  Pfam annotation: Domain name=EGF; Domain location=27-66; Score=2.9; E_ value=3.8; Accession=PF00008.17; Description=EGF-like domain
  Pfam annotation: Domain name=EGF; Domain location=73-109; Score=38.7; E_value=2e-08; Accession=PF00008.17; Description=EGF-like domain
  Pfam module annotation: Pfam domain module=EGF::EGF::EGF; Domain location=116-147::27-66::73-109
MSITTGICQVVAVSLLLGLLSVYSLECDDDRCKTGLCNNTGACICNLPDPSTILNGDRTFFGGKFCDEEMTMCDGTNSFWCEHGATCEEIVQGEKYSCKCPLGFAGEHCEHSGAPCGHTFCFHNAECLAETGDVCQCPSEWKGSADCSLPTTPTDFYSISTDTKSSKVSSSSDSNKALAVLAVSSVGGAAAGAIYGKKLFNKKKREARFQQLSEMQTQGILDGDGDEEDENHNMWALVKVKPLLFQASDTLRLGSGPLICAISE

SEQ ID NO: 151463 - protein, 120 aa, Glycine max
  Coding DNA Sequence Number=SeqID_34685
MNCVFVHASSTHEFGAMRSDCLVQFSILNPFLVLMNCVFVYVSSILEFGAMRSDYLVQLSILNLFRSPMNCIFGHVSSTHEFGAMRSDCLVQFSILNHFSEPHELRFRSWVLHLRVWSHA

SEQ ID NO: 151464 - protein, 187 aa, Glycine max
  Coding DNA Sequence Number=SeqID_34686
GAGDDINLCVLSGFHITDSKKVYTDNHSGISSRQHDSKVSMTDLVSAEDDVNLRVQQKVYTNNHSGISARQRDSKVSMTDLVSAEDDGAEDDVSLCVLSGFSSYRQQKVYTDNHSGISARQRVSKVNMTDLVSAEDDGAEDDVSLCVLSGFSSYRQQKVYTDNHSGISARQRDSKVSMTYLVSAEDG

SEQ ID NO: 151465 - protein, 110 aa, Glycine max
  Coding DNA Sequence Number=SeqID_34687
  Gene Ontology: Mol. function=sequence-specific DNA binding; Cellular component=intracellular; Biological process=regulation of transcription, DNA-dependent
  Homolog annotation: Hit_ID=Q390V6; Match level="QueryCoverage=90%, HitCoverage=64%, E-value=9e-33, Identity=65%"; Hit description =Transcriptional regulator, AsnC family
MAFKHFRERLDAVDEVVGGVLVLPAQPDPHEHREATAHLGLIQQGNVAVDVAALLQQPYPPQAGRRRQPDQPGQLQVLQAAVALQGVEDAPIEVVELILHAISPWTPSAA

SEQ ID NO: 151466 - protein, 360 aa, Glycine max
  Coding DNA Sequence Number=SeqID_34688
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=100%, E-value=5e-32, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LTFRRLHILAFRGLHALTFRGLHALTFRGLHALAFRGLHVLTFRGLHALIFRVLHVLTFRGLHVLAFRGLHAFLFIGLHALPLRGLHMLAFRGLHALAFRGLHALTFRGLHALRATRPHLQKTTRPRLQRATRPHKQRTTRPSLQRTTRPFLQRVARPRLQRTTCPPLRGLYVLTFQGLHVLAFRGLHALFFKGLYAFAFRGLHALHFRGLQVLVLRGLHALAFRGQHSLAFRGLHVLTFRGLLALPFRGLHVLASIGLHALTIRGPHGLVFRGLHVLTLRGLPFLSFRGLHALALRGLHVLTFNGLHALPFGGQHVLTFRGPHALPFTGLHVLASIGLHTLTIRGLHVLTIQRTTHPRL

SEQ ID NO: 151467 - protein, 99 aa, Glycine max
  Coding DNA Sequence Number=SeqID_34689
MLIERVRFRIDIIIQGLTILAPVDSPNTDGIDPDAICELNLCSNIRRLMFKKEFDTSYVGFNSGSELLSRQNLCNAYLDFKIHVILLPSIWLLCATIWN

SEQ ID NO: 151468 - protein, 252 aa, Glycine max
  Coding DNA Sequence Number=SeqID_34690
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=2e-33, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTLRGLHALAIRGLHVLAFRGLHVLTFRGIHVLTFRGLHVLAFRGLYDLANRGQHALTFRGLHALTFRALHALTFRGLHVLPIRELHALTLRGQHVLTIRGLHVLAFRGLHVLAFRGLHILAIRGLNALTFRGLHVLAIRGLQSTPLEDYTGLHALTFRGLHVLAIRGQYALTFRGLHVLAIRGLHALTLRGLHVLAIRGLHVLAIRGLHVLAIRGLNALTFRALHVLAIRGLQSTPLEDYMSSPLEDY

SEQ ID NO: 151469 - protein, 320 aa, Glycine max
  Coding DNA Sequence Number=SeqID_34691
  Gene Ontology: Mol. function=DNA-directed RNA polymerase activity; Cellular component=chloroplast; Biological process=transcription, DNA-dependent
  Homolog annotation: Hit_ID=Q2PMQ3; Match level="QueryCoverage=64%, HitCoverage=61%, E-value=1e-114, Identity=100%"; Hit description=DNA- directed RNA polymerase alpha chain
  Pfam annotation: Domain name=RNA_pol_A_bac; Domain location=174-286; Score=77.3; E_value=5e-20; Accession=PF01000.16; Description=RNA polymerase Rpb3RpoA insert domain
  Pfam annotation: Domain name=RNA_pol_L; Domain location=132-320; Score=49.6; E_value=1.1e-11; Accession=PF01193.14; Description=RNA polymerases L  13 to 16 kDa subunit
  Pfam annotation: Domain name=Ribosomal_S11; Domain location=28-120; Score=160.8; E_value=3.6e-45; Accession=PF00411.9; Description =Ribosomal protein S11
  Pfam module annotation: Pfam domain module=RNA_pol_A_bac::RNA_pol _L::Ribosomal_S11; Domain location=174-286::132-320::28-120
  Subcellular localization annotation: CTP_CleavageSite=15; ConfidenceScore=5.13e-01
MAKPISKKGSRKNVRIGSRKHTRKIPKGVIHVQASFNNTIVTVTDVRGRVISWSSAGTCGFKGTRRGTPFAAQTAAGNAIRTVSDQGMQRAEVMIKGPGLGRDAALRAIRRSEKIRVSTRTLQWKCVESRIDSKRLYYGRFILSPLMKGQADTIGIAMRRVLLGEIEGTCITRVKSEKIPHEYSTIIGIEESVHEILMNLKEIVLRSNLYGTRDASICFKGPGYVTAQDIILPPSVEIVDNTQHIANVTEPVNLCIELKIERNRGYRIKTLKNFQDGSYPIDATFMPVRNVNHSIHSYVNGNEKQEILFLEIWTNGSLNS

SEQ ID NO: 151470 - protein, 449 aa, Glycine max
  Coding DNA Sequence Number=SeqID_34692
  Gene Ontology: Mol. function=transporter activity; Cellular component= integral to membrane; Biological process=transport
  Homolog annotation: Hit_ID=UPI00005F88C4; Match level="QueryCoverage =57%, HitCoverage=58%, E-value=1e-85, Identity=60%"; Hit description =COG0477: Permeases of the major facilitator superfamily
  Pfam annotation: Domain name=3Beta_HSD; Domain location=240-447; Score=-151.6; E_value=0.087; Accession=PF01073.9; Description=3-beta hydroxysteroid dehydrogenaseisomerase family
  Pfam annotation: Domain name=Epimerase; Domain location=239-448; Score=-35.1; E_value=0.00071; Accession=PF01370.11; Description=NAD dependent epimerasedehydratase family
  Pfam annotation: Domain name=MFS_1; Domain location=83-439; Score= -23.1; E_value=0.0036; Accession=PF07690.6; Description=Major Facilitator Superfamily
  Pfam annotation: Domain name=NAD_binding_4; Domain location=270-448; Score=-76.8; E_value=0.0012; Accession=PF07993.2; Description=Male sterility protein
  Pfam annotation: Domain name=adh_short; Domain location=238-407; Score=-64.1; E_value=0.092; Accession=PF00106.15; Description=short chain dehydrogenase
  Pfam module annotation: Pfam domain module=3Beta_HSD::Epimerase::MFS _1::NAD_binding_4::adh_short; Domain location=240-447::239-448::83 -439::270-448::238-407
MGHFHEYGGLAGWKWLYIIEGAPSLLIGVLVIFLLTDRIAQAKWLSDDEKALLEARLRSDGSHKTEQHGSMLAVLKNPKVWLLTFIYFCLIAGFYTVSFWMPTLIHNAGEGDVLKVGLLTAIPYAAAIVTMIAASRSADKRRERRWHLAAIAVMSGLGMIIAALFSHDLVIAMIGLTIGAAGGLSTLPLFWSLPTAFLGGASAAVGIAVINSFGNLAGFVAPWIMGLLTDMTHSTLTGTLIISATLFIGAAAIFRIPARMRGSLSGPQGETQEIGRLIAIDRVALQGIDDSRLKVLTGDISDSEWLRSAIPAQVDSVFHLAAIVSSQAEQDFELGMKINVDAFRQLLEHLRQLPQSVKLVTTSSVAVFGGDLPEKVSDSQVWLPQSSYGTQKAICDLLLADYSRRGWLNGRSLRMPTIVVRPGRPNQAASSFASGIIREPLNGESAVCP

SEQ ID NO: 151471 - protein, 103 aa, Glycine max
  Coding DNA Sequence Number=SeqID_34693
MGETHEVPRDRTLADFEPHLGYDTEGQAFCGIPLPNTLGGGAQYRPQPQPLHFAMGKVSPTMLCLVPDVVIPMKFKVPDFDKYKGTTCPKNHLKMYYRKMGAY

SEQ ID NO: 151472 - protein, 126 aa, Glycine max
  Coding DNA Sequence Number=SeqID_34694
  Gene Ontology: Mol. function=nucleic acid binding; Biological process= DNA integration
  Homolog annotation: Hit_ID=Q1S9K1; Match level="QueryCoverage=94%, HitCoverage=14%, E-value=6e-17, Identity=40%"; Hit description =Integrase, catalytic region; Zinc finger, CCHC-type; Peptidase aspartic, catalytic
  Pfam annotation: Domain name=zf-CCHC; Domain location=48-65; Score =14.2; E_value=0.0046; Accession=PF00098.13; Description=Zinc knuckle
MVKGNLEKFLETKRILEISLRQIKKNIFHVTSIKRKVTQRRIVGIVESQCHYCKKFRHMEKNCRNKNKHQANFVEEHDNGQHLFYATRDSSDEIRGNWYLDSGCSNHLANDRSIFKEIDNTVKVKV

SEQ ID NO: 151473 - protein, 312 aa, Glycine max
  Coding DNA Sequence Number=SeqID_34695
  Gene Ontology: Mol. function=cyclopropane-fatty-acyl-phospholipid synthase activity; Biological process=lipid biosynthetic process
  Homolog annotation: Hit_ID=Q0F1K4; Match level="QueryCoverage=87%, HitCoverage=61%, E-value=4e-40, Identity=35%"; Hit description =Cyclopropane-fatty-acyl-phospholipid synthase
  Pfam annotation: Domain name=CMAS; Domain location=160-312; Score= -40.6; E_value=7.6e-13; Accession=PF02353.10; Description =Cyclopropane-fatty-acyl-phospholipid synthase
  Pfam annotation: Domain name=Methyltransf_11; Domain location=226 -306; Score=16.6; E_value=0.0013; Accession=PF08241.2; Description =Methyltransferase domain
  Pfam module annotation: Pfam domain module=CMAS::Methyltransf_11; Domain location=160-312::226-306
MRHHLATALQFEPPLLDQPQPWQWDEDVQTTAGGETSQARFILNRLFQDYPGAFSVRLWNGNLLNIGEGDPAFTFCLQQASVLRNMVWFCDPKCLAEAYFSGQIQILGDFHAAMQLREHFESLSLPLHEKLGLIFRALTLATDFAQPEQTSLPQIDPTPNQLDTSSPVALSYDNVPEDFYQCWLDEHMLHSCAYFSGNTRDLAQAQRNQLDLICLKLHLQHGDSLLDIGCGWGGLACWAAKHYGVFVHGITQNASQYAYATKQVKRLGLEHLVTIELGNYQDLPATGSYDKAACIGIADHIGEAHFPDYLAK

SEQ ID NO: 151474 - protein, 82 aa, Glycine max
  Coding DNA Sequence Number=SeqID_34696
MEHYLQHLVRQQAANHRGQGQSSTPSVCPTPEQFATEVAWPGDWPDAQVGEEPAGSPGRMDEPFMDEDMIDLFDFLGGSGAT

SEQ ID NO: 151475 - protein, 52 aa, Glycine max
  Coding DNA Sequence Number=SeqID_34697
MHIVVVRQGQDHLELPSGVRTKCGQQKPIKVLKNGCKWGWGHDRLIVALSLY

SEQ ID NO: 151476 - protein, 98 aa, Glycine max
  Coding DNA Sequence Number=SeqID_34698
  Subcellular localization annotation: CTP_CleavageSite=31; ConfidenceScore=5.27e-01
MEQRKYSRNSNGHNFSHGCPIQVHNLSRRLKVNNRSSREIQMLITVRMVVRFRCVRIEALEIEQQKLSRNSNGHNVSHRCPIRAHNTSRRSKLHSGCS

SEQ ID NO: 151477 - protein, 394 aa, Glycine max
  Coding DNA Sequence Number=SeqID_34699
  Gene Ontology: Mol. function=transporter activity; Cellular component= integral to membrane; Biological process=transport
  Homolog annotation: Hit_ID=Q6CYZ5; Match level="QueryCoverage=89%, HitCoverage=87%, E-value=1e-107, Identity=55%"; Hit description =Putative membrane protein
  Pfam annotation: Domain name=MFS_1; Domain location=17-360; Score =111.5; E_value=2.5e-30; Accession=PF07690.6; Description=Major Facilitator Superfamily
  Pfam annotation: Domain name=Sugar_tr; Domain location=17-394; Score=- 154.9; E_value=0.051; Accession=PF00083.14; Description=Sugar (and other) transporter
  Pfam module annotation: Pfam domain module=MFS_1::Sugar_tr; Domain location=17-360::17-394
MTTSVSTTQLNLRIISIVVFTCICYLSIGLPLAVLPGYIHYQLGYSTLIAGIVISLQYISTLVSRPHAGRYTDIWGPKKVVSLGIICCMLSGLFTLAAVMLQAIPLLAVSALLIGRVFLGVGESFTATGATLWGIKTVGAIHTSRVISWNGVATYVAMAVGAPLGVMLNSYFGISGFAVVVVLVALIGLLFARTRQDVSVTAGVRAPFHVVVRRIWPYGLGLALGTVGFGVIATFITLYFSAHHWQGAAFTLSLFSIGFICIRLILGNTITRYGGVPVSLVCFVVECLGLLIIWQAPSAWIAGIGAFLTGSGFSLVFPALGVEAVKQVEEQNQGTALGTYSAFLDLALGLTGPVAGWVAGYYALDTLYLLAAVVVAMAFILLLRVCLQQTRTNV

SEQ ID NO: 151478 - protein, 295 aa, Glycine max
  Coding DNA Sequence Number=SeqID_34700
MEASLCISGKGFILNTEGQPWKLLRKDLTTLAQTWSVLSYSNLAPTSCISDLNTDRARLVYGLITRMDMNIGGLIFGQMTMMAQSNSSRLGFLALITTLCRSRGVGSDALTSYENLRLAIDLAYIIRNCWNANDQTVNFPEARKTTLRAADVPSSFAPIDGILASSTSSPLPALTDLSARALRLQMPNFKACLKDKFSLYKATIPGAVDFEKRILETRSNEAAHPGPVPASAEAPFLGVDPSSPQHAADSSTPVLEIQEGQTILVLPLDTSPPATPVWHLTDEKNVQIQDNQDKS

SEQ ID NO: 151479 - protein, 78 aa, Glycine max
  Coding DNA Sequence Number=SeqID_34701
  Subcellular localization annotation: CTP_CleavageSite=34; ConfidenceScore=5.06e-01
MASFSQMQSQFQSHMQSQGIALPLEPEVGPSGPRVSTKESCVDPSGNNPETGDSGNKQLFLQQNLHMPDLSDDPYIDT

SEQ ID NO: 151480 - protein, 44 aa, Glycine max
  Coding DNA Sequence Number=SeqID_34702
DSLEEQASQGSFVLTAAIGRPEHPGHVCAARASVTIKKYFGLAP

SEQ ID NO: 151481 - protein, 102 aa, Glycine max
  Coding DNA Sequence Number=SeqID_34703
YIRSNLHAHFSSLWSGYYPTPTPYRLVEPVQVIEVSSSEEDLEEDPEELPPELAVDALDFPEGDEDPLPDVDSPEDIMSASEADSTEELGPGGTANSDDSSS

SEQ ID NO: 151482 - protein, 118 aa, Glycine max
  Coding DNA Sequence Number=SeqID_34704
MSLPSAVHVSSIIKREASGDWEIRSSVVFRIEEKEGVETKVVITERAGQTKSVSYLCFPLIPNESPEMCQKSKGSRFARSVKFRNVAEIEKRSFLQKAVASGGSNLARLGELSLPGRA

SEQ ID NO: 151483 - protein, 64 aa, Glycine max
  Coding DNA Sequence Number=SeqID_34705
MNDSSSLGTLIMPLTSESLMEEMAEMRRYEEARSIAYKELQAQDVLQQQNDKIRKRVDATQATM

SEQ ID NO: 151484 - protein, 122 aa, Glycine max
  Coding DNA Sequence Number=SeqID_34706
MTKSLKDFLACFHTTTIQVLAPNERMIVVALCKGLHVEPFEESLVRRKLETMADILSCGGRWGYGEQEDHGEKGGKSDYHIKIALERLLEVEEQLDKRGFDYGSRHHEAHCPKGFEGGDVSS

SEQ ID NO: 151485 - protein, 173 aa, Glycine max
  Coding DNA Sequence Number=SeqID_34707
  Homolog annotation: Hit_ID=Q6CQF2; Match level="QueryCoverage=23%, HitCoverage=50%, E-value=2e-10, Identity=73%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRSV

SEQ ID NO: 151486 - protein, 115 aa, Glycine max
  Coding DNA Sequence Number=SeqID_34708
VRITVRYLRVSSGPPPLDDTRVRITVRVRITVRYLRVSSGPPPLDDTRVRITIRYLRVSSGPPPLDDTRGANNRKVSPRATSSWVMVTESSVVDKSEAFAPTYPPMRNSDLRSSG

SEQ ID NO: 151487 - protein, 152 aa, Glycine max
  Coding DNA Sequence Number=SeqID_34709
  Subcellular localization annotation: CTP_CleavageSite=41; ConfidenceScore=5.49e-01
MILHKIRRHYSLKTVPSGVTNCRNLPFGGRATRGSRVRLPRKENARSRHQRLFEENVRKIGKVWSTNFKCERFGSCFYARGRRETLRHWTINDLLVFERRETLRHWTINDLWVFERRETLRRWTINNLLGWSTKAGFLLLRILNCDEEIRPT

SEQ ID NO: 151488 - protein, 177 aa, Glycine max
  Coding DNA Sequence Number=SeqID_34710
MVKEECKEASVSSKRLAKKERHFEIKTNIKVISPLRQPPHFLLCEKTLVSIATPLRLEFIPQVKELLDEGLVHKSLNPCALLVPKIGIIRHQIPKIGGMNVLSGATLFCKITHAPNIFMICLHRDSLGSDQGVPINPKRIKVIPEWPTPPSVEEKIPEFQKSWDLRSNPFQGGGNMM

SEQ ID NO: 151489 - protein, 96 aa, Glycine max
  Coding DNA Sequence Number=SeqID_34711
AIDREGLPMALYLPLSAGAYFDKLQDQWLKLLLLQRFSCDLFSFRPCSCTHLKEGLLVITEGMTKELLLRAIDFPTEMERMRSYSLSIADAKTKRA

SEQ ID NO: 151490 - protein, 69 aa, Glycine max
  Coding DNA Sequence Number=SeqID_34712
MACTHIPVEAKMVIQCLMECVGASHDKHTLCSSRILGEMEVDEPWLGLWLPLNYQVDMGASQHRTLELG

SEQ ID NO: 151491 - protein, 351 aa, Glycine max
  Coding DNA Sequence Number=SeqID_34713
MSMECVEDRISWDFGYNICTKFLGDDMVLLTGLSDDRAHQLISSEIDGGNSIFYSLEKWRPGIKPNNRVVWIQLWGFPIEAWDTERMTKVVSCIGDVIGPDDDTEDRRRLDRARMLVRTPLPSTINREVIVRVGINEYKRKRSLLADDWTDDVPSDDECDGADDDDSNTTLSFLAGSCPRRRCYKRSNHWSHDITSGLRREPSGQDTSLGNNRSDDNYRENAEVTATPNQGLRLAKVDPGECVSEKIADNSLIGEETLENTKAGPWQVNGEYLGKFSNCEGRAEKVVDLYEESRGQLTVMGPQPDRSPLQFQKFFGPSNNLGPIGNTEGCNKNNSPTKAQSSKGSPEMFAK

SEQ ID NO: 151492 - protein, 210 aa, Glycine max
  Coding DNA Sequence Number=SeqID_34714
MDMNIGALILGQISTIAQSNSSRLGFPALITTLCRAGGVTSDSLTYESLSPAINLAYIKKNCWNMDDLTVNFRGARKVRARPADIPSSSAPPAPSTSATPTPAPPISATPTPAAQDSQCFEAMLHSAGVEMRPNEVVLLEPIVPVIHETVEVEDPPTAVHERQADPPTPIMEMPEDPTTPVLRLPPTPPATPVLHLTDEEDMQDQDTQGT

SEQ ID NO: 151493 - protein, 77 aa, Glycine max
  Coding DNA Sequence Number=SeqID_34715
MGGLASHFHERLINTKRDEGSGRDRRKMGRKGKESSKCWIRGHTLSMHDVLSAHACDIWLPVWLLALSEDNTLSETL

SEQ ID NO: 151494 - protein, 98 aa, Glycine max
  Coding DNA Sequence Number=SeqID_34716
  Gene Ontology: Mol. function=RNA-directed DNA polymerase activity; Biological process=RNA-dependent DNA replication
MVALDMMHKEIEVYVDDMIAKSRTQKGIEVDPNKVKAILEMPEPCTKKQVRGFLGRLNYIARFISQLIATYEPFFKSLRKNQSVQWDDDYQVAFERIK

SEQ ID NO: 151495 - protein, 87 aa, Glycine max
  Coding DNA Sequence Number=SeqID_34717
  Homolog annotation: Hit_ID=Q76DY3; Match level="QueryCoverage=85%, HitCoverage=21%, E-value=5e-08, Identity=43%"; Hit description=AG -motif binding protein-1
MIGNFIDDIDCGNFFDHIDDLLEFPDDAAAADTSAAAPVPPPANFWSAESDSLPATDTVFSDNSVTDLSAELSVPTMAVRILNSFII

SEQ ID NO: 151496 - protein, 73 aa, Glycine max
  Coding DNA Sequence Number=SeqID_34718
  Subcellular localization annotation: CTP_CleavageSite=19; ConfidenceScore=5.03e-01
MAGGVFSKQGVKSRPRRFRNASVGDFVKIFKRSSSFFGLQPYAYLPLQDGGSLYDSNLGSKKVVSHGKERFCE

SEQ ID NO: 151497 - protein, 66 aa, Glycine max
  Coding DNA Sequence Number=SeqID_34719
MLPFDFWHITELHGLPNDGCQSTKATDDHNLSPRAIGLDCFWIVKKVRDQTVPRMPSGSPPLDDKR

SEQ ID NO: 151498 - protein, 108 aa, Glycine max
  Coding DNA Sequence Number=SeqID_34720
  Gene Ontology: Mol. function=N-acetyltransferase activity; Biological process=metabolic process
MWRIIYRASQVIDLFPTVSPEIIVREARLEDYWGSGRDSLQPDSLGQEIAEESVLVAVIDSSLDESFSFGSGGLKMGGFDGKFNLNKGYVAGILTVDNNADFLPRKGL

SEQ ID NO: 151499 - protein, 163 aa, Glycine max
  Coding DNA Sequence Number=SeqID_34721
  Gene Ontology: Mol. function=hydrolase activity; Cellular component =cytoplasmic mRNA processing body; Biological process=mRNA catabolic process, nonsense-mediated decay
  Homolog annotation: Hit_ID=Q9FNB6; Match level="QueryCoverage=92%, HitCoverage=32%, E-value=5e-47, Identity=62%"; Hit description =Arabidopsis thaliana genomic DNA, chromosome 5, P1 clone:MSH12
  Pfam annotation: Domain name=NUDIX; Domain location=1-112; Score=6.0; E_value=0.029; Accession=PF00293.18; Description=NUDIX domain
MGYEVFFFLPLCLLVKGWKGTSWSFPRGKKSKDEEDHACSIREVMEETGFDVSKLLNKDEYLEVIFGQQRVRLYIIAGVKDDTAFAPLTKKEISLSVLWLRTFNMIAFLCSYVKDHGYQNTEKLCNLQEIAWHRLDDLQPASDEVISRSITGLKLYMVAPFLA

SEQ ID NO: 151500 - protein, 158 aa, Glycine max
  Coding DNA Sequence Number=SeqID_34722
  Gene Ontology: Mol. function=glutathione-disulfide reductase activity; Cellular component=cytoplasm; Biological process =glutathione metabolic process
  Homolog annotation: Hit_ID=Q43621; Match level="QueryCoverage=79%, HitCoverage=25%, E-value=4e-59, Identity=88%"; Hit description =Glutathione reductase, cytosolic
  Pfam annotation: Domain name=Pyr_redox_dim; Domain location=31-133; Score=107.1; E_value=5e-29; Accession=PF02852.12; Description =Pyridine nucleotide-disulphide oxidored
MNLTPVALMEASYFAKTVFGGQTIKPDYSNIPYAVFSIPPLSVVGLSEEQAIEQTNGDLLVFTSTFNPMKNTISGRQEKTVMKLVVDAETDKVLGASMCGPDAPEIMQGIAVALKCGATKAQFDSTAVMGYFYWKGNDIMTSGIGFTYLKYLLKNVNI

SEQ ID NO: 151501 - protein, 236 aa, Glycine max
  Coding DNA Sequence Number=SeqID_34723
  Gene Ontology: Mol. function=glutathione-disulfide reductase activity; Cellular component=cytoplasm; Biological process =glutathione metabolic process
  Homolog annotation: Hit_ID=Q43621; Match level="QueryCoverage=46%, HitCoverage=23%, E-value=2e-47, Identity=84%"; Hit description =Glutathione reductase, cytosolic
  Pfam annotation: Domain name=Pyr_redox; Domain location=59-146; Score= 89.2; E_value=1.2e-23; Accession=PF00070.17; Description=Pyridine nucleotide-disulphide oxidor
MVLEPIIDPLLGHLHLARSRLEVLGVSGSVGKAALVAASLGELGITSDEALSLEDLPKHAVVLGGGYIAVEFASIWRGMGSTVDLVFRKELPLRGFDDEMRAAVARNLEGRGINLHPRTNLTQDGIKVITDHGEELIADAVLFATGTNMNAIYNSLFVGYLKCNLEGAGLVAGSHGHDWECWNSHLNCEHPLARYSCGLFVGCLKRNLKGGGRAPNSKRLNLETVGVELDNTGAIK

SEQ ID NO: 151502 - protein, 254 aa, Glycine max
  Coding DNA Sequence Number=SeqID_34724
  Gene Ontology: Mol. function=transferase activity, transferring nitrogenous groups; Cellular component=chloroplast; Biological process=amino acid biosynthetic process
  Homolog annotation: Hit_ID=Q9FEW2; Match level="QueryCoverage=79%, HitCoverage=49%, E-value=3e-95, Identity=85%"; Hit description =Histidinol-phosphate aminotransferase, chloroplast precursor
  Pfam annotation: Domain name=Aminotran_1_2; Domain location=24-253; Score=-42.9; E_value=3.2e-05; Accession=PF00155.11; Description =Aminotransferase class I and II
MLVINKRRGFLLQVLSARLGRKPEDIVKLDANENPYGPPPEVMEALGSMQFPYVYPDPESRRLRAALAHDSGLEAEYILAGCGADELIDLIMRLEPIPYIVDCPPTFTMYEFDAAVNGALVIKVPRRPDFSLNVEQIAEVVKQEKPKCIFLTSPNNPDGSIIDDEVLLKILELPILVILDEAYIEFSAIESRMSWVKKHDNLIVLRTFSKRAVLTKQALSSEKLGCLVIVEIMEFLGIKGGREIKENETEIDIN

SEQ ID NO: 151503 - protein, 157 aa, Glycine max
  Coding DNA Sequence Number=SeqID_34725
  Gene Ontology: Mol. function=glutathione-disulfide reductase activity; Cellular component=cytoplasm; Biological process =glutathione metabolic process
  Homolog annotation: Hit_ID=Q072J9; Match level="QueryCoverage=57%, HitCoverage=18%, E-value=3e-34, Identity=81%"; Hit description =Glutathione reductase
MARKMLIDGEAELAQGGGEEVSNFDFDLFIIGAGSGGVRAARFSSNFGAKVGICELPFHPISSETIGGVGGTCVIRGCVPKKILVYGASFGVLNPSMCWDRVMLLACLGVLPETTTELPSLICKGTQKPCCIPTFLLRYSDLKDTLALPHCLYLFSI

SEQ ID NO: 151504 - protein, 188 aa, Glycine max
  Coding DNA Sequence Number=SeqID_34726
  Gene Ontology: Mol. function=transferase activity, transferring nitrogenous groups; Cellular component=chloroplast; Biological process=histidine biosynthetic process
  Homolog annotation: Hit_ID=Q9FEW2; Match level="QueryCoverage=74%, HitCoverage=33%, E-value=7e-60, Identity=80%"; Hit description =Histidinol-phosphate aminotransferase, chloroplast precursor
MVRLAEACMAEIYGHTSQKLTAGSCVAPEICMQRRSELDRNSAGNYLKHVGLAGLRVGYGAFPLSIIEYLWRAKQPYNVSVAAEISACAALQNPTYLENVKNALLKERGRLYDLLKEVPFLRPFPSHSNFILCEVTSGKDAKKLKEDLAQMGVMIRHYDKKELKGYVRVTVGKPEQTDTLMKCLKRLS

SEQ ID NO: 151505 - protein, 159 aa, Glycine max
  Coding DNA Sequence Number=SeqID_34727
MDTEEFSFPRISDTCAHNIDSPPLWNLSPAASPNPYYQGNKRGENECFGAKLVAAEVHRKSFSCVENSRKRFGLEEDEDRMDMLWEDFNEELYSTTTTVSATSSSRELRYAPALTVAKTNNSSLFPTKNNKPSMVVIVRVMRKLFSINNSQGNSGSWND

SEQ ID NO: 151506 - protein, 96 aa, Glycine max
  Coding DNA Sequence Number=SeqID_34728
MELQRKIKEKSVGVVIGEVKAKEVDLGGVDFRFGERNITTVGKANSTFAARYDVGEAKVNGVVSRNDASNKEKKFSSLSMEKKKKLLIIKKGKIGQ

SEQ ID NO: 151507 - protein, 105 aa, Glycine max
  Coding DNA Sequence Number=SeqID_34729
  Gene Ontology: Mol. function=transferase activity, transferring nitrogenous groups; Cellular component=chloroplast; Biological process=amino acid biosynthetic process
  Homolog annotation: Hit_ID=Q9FEW2; Match level="QueryCoverage=80%, HitCoverage=17%, E-value=3e-14, Identity=47%"; Hit description =Histidinol-phosphate aminotransferase, chloroplast precursor
MAPGGRASSSATEEKNELSLMGVIDFYNTGALCWVKSNANLKQQVGLAPRPICSFEGNNQRKFVAMASTVPVEQVNNGPLQVTGDSFIREHLRKLAPYQPILPFE

SEQ ID NO: 151508 - protein, 53 aa, Glycine max
  Coding DNA Sequence Number=SeqID_34730
MQNLKGSKRKCKFDLKFPLEAGDRIDPFRNFSVNKIYESKKEMLKQRSTAQKT

SEQ ID NO: 151509 - protein, 802 aa, Glycine max
  Coding DNA Sequence Number=SeqID_34731
  Gene Ontology: Mol. function=transition metal ion binding
  Homolog annotation: Hit_ID=Q2QMA1; Match level="QueryCoverage=54%, HitCoverage=72%, E-value=4e-19, Identity=22%"; Hit description=WPP domain associated protein, putative, expressed
MDGIFECIDGRFEVSLADSTMMWIVHYAMNKAQEKMKEKTGVIERLNEISKFYELAVMQLEGCLSIVHAETESSFLESSHEEVLNDLRDIKDRLQWRLKESELAIVEKDKELAQRLENELQLRHSLELKERQLVSLGVSHGIEISNLKAENDETTRNEHGVGNGEGGFCELSTSENQQKLEPQHDMSSEVQNNGIVGRKKVEEMGSDIDILKQTMDLAFGKMQSALFRCEMRSKEREWKLTIEKDVMSISIGSFMRDFQENIEAKVKRDENQVVKVWKDHWPRLMNEFTNLQLEFATFHDTYPEDSDCSSLSSPSKPSSPTKPSSPEGSHEMPNRFSQKMEETDKPPEEEENEDGSSKYVAKLIKNHESIIRRKSEELNLSKHGISQERKASYVRRRKELNRVRERIHVVVEKLDSFIRRNAKLIESLFNQRAIHNAEPFPGRKLSEVDEIHTIKDVESHRSAEKQAVIDIRANQEFALIKGNDGEAEESCLQCLTCSNQEDVCMVVFKAMVKEWKLELDNYYMENYIRENINQVFLAETLNDAFLLFMEAKSMVQDNTIEDSCSTSTMMLNQVRKVHGEENLTIILLESLLSCFEAEENLMLSAKCEIKEQCRELDLGSERGDLHEHEIFEDLITAEEQTFSSLTSKVENVLQQLGISKALLRELGTNLGHSLRDSESFHNKKSANEEGQLRLSSSAFMPLLNLLLTFAEFGSMICQKFEMMAVRLAKMKCCLDPVIELVGCLRSKQSLYQKAFFKRCQNLQKAEAEVDLLGDQVDSLLTLLEKIYVTLHQHAPALQQYFE

SEQ ID NO: 151510 - protein, 289 aa, Glycine max
  Coding DNA Sequence Number=SeqID_34732
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=99%, HitCoverage=54%, E-value=2e-55, Identity=35%"; Hit description =Leucine Rich Repeat family protein, expressed
  Pfam annotation: Domain name=LRR_1; Domain location=109-131; Score =14.0; E_value=0.53; Accession=PF00560.23; Description=Leucine Rich Repeat
  Pfam annotation: Domain name=LRR_1; Domain location=133-155; Score =14.8; E_value=0.3; Accession=PF00560.23; Description=Leucine Rich Repeat
  Pfam annotation: Domain name=LRR_1; Domain location=157-179; Score =3.7; E_value=58; Accession=PF00560.23; Description=Leucine Rich Repeat
  Pfam annotation: Domain name=LRR_1; Domain location=181-203; Score =12.4; E_value=1.3; Accession=PF00560.23; Description=Leucine Rich Repeat
  Pfam annotation: Domain name=LRR_1; Domain location=205-227; Score =19.7; E_value=0.01; Accession=PF00560.23; Description=Leucine Rich Repeat
  Pfam annotation: Domain name=LRR_1; Domain location=251-274; Score =16.6; E_value=0.093; Accession=PF00560.23; Description=Leucine Rich Repeat
  Pfam annotation: Domain name=LRR_1; Domain location=275-289; Score =1.1; E_value=1.8e+02; Accession=PF00560.23; Description=Leucine Rich Repeat
  Pfam annotation: Domain name=LRR_1; Domain location=59-81; Score =13.5; E_value=0.75; Accession=PF00560.23; Description=Leucine Rich Repeat
  Pfam annotation: Domain name=LRR_1; Domain location=86-107; Score =12.4; E_value=1.4; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=109-131::133 -155::157-179::181-203::205-227::251-274::275-289::59-81::86-107
MINLSKNLPPPVPWNASYPPCSWMGVDCDPTNSSVIGISLIRYSLSASDFLPLVCKIQTLEHFDVSNNRLSSVPDGFITECGKIKGLKKLNFSGNMLGGDLPSFHGFDALESLDMSFNNLEGSIGIQLDGLVSLKSLNLTFNNFSGSIPTKLGNSTVLEHLVLSVNHFGGKIPDELLSYENLTEVDFRANLLSGSIPSNIGKLSNLESLVLSSNNLTGEIPASLLNLTKLSRFAANQNNFIGPVPPGITNHLTSLDLSFNKLSGPIPEDLLSPSQLQAVDLSNNMLNGS

SEQ ID NO: 151511 - protein, 897 aa, Glycine max
  Coding DNA Sequence Number=SeqID_34733
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=91%, HitCoverage=86%, E-value=1e-166, Identity=41%"; Hit description =Leucine Rich Repeat family protein, expressed
  Pfam annotation: Domain name=LRRNT_2; Domain location=29-64; Score =15.4; E_value=0.021; Accession=PF08263.3; Description=Leucine rich repeat N-terminal domain
  Pfam annotation: Domain name=LRR_1; Domain location=121-142; Score =12.4; E_value=1.4; Accession=PF00560.23; Description=Leucine Rich Repeat
  Pfam annotation: Domain name=LRR_1; Domain location=144-166; Score =14.0; E_value=0.53; Accession=PF00560.23; Description=Leucine Rich Repeat
  Pfam annotation: Domain name=LRR_1; Domain location=168-190; Score =11.9; E_value=1.7; Accession=PF00560.23; Description=Leucine Rich Repeat
  Pfam annotation: Domain name=LRR_1; Domain location=192-214; Score =3.6; E_value=60; Accession=PF00560.23; Description=Leucine Rich Repeat
  Pfam annotation: Domain name=LRR_1; Domain location=216-238; Score =12.4; E_value=1.3; Accession=PF00560.23; Description=Leucine Rich Repeat
  Pfam annotation: Domain name=LRR_1; Domain location=240-262; Score =20.2; E_value=0.0074; Accession=PF00560.23; Description=Leucine Rich Repeat
  Pfam annotation: Domain name=LRR_1; Domain location=286-309; Score =17.2; E_value=0.059; Accession=PF00560.23; Description=Leucine Rich Repeat
  Pfam annotation: Domain name=LRR_1; Domain location=310-329; Score =9.7; E_value=4.4; Accession=PF00560.23; Description=Leucine Rich Repeat
  Pfam annotation: Domain name=LRR_1; Domain location=332-355; Score =10.8; E_value=2.7; Accession=PF00560.23; Description=Leucine Rich Repeat
  Pfam annotation: Domain name=LRR_1; Domain location=357-379; Score =18.2; E_value=0.03; Accession=PF00560.23; Description=Leucine Rich Repeat
  Pfam annotation: Domain name=LRR_1; Domain location=381-403; Score =14.2; E_value=0.48; Accession=PF00560.23; Description=Leucine Rich Repeat
  Pfam annotation: Domain name=LRR_1; Domain location=405-427; Score =8.0; E_value=9.3; Accession=PF00560.23; Description=Leucine Rich Repeat
  Pfam annotation: Domain name=LRR_1; Domain location=429-451; Score =14.7; E_value=0.34; Accession=PF00560.23; Description=Leucine Rich Repeat
  Pfam annotation: Domain name=LRR_1; Domain location=453-475; Score =15.4; E_value=0.21; Accession=PF00560.23; Description=Leucine Rich Repeat
  Pfam annotation: Domain name=LRR_1; Domain location=477-496; Score =4.7; E_value=38; Accession=PF00560.23; Description=Leucine Rich Repeat
  Pfam annotation: Domain name=LRR_1; Domain location=498-521; Score =3.8; E_value=57; Accession=PF00560.23; Description=Leucine Rich Repeat
  Pfam annotation: Domain name=LRR_1; Domain location=523-545; Score =21.5; E_value=0.003; Accession=PF00560.23; Description=Leucine Rich Repeat
  Pfam annotation: Domain name=LRR_1; Domain location=547-569; Score =8.1; E_value=8.8; Accession=PF00560.23; Description=Leucine Rich Repeat
  Pfam annotation: Domain name=LRR_1; Domain location=94-116; Score =13.5; E_value=0.75; Accession=PF00560.23; Description=Leucine Rich Repeat
  Pfam annotation: Domain name=Pkinase; Domain location=677-896; Score=- 103.2; E_value=0.021; Accession=PF00069.15; Description=Protein kinase domain
  Pfam annotation: Domain name=Pkinase_Tyr; Domain location=647-828; Score=-155.0; E_value=0.0058; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=29-64::121 -142::144-166::168-190::192-214::216-238::240-262::286-309::310 -329::332-355::357-379::381-403::405-427::429-451::453-475::477 -496::498-521::523-545::547-569:...
  Pfam module annotation: =:94-116::677-896::647-828
  Subcellular localization annotation: CTP_CleavageSite=77; ConfidenceScore=5.06e-01
MGRFEYIPTSFLSILFIFCFCPMVLSLLSQNQTKTMINLSKNLPPPVPWNASYPPCSWMGVDCDPTNSSIVGISLIRYSLSASDFLPLVCKIQTLEHFDVSNNRLSSVPDGFITECGKIKGLKKLNFSGNMLGGDLPSFHGFDALESLDMSFNNLEGSIGIQLDGLVSLKSLNLTSNNFGGSIPTKLGNSTVLEHLVLSVNQFGGKIPDELLSYENLTEVDFRANLLSGSIPSNIGKLSNLESLVLSSNNLTGEIPASLFNLTKLSRFEANQNNFIGPVPPGITNHLTSLDLSFNNLSGPIPEDLLSPSQLQAVDLSNNMLNGSVPTNFSPNLFRLRFGSNHLSGNIPPGAFAAVPNLTYLELDNNDLTGTIPAELESCRKLALLNLAQNHLTGVLPPLLGNLTNLQVLKLQMNKLNGAIPIEIGQLHKLSILNLSWNSLGGSIPSEITNLSSLNFLNLQSNNLSGSIPTSIENLKFLIELQLGENQLSGVIPSMPWNLQASLNLSSNHLSGNIPSSFGTLGSLEVLDLSNNKLSGPIPKELTGMSSLTQLLLANNALLSGEIPKFSQHVEVVYSGTGLINNTSPDNPIANRPNTVSKKGISVHVTILIAIVAASFVFGIVIQLVVSRKNCWQPQFIQSNLLTPNAIHKSRIHFGKAMEAVADTSNVTLKTRFSTYYTAIMPSGSIYFIKKLDCSNKILPLGSHDKFGKELEVFAKLNNSNVMTPLAYVLSIDTAYILYEYISNGSLYDVLHGSMLDWGSRYSIAVGVAQGLSFLHGFASSPILLLDLSSKSIMLKSLKEPQVGDVELYHVINPLKSTGNFSEVVGSVGYIPPGTITRYSGQCFPILRELWGEAMLLIKWHEFPDCKNYWELMISLQLYVRRKGDELQVDRTQTHLL

SEQ ID NO: 151512 - protein, 259 aa, Glycine max
  Coding DNA Sequence Number=SeqID_34734
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=99%, HitCoverage=80%, E-value=6e-21, Identity=34%"; Hit description =Leucine Rich Repeat family protein, expressed
  Pfam annotation: Domain name=LRR_1; Domain location=138-160; Score =13.9; E_value=0.57; Accession=PF00560.23; Description=Leucine Rich Repeat
  Pfam annotation: Domain name=LRR_1; Domain location=162-184; Score =14.5; E_value=0.4; Accession=PF00560.23; Description=Leucine Rich Repeat
  Pfam annotation: Domain name=LRR_1; Domain location=208-230; Score =2.2; E_value=1.1e+02; Accession=PF00560.23; Description=Leucine Rich Repeat
  Pfam annotation: Domain name=LRR_1; Domain location=232-254; Score =17.3; E_value=0.057; Accession=PF00560.23; Description=Leucine Rich Repeat
  Pfam annotation: Domain name=LRR_1; Domain location=78-101; Score =10.3; E_value=3.4; Accession=PF00560.23; Description=Leucine Rich Repeat
  Pfam module annotation: Pfam domain module=LRR_1::LRR_1::LRR_1::LRR _1::LRR_1; Domain location=138-160::162-184::208-230::232-254::78-101
MAGNVYSFGVILLELITGKTAVTEGMEFLKWVLRNPTDQDYILDFNIPRSKTNNEERATYAAKCYMKRPLILITVSPSLFKLRFGSNELSRNIPSGNWNHLTGVLPPLLGNLANLQVLKLQMNKHNGAIPIEIGQLHKLSILNLSCNSLGGSIPSEISSLSSLSLLNLQGNNLNGCIPTSIENLKLLIERQLGENQLSGVIPSMPWILQVSLNLSGNHISGYIPRIFDNLVSLEVLDLSNNKFSHSIPKELTEMSALTE

SEQ ID NO: 151513 - protein, 622 aa, Glycine max
  Coding DNA Sequence Number=SeqID_34735
  Gene Ontology: Mol. function=protein kinase activity; Cellular component=integral to membrane; Biological process=protein amino acid phosphorylation
  Homolog annotation: Hit_ID=Q2QWU6; Match level="QueryCoverage=99%, HitCoverage=83%, E-value=1e-145, Identity=43%"; Hit description =Leucine Rich Repeat family protein, expressed
  Pfam annotation: Domain name=LRR_1; Domain location=101-123; Score =14.7; E_value=0.34; Accession=PF00560.23; Description=Leucine Rich Repeat
  Pfam annotation: Domain name=LRR_1; Domain location=125-147; Score =14.9; E_value=0.3; Accession=PF00560.23; Description=Leucine Rich Repeat
  Pfam annotation: Domain name=LRR_1; Domain location=149-170; Score =3.9; E_value=54; Accession=PF00560.23; Description=Leucine Rich Repeat
  Pfam annotation: Domain name=LRR_1; Domain location=195-217; Score =20.2; E_value=0.0077; Accession=PF00560.23; Description=Leucine Rich Repeat
  Pfam annotation: Domain name=LRR_1; Domain location=219-241; Score =8.1; E_value=8.8; Accession=PF00560.23; Description=Leucine Rich Repeat
  Pfam annotation: Domain name=LRR_1; Domain location=29-51; Score=5.1; E_value=32; Accession=PF00560.23; Description=Leucine Rich Repeat
  Pfam annotation: Domain name=LRR_1; Domain location=4-27; Score=1.3; E_value=1.7e+02; Accession=PF00560.23; Description=Leucine Rich Repeat
  Pfam annotation: Domain name=LRR_1; Domain location=53-75; Score =14.2; E_value=0.48; Accession=PF00560.23; Description=Leucine Rich Repeat
  Pfam annotation: Domain name=LRR_1; Domain location=77-99; Score=9.2; E_value=5.3; Accession=PF00560.23; Description=Leucine Rich Repeat
  Pfam annotation: Domain name=Pkinase; Domain location=354-618; Score=- 15.9; E_value=1.3e-07; Accession=PF00069.15; Description=Protein kinase domain
  Pfam annotation: Domain name=Pkinase_Tyr; Domain location=354-618; Score=-63.7; E_value=1.5e-08; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=101-123::125-147::149-170::195-217::219-241::29-51::4 -27::53-75::77-99::354-618::354-618
FSPNLFRVKVWEQHLSGNIPPGAFAAVPNKTYLELDNNDLTGTIPAELDSCRKLALLNLAQNHLTGVLPPLLGNLTNLQVLRLQMNELNGTIPIEIGQLHKLSILNLSWNSLGGSIPSEITNLSNLNFLNMQSNNLSGSIPTSIENLKLLIELQLGENQLSGVIPIMPRSLQASLNLSSNHLSGNIPSSFDILDGLEVLDLSNNKLSGPIPKELTGMSSLTQLLLANNALLSGEIPKFSQHVEVVYSGTGLINNTSPDNPIANRPNTVSKKGISVAVAVLIAIVAAIVLVGLVTLLVVSVSRHYYRVNDEHLPSREDHQHPQVIESKLLTPNGIHRSSIDFSKAMEVVAEASNITLKTRFSTYYKAIMPSGSMYFVKKLNWSDKILSVGSHDKFVKELEVLAKLNNSNVMTPLGYVLSTDTAYILYEFMSNGSLFDVLHGSMENSLDWASRYSIAVGVAQGLSFLHGFTSSPILLLDLSSKSIMLKSLKEPLVGDIEHYKVIDPSKSTGNFSAVAGSVGYIPPEYAYTMTVTMAGNVYSFGVILLELLTGKPAVTEGTELVKWVVRNSTNQDYILDFNVSRTSQAVRNQMLAILEIARVCVSTSPESRPKMKSVLRMLLNAR

SEQ ID NO: 151514 - protein, 313 aa, Glycine max
  Coding DNA Sequence Number=SeqID_34736
  Gene Ontology: Mol. function=5'-3' exonuclease activity; Cellular component=intracellular; Biological process=DNA replication
  Homolog annotation: Hit_ID=Q5N8X0; Match level="QueryCoverage=82%, HitCoverage=69%, E-value=6e-92, Identity=66%"; Hit description =Putative DNA polymerase I 3'-5' exo domain
  Pfam annotation: Domain name=5_3_exonuc_N; Domain location=65-231; Score=14.9; E_value=2.3e-10; Accession=PF02739.7; Description=5'-3' exonuclease, N-terminal resolvase-like domain
  Subcellular localization annotation: CTP_CleavageSite=22; ConfidenceScore=5.38e-01
MSLLAGAYVQPRFPCNYNPTLSASCRTQKTATSLTVTTPKKTEKALFTESFDQTRDAQPLPEKKKRVFFLDVNPLCYEGSKPSLHSLGRWLSLFLEQVSHTDPVIAVIDGERGSEHRRKLLPSYKAHRRKFTRHISSLQRFSSGHVGRSLQVINDVLGKCNVPVIKVDGHEADDVVATLAGQVLNKGFRVVIASPDKDFKQLISDDVQIVMPLPELQRWSFYTLRHYRDQYNCDPESDLSLSECDEVDGVPGIQHLVPSFGRKTALKLIKKHGSLETLLNAAAIRTVGRPYAQDALKNHADYLRRNYEVLALK

SEQ ID NO: 151515 - protein, 720 aa, Glycine max
  Coding DNA Sequence Number=SeqID_34737
  Homolog annotation: Hit_ID=Q53P84; Match level="QueryCoverage=63%, HitCoverage=39%, E-value=9e-49, Identity=31%"; Hit description=FHA domain, putative
QDVRNKHAYSISPTPHQIESVNLSMPQEVVLNIMNEDQTQHSDMENLESCIKAMEKTSTNIWSRRGKATSAPQVRTSKSILKNAANVEVAMSNEKDIRNRTISKNLSSVLDGEVEEDDEEIYTPDKENISPNTLHLRFLKKGKIEGIKHSKSQRSRHILRDTFNCDIYPNESIDPTLCNMNKKDLFSVLDGEVKEKEIFIPEEENLNPNALQLRLLKKKGKVEEIKRSKSRRSPLSKGTFNPDMYPNENIGSTLCNINQKDSINRTISRDLFSDLEGEEEEEIFTPDKENFSPNTLHLRLLKKKGKVEEIKHSKSQRSPLSKGTFNPDMYPNESIGPSLRRMNQKDVINKTISKDLLSDLDGEEEEEEIFTPDKENFSPNTLRLQLLKKKDNFCPNLYPDENIIPTSNEENQTLKGVQDQKLQRNPFSSHIKFAQEQDLKDRVERIPFQSLRNSGDKRRSGTCCPVSASKSLHFSNCGQILDQRFNPSDISGVPKKRSWDMIVDTTSLVNKESRKALQLLQGLKGTRVVVSNKPSYHYAMSVIRELDRMKQQFTIFRRISESSLALEWIEECMVKSNWWIHIQSSVDEGRLIAPTPPASPLTQFSEESWTSLSTQKFSMEIASPTVEDHILDFALLYRRNQNDGQLILLSEDVTLKIKCMAEGLLCEPVQEFRESLVNPFSERFLWDKSIPRGQTWSCQDDVVLREKFCRLRKPSKGVAS

SEQ ID NO: 151516 - protein, 330 aa, Glycine max
  Coding DNA Sequence Number=SeqID_34738
  Homolog annotation: Hit_ID=Q53P84; Match level="QueryCoverage=40%, HitCoverage=12%, E-value=2e-27, Identity=43%"; Hit description=FHA domain, putative
  Pfam annotation: Domain name=FHA; Domain location=52-120; Score=52.9; E_value=1.1e-12; Accession=PF00498.16; Description=FHA domain
MGLENQSKAEEEKEGEIPVLTVLKNNTVLKNIFIVNKPTDQKQSSADHVNVLLVGRHPDCDLMLTHPSISRFHLQIRSNPSSRTFSLLDLSSVHGTWVSGRRIEPMVSVEMKEGETLRVGVSSRVYRLHWIPVSRAYDLENPFVAQLDSVAEEEEEEKEEEEEMQNLSCCPAEMEEIESMDSIVEDISSLFLDENVELTVKEEIPLEPWMLEDMISLCCEEERKSPSKEEAIEIPSDPFGTETSYLPTISDGENNLCDSVSQVLSPTYVESLVECDDTLTENLSDTSCLPAVEAVLETKMLQFHTPPDIFTSPLPSGHENLFEKHYSSLP

SEQ ID NO: 151517 - protein, 96 aa, Glycine max
  Coding DNA Sequence Number=SeqID_34739
MHSRSMCWNVSRNVLGPFIITGLGLDNRSSGTTIGLYTKGKKVGMEVHFVVRLFCWAEKVFPLRSFCSGRGSDPLLYLLIELVFRFNKTLSFVPIS

SEQ ID NO: 151518 - protein, 72 aa, Glycine max
  Coding DNA Sequence Number=SeqID_34740
MGLRVVNKGQLGPFWPVINGTSLWVGLPRPAFGPSGLQAKRDRPKWFMDLKFQPNPTFLENRPAQPVRPDSI

SEQ ID NO: 151519 - protein, 470 aa, Glycine max
  Coding DNA Sequence Number=SeqID_34741
  Gene Ontology: Mol. function=transcription factor activity; Cellular component=nucleus; Biological process=regulation of transcription, DNA-dependent
  Homolog annotation: Hit_ID=Q2R3Q8; Match level="QueryCoverage=82%, HitCoverage=48%, E-value=9e-52, Identity=35%"; Hit description=GRAS family transcription factor containing protein
  Pfam annotation: Domain name=GRAS; Domain location=65-363; Score =253.3; E_value=4.9e-73; Accession=PF03514.5; Description=GRAS family transcription factor
MEDSEEEELLNLTLSVDAGRKRRKKGRTRDSNNNNSNTNSVIIPIKSNEGMIFRLLQMRELMLRQDHRIRKGVVEDGINNNKNGLPLIHLLLSTATAVDDQRNYCAALENLIDLYQTVSLTGDSVQRVVAYFADGLAARLLTKKSPFYDMLMEEPTSEEEFLAFTDLYRVSPYYQFAHFTANQAILEAYEEEEERNNKALHVIDFDVSYGFQWPSLIQSLSEKATSGNRISLRITGFGNNLKELQETEARLVSFSKGFGNHLVFEFQGLLRGSSRVFNLRKKKNETVAVNLVSYLNTSSCFMKASDTLGFVHSLSPSIVVLVKQEGSRSLKTFLSRFTESLHYFAAMFDSLDDCLPLESTERLKIEKKVLGKEIKSMLNYDMDGVDYCPKYERMETWKGRMENHGFVGRKISSKCVIQAKLLLKMRTHYYPLQFEEEGGGGFRVSERDEGRVISLGWQNRFLLTVSSWQP

SEQ ID NO: 151520 - protein, 98 aa, Glycine max
  Coding DNA Sequence Number=SeqID_34742
  Gene Ontology: Mol. function=transporter activity; Cellular component= integral to membrane; Biological process=transport
  Homolog annotation: Hit_ID=Q39822; Match level="QueryCoverage=90%, HitCoverage=31%, E-value=9e-44, Identity=95%"; Hit description=Pip1 protein
  Pfam annotation: Domain name=MIP; Domain location=1-77; Score=-86.8; E_value=0.00039; Accession=PF00230.10; Description=Major intrinsic protein
MRLTWGMPHLPLVLAPLPIGFAVFMVHLATIPVTGTGINPARSLGAAVMYNQQKAWDDHWIFWVGPFIGAAIAAFYHQFILRAGAAKALGSFRSNPAI

SEQ ID NO: 151521 - protein, 298 aa, Glycine max
  Coding DNA Sequence Number=SeqID_34743
  Gene Ontology: Mol. function=nucleic acid binding; Cellular component= endoplasmic reticulum membrane; Biological process=DNA integration
  Homolog annotation: Hit_ID=Q1RSG2; Match level="QueryCoverage=56%, HitCoverage=16%, E-value=3e-62, Identity=59%"; Hit description =Integrase, catalytic region; Zinc finger, CCHC-type
  Pfam annotation: Domain name=DUF239; Domain location=120-254; Score= -2.7; E_value=1.7e-08; Accession=PF03080.5; Description=Arabidopsis proteins of unknown function
  Pfam module annotation: Pfam domain module=DUF239::RVT_2; Domain location=120-254::1-197
MDNEIRAIKKNDTWELVGLPTNKRSIGVKWVHKTKYNPKGEIDRFKARLVAKGYKQKPGIDYFEVFVHVARRCIKQLAEYVIEGKEDKVYRLKKTLYGLKQAPKARCPYEHTLYVKSIDHGDILIVRLYVDDLIFTGNNSKLIVEFKEAMISCFEMTNLGLMSYFFGIEDSVSGHWWLHVEGSDGSEDVGYWPKEIFTHLRKGSSLIKFGGEAYGPPNIGSPPMGTGKLPKTSFPNSGFFARLQIVDSKFRELDVNPIDMKSYCDTSSDCYDLLYHGDQGAQFRQAFLFGGPGGQCGV

SEQ ID NO: 151522 - protein, 128 aa, Glycine max
  Coding DNA Sequence Number=SeqID_34744
  Gene Ontology: Mol. function=nucleic acid binding; Biological process= DNA integration
  Homolog annotation: Hit_ID=Q1RSG2; Match level="QueryCoverage=95%, HitCoverage=11%, E-value=5e-36, Identity=53%"; Hit description =Integrase, catalytic region; Zinc finger, CCHC-type
MDIVRYMLKAKKMPKKFWAEVVATIVYTLNRCPTKTYAHVPDQLRKKLDDKGEKCIFIGHNTKSKAYKLYNPETEFDYKQRHEVDEKDMWDWSLKSQQESVVIVDNHEENDERLLDPTPDKPESSKRP

SEQ ID NO: 151523 - protein, 193 aa, Glycine max
  Coding DNA Sequence Number=SeqID_34745
  Gene Ontology: Mol. function=cholestenol delta-isomerase activity; Cellular component=endoplasmic reticulum; Biological process=sterol metabolic process
  Homolog annotation: Hit_ID=Q8LDC3; Match level="QueryCoverage=76%, HitCoverage=56%, E-value=1e-35, Identity=52%"; Hit description=C-8,7 sterol isomerase
  Pfam annotation: Domain name=EBP; Domain location=26-191; Score=28.0; E_value=6e-09; Accession=PF05241.2; Description=Emopamil binding protein
MEGSRVSESEGHPYVPRDLHLPGYVPCFLSVSNILSVYVFSSLLLLSLVWIFSGNVLEVPANNHTTIKLLTLIPKGRLMKTTVDRLLMCWLAFTGLTHTIIEGYFVFSPEFFKDRNGFYLAEVWKEYSKADSRYAGRNAAVVGFEGPTAVFVGPACLLAVKFPLDCNTLNRCHPLLEEDLCSILSSRRPEKEA

SEQ ID NO: 151524 - protein, 221 aa, Glycine max
  Coding DNA Sequence Number=SeqID_34746
  Gene Ontology: Mol. function=cholestenol delta-isomerase activity; Cellular component=endoplasmic reticulum; Biological process=sterol metabolic process
  Homolog annotation: Hit_ID=Q8LDC3; Match level="QueryCoverage=97%, HitCoverage=96%, E-value=2e-76, Identity=63%"; Hit description=C-8,7 sterol isomerase
  Pfam annotation: Domain name=EBP; Domain location=18-215; Score =266.2; E_value=6.5e-77; Accession=PF05241.2; Description=Emopamil binding protein
MEAHPYVPRDLHLPGYAPCFLSMSNILSVFASSSLLIVTLVWIFSGIEEDSFTLVIWVIKVCIKDQCLTHIILEGYFVFSPEFFKDKTGFYLAEVWKEYSKGDSRYAGRDAGVVTVEGITAVLEGPASLLAVYAIATGKSYSYILQFAISLGQLYGTAVYYITAILEGDNFSTNSFYYYAYYIGANASWIVIPLIIAIRCWRKICAAFRVQGGQTKKPKVR

SEQ ID NO: 151525 - protein, 117 aa, Glycine max
  Coding DNA Sequence Number=SeqID_34747
MDSILDHLTALTINPPSPKSLVIPSSSEPSKPHMKLDVPHFDGQDPLKYQTPMSHEYGLILIKLRSHTFLVELSLTEQRALRAIFALSATRADKANSLQDSSYSLSELMPPLADESR

SEQ ID NO: 151526 - protein, 108 aa, Glycine max
  Coding DNA Sequence Number=SeqID_34748
MVGGVWGRGCHHLHLSLHHNLSICLDNIFIFCSREEPDELTSTYLMNPRGSPVTHAIDLVIFFELLYLVAQFLWKVTMSYSYYYVKILFHSSEASTREQVEKQPCRAA

SEQ ID NO: 151527 - protein, 260 aa, Glycine max
  Coding DNA Sequence Number=SeqID_34749
  Gene Ontology: Mol. function=cholestenol delta-isomerase activity; Cellular component=endoplasmic reticulum; Biological process=sterol metabolic process
  Homolog annotation: Hit_ID=Q8LDC3; Match level="QueryCoverage=81%, HitCoverage=96%, E-value=1e-80, Identity=65%"; Hit description=C-8,7 sterol isomerase
  Pfam annotation: Domain name=EBP; Domain location=59-254; Score =280.9; E_value=2.4e-81; Accession=PF05241.2; Description=Emopamil binding protein
  Subcellular localization annotation: CTP_CleavageSite=32; ConfidenceScore=5.25e-01
MSSLQLSSQHWAALDTTTTTLSFSSSPLQKKKKMEGSHSQVSKGHPYVPRDLHLPGYVPCFLSVSNILSIYVFSSLLIVALVWIFSGRLKKTKVDRVLMCWWVFTGLTHMIIGGYYVFSPEFFKDKSGFYMAEVWKEYSKADSRYAGRNAVVVTFESLTAVLVGPPCLLAVYAIATGKTYSYILQFAISLGQLYGSAFYYITAILEGDNFSVNSFYYYAYYIGANASWIVIPSIVGIRCWGKICAAFRIQGGQTKKPKVR

SEQ ID NO: 151528 - protein, 252 aa, Glycine max
  Coding DNA Sequence Number=SeqID_34750
MRRRRRRKECWTWKGSRERSRTLSVFDRRDLLGAPSNIADSAEEVLLQQCMEEPFSAIDINNCGRTFFRALSRKKFFCGISWKNLLPCIAAEEPSSVVNITTVEEGFSMHCCGTSSSVGSHGRTFFHALPFFCGISWKNLLPCITAKEPSSIVNVTTAEEGSSMRSRGRSSSAGSHGRTFFRALPRKNLLPNARKNLRLLPRATNETQMSSNLRLAYTAEGNKNATKNLRGGSVEKKWTLEERKETHGGEEI

SEQ ID NO: 151529 - protein, 196 aa, Glycine max
  Coding DNA Sequence Number=SeqID_34751
  Gene Ontology: Mol. function=ubiquitin thiolesterase activity; Cellular component=intracellular; Biological process=ubiquitin -dependent protein catabolic process
  Homolog annotation: Hit_ID=Q84JS7; Match level="QueryCoverage=81%, HitCoverage=35%, E-value=4e-20, Identity=34%"; Hit description =Putative carboxyl-terminal peptidase
  Pfam annotation: Domain name=DUF239; Domain location=71-195; Score =20.8; E_value=2.3e-10; Accession=PF03080.5; Description=Arabidopsis proteins of unknown function
MQTRLPFMEKTFQIHNSNKGCPSGKVPIRMLKLRQEINYNFSESQPENFRQYSRNPYQHFATLETTPSTTYHGASAWISASDNLLVQGTQYSLSQIWLQNGPLSELNSIQVGVGVNPRVYGDDKPHLASFWTGDNFKKTGCFDAICPGFVQVHPRITLGQTIEPSFTGGLDGKDYIAIKVTQVNIGNKNVFSFYRD

SEQ ID NO: 151530 - protein, 388 aa, Glycine max
  Coding DNA Sequence Number=SeqID_34752
  Gene Ontology: Mol. function=transcriptional repressor activity; Cellular component=integral to membrane; Biological process=transport
  Homolog annotation: Hit_ID=Q1SCZ1; Match level="QueryCoverage=86%, HitCoverage=49%, E-value=1e-136, Identity=77%"; Hit description =Prefoldin
  Pfam annotation: Domain name=CASP_C; Domain location=209-388; Score =154.1; E_value=3.8e-43; Accession=PF08172.3; Description=CASP C terminal
MFFPPVGASWFFMIFCNIKWNESCLKLLSADAFPCSIRLAVYCSDTSVSMQGVLRNQLQTANEETETKNSDNFDSNSALENSLNAKEKQISDLNMELHNIETALSNERDQHINEVKKLTAMLNEKEAALEEMKKELKARPTEKMVDDLRKKVKILQAVGYNSIEAEDWEVATSGEEMSKMESLLLDKNRKMEHELTQLKVTLSEKTSILETAEQKIAELTAKSNEQQKLIQKLEDDILKGYSSNSKDRKGNFLDDWDLSEAGGGEVSENTDQRQVSLDQDQSSMLKVICNQRDRFRTRLRETEEEIRQLKEKIGVLTVELEKSKVDNVKLYGKIRYVQDYNHEKVVSRGSKKYAEDLESGFMSDVESKYKKIYEDDINPFAAFSKKVT

SEQ ID NO: 151531 - protein, 568 aa, Glycine max
  Coding DNA Sequence Number=SeqID_34753
  Gene Ontology: Mol. function=RNA-directed DNA polymerase activity; Cellular component=chromatin; Biological process=chromatin assembly or disassembly
  Pfam annotation: Domain name=rve; Domain location=451-568; Score =32.1; E_value=2e-06; Accession=PF00665.16; Description=Integrase core domain
  Pfam annotation: Domain name=zf-H2C2; Domain location=392-433; Score =14.3; E_value=0.0046; Accession=PF09337.1; Description=His(2)-Cys(2) zinc finger
  Pfam module annotation: Pfam domain module=rve::zf-H2C2; Domain location=451-568::392-433
MATIDELLDELGLASWFSKLDLRQGFHQISMAVADVAKTAFRTHQGHYEYKVMPFSLCNAPSTFQATMNEPLKPFLRRFVAVFFDDILVYSASLDDHVSHLRQVFDCLSHAQFFLKETKCVFAQYQLTFLGHIVSARGVASDPSKIDAMVQWPIPTNTHSLRGFLGLTGFYRKFVKGYASLAAPLTALLQKDNFLWTKASQTAFESLKRAMTQAHVLSLPDFSIPFILETDASGSAIGAVLQQRGHPLAFFSKALCPRMQQASTYVRELHAITTAVVQTPEQQSYLAKLLGYNYDIQYKSGKSNIVANALSRVPHPEASQYWLLSIPHFIFLDTLRQHFTTSAPFQAMLHQVTSDPSSHLEFALRDGLLFFNNRIWLEPDNPFVDTLIDEFHSTPIGGHLGFAKTLHRVQASFHWNTLSRDVKRFIRQCPTCQQVKYETKRPAGLLQPLPISSSPWQDLSLDFITGLPPSRGYTTILVVVDRFTKGAHFGALPDRYTAHKVALLFFDIVAKHHGFPRSLISDRDPIFVGHFWRDLFQLSGTKLCMSTSYHPQTDGQTEVLNRTLEQYL

SEQ ID NO: 151532 - protein, 255 aa, Glycine max
  Coding DNA Sequence Number=SeqID_34754
MAGWGDGVGERGLMDMWKKAEVEWVLKLHGEGSVVRDGGPEVFEPLDTKNYVRATDGQNMKINGGVGAKLVTGKGGAVADGDLQGVGRDSGELKAESIGGGGAGKGVETNLGKGGEGWERMGFAGWVFGSAQSKFALAGSLLWGEAAYVVAGGRGSGKVEGSRPVDGGRRNGACRQVYLPAAWRGRWPEGERWAGKLELPDNWEILKIHPMASVPSKPATSSLIWWRDEGGDTGGGVGAVPAWHPNRGTGRGESV

SEQ ID NO: 151533 - protein, 386 aa, Glycine max
  Coding DNA Sequence Number=SeqID_34755
  Gene Ontology: Mol. function=manganese ion binding; Cellular component=chloroplast; Biological process=isoprenoid biosynthetic process
  Homolog annotation: Hit_ID=Q8VXZ0; Match level="QueryCoverage=85%, HitCoverage=83%, E-value=1e-107, Identity=59%"; Hit description =Nudix hydrolase 20, chloroplast precursor
  Pfam annotation: Domain name=NUDIX; Domain location=204-341; Score =17.6; E_value=0.003; Accession=PF00293.18; Description=NUDIX domain
  Subcellular localization annotation: CTP_CleavageSite=89; ConfidenceScore=5.76e-01
MGTVCCCINKFATLSNIRSRPFFSSHFPSHHFPSTTTSINFSIASSSFSSATSSFTWDDVFRISESQSATQDRSRYLQGFSHKLQLCNRASEKQSEFLPFVIEDHVVGFIHNGFVEHLRDFGDVFVFPIDKNNGGPYGDFVSLHPTLKTADERTSAVGYVVERLGEEQIPGIRDELYPVTSSFGAPIFFSLERAAAPYFGIKAYGVHMNGYVEVDGQKHMWVGKRSDTKQTYPGMLDHLVAGGLPHGIDCQENLIKECEEEAGIPRSISVKAIPVGAISYMDIDGYRYKRDVEFCYDLKLPKSFLPKNEDGEVDSFKLIPVTQVAEVIRKTEFFKPNCSLVIIDFLFRHGYFSLCLLLSILFSLYITPEYLGYLDLLRNLRIGDCS

SEQ ID NO: 151534 - protein, 719 aa, Glycine max
  Coding DNA Sequence Number=SeqID_34756
  Gene Ontology: Mol. function=carboxylic ester hydrolase activity; Cellular component=extracellular space; Biological process=lipid metabolic process
  Homolog annotation: Hit_ID=Q1SD04; Match level="QueryCoverage=91%, HitCoverage=100%, E-value=0.0, Identity=70%"; Hit description =Esterase/lipase/thioesterase; AB-hydrolase associated lipase region
  Pfam annotation: Domain name=Abhydro_lipase; Domain location=305-368; Score=90.6; E_value=4.8e-24; Accession=PF04083.6; Description=ab -hydrolase associated lipase region
  Pfam annotation: Domain name=Abhydrolase_1; Domain location=382-689; Score=-10.4; E_value=0.051; Accession=PF00561.10; Description =alphabeta hydrolase fold
  Pfam module annotation: Pfam domain module=Abhydro_lipase::Abhydrolase _1; Domain location=305-368::382-689
NLSSDYRSVTDFKLPRPSASNLFVFHSDSILVIAKFLGFPHILDLEGFEEITELWKEKHNPMMQRVVDHVLGVAKESLKAITYESLNNIVRLINGVSALLLALLPGKANILEGIHGWELKPTFRGPRFPRWMENGVSSFNQFIHELSVDSDNSSLEYSSGEEDSDRFDCPPSPASQSSRTSEAGFAKYTMSITGNKRPSHLHAHKRVLSLKDHIIHRATDRRRGVVEDLHQGIELSIEAVFDVVHKAAHLLISPSEAFGTLFRLFSSHESGTKEDCDGVEDTPIYSATLGENDPTPTQRNVKYQPLNTDARTCQDVITDLGYPYEAIRVITADGYILLLERIPRRDSRKAVYLQHGVFDSSMGWVSNGVVGSPAFAAYDQGYDVFLGNFRGLVSREHVNKNISSRQYWRYSINEHGTEDIPAMIDKIHEVKTAELRLTKPDIEEETDDDQLYNLCAICHSLGGAGMMMYVITQRIEGKPHRLSRLVLLSPAGFHDDSNAVFSMAELLLVLLAPVLSLLVPAFYIPTRFFRMLVNKLARDLHNLPAVGGLVQTLMSYVVGGDSSNWVGVLGLPHYNTNDMPGVSFRVALHLAQMKRTGRFRMFDYGSASANMEVYGSPMPLDLGEHYGLIDIPVDLVAGQKDKVIRPSMVKKHYKLMKGAGVDVSYNEFEYAHLDFTFSHREELLSYVMSCLLLVDPNKKHQVNQRVVRSRRKGQVATSG

SEQ ID NO: 151535 - protein, 72 aa, Glycine max
  Coding DNA Sequence Number=SeqID_34757
MSVKIGDMMDEIDHKMCILLSGVWVFYGVLIILSIMWCSMLKFKEKRIKKEKERENLPSESAAIDSIQMYGA

SEQ ID NO: 151536 - protein, 290 aa, Glycine max
  Coding DNA Sequence Number=SeqID_34758
  Gene Ontology: Mol. function=transferase activity, transferring glycosyl groups; Biological process=response to oxidative stress
  Homolog annotation: Hit_ID=Q9M2R0; Match level="QueryCoverage=99%, HitCoverage=37%, E-value=2e-95, Identity=56%"; Hit description =Anthranilate phosphoribosyltransferase-like protein
  Pfam annotation: Domain name=PRT_C; Domain location=135-290; Score =285.5; E_value=1e-82; Accession=PF08372.1; Description=Plant phosphoribosyltransferase C-terminal
MGEIQLAVRFSGPSLLNVLQTYAQPLLPRMHYLSPSSIFQLDNLRNQAAAITTLRFKRAEPPLSKEVVEYMLDMGVNVWSMRRARAQFFRIASLLNVLVSVAKQFREIHAWKNSITTVVSYFMFLIVIFCPQIVLPSTFSFLLLAGIWGYRTRPRCPSHMDMRLSQADTASVEELEEEFDSFPSKFSGENLKRRYDRLRGVAGRVLEVMADLATQGERVQSLLSWRDPRATALFVIFCSVAVIVTYLVPFRILVFIWVTYMLRPPRFRFDIPAVPQNFLRRMPAKSDGLL

SEQ ID NO: 151537 - protein, 651 aa, Glycine max
  Coding DNA Sequence Number=SeqID_34759
  Gene Ontology: Mol. function=metal ion binding; Cellular component =nucleus; Biological process=regulation of flower development
  Homolog annotation: Hit_ID=Q2QPD5; Match level="QueryCoverage=97%, HitCoverage=87%, E-value=0.0, Identity=52%"; Hit description =Fibronectin type III domain containing protein, expressed
  Pfam annotation: Domain name=fn3; Domain location=257-347; Score =12.1; E_value=0.0097; Accession=PF00041.11; Description=Fibronectin type III domain
  Subcellular localization annotation: CTP_CleavageSite=28; ConfidenceScore=5.15e-01
MAETKSTSKIVKKQDSKKVSGLTNQPSRKQHRKGENPVRFVPAPDPPSDFGHSNSWICKNSACRAVLSKDDTFCRRCSCCICHLFDDNKDPSLWLVCTCESSQGDSCGLSCHIECALQHEKVGVVDHGQLMQLDGGYCCASCGKVTGILGCWKKQLNIAKDARRVDVLCYRIYLSYRLLDGTSKYKELHEMVKEAKAKLETEVGPVNGVSAKMARGIVSRLPIASDVQKLCSLAIEKADEWLATVPNVHPESREGSLPAACKVVFEEVTAFSVKIILIEMSNASSSVDIKGYKLWYYKSREESHTKDPVSVFPKAQRRILISNLQPCTEYTFRIVSFTDTSDLGHSEAKCFTKSIEILEKNSSSSVAMNKKKENLQTECNSSGSEMEPNPTMEDSGFKVRDLGKILHLSWAQEQGCFEEFCCADKRNCCGKSETIKPTNLQEQLPSVSRDLDLNVVSVPDLNEELTPLFESSRDEDNGCTLQQAVEADDDAASHDLEKNLAISHGSGGSQTWNHGPTGEVPAVDSRGDACRKRMASTNEETHDCDSTLINDSPLRASDGPFSLDENFEYCVKVIRWLECQGHIKQEFRLKLLTWFSLRSTEQERRVVNTFIQTLIDDPSSLAGQLVDSFSDIISNKRPRNGLSSNKAVSSS

SEQ ID NO: 151538 - protein, 442 aa, Glycine max
  Coding DNA Sequence Number=SeqID_34760
  Gene Ontology: Mol. function=transferase activity, transferring glycosyl groups; Biological process=response to oxidative stress
  Homolog annotation: Hit_ID=Q9LXU2; Match level="QueryCoverage=95%, HitCoverage=54%, E-value=1e-135, Identity=55%"; Hit description =Anthranilate phosphoribosyltransferase-like protein
  Pfam annotation: Domain name=C2; Domain location=223-305; Score=36.9; E_value=6.8e-08; Accession=PF00168.20; Description=C2 domain
  Pfam annotation: Domain name=C2; Domain location=384-442; Score=21.9; E_value=0.0023; Accession=PF00168.20; Description=C2 domain
  Pfam annotation: Domain name=C2; Domain location=54-142; Score=67.3; E_value=5e-17; Accession=PF00168.20; Description=C2 domain
  Pfam module annotation: Pfam domain module=C2::C2::C2; Domain location=223-305::384-442::54-142
MANQNQNQNQNQNQKKNKEDFSLKATTPNISAGRAISGDWLPTAFDLVEKMQFLFVRVVKAKDLPEKSESQPCNPFVEVNVGSFTGTTRCMEKTTTPEWNQVFAFAKERIQVLVLEIVVKNKGENGDPNDNGDLDEFVGRAAFTIGDVPMRVPPDSPLAPQWYKLENQNGVKLQGELMVSVWMGTQADEAFSEAWHSDASEASGENIAHTRSKVYISPRLWYLRINVIQAQDLLLKNKSGNNNSEIFIQGVLGNLALRSRSIKCSTSPSWNEDLMFVVAEPFDDCLFVSIEQGNNFKHESLAICAVPLKNVEQRIDATPPASVWYNLHKPKEKEGEEQEVNFSSKLNMRISLDGGYHVLDEATHYTSDVRPSSKYLCNPSIGVLELGILNAVGLSPMSKENRTNAFCVAKYGPKWVRTRTIVDSLSPKWNEQYTWEVFDPCT

SEQ ID NO: 151539 - protein, 394 aa, Glycine max
  Coding DNA Sequence Number=SeqID_34761
  Gene Ontology: Mol. function=RNA-directed DNA polymerase activity; Biological process=RNA-dependent DNA replication
  Homolog annotation: Hit_ID=Q1SWC8; Match level="QueryCoverage=71%, HitCoverage=50%, E-value=3e-13, Identity=40%"; Hit description=RNA -directed DNA polymerase
LVNGFVMGAFPPNVTDTTIVHIRKVDNPRGMKDLRSILCEMSYTRFYLKVLVIRMREVIDKCVSEEQFGFVPGRSIMDNALVLVEDVGGREIFHRMKENETLFIKYILDEYVVASSQLINLQMLEVMFSNNVDPNMNNLVISILGVTKGLGRGKYLGFLTGMENVKVNVLIDNPLDVWNVPLINHLFEPGDMQAFLRVPIVDVPRGDMRIWDHSSYGGYMMRSAYKLILPKLTNFDMLQIVSQPRPDFAPGEFIGLQFVLHASIMETTFHMFFSCLTNEVEYGQTQMLSYVALSIWRRRNDMLWEMIDVSDFSVVHHGDDLFHGWAKAKLKSSFSNVETGQASIAKWFPPPSRHVKCNIDIEELRLWTLRKEKHGSNNDYEVCHLPSFATHEVR

SEQ ID NO: 151540 - protein, 633 aa, Glycine max
  Coding DNA Sequence Number=SeqID_34762
  Gene Ontology: Biological process=regulation of GTPase activity
  Homolog annotation: Hit_ID=Q1SD19; Match level="QueryCoverage=99%, HitCoverage=94%, E-value=0.0, Identity=59%"; Hit description=Arf GTPase activating protein
  Pfam annotation: Domain name=Extensin_2; Domain location=277-591; Score=-141.6; E_value=0.091; Accession=PF04554.4; Description =Extensin-like region
MAKFTSQEVSALQEGGNQRAKEIYFKEWDALRHSFPDSRIHHSFILISMVGASNVDRLRNFIKHVYVDRRFTGDKTNDKPQRGKPGDKDDFYQGGSISPHYEDTYERRYSDRSSPGGRSPEYDKDSRQYGDHKRSPGRPPIINDWRREERRLSDGDYKLESQSPERAKDVDTSSPPVVRPVRDILGENVVPLRISEPPKTNSGRPADRSAPTQRTASSSSLASGNENPLDVKLETTKSLIDFDADPEPPVAPSIPQAQQTTVLQPVVQPANSSNDNWASFDVAPATKATPSSSNLSPLESMLSQLSVPASLPAQVSGVQGPIPASSLTSTSGAASVSGFSAFPPSNASVPSPGLTSVSPLNNAGQWANLQQQQPFFPVAVSQSSTQQFIPPLGGTANNQPWNVPSAPTVQGHPSTPMPHTYPHASKPANETISGVVSQPPVAEVRASGRKELPEDLFTVKYSSFPAPVLGWQMGVPHGMGISMQYNNVPVPSFPQPSKSTNPFDVSSEPTANQAPTFPSMSSLQGALPSVPPAGAVHPSSMGNPTHGWTPPPASSFLPAQAQMHATALGPMKISGAYMEQQIPTNMPMPRQEVGNFGNQGAVFGLSNPNQQLIGRLSNTPTSNSFPTGGNPFG

SEQ ID NO: 151541 - protein, 293 aa, Glycine max
  Coding DNA Sequence Number=SeqID_34763
MEIEAALCIPGREFILNAEGHPGKILRKDLTTLAQVWSVLSYSNLVPTSHTSDLTVDRARSRGVVSDNLAFECLSSVINLAYIRKNCWNPNDPTVIIRGTRRPRARPAEVPSTSVAPHPASTSAAPPPAHMTAAPYTLPLADFQRFEAMLRSIHQGQIILLQSLQLVAPLDSILTIEQFNEWVAWPGTQPPLHREDEDLAAQVPHQSEDESLESSTPEPLIRKRRVVVTQEAVATSEKSLEATSELLALVADTTSPQQAANPSTPEDQTTPDLSLNTSPVATHVLHLLEEEEG

SEQ ID NO: 151542 - protein, 57 aa, Glycine max
  Coding DNA Sequence Number=SeqID_34764
MVGGGQLKIYTSLSYNPLPPANSMTDWLADSAHNASLGVNAWASPPAGCSLNDTVIE

SEQ ID NO: 151543 - protein, 450 aa, Glycine max
  Coding DNA Sequence Number=SeqID_34765
  Gene Ontology: Mol. function=protein serine/threonine kinase activity
  Homolog annotation: Hit_ID=Q9FH45; Match level="QueryCoverage=77%, HitCoverage=57%, E-value=4e-32, Identity=26%"; Hit description =Arabidopsis thaliana genomic DNA, chromosome 5, TAC clone:K2N11
  Pfam annotation: Domain name=PH; Domain location=8-115; Score=33.4; E_ value=7.8e-07; Accession=PF00169.19; Description=PH domain
MAAPHSEGVMEGWLYIFASNRIGLHCSRKRYFILKESFLRSFKDKPVSLMKEPNRSAIIDSSVRVIDNGRETINKKVFFTFTVYNASNQIDQLKLGASSSEEAAKWIRLLKDAALKENSNSELNLVNTSKKKHSSLRMGGSKRTNWKHYVEWNFQSCIYTEAMISDVIAPSQWKIFSINNGLRMFKEARDWDSHGNKWGTHPVMMAVGVVDGTSEEIFHTLMSLGSSRSEWDFCTYQGSVVDHIDDHTDIIHVKLYNDWLPWGMKPRDFLLRRYWRREDNGTYGGGFLVTPINKGKQSLVKHMLAIDWKLWKLYLSSSSARFSTIRMLERVAALREFFKAKAGNCSSEPIEIAVDTKNEVTEENSKAVEGVLEGEVDGETSRRTSLMGLDDSDEFFDVSEPKNYDEFENEWHSAPLSEQHSQRLKWYLAVCKDKNRESSRGKKTKGLKEK

SEQ ID NO: 151544 - protein, 156 aa, Glycine max
  Coding DNA Sequence Number=SeqID_34766
  Gene Ontology: Mol. function=transferase activity
  Homolog annotation: Hit_ID=Q1SE38; Match level="QueryCoverage=72%, HitCoverage=25%, E-value=8e-22, Identity=44%"; Hit description =Transferase
MRFSAAEECGAFAAKRISKERKNMNIIETPGKKKSNGNDETKPTRYQVVSSFMCKHMIVACTKESCDTTSPMVALHFVDMRKRMGEPFSKGAIGNLLWPAMVLLEDVDKNTNIRDLVRVLEEGLGKLTKELFLKVQNDPRFLGSDECALMLEGIAT

SEQ ID NO: 151545 - protein, 105 aa, Glycine max
  Coding DNA Sequence Number=SeqID_34767
  Subcellular localization annotation: CTP_CleavageSite=25; ConfidenceScore=5.29e-01
MFGLSASLKSSTSFVQCRRSSLQVEVSTVVSSMRIFSSMARLGVADEIHGAKVVDGATDGLKKHGDEFVGRGEVAKVGPGKELEEEVVAIERCQQGQLGRGGCRQ

SEQ ID NO: 151546 - protein, 88 aa, Glycine max
  Coding DNA Sequence Number=SeqID_34768
MMIGRWAAQGPNNGCHNKLEVFKGWGGKKFQKAIHKVLNIGHGRHGHIVNICTCIGDKPSLEKPHNTHAVQENCGRSRKPFPKQHPTE

SEQ ID NO: 151547 - protein, 417 aa, Glycine max
  Coding DNA Sequence Number=SeqID_34769
  Gene Ontology: Mol. function=L-serine transporter activity; Cellular component=membrane; Biological process=transport
  Homolog annotation: Hit_ID=Q1SD20; Match level="QueryCoverage=99%, HitCoverage=100%, E-value=1e-162, Identity=66%"; Hit description=TMS membrane protein/tumour differentially expressed protein
  Pfam annotation: Domain name=Serinc; Domain location=10-412; Score =57.0; E_value=1.9e-19; Accession=PF03348.6; Description=Serine incorporator (Serinc)
METGENNSTSSSNQSCAVMKDSKWYTQFRNVSNPWMARYVYGLIFLVANLLAWAARDELSSLSALTEMKASILTYIEPAGLKGCKVGKNCLGADGVLRLFYMIMFWSTAGTSKLKEGRDEWHSGWWLVKIVVLVLVTIFPFLLPSELIDLYGQIAHFGAGVFLLIQLISIISFINWLTDCFGSEKYAERCQIQVMLFATISYFICLVGIILMYIWYAPQPSCLLNIFFITWTLVLLQLMTSVSLHPKVNAGILSPGLMGLYVVFLCWCAIRSEPEGAECIRKSESANKTDWQSIISFVVAILALVVATFSTGIDSKCFQVLQCISNKSLQFRKSDPPAEDDVPYGYGFFHFVFATGAMYFAMLLIGWNSHHSMRKWTIDVGWTSAWVRIVNEWLAVCVYLWMLVAPIIWKSRHADST

SEQ ID NO: 151548 - protein, 226 aa, Glycine max
  Coding DNA Sequence Number=SeqID_34770
  Gene Ontology: Mol. function=protein serine/threonine kinase activity
  Homolog annotation: Hit_ID=Q337P5; Match level="QueryCoverage=85%, HitCoverage=28%, E-value=7e-38, Identity=42%"; Hit description =Pleckstriny domain-containing protein, putative, expressed
  Pfam annotation: Domain name=DUF1336; Domain location=41-214; Score =207.2; E_value=3.9e-59; Accession=PF07059.3; Description=Protein of unknown function (DUF1336)
MEVQKKGYMDLQETSSRDNSEPCPYGATLQKDSSCNLPCSWDESDASLFYIRGKTYLKDKKKVKAERTLMQMVGADWIQSNSRQDDLCSRPGSIVQVPGSSLYSIGLYYMMKTPLEDNPLLHSFVHGDDAYRNSRFKLIPYIFKGPWIVKQSVGNKPSLLGKALDIRYIRGRNYLEVDINIGSSTVARGVVNLVLGYLNNLVVGMAFLIQITRDTGPISVEAHFEL

SEQ ID NO: 151549 - protein, 155 aa, Glycine max
  Coding DNA Sequence Number=SeqID_34771
MIDPGSHLMKLGRDIQILWCLGNVVVYYTEFDEFKEELERRHWDEKLTDFADNNIDIAIVKEFYANLYDPEDKSPKQVTVRGHLVKFDEDTLNTFLKTPIILEEGENLCTYSRFALLRPDPQELDAKLCIPGRGFELNADGQPLKILRKNMTTLA

SEQ ID NO: 151550 - protein, 113 aa, Glycine max
  Coding DNA Sequence Number=SeqID_34772
ERVVEDLPTAVEELNKEQQEAPVEEVVTDVEGFSGEPHDTSVMRDFEHHIALRVWNGEERPELKLSSHGRKMTKFGRPAPEIEGLMAASRRSPLIACSLDTGDRGLMSTFVEH

SEQ ID NO: 151551 - protein, 83 aa, Glycine max
  Coding DNA Sequence Number=SeqID_34773
  Gene Ontology: Mol. function=RNA-directed DNA polymerase activity; Biological process=RNA-dependent DNA replication
MNPPVLMPPVPRRPLILYMTILEESIWCMLGQHDESGKREQAVYYLSKKFTACEMNYSLLERTCCALAWASHRLRQYMMSVIP

SEQ ID NO: 151552 - protein, 153 aa, Glycine max
  Coding DNA Sequence Number=SeqID_34774
MDADSQLVYEMCRTWTQEFPQLTLVVNEALKTGRITPSNRFGSRLQPLAEATSARRAVHGLWWRVQTMPTNMSRNTRDFYSGKSPTRLSSSRPCWFQLWQQTRAGTPERSMNRSVTSKAPSRRFVASRSLLQCLGRKLRGLENEKRRMMEELK

SEQ ID NO: 151553 - protein, 111 aa, Glycine max
  Coding DNA Sequence Number=SeqID_34775
MNESCLSPACEEDEEQFIQFASKRSRPDENEKFFCPCINCLNGRRKKVNDIRDHLLCDGIQRNYTTWIWHGEMTDMQSGPQSEPFDVEMGDHLEDMIRDLGQECFQQAHAP

SEQ ID NO: 151554 - protein, 226 aa, Glycine max
  Coding DNA Sequence Number=SeqID_34776
MARMKETGQMTSEAAKEIAKRIVRFLGGAGLTGKLFRPWTSKCTDYCHWAIEHLGRVRAPGAGVTIKHYFGPASKGSCTSSSMATKDLEQLTQKIRDQLEMQSQGLALPLEAEVGPFTVRASTKESCVDPSGQDPKMGDSKKFRLYVNDSPSQLVALGRVYEGSTTIHNALNTFLAWPTHLVKPFSEQDKQEVEGPTKPIDMSDPDVDPSYLMTLTIPQLFLKSLH

SEQ ID NO: 151555 - protein, 75 aa, Glycine max
  Coding DNA Sequence Number=SeqID_34777
MLVFEGSEGSKEGSRTNLYTRTKIFSIVIQSTSFKGGFQELFHVFLIHRAYATCVRPTSIHLINNFVILTKFFDA

SEQ ID NO: 151556 - protein, 435 aa, Glycine max
  Coding DNA Sequence Number=SeqID_34778
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-62, Identity=33%"; Hit description= UPI00006A17C9 related cluster
TLGTSTLTFRGLHTLDFRGLHALAFRGLHVLAFRGLQVLAFRGLHVLTLRGLKGYTPSPSEDYTSSPSEGYTPSPSEDYTSSPSEGCMPSLSEGYMPLPSEDYTSSPSEGYTPSPSEGYMLSPSEGYTPSPSEDYTSSPSEGSTPSPSEGYTPSPSDGYIPSPSEDYTSSPSLALRGLHVLAFRGLHVLTLRGLHTLTFRGLHHLAFRGLHVLTFRGLHALAFRGLHVLAFRGLHTLTFRGLHALTFRGLHVLAFRGLHALTFRGLHALTFRGLHALTFRGLHVLAFRGLHALTFRGLHALTFRGLYALAFRGLHIFTFRGLHALIFRGLHALPFRGLHVLAIRGLHALALRGLHALTFRGLHALTFRGLHVLAIGGLHALAFRGLHILAIRGLHALAFRTLHALTFRGLHALTFRGLHVLAFRGLHALTFRGIH

SEQ ID NO: 151557 - protein, 136 aa, Glycine max
  Coding DNA Sequence Number=SeqID_34779
MSKNWVLKKHNKTFCEWFKDTIFADENASKTLRKLAYGPKRNVITWQGYNMYSFYTKAQDDKSTMQNSGVTLRAEAQHFTTLVLATSNKSEIYKEEAQNTAQKHKPKRVESVNADAEAFGDHWKVQIGLCILKLKH

SEQ ID NO: 151558 - protein, 246 aa, Glycine max
  Coding DNA Sequence Number=SeqID_34780
MWDAIVFVVFKQDFPLYIKHEDLSEIPDSGQCLSISVIQLWILHPTKTSMRAGNSDVYGFLEPQSIHRSGQSQFESESYMKSWMQNSKCDVYLRAYLNGDHWQMVIILPKENLVVWFCSLHNRPYNYLKRIINRSVLFFNTFALVLLNNINILMFFVFNTALKGLDDTPQPKSKAGARWIVFKCNRQKGSTECGYYVMHWMSTIILGSFRNNCETYFNDVSPLEAKRLKALRIQWAQYYLKVRNQT

SEQ ID NO: 151559 - protein, 191 aa, Glycine max
  Coding DNA Sequence Number=SeqID_34781
  Homolog annotation: Hit_ID=Q47522; Match level="QueryCoverage=27%, HitCoverage=64%, E-value=6e-24, Identity=100%"; Hit description=LacZ protein
MGDSDKCGLYVNDNPPQLITLGRVYEGSMTIHNVPLGNYQVKVGVEEVRDANVRLPVPTQKDKKGAKGSTKLVDMSDPNVDPFPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 151560 - protein, 65 aa, Glycine max
  Coding DNA Sequence Number=SeqID_34782
  Subcellular localization annotation: CTP_CleavageSite=43; ConfidenceScore=5.32e-01
MASMSAFICSCTSSSSPITLALAQDMGLNQFRFFNMVHDILVKVKLEVTRTSPVLNVFGSRQSSD

SEQ ID NO: 151561 - protein, 55 aa, Glycine max
  Coding DNA Sequence Number=SeqID_34783
  Homolog annotation: Hit_ID=Q2R1R7; Match level="QueryCoverage=99%, HitCoverage=3%, E-value=1e-08, Identity=56%"; Hit description=AT hook motif-containing protein, putative
MLDEYNIHAKSFRMAKDRLADTQVDNVKLRLIATREKDGRTYNLPNDSEVAALIV

SEQ ID NO: 151562 - protein, 134 aa, Glycine max
  Coding DNA Sequence Number=SeqID_34784
  Homolog annotation: Hit_ID=Q1T1F7; Match level="QueryCoverage=69%, HitCoverage=19%, E-value=4e-13, Identity=41%"; Hit description=IMP dehydrogenase/GMP reductase
RLLGLRQGSVVDRTYACNGYMIYTRTDARKAFRDLSQTGRYTWGVATLVHMYDQLNDASRQLGGYITLLQCWIYEHFPSIAESTTDQDYGEDSPHACRWIATKKTVKSIHTPAYRERLDRLQILDVCWIPYGEH

SEQ ID NO: 151563 - protein, 108 aa, Glycine max
  Coding DNA Sequence Number=SeqID_34785
MGLTLPFIPSNFPSAISAYKHHKHHHTSPKQNGNLAKLPIISPKAPYPRKSSEKEVYPNLKFRSPTRRDALHDSKNAFLSRLGAEMVTKGWSFVGQQWWMREKKKKAA

SEQ ID NO: 151564 - protein, 83 aa, Glycine max
  Coding DNA Sequence Number=SeqID_34786
MPRTHDAILYYNGKWNMPPQNKFVGCAFTGKNPKKFQIPSTCTIDELKNLIKQVAPKGIPPLGIHESQTLTEPGNGTIFFWIL

SEQ ID NO: 151565 - protein, 93 aa, Glycine max
  Coding DNA Sequence Number=SeqID_34787
GQVQIHECLYQLSLSQQSQGFAPFACPIPNQFRAEVAWPGDWSEDQTEEAPAGAPDGAEDARMDEEMTDLLDFLGGSVTSWKFLPGIFVNGVF

SEQ ID NO: 151566 - protein, 98 aa, Glycine max
  Coding DNA Sequence Number=SeqID_34788
MNEEGEENEEKRGGVGRNLMPVNESPNRVVELSEKPKGVIRGPGRRHSNAINSYSSCEERDWAKVMQSSQGGDPSLEPWLGDSRKIGPGMQEKTLGFS

SEQ ID NO: 151567 - protein, 105 aa, Glycine max
  Coding DNA Sequence Number=SeqID_34789
MGAPKSVKSTECEPSMWEHVDEMNIMVGSSRTPTMARKTIELDLLSTYGFRASKALSHFHWTCRWKSLYPEATSHPKPAHDKGITINAYKLSTQYNFNHLENPNI

SEQ ID NO: 151568 - protein, 386 aa, Glycine max
  Coding DNA Sequence Number=SeqID_34790
  Gene Ontology: Mol. function=ribonuclease activity
  Homolog annotation: Hit_ID=Q0WPN0; Match level="QueryCoverage=89%, HitCoverage=29%, E-value=1e-49, Identity=37%"; Hit description =Putative 3'-5' exoribonuclease
  Subcellular localization annotation: CTP_CleavageSite=41; ConfidenceScore=5.13e-01
MYHGASEVNEAQGLSPDSGKIGTPTHASPSLGNSLNQVNVCSSNEQGLSKASNVAFISIPPMHINEQVEPGDLRILPMCGGGIDSNSFSEPTGCRGSSGINKNKDSVPCGQIGLCGQEKYFSPHWSVEAVEKELEEGDVFKALFHVNAHNRLEAYCKIDGMPTDVFIGGIPAQNRAVEGDVVAVKFDPLPLWTKMKGPNGSCNNTATPEGCNLTEDKEVGGNICKGKAKVDAEYESAHGRSYPGQNKEDADQNSLYKSYPFTETTMVYDDITSRGSTNHLDLHGMANHDSINGHHCAAPNSLKINSCSGQSNAVEKMCLLVNSFPSKRPTGRVVAIIERSPRREGIVGHINVKQWVSFRDTSKKDVKKNKNLISEHEYIQLIPTDP

SEQ ID NO: 151569 - protein, 139 aa, Glycine max
  Coding DNA Sequence Number=SeqID_34791
  Homolog annotation: Hit_ID=Q10NP4; Match level="QueryCoverage=73%, HitCoverage=94%, E-value=2e-19, Identity=50%"; Hit description =Expressed protein
MVDGRTWRKTEISPYKHTIVPYGTTMAALPSQIAYGGVVKSKRSIWRLKTITDFFWAIVNYIGLFFATMFSMEKSDAYRKGSVGKKWDGGAPGGGPGGGGGGGGGPRGPPRGGLDNVRGLDSIRGRDHSSLPACGSCCG

SEQ ID NO: 151570 - protein, 536 aa, Glycine max
  Coding DNA Sequence Number=SeqID_34792
  Gene Ontology: Mol. function=ribonuclease activity; Cellular component=cytoplasm; Biological process=electron transport
  Homolog annotation: Hit_ID=Q0WPN0; Match level="QueryCoverage=99%, HitCoverage=48%, E-value=1e-172, Identity=58%"; Hit description =Putative 3'-5' exoribonuclease
  Pfam annotation: Domain name=RNB; Domain location=1-283; Score=214.0; E_value=3.4e-61; Accession=PF00773.9; Description=RNB-like protein
MLPALLSENIGSLSPGVDRLAVSMLLDINVAGDVVDRWIGRTVIQSCCKLSYEHAQDIIDKAFDFEGSNFIEDGYPRVYGHFEWPDVIMSLESLYEISNVLKQKRFTDGALRLENPKVVILFDENGVPYDSRLSERKESNFLVEEYMLLANRIAAEVICRAYPDGALLRRHPEPNMRKLREFMAFCQKHGLELNTSSSGELHWSLEQIREKLKGDPVLYNILISYATRPMQLASYFCSGDLKDSENEWGHYALAVPFYTHFTSPLRRYPDIIVHRTLLATIEAEELYMKHQKALQGSKEVKVQKRCFTGINFDKSAAESTEGREALSAAAVKHSVPCAETLADIATYCNGRKLASRNVKDACDKLYIWFLLKKKEVLLSEARILGLGPRFMSIYIQKLAIERRIYYDEVQGLTVEWLETTSTLVLSMSTNKCAYRRGCPNKLRPFEEVALLTCPYNLDFTTDNSNPSEVMKVDDSISAMDREPISRSDALETLIDPAFFPLTVRLLSTIPVALHAVGGDDGPLDIGVRLYMSSYIG

SEQ ID NO: 151571 - protein, 76 aa, Glycine max
  Coding DNA Sequence Number=SeqID_34793
  Subcellular localization annotation: CTP_CleavageSite=45; ConfidenceScore=5.16e-01
MSRRHALSASLARSASRLSPSRLSTSLALSENSLTHDKRKNGAKRDVEGFSIERCIVSLELDRAGLGYRMSGHGVR

SEQ ID NO: 151572 - protein, 41 aa, Glycine max
  Coding DNA Sequence Number=SeqID_34794
MCLCSHSGILLICVDAKSIGKYTGSSSTSGRQAQVLNTDVS

SEQ ID NO: 151573 - protein, 132 aa, Glycine max
  Coding DNA Sequence Number=SeqID_34795
MQERKGNKRKLTKEEVMILHNLPFGRRATRGLTGASSKGGRRAELPPMFILGNIRKTKKVWSTNFKCERFGNCFYARGRRETLRCWTINDLFVFERRETLRRWTINDLLGWSTKAGLLLLRILNCDEEIRPT

SEQ ID NO: 151574 - protein, 159 aa, Glycine max
  Coding DNA Sequence Number=SeqID_34796
MGVIDKLSVVHTVLLYVWDESDYMPILVKNRAEEILFGNIKTGKVYSAYKEQTQNQNLGPSNECKDKDASERLAINPRPSGEGLPSANTLDVGKSLQLQEKHLPDKFNFYCVWLILLKMLLKQGKNGPLKFEIIVGPSLDIENGNFERVSATMPCFGTK

SEQ ID NO: 151575 - protein, 104 aa, Glycine max
  Coding DNA Sequence Number=SeqID_34797
  Gene Ontology: Cellular component=membrane
  Homolog annotation: Hit_ID=Q8RYE2; Match level="QueryCoverage=81%, HitCoverage=18%, E-value=9e-14, Identity=48%"; Hit description =Expressed protein
MVDLCISGHWLFSALGFLIGLLWEFSATLVTAEFKHGGSDAQFWFACIVGPLEVWIRWFLAWFNGFGSGRTGILKGIPFGTLAANKSAAGVMAALASVHKAASF

SEQ ID NO: 151576 - protein, 258 aa, Glycine max
  Coding DNA Sequence Number=SeqID_34798
  Gene Ontology: Mol. function=protein binding; Cellular component =apoplast; Biological process=response to biotic stimulus
  Homolog annotation: Hit_ID=Q9CA24; Match level="QueryCoverage=86%, HitCoverage=62%, E-value=1e-101, Identity=73%"; Hit description =Thaumatin-like protein; 12104-13574
  Pfam annotation: Domain name=Thaumatin; Domain location=35-240; Score= 291.0; E_value=2.2e-84; Accession=PF00314.8; Description=Thaumatin family
MALHLQTILPFILVLAIILSGQRTCDSARVFTIVNYCKETLWPAVTPGESFNGGGFVLKPGESAVFTAPVSWSGRIWARTGCKFDQNGNGNCQTGSCGTTLKCSASGKTPASLAEFTLAQPDFYDVSLVDGFNVPMAVKPINGKGNCSTAGCDSDLRNSCPKELSLRANGKTVGCRSACDVFNTDEYCCKGNYGNPSTCKPTFYSKKFKEACPTSYSYAYDDPTSIFTCTGTDYVIAFCSSRKQQNTGIAATVQEYSV

SEQ ID NO: 151577 - protein, 83 aa, Glycine max
  Coding DNA Sequence Number=SeqID_34799
MEEEEEEEEEEEGDDDNKRSDFGVSEFGECSWFEELVEQSRASSVWVLWTCCAHNGWLFWKRIVRIRERENEWGVRKMDARAF

SEQ ID NO: 151578 - protein, 76 aa, Glycine max
  Coding DNA Sequence Number=SeqID_34800
MSKRGIRGPLLCIGDLLNDIGEEEEEGRGHSLLREASPSPSSSLLNNLTKLFQEHYDHLNSTLSGTDHSWTSLTLK

SEQ ID NO: 151579 - protein, 106 aa, Glycine max
  Coding DNA Sequence Number=SeqID_34801
  Gene Ontology: Mol. function=monophenol monooxygenase activity; Cellular component=chloroplast; Biological process=metabolic process
  Homolog annotation: Hit_ID=Q66NX3; Match level="QueryCoverage=64%, HitCoverage=11%, E-value=1e-11, Identity=47%"; Hit description =Polyphenol oxidase
MNKQVPKNCSRHGSDKYVKFDVHIDDDEDNLSEPDQTEFVGTFVNLFHGQGHNIKVTSFKVGISKVLDCLEAKEDDVVLVTLVPKVGKGDVIIGGIKVEFIPKYKD

SEQ ID NO: 151580 - protein, 94 aa, Glycine max
  Coding DNA Sequence Number=SeqID_34802
  Gene Ontology: Cellular component=cell surface
  Homolog annotation: Hit_ID=Q1H8M4; Match level="QueryCoverage=83%, HitCoverage=14%, E-value=5e-18, Identity=55%"; Hit description =Regulator of chromosome condensation family protein
  Pfam annotation: Domain name=RCC1; Domain location=30-82; Score=45.9; E_value=1.4e-10; Accession=PF00415.9; Description=Regulator of chromosome condensation (RCC1)
MGDTVSLPNLSTKVVAIAAGEAHTLLLTGDGRVYSWGRGILGRLGQGSEHDKHFPVEVKFGSEEDSVRIVGIAAGAYHSLALAGSNTSQLSYHL

SEQ ID NO: 151581 - protein, 108 aa, Glycine max
  Coding DNA Sequence Number=SeqID_34803
  Gene Ontology: Mol. function=heat shock protein binding; Cellular component=integral to membrane; Biological process=protein folding
  Homolog annotation: Hit_ID=Q337D7; Match level="QueryCoverage=99%, HitCoverage=20%, E-value=1e-29, Identity=60%"; Hit description =Chaperone protein dnaJ 13, putative, expressed
  Pfam annotation: Domain name=DnaJ; Domain location=1-29; Score=-6.5; E_value=0.019; Accession=PF00226.21; Description=DnaJ domain
MKDIATQNFQQICKAYEILSDPNKRRIYDIYDMEGLTSNLELGPNLNGAEKIKAKLERLKRMKEREKVAAHFLPFGTILANMSLPHYVDGNGLLIGQFLSPDNEMLVA

SEQ ID NO: 151582 - protein, 175 aa, Glycine max
  Coding DNA Sequence Number=SeqID_34804
MALYFSEWLCVGLDVDALDSVNKEEGIVVESSDNEDLTVEVDVVRQWGTFLLFLPFGGAFVAHACDIIGDAKGRNDNSWMAIGFAFDVRHTGIPDYDGTVHVVEGGYLGIGIGGYEVAETVVVGSRGGDENVQEKDNVEDKEEDEDEAEEKEKEKGKCNSSPSKSLLDLARIIPY

SEQ ID NO: 151583 - protein, 115 aa, Glycine max
  Coding DNA Sequence Number=SeqID_34805
  Gene Ontology: Mol. function=RNA-directed DNA polymerase activity; Biological process=RNA-dependent DNA replication
MRPILDKIIYERYCAFIGGRHLLNGSFFVNEVLDDAKIRRKGLCCSSHDLYSGEYGSPMEEFITSRGLRQCDLIAPFLFLLTTKVLSEMMRKALSSEVLSGHEVGTLSGCISYAV

SEQ ID NO: 151584 - protein, 71 aa, Glycine max
  Coding DNA Sequence Number=SeqID_34806
MKNISKLFEELDVCAKVTIKCKLRDIAYPDLNSICAPPEKVITDKWINITDMSYVIASKKSTTERLFYTSR

SEQ ID NO: 151585 - protein, 159 aa, Glycine max
  Coding DNA Sequence Number=SeqID_34807
MTLVQWYCLKGPVVFTDAVTWFCEDCATKLGVPLALDQSTPILSVSRNNSKKEAKKKHKERKANSSLVAKTKEVLSGRHISPEPEHPQCSNRCEECEVKDECGPRDVANFDVGEEESVARDLINSDEGFKFVPVSQGAIDNDSGCVELDGHVYAHPTID

SEQ ID NO: 151586 - protein, 472 aa, Glycine max
  Coding DNA Sequence Number=SeqID_34808
  Gene Ontology: Mol. function=transcription factor activity; Cellular component=nucleus; Biological process=regulation of transcription, DNA-dependent
  Homolog annotation: Hit_ID=Q5NE24; Match level="QueryCoverage=99%, HitCoverage=99%, E-value=1e-139, Identity=54%"; Hit description =Nodulation signaling pathway 2 protein
  Pfam annotation: Domain name=GRAS; Domain location=70-380; Score =332.3; E_value=8.2e-97; Accession=PF03514.5; Description=GRAS family transcription factor
MDMLIMDDPDFLDFSDHSITTTLSSHEDCNKNNNNLWSPLIDWESLNACENDFQTLIDSVMIDNNDDVLTPEESDQSAAEESESDSTGGDERGLRLLHLLMAAAEALSSGTESHDLARAILVRLNELVSPTQGTNIERLAAHFSHALHSLLNGTASAHTPPIDTLTAFQLLQDMSPYIKFAHFTANQAILEAVAHEKRVHIIDYDITEGAQWASLIQALSSAGPPGPHLRITALSRGGGGGGNSSSASGQRSTASVQETGRRLTAFAASVGQPFSFHHSRLDPDETFRPSNLKLVRGEALVFNCMLHLPHLNFRASGSVGSFLRGAKELNSRLVVLVEEEMGCVAADSGFVGFFMDSLHHYSAVFDSLEVGFPMQTWARALVEKVFLGPRITGSVARMYGSGTEEEKVSWGEWLGAAGFRGVPLSFANHCQANLLLGLFNDGYRVEELENNRLVLGWKSRRLLSASVWSSNS

SEQ ID NO: 151587 - protein, 50 aa, Glycine max
  Coding DNA Sequence Number=SeqID_34809
MEQELEGNGMYTPVDLKTRLVNAKASSIEKGVDMCQVLRDCVCDYILATE

SEQ ID NO: 151588 - protein, 232 aa, Glycine max
  Coding DNA Sequence Number=SeqID_34810
MVRFGEGEGTGVQCCGGRRRHTMYAMLGLRCGVPQIARIKLIRKKFMDQLDLHMDEDQWMYESIMFEEVNIDYENEEECGVNEPHVDYSDAFNTSQIIMFMIPRGCCRCIGNLLRFQCMQRKNDDDVNTMLMCNHQFSSVGLIELLCTIGRTPDDILNILEATMIPTHDALLYYNRRWNMSRQNEFVGYSFTAKDPKKFDIPFGCTMNELKDLIKQVAPYGIPPYGIYETQT

SEQ ID NO: 151589 - protein, 173 aa, Glycine max
  Coding DNA Sequence Number=SeqID_34811
  Gene Ontology: Mol. function=aminoacyl-tRNA ligase activity
  Homolog annotation: Hit_ID=Q6Z302; Match level="QueryCoverage=55%, HitCoverage=27%, E-value=3e-21, Identity=57%"; Hit description =YbaK/prolyl-tRNA synthetase protein-like
MTENNVLKTFIEQNKGKWEVERVGVFPWVGVPAEILGCQEKHWRANSNPLTKPGRNRELHINFSQYEHPTILTVEEGGNKRLKNEKYVGHLGGGVTKSLCFEGNDKKRRFYLVSALKDTQLDIKVLSQRLGLGKGGLRMTPSEALGEILQKIRIKCGKKMNHVQKSTSHRNRN

SEQ ID NO: 151590 - protein, 127 aa, Glycine max
  Coding DNA Sequence Number=SeqID_34812
MAVLISGDFWKLRKRCKDEGGEGKRGLGKDRRGHGFKHLDLQQGEKFKEFGAPEFHHDCAKELEIHTMADSNSGTPNSFNFSHCKNNNQRPRISIHHIEIQPEDISIHLVFNADSGHQMSFMVCDCV

SEQ ID NO: 151591 - protein, 179 aa, Glycine max
  Coding DNA Sequence Number=SeqID_34813
  Gene Ontology: Mol. function=metallopeptidase activity; Cellular component=cytoplasm; Biological process=amino acid metabolic process
  Homolog annotation: Hit_ID=Q9C6Y8; Match level="QueryCoverage=49%, HitCoverage=20%, E-value=9e-33, Identity=69%"; Hit description =Aminoacylase, putative
IIEKGPLRDYMGRPLMTATDDSNPWWSVFKQAITSVGEKLSRPEILASTTDARYLRQKGIPVLGFSPMKNTPILLHDHNEHLKDTVFMKGIQGKSERLDTPPPNNKWSKSINSNVVIGHHEKRKKKSPLLFQFAHGGDWECLIQASQIYKYIKGVAGLHTGVRSRIVSIRLMRNAGNTF

SEQ ID NO: 151592 - protein, 95 aa, Glycine max
  Coding DNA Sequence Number=SeqID_34814
MSLNQVLVKRKKAEWCDKNTEIMLKVCIEELIGKDTCLGWDGEMKTIAASDEWWEAKIQKLATEKFWCPAATEVATTLLLVQFANEFATEFDNDA

SEQ ID NO: 151593 - protein, 332 aa, Glycine max
  Coding DNA Sequence Number=SeqID_34815
  Gene Ontology: Mol. function=DNA binding
  Homolog annotation: Hit_ID=Q1S0F5; Match level="QueryCoverage=54%, HitCoverage=34%, E-value=1e-16, Identity=31%"; Hit description=IMP dehydrogenase/GMP reductase
KHLEEKANALADRGEWASFIDVLALLVFGVVLFPNVDGLVDLAAIDAFLAYHYSKESLVVAILADAYDTFDRRCEKSSARIIYCTPALYVWLVSHLFRHESRPICPLQGHCTCAEKGKANWEQLLASIVGTSVNWFPRWKEGRVGVLSSCQGFSNIPLMGTRGCINYNPILAIRQLDYPMRGASSEESTMPFIAWGFSDPNARIFQRVRKAWSVLDWLSKFKVSSEEEVETLEESEEVQALKVELEKAQVVKERFKTMTIKVRKECDELRDVNMATTEALEGETKRARKEEWVQNKFRGALWGSNDELKLRRAKRDQSRVEGMILEGKLKAC

SEQ ID NO: 151594 - protein, 213 aa, Glycine max
  Coding DNA Sequence Number=SeqID_34816
  Subcellular localization annotation: CTP_CleavageSite=33; ConfidenceScore=5.22e-01
MNVGALISGQISSMAQSNSSKLGFPALITALCRSKGVASDSLVFECLRPIINLAYIRKNCWNPADLIVTIRGARRVRARPAEAPSTSAAPPPARTLATPSTPSSTNFQRLEAMLQSIHQGQIVLLQSLQLVAPPDSIPSIEQFNEWVAWPRTQPPLHREDEGLTAQVADPSTPEDQTTPVLSPNTSPPATPVLHLTNEEDVQTQDTQDRSQDF

SEQ ID NO: 151595 - protein, 109 aa, Glycine max
  Coding DNA Sequence Number=SeqID_34817
MHKALRSGAPLPYPQLVTLFLRHFEIPLDSEPFVLVKRSFAIGASAVTSFGYRKDVDGQWLKKDAQPPQDERTPSPPPPQDDSSALMNEMPLMLALKEWIPTSLSLKRM

SEQ ID NO: 151596 - protein, 71 aa, Glycine max
  Coding DNA Sequence Number=SeqID_34818
MANVVLKFHEDPTVNESEIVIFLRQVRWPAGKREGFGRKEKKRNCEAKEAKESFTKIEMLQFLRTKLDFVS

SEQ ID NO: 151597 - protein, 96 aa, Glycine max
  Coding DNA Sequence Number=SeqID_34819
  Gene Ontology: Cellular component=integral to membrane; Biological process=transport
  Homolog annotation: Hit_ID=Q9FVU0; Match level="QueryCoverage=59%, HitCoverage=27%, E-value=2e-10, Identity=55%"; Hit description =Integral membrane protein, putative
MARDRNSRIGISVVMLLCFAAHFYVLPLAEAVWLTLPTSGTKCLSEEIQSNVVVLADYYVVTQEGGLQTLSVKFGWFRVAGYFSCCLIPYALKLVY

SEQ ID NO: 151598 - protein, 585 aa, Glycine max
  Coding DNA Sequence Number=SeqID_34820
  Homolog annotation: Hit_ID=Q1SP02; Match level="QueryCoverage=44%, HitCoverage=62%, E-value=3e-27, Identity=31%"; Hit description=IMP dehydrogenase/GMP reductase
  Pfam annotation: Domain name=DUF1723; Domain location=237-286; Score =48.6; E_value=2.1e-11; Accession=PF08330.1; Description=Protein of unknown function (DUF1723)
MAKSNRSDRRKVLPEKLPEELVPVASPKEGSSGRTKNSSGEATGRTSSGELLPIMVRTRGLGHALARVIGRGRHDEHDAIDVPQRRRPTASTSRRRVHITIDEGVPQVTEDVPHMAEDVPQVTEDVPHVADDVAQMSEDAPQMIADVDATIVEDLGRDGAKGSHADEGFPGGPCDPSVPTSFAEHVAHAIWTRQERPKLKLVSHGRKVALIGRPVPAIEGLVVTTGLSPLIECTVVIGNPGLISVFVERWHRETSTFHLLVGELTITLDDVSSLLHLPISGAFHSFEAISVDETVFLLMELLEVSGTTMDCSNSCLSTTPGFSRPGSKWGYAWGAAALIHMYDQLDEASRTTTRQIGGYLTLLQCWIYEHFPSVHQCVTDDAYEETFPRASRWLTMKAHMKGIIGALYRAHCDALTVTDVCWLPYSDHRGVRVFELISSFQGQLKWGPTASIPSLPVSASLSYDDIDDRWMHFLDHVVAVGYLCVVSGQASDQPRHAPAPDHEDYMQPDIPQVPVAFDPPRHAVDDYKGCEAIAKRLERVLNLRMVTVGTELHDIMQDCLRIAKGLPAQMEVLGLDKDDAQSIDD

SEQ ID NO: 151599 - protein, 119 aa, Glycine max
  Coding DNA Sequence Number=SeqID_34821
  Gene Ontology: Mol. function=protein binding; Cellular component =integral to membrane; Biological process=transport
  Homolog annotation: Hit_ID=Q9FVU0; Match level="QueryCoverage=70%, HitCoverage=40%, E-value=4e-29, Identity=68%"; Hit description =Integral membrane protein, putative
MDGKHQEEATVSLDWKTGIYAKDWESVAKKEKIEGVELELRKLEGAVEAIHGYLVYLKDKEARMREVSERTNGRVAWFSIMSLSVCILVSGYPFKGMCTSALNYIDMLICRIEELFYWG

SEQ ID NO: 151600 - protein, 101 aa, Glycine max
  Coding DNA Sequence Number=SeqID_34822
  Subcellular localization annotation: CTP_CleavageSite=29; ConfidenceScore=5.18e-01
MRDKEIEGNPTVGNSPSRRHIPSQSRRCRLQSTEGNSSSPKPRNYASPSQPVINSEVAGNTDCRKIIYEVWKTTIMGFPMLIQSQKLKILKSKLKEQIYLW

SEQ ID NO: 151601 - protein, 124 aa, Glycine max
  Coding DNA Sequence Number=SeqID_34823
MTLHPLCKAFSIEWMDYTTWILVLIGLRRMISHHKKGGDCRSKASNIILMMPKIFKKIHSNKIKEIKKIQVKIQEKTQDMQEPQEKHQDKYKKNFSKKRLNKTICPKEFFNEKSFTLLSGNRLP

SEQ ID NO: 151602 - protein, 166 aa, Glycine max
  Coding DNA Sequence Number=SeqID_34824
  Gene Ontology: Mol. function=RNA-directed DNA polymerase activity; Biological process=RNA-dependent DNA replication
  Homolog annotation: Hit_ID=Q1S7B8; Match level="QueryCoverage=62%, HitCoverage=13%, E-value=2e-13, Identity=40%"; Hit description=RNA -directed DNA polymerase
MIDSNEYDGVNGGCMDMTMCLMEARQRVSWSWNDRECGSASGKKGCVVYMMSQAIERNLFSSFLVGKLKVEVNLLQYVDDTLFFGKASLANVLTIKSVLRYLELISRLKRDENVRKIQWVRWRKICWPRNHEGLKDLGSFNETLLGKGRWNFILSRGILTGGSVKF

SEQ ID NO: 151603 - protein, 308 aa, Glycine max
  Coding DNA Sequence Number=SeqID_34825
  Gene Ontology: Cellular component=mitochondrion
  Homolog annotation: Hit_ID=Q1SXB1; Match level="QueryCoverage=96%, HitCoverage=74%, E-value=8e-28, Identity=37%"; Hit description=Tudor
MASEEKKLENQLLKVGNKLLKPPSSTNGLLYLLNRVKSLLERVEQSPTKSLQDALSPSLKALIGDALLRHADIEVKVTVASCVIDIVRISAPEIPYDDDQMKEVLPIARRLAESVLESCATILRPYLKQVVNTLGISLDDYSDVLVSICQEKIGSLKQNDEFLTNDHMEDEIESRKELVEESTQDKPISLKLLEASKSSNLTIEKEPKKLIDFREGTKDMDKMSNTKAYGAKLVGTRVKVWWPDDKMFYEGVVSYFYAPRNMHKIVYDDGEEEYVILKEEKWKIIKTSDNLDTGEGTYCTCHDALKDL

SEQ ID NO: 151604 - protein, 58 aa, Glycine max
  Coding DNA Sequence Number=SeqID_34826
MGVKYLEAVEQRLHATKQWSSDEIRTRLKQDDLQGKMSYWISSLSVESAKLKHRESQA

SEQ ID NO: 151605 - protein, 91 aa, Glycine max
  Coding DNA Sequence Number=SeqID_34827
  Gene Ontology: Mol. function=carboxypeptidase activity; Cellular component=membrane
  Homolog annotation: Hit_ID=Q9SUF1; Match level="QueryCoverage=89%, HitCoverage=21%, E-value=1e-22, Identity=60%"; Hit description =Nodulin-like protein
MEKTCDARFSIMLNQAKPYLLTVGLQFGMAGTFIIIKATLDHGMSRFVLTVYRNAIAAIMLAPFAIIFERNVRPKMTMSVFMQILALGFLE

SEQ ID NO: 151606 - protein, 801 aa, Glycine max
  Coding DNA Sequence Number=SeqID_34828
  Gene Ontology: Mol. function=solute:hydrogen antiporter activity; Cellular component=integral to membrane; Biological process =regulation of pH
  Homolog annotation: Hit_ID=Q9LUN4; Match level="QueryCoverage=97%, HitCoverage=96%, E-value=0.0, Identity=66%"; Hit description=Na+/H+ exchangeing protein-like
  Pfam annotation: Domain name=C4dic_mal_tran; Domain location=201-452; Score=-86.7; E_value=0.053; Accession=PF03595.8; Description=C4 -dicarboxylate transportermalic acid transport protein
  Pfam annotation: Domain name=Na_H_Exchanger; Domain location=37-423; Score=270.0; E_value=4.9e-78; Accession=PF00999.11; Description =Sodiumhydrogen exchanger family
  Pfam annotation: Domain name=Na_H_antiport_1; Domain location=50-389; Score=-315.1; E_value=0.036; Accession=PF06965.2; Description=Na+H+ antiporter 1
  Pfam module annotation: Pfam domain module=C4dic_mal_tran::Na_H _Exchanger::Na_H_antiport_1; Domain location=201-452::37-423::50-389
MASPDSKCPAPMKATSNGAFQHENPLDYALPLLILQICVVVVFTRFLAFICKPLRQPRVIAEGGILLGPSAMGRSEKFLNTIFPKRSLTVLETVANIGLLFFLFLVGLELDLRSIRKTGHKALFIALSGITFPFILGIGTSYALRATISKNANPTSFLVFMGVALSITAFPVLARILAELKLLTTNVGRIAMSAAAINDVAAWILLALAIALSGSNTSPLVSLWVILCAAGFVLFAMFAISPLLGMMAKRSPEGEPVQEIYICITMTLVLACGFITDTIGIHALFGAFVVGIVMPKDGPFAGALIEKIEDLVMSLFLPLYFVSSGLKTDVASISGALSWGMLVLVIFTACFGKIIGTFLVSLLCKVPFREALALGFLMNTKGLVELIVLNIGKDRKVLNDQAFAICVLMALFTTFITTPIVMAVYKPARTGSRYTHKTVQRNDPNTELRVLACFHSTRNIPTLINLIESSRGTKKRAKLCVYAMHLMELSERPSAITMVHTARNNGMPFWNKKHDNRDQVVIAFQAYGHLSSVNVRPMTAISAFSNIHEDICTSAHQKRAAIIFLPFHKHQRFDGTMESVGNSLRAMNGLVLSHAPCSVGILVDRGLGGTSQVQASDVSYKVVVGFFGGRDDREALAYGMRMAEHPGVSITVVKFVVPPGMTLAFGAKLIGVTADKDRKVIKVAEGTTTDVEKQEDEHFWSEFLGVCCKNAESIMYEERLVESKEDILTTMREMNKSNLILVGRMPPVVPLVDTSDCPELGPVGSYLASSEFSTSASVIVFQQYNPKTDIYAKVLKNGPPL

SEQ ID NO: 151607 - protein, 69 aa, Glycine max
  Coding DNA Sequence Number=SeqID_34829
  Subcellular localization annotation: CTP_CleavageSite=38; ConfidenceScore=5.41e-01
MKAQVLNTDKGSSQWWCRRRRTNKKTGAGTRKRRKNMNAQGGRRKGSDGVRNVNNGAAQVHLATPELFS

SEQ ID NO: 151608 - protein, 157 aa, Glycine max
  Coding DNA Sequence Number=SeqID_34830
MEQPIYSSSYDVFNNCGSSLQTSMQGGAVDVSAYDKDNWISGPSSMLSDQSEDMGMIQRINREMIESWPEYSGQLKDDNSTWQFEKDTVGQETFKTIMPNYIRDSTVVRFRDIALPNLMQSYPLRALDRRLQEDCAKDAREGPRTLMSLSIDFEPMG

SEQ ID NO: 151609 - protein, 49 aa, Glycine max
  Coding DNA Sequence Number=SeqID_34831
MAVETGTGVPLLMCKEDDALDPVQPDMVGLISGLGGRGTNMKKGSGEWS

SEQ ID NO: 151610 - protein, 57 aa, Glycine max
  Coding DNA Sequence Number=SeqID_34832
MFTSHLYSLWLELVISVGVSNSWSNRKEFLAAEATGAMEIDGEIEARNVVILVIGWG

SEQ ID NO: 151611 - protein, 63 aa, Glycine max
  Coding DNA Sequence Number=SeqID_34833
MAPYFASTLETEQSVWRLRRVSNCKGWWPPVNERAEGCQQGFLERKRKEARASGAKEQSDECF

SEQ ID NO: 151612 - protein, 138 aa, Glycine max
  Coding DNA Sequence Number=SeqID_34834
  Gene Ontology: Mol. function=nucleic acid binding; Biological process= DNA integration
  Homolog annotation: Hit_ID=Q7G463; Match level="QueryCoverage=82%, HitCoverage=29%, E-value=7e-17, Identity=36%"; Hit description =Transposable element protein, putative, Retrotrans_gag
GENANDNRPLKEYAAPTIRDPVDHLEGFLEICETQNFHRVTQDALSLRLFPLTLVGKAWATFLDKYYPSSKIDEMRKLITNFGQGQIKSFADAWERVLKLLLACPHHGIERPLTIHFFHDGWNYLSKMLLHCAAGGSF

SEQ ID NO: 151613 - protein, 95 aa, Glycine max
  Coding DNA Sequence Number=SeqID_34835
MVISVGVSKSWSNREEFLAAEATGAMEIDGGIKARNAVILVILLGWGGGRSALILESLSLASAPGFIYLLNNLGLLLGEDVLLLVHAFVIVMMDG

SEQ ID NO: 151614 - protein, 71 aa, Glycine max
  Coding DNA Sequence Number=SeqID_34836
MSNETTKCSEMLGSNSKAQSQDILPNAFPYCENFEVKCFVRSIDREPMIKHFYVRRKGDESQVGRNQTDLL

SEQ ID NO: 151615 - protein, 36 aa, Glycine max
  Coding DNA Sequence Number=SeqID_34837
MALSATSRGFSIKRCIVSLDLDRAGLGYRMSGHEVR

SEQ ID NO: 151616 - protein, 114 aa, Glycine max
  Coding DNA Sequence Number=SeqID_34838
ERGGGVPPLLLAGWDEKASPAIGAGRTGVTRRETRASPAIGAGGIGSAPRVHALTSAPPAPRVHALTSARSRLKGLQCLVFSSEKPMLVVVAVVLSSFKCPYPYLGHKFLIFQC

SEQ ID NO: 151617 - protein, 85 aa, Glycine max
  Coding DNA Sequence Number=SeqID_34839
MKDQQRVIRLTESMLMHYILFKIVILQLKVMHHHLSKQNQEGSCRCWINFIHAFMILLKILLMIKLMVIMDKWMNITDMGYVIAS

SEQ ID NO: 151618 - protein, 119 aa, Glycine max
  Coding DNA Sequence Number=SeqID_34840
MPRGFSMTSTRCVRVVSSEKWRLRKPSRGYDYHCIIEWIWEQVSIGHQNWGEFYRWVLWFDLGMAFVDNWVVGKEKGCYWLSNDIVWPVGSFHVGTTIAAWVSPSSHPLHLPQFSHSSK

SEQ ID NO: 151619 - protein, 130 aa, Glycine max
  Coding DNA Sequence Number=SeqID_34841
MAAQFIHDRVEMECLEGVWDTLEGNARCRFRGTIRLTATSLVHPEEPARTLQRTLEWILPTPTPYLLVEPVQVIEVTSSEEDPEEDPEELPPEPAVDALDFLEGDEDPLLEVDSPEDVMLAYEADSTEES

SEQ ID NO: 151620 - protein, 77 aa, Glycine max
  Coding DNA Sequence Number=SeqID_34842
MEQYLQHLLSLSQQGQGFVSFACPTPDQFRIEVAWPGEWPEAQAEEAPAGAPGDAEEARMNEEMTDLLGFLGGSRAA

SEQ ID NO: 151621 - protein, 62 aa, Glycine max
  Coding DNA Sequence Number=SeqID_34843
  Subcellular localization annotation: CTP_CleavageSite=23; ConfidenceScore=5.01e-01
MISLSETSSLSGSLLLVLSATICAERNSSCAKRNNSRLSQIIGKCLRNFQPKFEDNPMVNES

SEQ ID NO: 151622 - protein, 134 aa, Glycine max
  Coding DNA Sequence Number=SeqID_34844
MKMKANKTRNELKVSDSKTYWLKTEEHTKNVRRTMKNDGKSSRKRLRSFTEAPQLGFSSRKHSFSLKTAEMHSIGLRKYYGSLSDLILFFFVLPLTNLKWKRLTQGYGNFTEALRKPRRSIFRKSREVLAALLA

SEQ ID NO: 151623 - protein, 236 aa, Glycine max
  Coding DNA Sequence Number=SeqID_34845
MKIVAKADPFGSDENGIDGEEEGVVEIGVPEYGRKHNGKGEVEVGGKDAATGGLVRNRWEAAMGRGGSVISAGGGGFAKEEDGKVGWLPWEAEATWFRLGVVTSQRKKMERVVWVPCLTMEASRRSTQATECSASSIEEQQAGPIVRNRGHKPCFEDKENLLTLKIAFNKFCYGLWLDGDGTVIIAASSYHTVSVVFIKTLKLNTRLVLVTDSQLTQVTIRMIIIGKSPSRIVDIG

SEQ ID NO: 151624 - protein, 106 aa, Glycine max
  Coding DNA Sequence Number=SeqID_34846
MVHVDPVTGKADNPHKKKLRTYLGIVARDKVDVTYKNWKQVLVALKDLIWEDILFKSNLTSKWAFAVDKDNVDVTVCKKFSISKEKWAQFCQSHRDPSWEDVRKKA

SEQ ID NO: 151625 - protein, 158 aa, Glycine max
  Coding DNA Sequence Number=SeqID_34847
MLCNRLPEEKTLEIAMAAQLIHDRVEMECLEGVWETLEGNVRCRFWGTIRFTATSLVRPEEPARMLQRTVEWILPTPTPYRLVEPVQVIEVSSSEEDPEEDPEELPPEPVVYAIDFPEGDEDPLPDVDSPEDVKSASEADSTEESGPGGIVTNGDSSS

SEQ ID NO: 151626 - protein, 242 aa, Glycine max
  Coding DNA Sequence Number=SeqID_34848
  Homolog annotation: Hit_ID=Q2HSG3; Match level="QueryCoverage=99%, HitCoverage=4%, E-value=1e-115, Identity=82%"; Hit description =Putative zinc finger in N-recognin, putative
  Pfam annotation: Domain name=zf-UBR; Domain location=120-190; Score =52.5; E_value=1.4e-12; Accession=PF02207.10; Description=Putative zinc finger in N-recognin (U
  Subcellular localization annotation: CTP_CleavageSite=70; ConfidenceScore=5.19e-01
MEKLVGNENLLPGLKFLFAFIESVFSDCGSSKISLQKTTKKSSSGNSLAVGHSSARLVGSRKNSETFILSANQEGGSTSLECDATSMDEDEDDATSDGEVLSIDKDDEEDANSERALASKVCTFTSSGSNFMEQHWYFCYTCDLTVSKGCCSVCAKVCHRGHRVVYSRSSRFFCDCGAGGVRGSNCQCLKPRKFTGDSSAPVRGSNTFQSFLPFPEDGDQLPDSDSDFEEEISSDADNSLSY

SEQ ID NO: 151627 - protein, 249 aa, Glycine max
  Coding DNA Sequence Number=SeqID_34849
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q7WET9; Match level="QueryCoverage=61%, HitCoverage=32%, E-value=4e-26, Identity=42%"; Hit description =Sensor kinase protein
RSLCHRRSAAGRAAPPGGASGTGDPVDQQGVHAAAPAGAARGRSAVAHADRLSACAASAMSASHARERAHFTSAGVADAAHRHAVRAGGRFGGRADFPNSGAKTAHQREPGRGGIAADRADAGRPGADVGRRARRGNGAGGAAARGFSDGAPGRRQPVADLRRARDGQRAEDAGALPVAHRRGGGGGFPADCAVGVWGHAPGIEAVMAHGGAGVADCAQYAVDAPQRAGGAERVAAVDPFVQCDARSVE

SEQ ID NO: 151628 - protein, 87 aa, Glycine max
  Coding DNA Sequence Number=SeqID_34850
MHQLQTLSTTYSRPAPQVPVAFDPPPHVDDYEGYEAIAQRLERVLNLRIVTAGTELYDIMQDCLTIGRGGPSANGTVRARQRCRTDH

SEQ ID NO: 151629 - protein, 124 aa, Glycine max
  Coding DNA Sequence Number=SeqID_34851
MGTTDIGLVYHGDTSCALAGYLDFDYAVDLDARRTVTRIRGERRRHLLEDKPLKEKLHHQKSALDKKLKEEASMKEENERDRVMQSYPLRALDRRLQEDWARDAREGATVLMSLRVDFRAMTWA

SEQ ID NO: 151630 - protein, 101 aa, Glycine max
  Coding DNA Sequence Number=SeqID_34852
MASMDNSFKECFVKGCKEMRQKTTAEIKYLNFVRIKLIDTVDLEGGPVGKPVVPAALMNRPTRGERRFAYWALAECILAYYVGTDEGVSEVLHVAGEKRLH

SEQ ID NO: 151631 - protein, 461 aa, Glycine max
  Coding DNA Sequence Number=SeqID_34853
  Gene Ontology: Mol. function=RNA-directed DNA polymerase activity; Cellular component=intracellular; Biological process=RNA-dependent DNA replication
  Pfam annotation: Domain name=RnaseH; Domain location=84-172; Score= -29.1; E_value=0.03; Accession=PF00075.14; Description=RNase H
  Pfam annotation: Domain name=rve; Domain location=331-461; Score =69.3; E_value=1.3e-17; Accession=PF00665.16; Description=Integrase core domain
  Pfam module annotation: Pfam domain module=RnaseH::rve; Domain location=84-172::331-461
PALTGRIARWQMLLSEYDIEYRTQKAIKGSILADHLAHQPIEDYQPIKLDFPDEEVMYLKMKDCDEPLPGEGPDSESRWGLIFDGAVNVFGNEIGVVIITPEGNHLPFAARLQFDCTNNMAEYEACILGIEEAIDLRIKNLDIYGDSALVELHHIPCDENQMADALATLSSMYEVSHRNNLPTIRIQRLERPAHVFAVEEVVDDKPWFHDIKCFLQSQEYPLGASNKDKRTLRRLSGNFFLNGDVLYKRNFDMVLLRCVDKQEAELLMHEIHEGSFGTHSNGHAMARKLLRAGYYWMTMETDCCKHARKCHKCQIYADRIHVPPTTLNVLSSPWPFFMWGIDMIGRIEPKASNGHRFILVAIDYFTKWVEAASYANVTKQVVVRFIKNQIICRYGVPNRIITDNGTNLNNKMMKDLCEKFKIEHHNSSPYRPQMNGAVEAANKNIKKIVQKMVITYTDWHE

SEQ ID NO: 151632 - protein, 185 aa, Glycine max
  Coding DNA Sequence Number=SeqID_34854
  Homolog annotation: Hit_ID=Q40538; Match level="QueryCoverage=19%, HitCoverage=64%, E-value=1e-07, Identity=86%"; Hit description =Nicotiana tabacum (clone 5) activating factor DNA sequence
MDYIRASIPYARINIVTTRKAGFYISVATCPSRASEGMLRQLATHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 151633 - protein, 88 aa, Glycine max
  Coding DNA Sequence Number=SeqID_34855
  Gene Ontology: Mol. function=ribonuclease H activity; Biological process=DNA integration
MSHGRLYQQRIKNTFDKKLCSCKFNEGDLVLKKVSHAVKDNRGKWAPNYEGPFVVKKAFSGGALVLTNMDGEELPSPLNSDVVKRYYA

SEQ ID NO: 151634 - protein, 146 aa, Glycine max
  Coding DNA Sequence Number=SeqID_34856
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=84%, HitCoverage=22%, E-value=2e-58, Identity=70%"; Hit description =Photosystem I P700 chlorophyll a apoprotein A1
GVLKICFQIRLYNYNRSLLNGYKNTHALAPGTTAPVGGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQ

SEQ ID NO: 151635 - protein, 150 aa, Glycine max
  Coding DNA Sequence Number=SeqID_34857
  Gene Ontology: Mol. function=RNA-directed DNA polymerase activity; Cellular component=mitochondrion; Biological process=RNA-dependent DNA replication
MRELHEGIYGLHTGGHSLSTKVVRAGYYWPTLRADTFDFTRRCRRCQEFLDVLRTPLDNLLNLSSPWPFAMWGMDYFTKWIEARPIWEIVANEVEKFTWKHFICRYGLSYAIVMDNDTQFKAQTYEDFLTRLGMKHLGTSIKHPQTNEQA

SEQ ID NO: 151636 - protein, 67 aa, Glycine max
  Coding DNA Sequence Number=SeqID_34858
MSFISPVVDGEFRRKNNNDYMKNYFCPHVYPKSCIYRLQQYAKYAEVVIEELSLNLVVVVGYRQERV

SEQ ID NO: 151637 - protein, 50 aa, Glycine max
  Coding DNA Sequence Number=SeqID_34859
MDQYDFFGDGEDGHSHPGSWFMVSWDFGSRLVERMDMIYVRVLVWPAIQG

SEQ ID NO: 151638 - protein, 136 aa, Glycine max
  Coding DNA Sequence Number=SeqID_34860
MEETHEIPHHDLADFEPCLGYAAKGQAVGGVPLQKTLEGPQYHPQPQPSRSTTSKNPRAMTEMEKLDHLEERLRAIEGGEDYAFANLKELFLEPNIITPPKFKVLDFDKYKVTTCPKNHLKMYCQKMGAYAKMRNC

SEQ ID NO: 151639 - protein, 325 aa, Glycine max
  Coding DNA Sequence Number=SeqID_34861
  Gene Ontology: Mol. function=RNA-directed DNA polymerase activity; Biological process=RNA-dependent DNA replication
LRENGCKCTNGLHRNGQHGGAIRGRCPRGTFDWGKCPCRKKCQEVWRPLAKKKDQEVGMIAHGKPQQNFTPYRQVANVASTIPNPSYHQQRPHYPYPPQQYPPQPYPPQQYPPQQYPPQQYPPQQYHQPQYPQKQQNRPQTPQQPYHSQNRQKTTFDPIPMKYADLLPALLAKNLVHVRTPPRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEICPVNVKGCPKVQEDVQGLIDSRELIITRKDKE

SEQ ID NO: 151640 - protein, 72 aa, Glycine max
  Coding DNA Sequence Number=SeqID_34862
GSPRCGVSTENNGGLWWLRVDVGDGESSWDTKFGDDPTVNEGWAAFIPRQLHVASLRSFIKRLPQEDSSWLL

SEQ ID NO: 151641 - protein, 100 aa, Glycine max
  Coding DNA Sequence Number=SeqID_34863
MGIAPTRHPVDPEKSNRALGFPALVTGLYQSYRMPVPPRQGYVIIGIAPARHPVDPKKVPVTSSKGIRPPTDRASSRSTASLGRRRAKHHSSIGMAGSGQ

SEQ ID NO: 151642 - protein, 92 aa, Glycine max
  Coding DNA Sequence Number=SeqID_34864
  Subcellular localization annotation: CTP_CleavageSite=54; ConfidenceScore=5.19e-01
MHMTQMQSRNAGARGNVPFLDKTSSGSKVPQRREDPDRTPMRCICKRRNNMTISTEHKQKGYMIFMHGSVKNGTQRVCSVPLFKGPIRERTN

SEQ ID NO: 151643 - protein, 139 aa, Glycine max
  Coding DNA Sequence Number=SeqID_34865
  Homolog annotation: Hit_ID=Q6CQE5; Match level="QueryCoverage=45%, HitCoverage=57%, E-value=2e-08, Identity=63%"; Hit description =Protein TAR1
MVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRTFEKRVKECLKLFGREADGGRRCVSVGCGT

SEQ ID NO: 151644 - protein, 96 aa, Glycine max
  Coding DNA Sequence Number=SeqID_34866
MAQKEETSTDQIPEPSPTPLPDDVIPSAPTSELEQPISQDSPAAQVLDLNEFAQEQPQEQDALEKNEHVIGSMTENVSQFVRLIVKEFIDRISVRV

SEQ ID NO: 151645 - protein, 97 aa, Glycine max
  Coding DNA Sequence Number=SeqID_34867
MTKFCLCVSSGPPPLDDKRVRITVRYLRVSSGPPPLDDTRVRITVRYLRVSSGPPPLDYTRVRITGQYDKDYGAADKCKALAPTYPPMRNSDLRSSR

SEQ ID NO: 151646 - protein, 35 aa, Glycine max
  Coding DNA Sequence Number=SeqID_34868
MASPRLSETQCHQVQFIAVRIEGHRDEHLSTTDGR

SEQ ID NO: 151647 - protein, 44 aa, Glycine max
  Coding DNA Sequence Number=SeqID_34869
MPQLAVLISHIGELYGCNDSYTRDEAKCTLGGSNSGLDSIDIIP

SEQ ID NO: 151648 - protein, 83 aa, Glycine max
  Coding DNA Sequence Number=SeqID_34870
MTPTPSPSVYKECGETGYVVKDCLYTQALEEVNYASGKNIDTLIPTTKGGEITQTSLGKSREIKGKVRVRTRIGLSRRRGDQP

SEQ ID NO: 151649 - protein, 146 aa, Glycine max
  Coding DNA Sequence Number=SeqID_34871
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=76%, HitCoverage=91%, E-value=3e-54, Identity=95%"; Hit description =Chloroplast 50S ribosomal protein L14
  Pfam annotation: Domain name=Ribosomal_L14; Domain location=25-146; Score=218.6; E_value=1.4e-62; Accession=PF00238.10; Description =Ribosomal protein L14pL23e
  Pfam annotation: Domain name=Ribosomal_L16; Domain location=1-76; Score=-36.3; E_value=0.0067; Accession=PF00252.8; Description =Ribosomal protein L16
  Pfam module annotation: Pfam domain module=Ribosomal_L14::Ribosomal _L16; Domain location=25-146::1-76
MSRNVRRGGQIWVRIFPDKPVTVRPTETRMGSGKADNSGARELMCIRILGASNRRYAYIGDIVVAVIKQAVPNTNLERSEVIRAVIVRTCKELKRSNGIIIQYDDNAAVVIDQEGNPKGTRIFCAIARELRQFNFTKIVSLAPEVL

SEQ ID NO: 151650 - protein, 183 aa, Glycine max
  Coding DNA Sequence Number=SeqID_34872
MASKKRKAPSTLTQARFDKSRFTSQEAWERYTDIVELKNFVDGSIDVAIVKEFYANLYDPEDKPPKQVKVRGCLVKFDVDTLNSFLKTPVILKEGENFPLNADGLPLKILRKNLTTLAQTWSVLSFSNLVPTSHTSDTALDRARLGFPALITALCKARGVVSDSLTLESLGAAINVAYVKKNY

SEQ ID NO: 151651 - protein, 38 aa, Glycine max
  Coding DNA Sequence Number=SeqID_34873
MEERRKRKGAAQGFLENVIFIEQDAWPSVLVSSITVFM

SEQ ID NO: 151652 - protein, 71 aa, Glycine max
  Coding DNA Sequence Number=SeqID_34874
MGAKHLARTKEKSHVIKQRSPDEIRDAKLAVYYPDEHQTPTDTTQHDQFVGYDSSDSSDDDVNMTQENIDI

SEQ ID NO: 151653 - protein, 88 aa, Glycine max
  Coding DNA Sequence Number=SeqID_34875
  Subcellular localization annotation: CTP_CleavageSite=55; ConfidenceScore=5.04e-01
GVQIAIRPTWTFQGVPTKGGSFWWKQPILPGRAELAWASWATTTSLFSPINRGKRAEQIRSTLLVSEIHLKLVRKIVSVKKIQAEALP

SEQ ID NO: 151654 - protein, 79 aa, Glycine max
  Coding DNA Sequence Number=SeqID_34876
MDGQWVRKQDLPPPIPDEHTPSPPPQRDSSSSLLNDVRTELWDLRAFVGDRFDAMDSRITCLEDDMSFIRHCFDPPADP

SEQ ID NO: 151655 - protein, 243 aa, Glycine max
  Coding DNA Sequence Number=SeqID_34877
  Gene Ontology: Mol. function=RNA-directed DNA polymerase activity; Biological process=RNA-dependent DNA replication
MSRFRVSDIVVTRRSLHTHSDYLNLVKEAWNRDDGGVIYGLNNVGKDSIVFNVEVKYYCKEEKCGSAKNIGTNVCPLPQEVIPNLVKLVTKEEVGDDVWRFVREAIQKVRWKPVKLTSNGPSVSHLLFADDVLLFAKGQASQAKLIMNILNDFSSLSGLKVSLEKSRIFASSAWKGRLLNKPGRMVMANVVMSFIPSWDAHLMNWEIISRPKRRGGLGVRVAKLQNTSHGNIFLAKKTKGFKT

SEQ ID NO: 151656 - protein, 124 aa, Glycine max
  Coding DNA Sequence Number=SeqID_34878
MSHFQGFFKGSVVTSKKPRKKSRELHFSIESLRWILKILLQLKCSSPCSGLKASNGSLWWPPVVMGNGGEGIALSALVSLSELSMGVICKITTVKTRRHESRNLQFKFEGDPTVNEFEVMVLLK

SEQ ID NO: 151657 - protein, 105 aa, Glycine max
  Coding DNA Sequence Number=SeqID_34879
MAGIESFNESLDDMVEEAHLVFDSMPQCVTMKVLKDVKFDPETYFSKTMTSNSLTVGSPSNLNCRFRDSCLRVLTVVILQITPMDSSLSETSALSAIPNPRVKFD

SEQ ID NO: 151658 - protein, 742 aa, Glycine max
  Coding DNA Sequence Number=SeqID_34880
  Gene Ontology: Cellular component=nucleus; Biological process =regulation of transcription
  Homolog annotation: Hit_ID=Q1T621; Match level="QueryCoverage=99%, HitCoverage=100%, E-value=1e-129, Identity=54%"; Hit description =GRAS transcription factor
  Pfam annotation: Domain name=GRAS; Domain location=360-656; Score =290.8; E_value=2.7e-84; Accession=PF03514.5; Description=GRAS family transcription factor
MKAVPLPYQEFRGNGVLDFASGAAAAVSDSLLLPQQEQFLQRWNPQRENFCYVGIEPSSGLDRKRKTSSPPTSSSTLSSSRASSGSTDSTTGTATATAAEKENNPPQAGLEVGQARCGLGMEDWESVLSESPGQDHSILKLIMGDIEDPSVGLTKLLQGGSGSQDVEFNGVGVGFGLVDQSSVLFPIPSVNFVSSSSSIDPSGTGNCSDFPFNSQTNVSPNVPRVGSGVNPNTTGFPASASNLSPVSLPQGVFLPQQQQQHHPPIEPLDEKLQVLNPQFILNQNQSQFMPNAGLVLPLTYGQLQENHQLLPQPPAKRLNCGPNYQVPKTPFLDSGQELLLRRQQQQLQLLPHHLLQRPSMVVAPKQKMVNSGGQDLATHQLQQAITEQLFKAAELIDAGNLELAHGILARLNHQLSPIGKPFQRAAFYFKEALQLLLHSNANNSSFTFSPTGLLLKIGAYKSFSEISPVLQFANFTCNQALLEAVKGFDRIHIIDFDIGLGGQWSSFMQELALRNGGAPELKITAFVSPSHHDEIELSFTQESLKQYAGELRMPFELEILSLESLNSASWPQPLRDCKAVVVNMPIGSFSNYPSYLPLVLRFVKQLMPKIVVTLDRSCDRTDAPFPQHLIFALQSYSGLLESLDAVNVHPDVLQMIEKYYLQPSMEKLVLGRHGLQERALPWKNLLLSSGFSPLTFSNFTESQAECLVQRTPSKGFHVEKRQSSLVLCWQRKDLISVSTWRC

SEQ ID NO: 151659 - protein, 69 aa, Glycine max
  Coding DNA Sequence Number=SeqID_34881
MWLFMILVEEVVITWLKMEGIGSDDSFKLPAYFYVCSLILKIHPWNSYVLMVVCWIKKPSQDEEQKGHF

SEQ ID NO: 151660 - protein, 74 aa, Glycine max
  Coding DNA Sequence Number=SeqID_34882
MHHQDPNPYPWPTPEQFRATIKWPRGGPIFQEEVGPAGEKGPIDDQGDAHDQGGGRADEDEDMADHADYFIGED

SEQ ID NO: 151661 - protein, 88 aa, Glycine max
  Coding DNA Sequence Number=SeqID_34883
MASGNRLLRVGNRLQGLKVKTGSYDGLWLRNGSGMLKGPLVIDYQCCVIDYTEEQATSNRVPVMCNRLHSAFYRFSCSEAVKFVFGLW

SEQ ID NO: 151662 - protein, 71 aa, Glycine max
  Coding DNA Sequence Number=SeqID_34884
MATQLIHDRVEMECLEGAWETLEGNVRCRFRGTIRFTATSLVHPEEPARTVEWILPTPTPYRLVEPVQVIE

SEQ ID NO: 151663 - protein, 98 aa, Glycine max
  Coding DNA Sequence Number=SeqID_34885
MGKFAVNEPMNESVNELLNESMNEPVNVNGQFYEDEVNTSDDDKSYEMDDVNLLRALFQQMRVIISLMKVSMILLVSMEIGVIKIRVIVLVILRKPAM

SEQ ID NO: 151664 - protein, 149 aa, Glycine max
  Coding DNA Sequence Number=SeqID_34886
MPELDVKKRGGYPNIDPSALKRLPERSRKTRRKSEVEGESGADNSESVQANFACSQQSKVTNQQTQIHSQVPDESSSGGVNTTEDTRAHLKKGKNLELKGRQGCRMQDCTTSILLLYLLAEFKSGGSTIMTIADVAARGLGRITACLEA

SEQ ID NO: 151665 - protein, 193 aa, Glycine max
  Coding DNA Sequence Number=SeqID_34887
  Homolog annotation: Hit_ID=Q1S9W4; Match level="QueryCoverage=38%, HitCoverage=21%, E-value=2e-08, Identity=56%"; Hit description=NAD -dependent epimerase/dehydratase; TonB box, N-terminal
DGETVGAAGGGRVANQLLPGTERRGEEVVGVGMDMVVAVGCIGGDEERVVEGEEEDEDECEQESGCCIALALCSCCKICNVDSNKFGMFDAHDCVNNIANDLDLPPCHPFILWFRSTVNGKILSFKVDADVSNIKDGFWNLPVIENVNEPVNENVNEGKFSYLRTQIARTSGEFGVVEQIASVNGNTSDQIAT

SEQ ID NO: 151666 - protein, 248 aa, Glycine max
  Coding DNA Sequence Number=SeqID_34888
  Gene Ontology: Mol. function=RNA-directed DNA polymerase activity; Cellular component=intracellular; Biological process=RNA-dependent DNA replication
MAPDRVQLQNMCKRYIESVKECAQRWRDLVAQVVPLMTKTEMITMIMDALPVFYYEKKVGCMSSNFVDLVFVGEMIEVGLRKGNFDYAASTNSSNRRPAMSGGKKKEGEAHVVTTDLLPYLLNNEMVAISPTKIPQPTFPQGYNPNVTCAYHGGAPGHSIEHCMALKHKEDNPNVRTNLLANNGSSSMSVIEDEETWELKRRADKVDYKGDEEDWCLLHPKTLHDVQVCPMFKELLKGLMNESDSCYL

SEQ ID NO: 151667 - protein, 125 aa, Glycine max
  Coding DNA Sequence Number=SeqID_34889
MIRGDTLRLSAPFCHPEAAGPMTSRDQVWSFCTLVSSRGGGPDDTRKYPSDRTLDSMQRLTQSSAPFVPPGTASHLHAEIFMVTRDSRQPRGAKLVSYTDFSSGDLCLMTCDHSLVLVRCLASHH

SEQ ID NO: 151668 - protein, 100 aa, Glycine max
  Coding DNA Sequence Number=SeqID_34890
  Pfam annotation: Domain name=G-patch; Domain location=44-87; Score =25.1; E_value=0.00017; Accession=PF01585.13; Description=G-patch domain
MDSRARSGPFNASLEIEIREDMLVSCPSSTAYVEAAEESLETALQSFEVVMLKHGYEPGMGLGKDSHGNVDVVDIRGNPYKYGLGYEPGKPGRRNAPSRL

SEQ ID NO: 151669 - protein, 53 aa, Glycine max
  Coding DNA Sequence Number=SeqID_34891
MQNSGVNLRAKSQQFATAHDDNPHVVTMPYFGVIEEIEEISRSSLIRMSFSSW

SEQ ID NO: 151670 - protein, 90 aa, Glycine max
  Coding DNA Sequence Number=SeqID_34892
MDKFGAIQGSNPPFLFWEMTSAGLFPCKLRGFQVLASPCALQILTQNHNEQDMLEDDEMSFFNQERFDMPDEESVSQITLLYMPLLPRQR

SEQ ID NO: 151671 - protein, 305 aa, Glycine max
  Coding DNA Sequence Number=SeqID_34893
  Gene Ontology: Mol. function=oxidoreductase activity; Cellular component=membrane; Biological process=electron transport
  Homolog annotation: Hit_ID=Q9FHC8; Match level="QueryCoverage=91%, HitCoverage=67%, E-value=1e-45, Identity=35%"; Hit description =Cytochrome P450
  Pfam annotation: Domain name=p450; Domain location=2-300; Score= -171.3; E_value=0.0036; Accession=PF00067.12; Description=Cytochrome P450
KKFKIFLQLTIQKKIENCLIPFLMMHPKLELRWTCKMPFRGSPLTLPAPVFLDIYDPICLPNMFTKLSHFAYQKALIVMEDVAFHRHITPRCLWKLQEWLQIGQEKKFKEAIKAFDKFLHERIASKREEQSRCNNHTKKEDDNTHSDLIRVLMEEGAEKGKIMDDKYLRDTAFTLVSAGSGTVSAEFGKLVYLHGAICEALRLFPSIPFDHKCTIKSDILLSGHHVSPNTMIFYSLYSMGRMERIWGPRSCLGKDITFIEMKMVAVALLWRFHMQVVEGHPITPRLSITLGTEHGLKVKVTERCI

SEQ ID NO: 151672 - protein, 501 aa, Glycine max
  Coding DNA Sequence Number=SeqID_34894
  Gene Ontology: Mol. function=oxidoreductase activity; Cellular component=membrane; Biological process=electron transport
  Homolog annotation: Hit_ID=O22189; Match level="QueryCoverage=98%, HitCoverage=95%, E-value=1e-114, Identity=42%"; Hit description =Putative cytochrome P450
  Pfam annotation: Domain name=p450; Domain location=26-500; Score =74.7; E_value=2.9e-19; Accession=PF00067.12; Description=Cytochrome P450
MFMYIGVFVSILSTIIFFRKHNRDEPITNWPIIGMLPSVLQNLSNIHYLTTEALKHYGGTLMFKGPWFTNTNFILTSDPMNVHHITSKNFGNYGKGSNFNEIFEVLGGGIINSDDLHAWKQERTMLHSLLKRESFKIFLQKTIQKKLENCLIPFLDHASKAGAEVDLQDAFQRFTFDNACCMAFGYDPNCLPNKFSTKLSHFAYQKALIVLEDVAFHRHITPRCLWKLQEWLQIGKEKKFKEAIEAFDKFLFERIASKREEQSRCNNHTKKEDDNTHSDLIRVLMEEGAEKGKIMDDKYLRDTAFTLVSAGSGTVSAGLSWFFWLVSTHPDVEAKIFQEIKDNCVNQDGDWIASSVEEFGKLVYLHGAICEALRLFPSIPFDHKCAIKSDILPSGHHVSPNTMILYSLYSMGRMEQIWGDDYLDFKPERWISERGNIIHIPSYKFIAFNAGPRSCLGKDVTLIEMKMVAVALLWRFHMQVVEGHPITPRLSMILAMEHGLK

SEQ ID NO: 151673 - protein, 333 aa, Glycine max
  Coding DNA Sequence Number=SeqID_34895
  Gene Ontology: Mol. function=signal transducer activity; Biological process=response to light stimulus
  Homolog annotation: Hit_ID=Q7XIJ3; Match level="QueryCoverage=62%, HitCoverage=44%, E-value=1e-29, Identity=37%"; Hit description =Putative phototropic response protein family
  Pfam annotation: Domain name=NPH3; Domain location=47-266; Score =174.2; E_value=3.3e-49; Accession=PF03000.5; Description=NPH3 family
  Subcellular localization annotation: CTP_CleavageSite=36; ConfidenceScore=5.69e-01
MDQNYEATLFNSSSSSSPSSPESSSAKRFSYSSRVTPKTVKSTLPNKAGWFEDLATLPPKIIEKILQTIGAYKTDNNNLIITRFLLHYLKIVTPTREVNCNNSVEYAGLAETAVYGVIFVGNKSFSCRGLFWVLRIVSRFGMSRDCRIEIEKLIGGVLEQATLDDLLFSGHHMGLYYDVTFVIRLIKQFVDMNGSDGVCVQKLKKVGRLVDKYLIEISPDQNLKVTKFLAVAECLPDCARDCFDGVYRAIDIYLQESKTSTGQLSRPPWSHTLFLLHLLCIINFLKNHMNCEISKTQTKIKDKGKYSDQMGSDLAKCWHYYKVSFVLIICNFD

SEQ ID NO: 151674 - protein, 43 aa, Glycine max
  Coding DNA Sequence Number=SeqID_34896
TPPALSTLISRLAHGLDADAMPDSSVVLSALKLLLVVDARLAY

SEQ ID NO: 151675 - protein, 257 aa, Glycine max
  Coding DNA Sequence Number=SeqID_34897
  Homolog annotation: Hit_ID=Q1S5P6; Match level="QueryCoverage=29%, HitCoverage=13%, E-value=2e-23, Identity=69%"; Hit description =Ankyrin
MSNATQDKHEAEEFYELAKDEEPPLYEGCTKYSRLSFLVKLHHIKCGMSDKAMTMILELLNDAFGHAKIPSSFCEAKKIIPHTFEFDSRTVVRNRDEVESQQCTKEEMYPNSHRKKDGSFVNEAARQEYEQLHNEIQKTSSKNKAFARAFEKEHPEYVGGMELGVTPSHDTESISHSTRSVSSSESVKMRKLQVEINALKDQVAQVDVLKEQVDFLMQNVKGNKLGQEIQDVRLTLVMCLKIMEHHHGGQFKYFFYL

SEQ ID NO: 151676 - protein, 166 aa, Glycine max
  Coding DNA Sequence Number=SeqID_34898
  Subcellular localization annotation: CTP_CleavageSite=90; ConfidenceScore=5.20e-01
MAAGSNTGFHCDDMGSALNWHGAVSSLPEMVPMGNYFGLNSNTSGMTMMMYSGNSSVNNNVYEPVTSQPGNASGSSLPLDSAPGLRNEERLAAEWSVDEQCKLEEGLAKKKKNYLRERRNRTRRRTRNCKGKKTLDTTRKVKKLKEYSYNASSLCLSEGAILLRLL

SEQ ID NO: 151677 - protein, 122 aa, Glycine max
  Coding DNA Sequence Number=SeqID_34899
  Gene Ontology: Mol. function=DNA binding; Cellular component=nucleus
MARYDDEPSFMKYIKIASTLHDKTVRDVALRCTWMTRKRRKPEEPMVKMVNNRKDKLVKSSSKQYFQSTPTPSMTTYSLISNHMNKSQGILWQDGKYIISSHHCKCNTNISDFEVPIQFGQG

SEQ ID NO: 151678 - protein, 293 aa, Glycine max
  Coding DNA Sequence Number=SeqID_34900
  Gene Ontology: Mol. function=protein disulfide oxidoreductase activity; Biological process=intracellular signaling cascade
  Homolog annotation: Hit_ID=Q67UI1; Match level="QueryCoverage=51%, HitCoverage=21%, E-value=9e-21, Identity=36%"; Hit description =Glutaredoxin-related-like protein
  Pfam annotation: Domain name=Glutaredoxin; Domain location=136-195; Score=57.1; E_value=5.8e-14; Accession=PF00462.14; Description =Glutaredoxin
MGSEVVEEPTETTSLSSPRKIQTNDAPTANCHVSVTPTTLSIVQPHSLLPKPVPPTTTYSPNDVVVSSSATFAKFLRQRRNDLSSAISKGISTLKHSINDQNDCNCVTEFNLSGLKVFVTVENKNDASFARGRMRISFFSRSNCRECCAVRRFFRERALRFVEINVDVFAEREKELRERTGSATVPKIFFGEKLIGGLVELNALRKDGGEELERRLTAAVGEGPSAPAYGFDEAAEVEEEEEEEEEIGRVVRVLRQRLPIQDRWMKMKIARNCFAGSELVELLVRHHGCAPSK

SEQ ID NO: 151679 - protein, 96 aa, Glycine max
  Coding DNA Sequence Number=SeqID_34901
MEEFDAQVAWLGAQPSPSRGGGASAAQEPASEEPTAAATEGEDELTPPEPFYFDACIHMAQEEDASTDQIPESSPTPIHDDASPSALAFELEHPIS

SEQ ID NO: 151680 - protein, 108 aa, Glycine max
  Coding DNA Sequence Number=SeqID_34902
  Gene Ontology: Mol. function=nucleic acid binding; Biological process= DNA integration
  Homolog annotation: Hit_ID=Q1SLU0; Match level="QueryCoverage=61%, HitCoverage=11%, E-value=9e-15, Identity=42%"; Hit description =Peptidase S8 and S53, subtilisin, kexin, sedolisin; Integrase, catalytic region
MYVGGPQRTSLNALVENQSGGRLRIIRSDNGKEYVNDTFHKFCEEADIEHQLTVPYTLQQNDVKRDKLDKKAEPRVFIGYNKSTATPMNQREKFNKEDGADKVERSMI

SEQ ID NO: 151681 - protein, 146 aa, Glycine max
  Coding DNA Sequence Number=SeqID_34903
  Homolog annotation: Hit_ID=Q1T344; Match level="QueryCoverage=68%, HitCoverage=36%, E-value=2e-15, Identity=37%"; Hit description=RNA polymerase, RBP11-like
MLIVQTLLILLRSDTDTGRRERSSFVLIACERSGQYKCRNKEFVRRDTSTRKCGCSFRLHEKPVRGGEGWMVKLICGMHNHELAKSLVGHPYAGRLTKVEKNIIEDMIKSMVKPRNILPNIEGTQCPQLHHNQTNLQCKKCISFFN

SEQ ID NO: 151682 - protein, 167 aa, Glycine max
  Coding DNA Sequence Number=SeqID_34904
  Homolog annotation: Hit_ID=Q1SAJ3; Match level="QueryCoverage=54%, HitCoverage=20%, E-value=4e-24, Identity=54%"; Hit description=WD-40 repeat
MEHFNNDDLEYVVDEYYDVPDFAVEDTSSDIVPELTSDVDSDFEDEFPTSNAKTDTTASEARNGKDIQGIPWERLNYSRDKYRETRLKQYKNYQNFSRSRHDLRKECLEVQKGETFYDFFFNTRLVKSTIVHFQINGFFALIRAGSSYCCSQPYLAELSDCEKFCYA

SEQ ID NO: 151683 - protein, 51 aa, Glycine max
  Coding DNA Sequence Number=SeqID_34905
MEEARRVMRTRRMGLLCTFAMSDDKTALNWTPTAIEIAFLPEWADWDHIRS

SEQ ID NO: 151684 - protein, 107 aa, Glycine max
  Coding DNA Sequence Number=SeqID_34906
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6Z8I7; Match level="QueryCoverage=83%, HitCoverage=15%, E-value=1e-19, Identity=55%"; Hit description =Putative beta-D-xylosidase
MLRTLFIIPKCSLAQIDQAVEVAKKLEYVVLVMGLDQSEEREERDCVHLDLLAKQLELINSIAEAYKKPIILVLLSGGPIDTSSAKWKTTNYLVPKRYYIKVPMTDM

SEQ ID NO: 151685 - protein, 204 aa, Glycine max
  Coding DNA Sequence Number=SeqID_34907
  Gene Ontology: Mol. function=transition metal ion binding; Cellular component=cytoplasm; Biological process=electron transport
MQRGSQSEPFDVEIRDRLEDMIRDHEQESFQQAHAFMYDTLQIDSKKPLYLGCNNSLTLLLVVLSLVNAKTRYGWSNKSFSLLLQLVHDMLPEENTLPKSYYQAKKILCPMGMKYQKIHAYPNDCILYIHEFKEMHKCPRCGVSQYKVKDDDECSNDENSKKGPQAKVLRYLPIIPMFKNLFANGDDTKDLTWHANGRNYDGMC

SEQ ID NO: 151686 - protein, 133 aa, Glycine max
  Coding DNA Sequence Number=SeqID_34908
MDNEWKIEVMGRRSWSRKDLSKLKGMIPIPSLYLCFTAPIGHVSQCSKIKMRMNWKKGNHQFTKLFMLKIRVEAVFSSLGKSFIEFKKQTSNFRERSLNTFVVRAFWQINFGCRQDGGRFEEFTRTMELLYRI

SEQ ID NO: 151687 - protein, 73 aa, Glycine max
  Coding DNA Sequence Number=SeqID_34909
QQNPCGTTLGLPIDYYYERFGTLAKELTVGSHCSLALKKHDDNVILHVNIANPQPAIVYASSSSIYNHNTQRK

SEQ ID NO: 151688 - protein, 213 aa, Glycine max
  Coding DNA Sequence Number=SeqID_34910
  Homolog annotation: Hit_ID=Q1SP02; Match level="QueryCoverage=79%, HitCoverage=37%, E-value=4e-20, Identity=35%"; Hit description=IMP dehydrogenase/GMP reductase
CWIYEHFPSVHQCVINDAYEEKSLRASRWLTTKAHMKGITRVPYRARCDALTVTDVCWLPYTEHRGVKGFELISSFQGQLRWGPMVVTARPERVLRQFGYIQSIPPPPVSASLSYDDINDRWVHFADHVLAVGELCADYMEWFFRISHPFMISTQAGDQPRHAPTPDHEEYMQPAIPQVPVAFDPPPLAVDDYEGYEAIAERLERVLNLRMVT

SEQ ID NO: 151689 - protein, 61 aa, Glycine max
  Coding DNA Sequence Number=SeqID_34911
MAEDLTEHVIDFWAELPRADEDFLGSIRSWKNLQIALEDETIWLKGFTEEQAASPEDKAKT

SEQ ID NO: 151690 - protein, 131 aa, Glycine max
  Coding DNA Sequence Number=SeqID_34912
  Gene Ontology: Mol. function=nucleoside-triphosphatase activity
  Homolog annotation: Hit_ID=Q11UF1; Match level="QueryCoverage=78%, HitCoverage=27%, E-value=2e-29, Identity=63%"; Hit description =Possible ATPase
  Subcellular localization annotation: CTP_CleavageSite=4; ConfidenceScore=5.03e-01
MALRVFILFDGPVNDPFQNFNLLFRIPDMFQYPKVGKYCFTSPANQSTCSNKVLKFYRSTVGNCNSGIPETDYGIEVNFINRFQIHCFTKVLKLSYFLGPNFRNIPFPLHFLIFFLLKEPVEAAQDSHNLH

SEQ ID NO: 151691 - protein, 68 aa, Glycine max
  Coding DNA Sequence Number=SeqID_34913
MCLIFDVLRVGCAKLSWTCISLVYVSMLKLIGMDYSVVQLSERDYGHTKADSNLQISSQQRIIRKWRI

SEQ ID NO: 151692 - protein, 469 aa, Glycine max
  Coding DNA Sequence Number=SeqID_34914
  Homolog annotation: Hit_ID=Q1SR88; Match level="QueryCoverage=30%, HitCoverage=33%, E-value=9e-09, Identity=28%"; Hit description=IMP dehydrogenase/GMP reductase
  Pfam annotation: Domain name=DUF674; Domain location=1-460; Score =211.4; E_value=2.1e-60; Accession=PF05056.3; Description=Protein of unknown function (DUF674)
MASKQEPKLSLTLLVDKERNCVVVAEASGDLIDILFSFLTLPLGTIIRLVSKKQGHDEADEIGCINNLYQSLENSGDEVFWNHICKRMLLCPRNPCEALCQKLKVKLDDSKPMKYFMCSSRCRRGGDWFLSTFAEASCHCGKLMDKEMKQHGDSNEGTHGDGVFVKGQTMYLIFDDLRVLESSPGNSAQQLVQLGYKNFQKLIKRSLNVGIKEILDILKHALTSKSPLSDVFLGNGVSKRMCAFSPKPRPENQGWKNYNSMINIKVTVRKSKKTILYAESEGDFVDFLFSFLTTPLGSILKLLDGNFSLGCMNSLYESVKDLNPSWFTNPSGTPLLNLRVAPQFGCKRQPTQLCEEDTPCYWYGTGVIKSNICYSIGNGVVSKDHSLIQHPGAMKLFDPRSPNGTKESSVGFVRRPSLFVVWDDLQVTPLANTSSISLLQKLNVPLDNLEEHELRIGEIEVTVHSLLIL

SEQ ID NO: 151693 - protein, 190 aa, Glycine max
  Coding DNA Sequence Number=SeqID_34915
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=51%, E-value=6e-32, Identity=50%"; Hit description =Integrase, catalytic region
MPHFQFLDDLKRELPNIDEFVTLLKVFLCLAEWCYNTTCHSTTNLTPYEITYGKPPPSILQYISGTSSVEGVDFLLASRQDTFQHLRKKLKRAQDQMKKVAEGHHRDMVFAIGDWAYVKLRPYRQSSLFGITYQKLGKCLIMDQSILSTPSSNSCRGKASYPAANYSGSQVGFFRSIQALGSRAMAQFAT

SEQ ID NO: 151694 - protein, 145 aa, Glycine max
  Coding DNA Sequence Number=SeqID_34916
MADNNQTLKELATLDVVYQPWCIQYPETKMLMDRSMIDAASRATLMDKTPIATKQLISNMVANYRQFGTRVATPSRVAAPSRVAASEVSVSMVTDNQKLENKLTELTSLMRQLAIGQQNVMAANQPRLCGICCAPDHPTDAYSTL

SEQ ID NO: 151695 - protein, 419 aa, Glycine max
  Coding DNA Sequence Number=SeqID_34917
  Gene Ontology: Mol. function=RNA-directed DNA polymerase activity; Cellular component=chromatin; Biological process=chromatin assembly or disassembly
MANNTCSQTLTRLGLEEAVTLLTQNQSSLHSKIDEVISRLNALKIGSVGHPPWSHPPRMKLDVSWFDGSNAMSWTFKISQFFEFHGTPDDERLQALEMCFAPSFYDNLREFSSNFYHPRFASRFRLSRLYPSFRKSLWPNCRRINRIISNTLRVDGSINEHNVVVLIDGGVEKCFCYYPRALVLCGPISYGPWGADLIFGVEWLKHMGPITTEYSSLTMSFNWGNELVKLRGCTGPSPTEETPGLVKHMLHINGVATFFQLQLCASSDNPYEPSTILLPSQLQLLLNIYSPIFQQPTTLPPQWTIDHTIHLIPNSQPPLLFPSIALKKKDGTWCFYINYHALNTITVKEKFPLPTIDELLDDLGHATWFSKSDLTQGFHQIRMASAYVSKTVFHTHQGHYEYNVIPLSLCNASLMFQQQ

SEQ ID NO: 151696 - protein, 68 aa, Glycine max
  Coding DNA Sequence Number=SeqID_34918
MLDFMKVAWLIRGCRYELFWVVVMGGNGGGKEKDKEEEIYILRQFLAVNIFVPLTVTLDGQKDYFELI

SEQ ID NO: 151697 - protein, 313 aa, Glycine max
  Coding DNA Sequence Number=SeqID_34919
  Gene Ontology: Mol. function=transporter activity; Cellular component= intracellular; Biological process=transport
  Homolog annotation: Hit_ID=O22270; Match level="QueryCoverage=80%, HitCoverage=84%, E-value=1e-80, Identity=54%"; Hit description =Putative phosphoglyceride transfer protein
  Pfam annotation: Domain name=CRAL_TRIO; Domain location=138-304; Score=21.1; E_value=2e-07; Accession=PF00650.10; Description =CRALTRIO domain
  Pfam annotation: Domain name=CRAL_TRIO_N; Domain location=43-121; Score=41.9; E_value=2.1e-09; Accession=PF03765.5; Description =CRALTRIO, N-terminus
  Pfam module annotation: Pfam domain module=CRAL_TRIO::CRAL_TRIO_N; Domain location=138-304::43-121
MEVNLSESVTKLNYKLCRSDINGREIEVLWKNVAVYNCCMSVDLNKTASNGHDKMVISQEHQAKITKVRGLIGPLSDKESVYCSDASISRYLRSRNWNVKKAAQMLKQSLKWRKEYKPEEIRWEEVAAVAEKGMLYRPNYCDKYGRPVIVMRPCNKKSTPAQDMIKYFVYCMENAIIYLSPHQEQLAWLIDFQGAKMSDVSFKTSRETIHILQEYYPKHLGLAMLYKAPRIFQPFFTMLRPFLETELYNKVKFGYSDDLNTKKMLEDLFDMDKLESAFGGNGDTGFDMNRYAERMKEDESKIISFWTQAKPVS

SEQ ID NO: 151698 - protein, 89 aa, Glycine max
  Coding DNA Sequence Number=SeqID_34920
MAQASSIERDTLKASSGNSIRSLEEIHIRWIPPIPPWHKVNVDGPYRKASSSAACRGLIRDHIGRFIKGFSTNLGCCNALWAKLWALYK

SEQ ID NO: 151699 - protein, 343 aa, Glycine max
  Coding DNA Sequence Number=SeqID_34921
  Gene Ontology: Mol. function=transporter activity; Cellular component= intracellular; Biological process=transport
  Homolog annotation: Hit_ID=O22270; Match level="QueryCoverage=83%, HitCoverage=93%, E-value=4e-78, Identity=49%"; Hit description =Putative phosphoglyceride transfer protein
  Pfam annotation: Domain name=CRAL_TRIO; Domain location=136-304; Score=45.2; E_value=2.2e-10; Accession=PF00650.10; Description =CRALTRIO domain
  Pfam annotation: Domain name=CRAL_TRIO_N; Domain location=41-119; Score=44.9; E_value=2.6e-10; Accession=PF03765.5; Description =CRALTRIO, N-terminus
  Pfam module annotation: Pfam domain module=CRAL_TRIO::CRAL_TRIO_N; Domain location=136-304::41-119
MPPFNDETKINNILEFTLVPSKFSLRYIGGSHRFCLSMSQELKKAASKGHEKMVTSQEEQAKITEVRGLIGPLSDKESVYCSDASISRYLRSRNWNVKKAAQMLKQSLKWRKEYKPEEIRWEEVAEEAQTGMMYKPNYHDKYGRSVLVMRPCVQKSSSTQGQIKYFVYSIEHAILNLPPHQEQMVWLVDFQGFKLSDISFKVARESAHILQEYYPKQLGLIILYNAPMIFQPFFSMVKPFLETETVNKIKFGYSNNHNTKKIMEDLFDKDNLESAFGGNGDTGVDINKYAERMKEDDNKKHSFWTQAKSISSVAQNAPSDSIRLDAVSDASNTKKIDCSRVPN

SEQ ID NO: 151700 - protein, 318 aa, Glycine max
  Coding DNA Sequence Number=SeqID_34922
  Gene Ontology: Mol. function=intramolecular transferase activity, phosphotransferases; Cellular component=cytosol; Biological process =metabolic process
  Homolog annotation: Hit_ID=Q6Z8J0; Match level="QueryCoverage=81%, HitCoverage=82%, E-value=1e-103, Identity=69%"; Hit description =Putative phosphoglycerate mutase
  Pfam annotation: Domain name=PGAM; Domain location=94-268; Score =125.4; E_value=1.6e-34; Accession=PF00300.12; Description =Phosphoglycerate mutase family
  Subcellular localization annotation: CTP_CleavageSite=80; ConfidenceScore=5.33e-01
MAAEVYYQAIGTLQSHSYLNNLNHHQKHQNNLVTLVSRDFISSNGLSTRRSNCTGQRNCSVIRSLASQTSVVDPVLSPSRSNAGDTYKKSNEAALILIRHGESLWNEKNLFTGCVDVPLSKKGIDEAIEAGKRISSIPVDVIFTSALIRAQMTAMLAMTQHRRGKYTSKMLFPKSSTSQQVPIMMHNESEQARYGELQGLNKQETADRYGKEQVHEWRRSYDIPPPNGESLEMCAERAVAYFRDQIEPQLLSGKNVMISAHGNSLRSIIMYLDKLTSQEVISLELSTGIPMLYIFKEGRFIRRGSPIGPSEAGSLCLY

SEQ ID NO: 151701 - protein, 158 aa, Glycine max
  Coding DNA Sequence Number=SeqID_34923
  Gene Ontology: Mol. function=nucleic acid binding; Biological process= DNA integration
MRKLGVERAKDVLELVHTSICDDYSGYGYLYLIHEKSQSLNAFKSFKVEVELQLGKKIKVVKFDRGESLREEALKTATYILNRGYKFHGPILRSFFEMGNKRFLEKVEFRKEENIRNVAFKEEPVIDNAQVLIPITVQETTLIIENNVPIIVDDIVQE

SEQ ID NO: 151702 - protein, 88 aa, Glycine max
  Coding DNA Sequence Number=SeqID_34924
MSNLASKLKALTLELGEDLLNKKTKGVVEGSSQQKKQKKDENFTYYFFKKFGHMKECPRVVYGADYMTSDDERFIFMGDDKRVAVKAI

SEQ ID NO: 151703 - protein, 64 aa, Glycine max
  Coding DNA Sequence Number=SeqID_34925
  Homolog annotation: Hit_ID=Q9LV14; Match level="QueryCoverage=92%, HitCoverage=11%, E-value=1e-07, Identity=50%"; Hit description =Arabidopsis thaliana genomic DNA, chromosome 5, P1 clone:MRG21
MKTTKGGKVMNPTDAYRKELRKKELKRNKKERKKVREVGILKKDPDQLKKQIDNLEMMKSSIKF

SEQ ID NO: 151704 - protein, 1616 aa, Glycine max
  Coding DNA Sequence Number=SeqID_34926
  Gene Ontology: Mol. function=nucleic acid binding; Cellular component= intracellular; Biological process=ubiquitin-dependent protein catabolic process
  Homolog annotation: Hit_ID=Q10RB2; Match level="QueryCoverage=100%, HitCoverage=99%, E-value=1e-155, Identity=41%"; Hit description =Ubiquitin carboxyl-terminal hydrolase family protein, expressed
  Pfam annotation: Domain name=DUF627; Domain location=63-185; Score =24.5; E_value=6.4e-09; Accession=PF04781.3; Description=Protein of unknown function (DUF627)
  Pfam annotation: Domain name=DUF629; Domain location=334-863; Score =51.7; E_value=2.5e-12; Accession=PF04780.3; Description=Protein of unknown function (DUF629)
  Pfam annotation: Domain name=UCH; Domain location=1286-1603; Score= -12.1; E_value=9.6e-06; Accession=PF00443.19; Description=Ubiquitin carboxyl-terminal hydrolase
  Pfam module annotation: Pfam domain module=DUF627::DUF629::UCH; Domain location=63-185::334-863::1286-1603
  Subcellular localization annotation: CTP_CleavageSite=50; ConfidenceScore=5.11e-01
MGHKKRNPAPRSKQSPPAAANGGSATSPDADSAFNNVSDHNPRKIELASPQSEGSDYSTVKLECERALTTLRRGNHTKAMKQLKEICAREEGSPHAAFVNRVHSLMCFKTATVITDPSSKQRHLRNALESARRAVELMPNSVEYAHFRATVMLEAASEGKDYEEVVHECERGLAIENPSDPAKETLQDESEHKALSLEERIGHVQNELRQLIQKSNIASLSSWMKNLSNGEERFRLIPIRRTPEDPMEVRLVQTRRPNEIKKVTKTPEERRKEIEVRVAAARLIQKNSESPQLPNEGDRDDRPLDSSVGSGQRIGDRRRHVNARKSGFSAERMKWVHSYWNSVSMDLKKDFLRVKIYDLKSHYGSSKDTLPNDILSEALFYAEANKTWKFWRCCNCEEKHSNPDSHRHHVVQEHMGSLSPQMQRLLPQNVDSEWIEMILNCSWNPLDVLAAVRMLDNKAKLKSSPLPEDLYLDHHALDYNDCFKDASSSYIEKESSGDSRRNCSVECNNHCKIENDVREGVEDQLSMANPIIDCWPVSDDPERAKLLGKIHAIFETLIRHKCLAASHLNKVIQFTMGEIQGLAAGSQLLNHGVDQTPMCICFLGATQLKTIFQFLQEISHACGLARNADKGGSPTNDLLNISQGPEIKDKIVLDGDASCLLLDEYLLQTQVTAGTVQGAILDDVTTPSSPDGISCYNDALLSWIFSCSPIGDQLTSWLRTREDKLNKGKEIVQLLEKEFYHLQGLCEKKGERIAYEEALQTVEDLCLEEGKKRETVGEFVQRSYESVLRKRREELIESENDMMYVSNKFELDAISNVLQEAEARNVNQFGYDETYAGVTSQLCDLESGEEDEWRMKDYLHQMDGCIENAIQKLKEHLSIELSKIDARIIRSVTEMQQLEFKLGPISANDYRAILVPLVKLYLRALLEDLAEKDAREKSDAVSEALLAELALDSKKAVKGGSESARHVEKTKDKKKNKDHRKARDFKVTSGHAHFSLGSTTPDSNLVAPESDFPDNEVVSMNDDDLEQLEEEFRRKIELEEEEKKLEETLEFQRRIENEAKQKQLAEQQKKSSGLYLEGVVDKLQDSETKVDAYPPDAHEHVGVPVQDQLVKENGSQSSLDGVLTPTANGSLDNYSHQSNTSLPNGVVPENGLDRRAGKKHKRKNSSRQVDGKFEFISSAKDNIEDTHTDYHPREQFKFDNNQDVNNVWQNNGSKVMGELQVEDAEEERFQADLKMAVRQSLDTYQARGNSHSVSSLRMSQRASSQEDSVDCLPVEDSTDNVNGATLLGTGLKNEVGEYNCFLNVIIQLQSLWHLRRFREEFLGRSRSEHDHVGNPCVVCALYEIFTALDTASKDSRREAVAPTSLRIALSNLYPHSNFFQEAQMNDASEVLAVIFDCLHQSFTRGSSVSDAESAESNCTGSWDCANGSCIAHSLFGMNIFEQMNCYHCGLESRHLKYTSFFHNINASALRTMKDMFAESSFDKLLNLVEMNHQLACDLEAGGCGKLNHIHHLLSTPPHVFMTVLGWQNTCESANDITETLAALSTNIDISVLYPGLDPKCIHNLVSVVCYYGQHYHCFAYSHNHEQWIMYDDKTVKVIGGWADVLTMCERGHLQPQ

SEQ ID NO: 151705 - protein, 175 aa, Glycine max
  Coding DNA Sequence Number=SeqID_34927
QAWGGTWTTMLVYHSTSRLPGSKAQAILMDFSEYLFQVCYMLIYALRLNDHVIQAKGHDPTAEDSILNDECRFLFIQDAPSTSLSMLGKGYVSLGHALLIFDHDDVGKPSKKFIYAFVLVVGEVLTKLCTLPGFVFELQFEKFFNRLWAFINSVIPQIYIEYVVQTCLVDSQGSD

SEQ ID NO: 151706 - protein, 131 aa, Glycine max
  Coding DNA Sequence Number=SeqID_34928
CDDLDVELPGCWGSLGGLMGTRGWWVYARFVDVENLLWTIARPPPSTTCDGVVPGDMSRGSGDLGDVRRAPGSQQIKGTKTTKQGGLCGGWPAVNLVLQKGNWEIVEASGNRLPVCVIDYTEEWVTGNRLP

SEQ ID NO: 151707 - protein, 258 aa, Glycine max
  Coding DNA Sequence Number=SeqID_34929
FYANLYDLEDKSPKQVRVREHLIKFDADALNTFLKTPVVIEEGESFPAYSRFANLRPDPQELATCLCIPGKEFEQNADGLPLKILRKNLTTLAQTWSVLPFSNLALTFHTSDITLDRAKLIYGLVMLMNMNLGSLISCQISLIAQHYSSRIGFPALITALCKARGVTSDSLTFESLSPIINLANINKNCWNLDDPSITFWVTRKSKAKGSKAPSTSAPPTSAPSTYPLPPPPAAPVHQGPSAQSLPCLCCRAYIRANS

SEQ ID NO: 151708 - protein, 406 aa, Glycine max
  Coding DNA Sequence Number=SeqID_34930
  Gene Ontology: Mol. function=protein serine/threonine kinase activity; Cellular component=spindle; Biological process=protein amino acid phosphorylation
  Homolog annotation: Hit_ID=Q9M3V7; Match level="QueryCoverage=91%, HitCoverage=87%, E-value=1e-110, Identity=54%"; Hit description=S6 ribosomal protein kinase
  Pfam annotation: Domain name=Pkinase; Domain location=83-335; Score =255.5; E_value=1.1e-73; Accession=PF00069.15; Description=Protein kinase domain
  Pfam annotation: Domain name=Pkinase_C; Domain location=355-397; Score=41.8; E_value=2.4e-09; Accession=PF00433.14; Description =Protein kinase C terminal domain
  Pfam annotation: Domain name=Pkinase_Tyr; Domain location=83-319; Score=-0.8; E_value=2e-12; Accession=PF07714.7; Description=Protein tyrosine kinase
  Pfam module annotation: Pfam domain module=Pkinase::Pkinase _C::Pkinase_Tyr; Domain location=83-335::355-397::83-319
  Subcellular localization annotation: CTP_CleavageSite=58; ConfidenceScore=5.62e-01
MVSTFEKKKNLSKLIIPSSSSSPNPSPSSPHVIFSRSHSFVGPSPRFVPSSTPLFFLEEEEEEEEEEELPFGPDPPKIGPSDFHILRVVGQGAFGKVFLVRKKGDCFDDADGVFAMKVMRKDTIIKKNHVDYMKAERDILTKVLHPFIVQLRYSFQTKSKLYLVLDFINGGHLFFQLYRQGIFSSEDQARLYTAEIVSAVSHLHKNGIVHRDLKPENILMDADGHVMLTDFGLSKEINELGRSNSFCGTVEYMAPEILLAKGHNKDADWWSVGILLYEMLTGKREHSKDMKKNIGECRDTGKVPALGHDLLQKDPSTRLGNGPNGDGHIKSHKWFRSINWKKLEARELEPKFKPDVSAKDCTSNFDQCWTAMPADDSPAPTPTAGDHFQGYTYVAPNPWLSSRSLD

SEQ ID NO: 151709 - protein, 96 aa, Glycine max
  Coding DNA Sequence Number=SeqID_34931
  Homolog annotation: Hit_ID=Q1SJS8; Match level="QueryCoverage=48%, HitCoverage=6%, E-value=2e-09, Identity=65%"; Hit description =Galactose-binding like; Alpha-L-arabinofuranosidase, C-terminal
MQSKQKDLELEDNALIFVGGKVSVDILLLMKLLSFAVGVLPDHVPKVYETPSYRVQFMFRESNGATFLKSQLQTPDPDSVDASAILWKNLQDKKLT

SEQ ID NO: 151710 - protein, 276 aa, Glycine max
  Coding DNA Sequence Number=SeqID_34932
LPYERCAPEETIAPFVARGFNEGNAKILQRICKAWNTVERKDKELRGSSNGVISGYHKWLKARTQGITWLPKLRDPSKKEVEVPEESEKVKALKAELERTKVIKEKLKTTVTRVKKECDKLRDVNMTTTEALKRETKRAQKEEWSRNKYRGALWGSNNELKLRRVERDESRLESMYKEKVNLAASHGQRLEDEHAKVSALQMEREARERVIESLHGEVVKWMDRFSLTLNGSQELPRLLARAKAMADVYLAPDEVHGLFDYCQHMIELMSHIIRNC

SEQ ID NO: 151711 - protein, 364 aa, Glycine max
  Coding DNA Sequence Number=SeqID_34933
  Gene Ontology: Mol. function=CDP-glycerol glycerophosphotransferase activity; Cellular component=membrane; Biological process=teichoic acid biosynthetic process
  Homolog annotation: Hit_ID=Q18CY0; Match level="QueryCoverage=92%, HitCoverage=69%, E-value=7e-14, Identity=23%"; Hit description =Putative CDP-Glycerol:Poly(Glycerophosphate) glycerophosphotransferas e
  Pfam annotation: Domain name=Glyphos_transf; Domain location=152-352; Score=-61.2; E_value=0.016; Accession=PF04464.5; Description=CDP -Glycerol:Poly(glycerophosphate) gl
MQAKPHFDCQIILAPYFSRGAKAPDYTAQRDLLNDKGIRYTEYHEYEITARKPHVVFLQNPYDDARPNELQSLTLNRRNISIAYIPYGLDMGDGERNRVYQYNLPCQNVARWIFVRSQRHKDEFAKYCGNGNHHVYVSGHPKLDNYPSRFGVQTDGKVNKGKPTLLWAPHFVMPDDEKMWSTFNLYTQAMLDIIKRDDVNLIIRPHPLFKQFLDIRKERGTHSETAQNWQMLREYSHLKSHVEWDFSADYRYAFSQSDALMADAGSFLLEYLPSRKPILFLTHENCLGINSSAEFIYDAYDVANESADIKTFVDNLVSGKDPMRDKRLQVLRDELHMPEQGAGSEIVKIIEKTLMPAGVHHNVF

SEQ ID NO: 151712 - protein, 110 aa, Glycine max
  Coding DNA Sequence Number=SeqID_34934
MSWKYTAQGPDERKDASVIHVKNNLSFAKVTNIFGMSDMNHSGWIFVVPELPVRSKDPKGKAKANVSKSDKAGLTPNDEVPIEKIVEEGNNFSKKGISVEEATEFLRIIQ

SEQ ID NO: 151713 - protein, 111 aa, Glycine max
  Coding DNA Sequence Number=SeqID_34935
  Homolog annotation: Hit_ID=Q1SKD7; Match level="QueryCoverage=91%, HitCoverage=26%, E-value=3e-08, Identity=34%"; Hit description =Ankyrin
MAPKKIFSKRARKDATGEGSSAAPQADIEFDGHRFRSEEHQRRFEAIKSWSFLKERRVRLREGEYTKFQEEVAKRQWTQLTGPMAKYDPEIVMEFYANAWPTEEGVRDKRS

SEQ ID NO: 151714 - protein, 166 aa, Glycine max
  Coding DNA Sequence Number=SeqID_34936
MGSSQKPSLKKRFYQVKIKSLEGRSLHGTVGPSIRYKVTARASKKGKRIGTNSWLAWRGDSIFMRRMSKCSLDGTRGCINYNPVLAIRQLGYPDRELRGSSNGIIGGYHKWLRVRTQGLDWLPNLKTVRDDEVKASEESDEVQALKAELERAWVVEEKFKSIAIKV

SEQ ID NO: 151715 - protein, 64 aa, Glycine max
  Coding DNA Sequence Number=SeqID_34937
MKGINGILLRKGKIVKVGDFGLLGDNEPLNEGEVIAMGVDEENKEEASSHFQPWGRGRFFRRSY

SEQ ID NO: 151716 - protein, 90 aa, Glycine max
  Coding DNA Sequence Number=SeqID_34938
  Homolog annotation: Hit_ID=Q9FJI6; Match level="QueryCoverage=61%, HitCoverage=9%, E-value=2e-13, Identity=58%"; Hit description =Similarity to transportin-SR
MALLPKLPHQPQLLQTVCLTIGAYSKWLDSASCGLSVLPSVLDILMNGMGTSEECAAAAALAFRHICDGIVNFYLSTFLHFLFIPWNVDE

SEQ ID NO: 151717 - protein, 389 aa, Glycine max
  Coding DNA Sequence Number=SeqID_34939
  Gene Ontology: Mol. function=protein transporter activity; Cellular component=nuclear pore; Biological process=protein import into nucleus, docking
  Homolog annotation: Hit_ID=Q9FJI6; Match level="QueryCoverage=73%, HitCoverage=50%, E-value=7e-99, Identity=64%"; Hit description =Similarity to transportin-SR
  Pfam annotation: Domain name=IBN_N; Domain location=26-93; Score =22.3; E_value=0.00029; Accession=PF03810.9; Description=Importin -beta N-terminal domain
  Pfam annotation: Domain name=Xpo1; Domain location=98-243; Score =100.2; E_value=6e-27; Accession=PF08389.2; Description=Exportin 1 -like protein
  Pfam module annotation: Pfam domain module=IBN_N::Xpo1; Domain location=26-93::98-243
MDLQNTVKEALNALYHHPDDAVRMQADRYLQDFQRTLDAWQVADNLLHDPSSNLETLIFCSQTLRSKVQRDFEELPSTAFRPLRDSLNTLLKKFHKGPPKVRTQISIAVAALAVHVPAEDWGDGGIVKWLRDEMDSHPEYIPGFLELLTVLPEEVLNYKIAARPERRRQFEKELTSQMEIALNILTACLSISELKEQVLEAFASWLRLKHGIPGSVLSSHPLVLTALSSLNSELLSEASVNVISELIHYTTAGNIDGVSANMPLIQVIVPQVMNLKVQLGDSTKGDCKYYFMLKPRWALLENWLAAAYWDSTRKCIIYPFVRYWFKKERKLKREHRERVFYLDTQSPRTKLHSEDGKDTIREFERHLNYSPKLLPPPPHCYLLPSYYHN

SEQ ID NO: 151718 - protein, 261 aa, Glycine max
  Coding DNA Sequence Number=SeqID_34940
  Gene Ontology: Mol. function=nucleic acid binding; Cellular component= beta-galactosidase complex; Biological process=DNA integration
MAEDHSSSHILPSGATSFPGVPFAVATAITLALGGRSKLSFIDENSSPPDEASPYHESWLSKDQKVRSWILNSMSPHLAEIFSYSDSATQLWTTVRDMYGQQYNSARIFELQQDIVNLQQSGKPFVQLLGNLKRRWNELEVHRPHTVDAAILCKCVEEDKIFQLLASPGPEYEDLHSHILMSPELLSLLFVCSTIQREEARKKVMNAKNKSKLFDTHAYTSIYIVYLDSNFTSCGTSTFFLLLRITPPCRHKLRACVVLRL

SEQ ID NO: 151719 - protein, 349 aa, Glycine max
  Coding DNA Sequence Number=SeqID_34941
  Gene Ontology: Mol. function=nucleoside-triphosphatase activity; Cellular component=membrane; Biological process=response to abscisic acid stimulus
  Homolog annotation: Hit_ID=Q9FLD5; Match level="QueryCoverage=83%, HitCoverage=56%, E-value=1e-100, Identity=57%"; Hit description =Similarity to AAA-type ATPase
MKMSEMWATMGSTLASFMFLWTIMRQYCPYGVQRFFEKYTHRIMSYFYPYIRISFHEYMGDRLKRSEAYAAVEAYLSANTSKSAKRLKAEMGKDSSNLVLTMDEYERVTDDYDGVKVWWVSNKVMSPTRSPMSYYPEQEKRFYKLTFHSKNRDTITESYLKHVMREGKEIRLRNRQRKLYTNSPGYKWPSYKQTMWSHIVFEHPATFDTMAMEPEKKKEIIEDLVTFSKSKDFYARIGKAWKRGYLLYGPPGTGKSTMIAAMANLLAYDVYDLELTAVKDNTELRKLLIETTSKSIIGRGRRRAISPRGTRTRPRRMLLEGKRPRRKEGVVAAAKGEVDCVHNQLCGEA

SEQ ID NO: 151720 - protein, 574 aa, Glycine max
  Coding DNA Sequence Number=SeqID_34942
  Gene Ontology: Mol. function=galactosyltransferase activity; Cellular component=membrane; Biological process=protein amino acid glycosylation
  Homolog annotation: Hit_ID=Q10BV0; Match level="QueryCoverage=85%, HitCoverage=79%, E-value=1e-164, Identity=55%"; Hit description =Galactosyltransferase family protein, putative, expressed
  Pfam annotation: Domain name=Gal-bind_lectin; Domain location=126 -314; Score=105.3; E_value=1.8e-28; Accession=PF00337.12; Description= Galactoside-binding lectin
  Pfam annotation: Domain name=Galactosyl_T; Domain location=360-549; Score=57.5; E_value=4.3e-14; Accession=PF01762.12; Description =Galactosyltransferase
  Pfam module annotation: Pfam domain module=Gal-bind_lectin::Galactosyl _T; Domain location=126-314::360-549
MKRGNNLVALSRQRSIQILIAIAFLYVLFFTLEIPLVFRIAQKQRPTHTRRQLVRRQNGVVSALILNDAAFDSELYQSSCRAGKAIWEELKLKSRSPRGLISKPENRSGPCPGSVSVSGPEFLGRGSLMMIPCGLTLGSHVTVVGKPSRVQRKTCQFVMELLGLKTVEGEEPPRVLHFNPRLKGDWSWKPVIELNTCYRMHWGTALRCDGWKSRAGEDTVDGLLKCEKWIRGDEDNRDAVETKAAWWLKRLIGRTKRVNVDWPFPFSENKLFILTLSAGFEGFHINVDGRHGFTLEDATGLTLSGDIDVHSVFAASLPSVHPNVSSQQHLEFSTRWRAPNLPRYGVELFVGILSAGNHFAERMAVRKSWMQHSFIKSSKVVTRFFVALHPRKEINVELKKEAEYFGDIVIVPYIDNYDLVVLKTMAICEYGVHTVSAEYIMKGDDDTFVKIDAVMNQARNVPRSMSFYIGNINYRHKPLRWGKWAVTYKEWPEEEYPPYANGPGYILSSDIAHYIISEFEMHKLRLFKMEDVSMGMWVKQFNRSKPITRFCFSMGVGLEDQREGGRELWVGVGP

SEQ ID NO: 151721 - protein, 115 aa, Glycine max
  Coding DNA Sequence Number=SeqID_34943
  Homolog annotation: Hit_ID=UPI000044A741; Match level="QueryCoverage =63%, HitCoverage=18%, E-value=1e-09, Identity=53%"; Hit description =PREDICTED: similar to Ac1147, partial
MGGGAWPFLVGGAICLVNSVNERDLSLLNSYVEIIAIVGLQRGIPSKRESSARVDYVPALCTHRPSLLPIEWSGEVFGLRRREPAEGSLSMPHNQIDPRTCLFIYRREGGDDHGA

SEQ ID NO: 151722 - protein, 393 aa, Glycine max
  Coding DNA Sequence Number=SeqID_34944
  Gene Ontology: Mol. function=aminoacyl-tRNA ligase activity
  Homolog annotation: Hit_ID=Q2PF39; Match level="QueryCoverage=79%, HitCoverage=42%, E-value=1e-152, Identity=82%"; Hit description =Aminoacyl-tRNA synthetase
  Subcellular localization annotation: CTP_CleavageSite=32; ConfidenceScore=5.09e-01
MPYGSPPSVPGERSSPEPNPPNHVSDLKEETTAAAPPPLTTRSTRPSRACTMRASSRLLSSPAPSKKVARARKEGSPRPPSQCSKIVTPLVEPPSPSQLPRWNLRSMWEFASVLNFLHLFRPLLNISLEFSAEEFETALLAPNDTLFHIHMPLLKAIPPITRMALTRDTWITVLCRKLRDWWHWVADGDLPIVASHGAEIEIYKLLDPGVRVVILKVLCDIRVEQEDIRSYIDNSMKHGVQLSTFRKERIGGDSNGISYWYEDDPIIGHRMYREIRKTEVVQMKKGKPRGSLVLSNTSYLWEVIATNFDEFEDVSEKLFSSKNRTETSVGKRLKIDMLPEIEKVHKKKEKLLKKQHRQALLLDNYLVVDGLGPGRSLRDRKPVTYTFGKNLKV

SEQ ID NO: 151723 - protein, 467 aa, Glycine max
  Coding DNA Sequence Number=SeqID_34945
  Homolog annotation: Hit_ID=Q9LV14; Match level="QueryCoverage=21%, HitCoverage=19%, E-value=1e-24, Identity=65%"; Hit description =Arabidopsis thaliana genomic DNA, chromosome 5, P1 clone:MRG21
  Pfam annotation: Domain name=Extensin_2; Domain location=33-393; Score=-134.5; E_value=0.047; Accession=PF04554.4; Description =Extensin-like region
MREKGETPVMFSSHILGCLFGSHLGLPRRRTTAEEEERDSVYYHPTLNPTGAPPPGKPPMFKSSIGPRIPLSGASSSAGASSSGTELEDDVLTVPPPPPPPPLPDGSSASSADDAVLPESLPLPPPPPMPPKPATTVPTSLPPPPLPPPPPGPPPKEQVANRTLPPPPPPLQQSQPPPPGTNGGERRNQSALTDDSPSKEPGQLFAYSCLIDRKVQLPPPPPHSQVPPMAGVIQSDGAVLSTENKNSLSSQEIPKMVAGHPPPRQQPPVPGPMLIPSLQPDVLLPPGISRFPPPPPPPDMKPPLPVAGLPAQAPPPPGMMVPLMPRPPYGPPPGPPPMMRPPLPPGPPPNFQEEDHMATRPPPPPPKPSYVKSAASTVVKRPLAQHTPELTAMVPASVRVRREAAVSKTKPKPAVPGPTSRTVSGTSGPTIVKSESVSSSSAPKAQSIDDSYTAFLEDMKALGALDG

SEQ ID NO: 151724 - protein, 85 aa, Glycine max
  Coding DNA Sequence Number=SeqID_34946
MSSSSALKNFLLCRKNYGINYFFNTVEYFSSFYAEVVRRKNNSPVTTTLGYTPAKGGDGAEATVPRRRRGRFFERAPHFADSLED

SEQ ID NO: 151725 - protein, 243 aa, Glycine max
  Coding DNA Sequence Number=SeqID_34947
MNAPRMKGKIQTTVSARTVRMSDSSNSLRQTQGQLLIGSLDLHLEEVTPGDVFLPPTYRMTITLDDRDNEDPANDSSWHSTAAATNIGSSVRLTLLADLYLRYIESSFYVWVAMAYLLQLIDTIIFDDKSSTHRASTTISPMRANIPASSMESCVFAHLPSVDYLESEDWRDWMTYKWMLSSGVHMRSIEDGREALSFKEGAEVVLAMYRQFYASNLLVIRINFMIRHGQSCNNISFLWAMLY

SEQ ID NO: 151726 - protein, 84 aa, Glycine max
  Coding DNA Sequence Number=SeqID_34948
  Gene Ontology: Cellular component=anchored to membrane
  Homolog annotation: Hit_ID=Q2R3Y3; Match level="QueryCoverage=78%, HitCoverage=88%, E-value=2e-07, Identity=35%"; Hit description =Expressed protein
MVILGIGSAGVDMDFNGEDEDIVEREEDEHVDENGFVVGLHATELKLLPIPRKGEKQHWLEQHEQNHPDQHWCPITHFLSDSEN

SEQ ID NO: 151727 - protein, 537 aa, Glycine max
  Coding DNA Sequence Number=SeqID_34949
  Gene Ontology: Mol. function=sulfate porter activity; Cellular component=integral to membrane; Biological process=sulfate transport
  Homolog annotation: Hit_ID=P53393; Match level="QueryCoverage=99%, HitCoverage=85%, E-value=0.0, Identity=70%"; Hit description=Low affinity sulfate transporter 3
  Pfam annotation: Domain name=STAS; Domain location=413-525; Score =111.3; E_value=2.9e-30; Accession=PF01740.11; Description=STAS domain
  Pfam annotation: Domain name=Sulfate_transp; Domain location=95-390; Score=470.9; E_value=1.6e-138; Accession=PF00916.10; Description =Sulfate transporter family
  Pfam module annotation: Pfam domain module=STAS::Sulfate_transp; Domain location=413-525::95-390
IGYATLAKVAPEYGLCKYVASVYTATDWFDTSVVPPLIYAMMGSSREIAIGPVAVVSMLLASLVPKVEDPVTNPNAYRNLVFTVTFFTGIFQTAFGVFRLGFLVDFLSHAALVGFMAGAAIIIGLQQLKGLLGLSHFTSKTDVVSVLASVYKSLHNQIAPGQKGRRNRKLFWLPAISPLLSVILSTLIVYLSRADKHGVNIIKHVKGGLNPSSLHQLQLHGPHVGQAAKIGLICSVIALTEAIAVGRSFASIKGYHLDGNKEMLSMGIMNIAGSLTSCYVATGSFSRTAVNFSAGCQTAVSNIVMAVTVFLSLELFTRLLYYTPVAILASIVLSALPGLIDLSEACYIWKVDKLDFLACIGAFLGVLFATVEIGLLVAVIISFAKILIQSIRPGIEVLGRVPRTEAFCDVTQYPMAISTPGIIVIRISSGSLCFANANFWVSQDEDDLKETTKGRVQAVILDMTNLMNVDTSGILALEELHKRLLSRGVELAMVNPRWLVIHKLKLAHFVDKIGKEWVFLTVGEAVDACLATKIARA

SEQ ID NO: 151728 - protein, 100 aa, Glycine max
  Coding DNA Sequence Number=SeqID_34950
  Gene Ontology: Mol. function=sulfate porter activity; Cellular component=integral to membrane; Biological process=sulfate transport
  Homolog annotation: Hit_ID=P53393; Match level="QueryCoverage=85%, HitCoverage=12%, E-value=2e-18, Identity=58%"; Hit description=Low affinity sulfate transporter 3
MREQGVFHLEEHGQTERSQWVLDSPNPPPLWKKLFSSVKETILPHGNKFCFSSKRKTINGHALSCLQNLFPIISWLRDYKVSKFKDDLLAGLTLASLCIP

SEQ ID NO: 151729 - protein, 229 aa, Glycine max
  Coding DNA Sequence Number=SeqID_34951
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAITEIPL

SEQ ID NO: 151730 - protein, 187 aa, Glycine max
  Coding DNA Sequence Number=SeqID_34952
  Gene Ontology: Mol. function=branched-chain-amino-acid transaminase activity; Biological process=branched chain family amino acid metabolic process
  Homolog annotation: Hit_ID=Q7VTV5; Match level="QueryCoverage=50%, HitCoverage=31%, E-value=2e-43, Identity=90%"; Hit description =Branched-chain amino acid aminotransferase
MAGRMAVERRFSVVAVQHGAGLELVLGAAIGAARRAGVGDVQEDARVHAPQRGLGTRTEHRQVFGADFDDFVGGGGRGSGVMPSRQAGRRESDFAQPVMVLRVAAIHHVKKGFLQLLGDGAAPARADLAVVDLADRRHFGGGAREEGFIGNVDVVARQALGHHAQAEIGGQRMDGGTGDAGQDRGDL

SEQ ID NO: 151731 - protein, 128 aa, Glycine max
  Coding DNA Sequence Number=SeqID_34953
  Homolog annotation: Hit_ID=UPI00003CD4C5; Match level="QueryCoverage =92%, HitCoverage=81%, E-value=1e-24, Identity=43%"; Hit description =COG0339: Zn-dependent oligopeptidases
MFATPEEAEHAFYEALEQGDAVRLMQVWADDEEVVCIHPGGLRIVGHSAVHESWQHVLANGPLHIRPLRPLVMLSMMCAVHVLVEQVAVRTREGTQFANCYATNIYHKGPTGWRMVMHHASSAPTEAG

SEQ ID NO: 151732 - protein, 125 aa, Glycine max
  Coding DNA Sequence Number=SeqID_34954
MTLLLSNILPSDRNADLPLRKYQLGSHPQDIQWTQRRPTGPWGFHLWLQASANPTGRPSPHQGVATYPSAGGRRVTRGMRVPRKEYARSRHQRLFEENVGKTGKDAIYELFSERFGSCIYARGRY

SEQ ID NO: 151733 - protein, 165 aa, Glycine max
  Coding DNA Sequence Number=SeqID_34955
  Homolog annotation: Hit_ID=Q5XM22; Match level="QueryCoverage=39%, HitCoverage=36%, E-value=2e-16, Identity=64%"; Hit description =Resistance-like protein HAAS-2
MEAPAAIEDIVAEIPADTGAEAAEDEHERFLGGPSDPSVLTQYVEHVACSVWTGEECPKLKLSSHRRKVHSLGKFVPAIEGLVAGTGLSPLIACLSLLGLRQPNVVDRTYTCNGYVIYMSANARQVIGQLRLVYIYFIFWVALCLLTRVQPMSMLSTWRPFVTSV

SEQ ID NO: 151734 - protein, 71 aa, Glycine max
  Coding DNA Sequence Number=SeqID_34956
MVTSKENERKTLEHWKWFWKKEGEEMTFFQSYLDYKAQNAQVTNALGSRNVVHTPDIFSKIPTVRSWTSVP

SEQ ID NO: 151735 - protein, 334 aa, Glycine max
  Coding DNA Sequence Number=SeqID_34957
  Gene Ontology: Mol. function=4-alpha-glucanotransferase activity; Biological process=carbohydrate metabolic process
  Homolog annotation: Hit_ID=Q5PM02; Match level="QueryCoverage=97%, HitCoverage=46%, E-value=2e-96, Identity=53%"; Hit description=4 -alpha-glucanotransferase
  Pfam annotation: Domain name=Glyco_hydro_77; Domain location=104-334; Score=-203.3; E_value=0.00045; Accession=PF02446.8; Description=4 -alpha-glucanotransferase
MQAPANGSAPLPPVVIFYVGQPLSLAPVLSADAEWQLTSESGENWSGRCQPGEALVLPALPAGYHQLTLTQELQCHCCPIIVAPRRCYEPAELLAGESLWGSCIQLYTLRSAANWGIGDFGDLRQMIAETARRGGAFVGLNPLHALFPAAPESVSPYSPSSRRWLNILYIDVSAVADFGLSDAAQAWWQAEETQQAIRAARDAAWVDYTAVTRLKLQGLRLAWQQFRRRTADDGQAQAFVEFVRAGGDSLLHQGLFDALHAARSAQDGTGYGWQHWPAEWQQAHSATVLAFRIEHSDEVRFYMWLQWLAAEQFAACWQLCQQQQMAIGLYRDLA

SEQ ID NO: 151736 - protein, 89 aa, Glycine max
  Coding DNA Sequence Number=SeqID_34958
  Gene Ontology: Mol. function=RNA polymerase II transcription factor activity; Cellular component=transcription factor TFIIF complex; Biological process=transcription initiation from RNA polymerase II promoter
  Homolog annotation: Hit_ID=Q5N8X8; Match level="QueryCoverage=60%, HitCoverage=19%, E-value=2e-11, Identity=53%"; Hit description =Putative transcription initiation factor IIF beta subunit
MRPHNQTLELYGKLCRERTNKYMVKSRQIQVIDNDSGAHMRPMPGMISFSTSGPSVNGLFCFLLPITVLHDFMLRETPFLASWQFIIII

SEQ ID NO: 151737 - protein, 177 aa, Glycine max
  Coding DNA Sequence Number=SeqID_34959
MTTITQIWTTLLLSNVLPSDRVAPTRHLVDPKKSNGPPVSPTGCPFLPARSRHHDIGIVPTRHPVDPEKSNRTLGSPAFVTGLYQSYKVPIPPSKVMSSRHRDRAHKTPSGPEEVQQGLGVATSDYEPLSVLRSVCRPQQGHQAPLLIELSSRSTAPPGKRRARHHSSATRRQPSTF

SEQ ID NO: 151738 - protein, 217 aa, Glycine max
  Coding DNA Sequence Number=SeqID_34960
MVSPQGRNTWTVDDLVPYVEKITILSEEQERITEPAAHGPTSERRFPPQQFHMLQSSVETRGFDRRRETVEAQEYEKQIEEHGHGMYYTPPTFAEYPSQMYQYPFQGHHTDMSASSHWFGGVAETQPHFSWPTMTPTQQHDAPMVTPDAPLAPQWNVPGAIPDMGDLLGVDLRQEFSAEAEEVQPARHRDRRNPDRQARRWDRPCGTSSRHHRHDNE

SEQ ID NO: 151739 - protein, 177 aa, Glycine max
  Coding DNA Sequence Number=SeqID_34961
  Subcellular localization annotation: CTP_CleavageSite=13; ConfidenceScore=5.24e-01
NWGRSLPPSSPRRAQLAQASRVAFSRSNNLLEESSGGPKLACISRNFTNCLMMGAKHLTRTKQKLHVIKQRYRAENAGKFPKISHTQKQVGGSYFVIREIVLELEYESKMNSSNNVDKFFVGKKFDESKLLTTESMNVPSGNIEIAKESPVKDDSQSIVLDDKESVNTGYEHLEENR

SEQ ID NO: 151740 - protein, 134 aa, Glycine max
  Coding DNA Sequence Number=SeqID_34962
MYLFKKIFYKVERKSQGPQVAWGLEVGTGCCRTSIKTLGSMLEIETANTLRASENGEGFNPRSQGCLQGSMLETETANTLRASENGEGFNRRSQGCLQGSMLKGSMLGLSVVYRGSKKRQYVEGKRFNFDFFFV

SEQ ID NO: 151741 - protein, 231 aa, Glycine max
  Coding DNA Sequence Number=SeqID_34963
  Homolog annotation: Hit_ID=Q38JH5; Match level="QueryCoverage=42%, HitCoverage=42%, E-value=2e-19, Identity=44%"; Hit description=ER lumen retaining receptor family-like protein
  Pfam annotation: Domain name=ER_lumen_recept; Domain location=1-144; Score=-115.5; E_value=0.00015; Accession=PF00810.9; Description=ER lumen protein retaining receptor
MVVMTTMIMTKVVTVDDCGDGSRMIMMVAVVVIMVMVATIMTVMVVPSAILAILIHPYTTHRSFTRIVFAFSMYLEAGFCSPSTSFFAECKGYYVIALGVSRFLAVAHWIILVSGYFWFLAAFIAEMVQSFILADFCYYYIKSIEPCRQPCDLRLNPSPFSLALNVFAVSVSSIEPCRQPCDLGLNPSPFSLALNFVKKNIDLTSKKPGKTRAAHRVVVEEAGTLFTGLQM

SEQ ID NO: 151742 - protein, 301 aa, Glycine max
  Coding DNA Sequence Number=SeqID_34964
LWWNSNNFTLKTTLKGTEILISKQLLTDLLGVPTDSSRIYDGWCEIMGLRKTKIIKIFLKDKDNDFKKIPLSLSHLIINQMIKETSSVPCRMLMTLVLRHFGVFLEDETKDDEEDAENKEKEKKKKKKAKEKKEKKDNVSTKRSSPLFIELIRSGKRLKVRARISPQSNSEEVSEQNEKFGDEDKVSFEEVQNSEEEKPSEGHFEGAQDEEEKEQSPQGEEQVSKAVPFKKPLDYGSFYETSKHFSMKEKKDEEYHFEPQNENEYIHPYEGVKAVKAHKTMGSEPIQEDANVKIILMFWPS

SEQ ID NO: 151743 - protein, 199 aa, Glycine max
  Coding DNA Sequence Number=SeqID_34965
  Gene Ontology: Mol. function=thiamin-phosphate diphosphorylase activity; Cellular component=cytoplasm; Biological process=thiamin biosynthetic process
  Homolog annotation: Hit_ID=Q6A9C4; Match level="QueryCoverage=61%, HitCoverage=45%, E-value=7e-64, Identity=100%"; Hit description =Thiamine-phosphate pyrophosphorylase
  Pfam annotation: Domain name=TMP-TENI; Domain location=10-199; Score =124.2; E_value=3.6e-34; Accession=PF02581.7; Description=Thiamine monophosphate synthaseTENI
MSRPEFDLSVYLVTDTAQCGGPDEVVETVRHAIAGGVTLVQFRDHDLSDDEFVALGRRVREICVSGGVPLIIDDRVHLVAEIGADGVHVGQSDMPVDQARAILGDDLLIGLSAQTPAHVEAALESYYNSLAVVLQRRDWENPGVTQLNRLAAHPPFASWRNSEEARTDRPSQQLRSLNGEWDAPCSGALARRVWWLRAA

SEQ ID NO: 151744 - protein, 196 aa, Glycine max
  Coding DNA Sequence Number=SeqID_34966
  Homolog annotation: Hit_ID=Q2HT07; Match level="QueryCoverage=26%, HitCoverage=3%, E-value=1e-12, Identity=65%"; Hit description =Kinesin, motor region; Prefoldin
MEGERERMSEQVMVLENKLLEALDWKFMHETDLKKNSDLMIEDVHNDGNLISKQAIQNQPLGWGGYALKCKLQNLKHKLKSWSRDICGDLGSKVKQTQNRSLQGRHSIFYMYRRLNAPRHFGNDNRNYLPSSVFMEQTPYEISAHGSSRLHPTALFNSKMMIRSSSGWDKDLYNCQSYQRSFCSPNLTGHAKFDAE

SEQ ID NO: 151745 - protein, 100 aa, Glycine max
  Coding DNA Sequence Number=SeqID_34967
  Homolog annotation: Hit_ID=Q2HT07; Match level="QueryCoverage=53%, HitCoverage=3%, E-value=4e-13, Identity=66%"; Hit description =Kinesin, motor region; Prefoldin
MLAKENDELKMKLKALIEDNSKLIELYEQAAAENNNRNVNKGEDGQEIGSKIDNGEFMSTSNAINNETITDRTNAGRRYLRLNNTRCWPLCLLAGMTTCD

SEQ ID NO: 151746 - protein, 84 aa, Glycine max
  Coding DNA Sequence Number=SeqID_34968
MVTSPERVQMTTLVFACQSDLGSPNDEVRINVSKGCVRVTVGCLRMPPDSWVTVAKGRVVDKNRAFAPTYPQFAMRNSDLRSSC

SEQ ID NO: 151747 - protein, 245 aa, Glycine max
  Coding DNA Sequence Number=SeqID_34969
MEAMKEKMATMIEAMMSMKKMIEVNTNTVITTCTTTEVDPIHSSGINQASRLASDMVVPRDCTLADFEPHLGCATEGQAFGGIPLPNTLGGTTVSPTTTMLHFAFALERLPPAVVEREKFNHIEERLRAIEGGGDYAFTDMAELCPVPDIVIPARFKVLDFDKYKGTTCPKNHLKMYSRKIGAYSKNEKLLMHFFQADDHDCLCEKQMTMIVTAGVDDLDCHYGEQMTMFVTAGVDDLDCHYECR

SEQ ID NO: 151748 - protein, 944 aa, Glycine max
  Coding DNA Sequence Number=SeqID_34970
  Gene Ontology: Mol. function=binding; Cellular component=nucleus; Biological process=mRNA editing
  Homolog annotation: Hit_ID=Q84Q17; Match level="QueryCoverage=66%, HitCoverage=92%, E-value=1e-96, Identity=30%"; Hit description =Putative pentatricopeptide (PPR) repeat-containing protein
  Pfam annotation: Domain name=DUF1191; Domain location=679-936; Score =78.7; E_value=1.8e-20; Accession=PF06697.3; Description=Protein of unknown function (DUF1191)
  Pfam annotation: Domain name=PPR; Domain location=170-204; Score =33.2; E_value=9e-07; Accession=PF01535.11; Description=PPR repeat
  Pfam annotation: Domain name=PPR; Domain location=271-305; Score =40.0; E_value=8.2e-09; Accession=PF01535.11; Description=PPR repeat
  Pfam annotation: Domain name=PPR; Domain location=306-340; Score =34.8; E_value=3e-07; Accession=PF01535.11; Description=PPR repeat
  Pfam annotation: Domain name=PPR; Domain location=407-440; Score =19.5; E_value=0.012; Accession=PF01535.11; Description=PPR repeat
  Pfam annotation: Domain name=PPR; Domain location=448-482; Score =31.6; E_value=2.7e-06; Accession=PF01535.11; Description=PPR repeat
  Pfam annotation: Domain name=PPR; Domain location=549-583; Score =45.1; E_value=2.4e-10; Accession=PF01535.11; Description=PPR repeat
  Pfam annotation: Domain name=PPR; Domain location=584-618; Score=7.5; E_value=0.97; Accession=PF01535.11; Description=PPR repeat
  Pfam annotation: Domain name=PPR; Domain location=620-654; Score=5.1; E_value=1.8; Accession=PF01535.11; Description=PPR repeat
  Pfam annotation: Domain name=SLEI_Leptospira; Domain location=184 -196; Score=1.9; E_value=1e+02; Accession=PF07620.2; Description=SLEI
  Pfam annotation: Domain name=SLEI_Leptospira; Domain location=320 -332; Score=5.7; E_value=12; Accession=PF07620.2; Description=SLEI
  Pfam annotation: Domain name=SLEI_Leptospira; Domain location=464 -474; Score=6.4; E_value=8.2; Accession=PF07620.2; Description=SLEI
  Pfam annotation: Domain name=SLEI_Leptospira; Domain location=563 -575; Score=0.5; E_value=2.3e+02; Accession=PF07620.2; Description =SLEI
  Pfam module annotation: Pfam domain module=DUF1191::PPR::PPR::PPR::PPR ::PPR::PPR::PPR::PPR::SLEI_Leptospira::SLEI_Leptospira::SLEI _Leptospira::SLEI_Leptospira; Domain location=679-936::170-204::271 -305::306-340::407-440:...
  Pfam module annotation: Domain location=:448-482::549-583::584 -618::620-654::184-196::320-332::464-474::563-575
  Subcellular localization annotation: CTP_CleavageSite=67; ConfidenceScore=5.70e-01
MQPIAGTTKQPTTLLNPIFATPESRAPNSYPGLSTSTGSASNRERRRNQKKKTAQTPTSNVHQKKPREKRKREGKKSSERFRSLFSRFQPIFLISHVHNDELIYSFHAFFQRCFTLQQARQLHSQLVLTTAHRLPFLAARLIAVYARFAFLSHARKVFDAIPLESLHHLLLWNSIIRANVSHGYHQHALELYVEMRKLGFLPDGFTLPLVIRACSSLGSSYLCRIVHCHALQMGFRNHLHVVNELVGMYGKLGRMEDARQLFDGMFVRSIVSWNTMVSGYALNRDSLGASRVFKRMELEGLQPNSVTWTSLLSSHARCGLYDETLELFKVMRTRGIEIGAEALAVVLSVCADMAEVDWGKEIHGYVVKGGYEDYLFVKNALIGTYGKHQHMGDAHKVFLEIKNKNLVSWNALISSYAESGLCDEAYAAFLHMEKSDSDDHSLVRPNVISWSAVISGFAYKGRGEKSLELFRQMQLAKVMANCVTISSVLSVCAELAALNLGRELHGYAIRNMMSDNILVGNGLINMYMKCGDFKEGHLVFDNIEGRDLISWNSLIGGYGMHGLGENALRTFNEMIRARMKPDNITFVAILSACSHAGLVAAGRNLFDQMVTEFRIEPNVEHYACMVDLLGRAGLLKEATDIVRNMPIEPNEYVWGALLNSCRMYKDMDIVEETASQILTLKSKITGSFMLLSNIYAANGRWDDSARVRVSARTKERNATTQLPSNLTGVKIAELRLRSGTMRRRGFPIYNKFEIPIGVITKPYVKRLVLVNQYLGNWPISYYPLHNYTYLAPVLGLMASNASNLSATNLPMLHVNSCSGSSPYQGQVPPCQTSCSGCCCKTCWFDLQGSSNFSIVTGGNTCSTHSQGHFFTVAESSALPPPAPSQPPSPAAAAAVVPKESKSSNKMERAADSGEALNMASVGDTKAPAATVTRTQPTLEHEYAP

SEQ ID NO: 151749 - protein, 385 aa, Glycine max
  Coding DNA Sequence Number=SeqID_34971
  Homolog annotation: Hit_ID=Q84YF3; Match level="QueryCoverage=75%, HitCoverage=89%, E-value=9e-63, Identity=48%"; Hit description =Hypothetical protein 4B
  Pfam annotation: Domain name=DUF1191; Domain location=88-377; Score =311.3; E_value=1.8e-90; Accession=PF06697.3; Description=Protein of unknown function (DUF1191)
MTVKTSDTCSSRRRSQLVCKRMPGADKPVRARQRMRKEKIPHQAPFAIQAAQLLGRAIGAGLFAITPAGERGMCCKAIKLGNARVFPVTTFAQSSQARSLDAILQEYAFKALVKPRTGTIYNATATQLPSNLTGVKISALRLRSGSMRRKGFPSYNEFEIPIGVIAKPYVKRLVLVYQNLGNWSNSYYPLPNYTYLAPVLGLLVYNASNLSATNLPTLNVNASGDPIKVKFLHVKVPPLGAVPKCVWFDLQGSSNFSNVTGGNTCSTSSQGHFSIVAESSALPPPAPSQPPSPPPPPAAVVPKESKSSNKVGVIVGSVLGGFAFLVLLSLLVLWLLKYKQKKKIQQMERAADAGEALHMASVGDTKAPAATVTRTQPTLEHEYAP

SEQ ID NO: 151750 - protein, 147 aa, Glycine max
  Coding DNA Sequence Number=SeqID_34972
  Gene Ontology: Mol. function=nucleic acid binding; Biological process= DNA integration
  Homolog annotation: Hit_ID=Q1T010; Match level="QueryCoverage=99%, HitCoverage=16%, E-value=2e-28, Identity=35%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MMKQKNLPHSFWGDAVTTTAYLLNRCPTKRLKEKNDANRKKLQDKSEVMILVGYHAIRAYRLFNPAKQKIEVSRDVMNQKSQRDREFPAKYTNFEMLHEIEVTPEGDLVHFALLADAEPIDHEEAMKEYVWKKAIMEELKAIERNHT

SEQ ID NO: 151751 - protein, 115 aa, Glycine max
  Coding DNA Sequence Number=SeqID_34973
MICTVARLSEERAMADWRSWRRVGFVGRGSGMGRERLHIAAGSASRHRLVGERVNEVKGTQPKFLGCVDQLYGAMCHLGIQRAKPDIHCSFYRTHQNLSGGLQFWTLHFTSEFHP

SEQ ID NO: 151752 - protein, 250 aa, Glycine max
  Coding DNA Sequence Number=SeqID_34974
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-26, Identity=34%"; Hit description= UPI00006A17C9 related cluster
HILTFRGLHVLVFRGLQTLTFKGLHVLAFRGLHVLAFRGLHAITFRGLHVLSFRGLHILAFKRLHALTFRGLHVLSLRGLHALTFKGLHILAFRGLHVLALRGLHVLAFRGLHVLAFRGLHALTFRALHIPAIRGLHFLAFRGLHALAFRGLHIIVLRQLHVLTFKGLHVLAFRGLQVLSFKGLHVLAFRGCTSSPSKGYTPSPLEDCTSLPSEDCMSLPSEGCTPLPSEGYTPSPLEGYMSSPLEDYTS

SEQ ID NO: 151753 - protein, 60 aa, Glycine max
  Coding DNA Sequence Number=SeqID_34975
MGFKNRPRLPGLPLTDRVIPSQMHGRSNNQTDLVMPQGSGWTASTSRIGPERSNNNRLPK

SEQ ID NO: 151754 - protein, 89 aa, Glycine max
  Coding DNA Sequence Number=SeqID_34976
  Subcellular localization annotation: CTP_CleavageSite=20; ConfidenceScore=5.30e-01
TMATPSASPPPPPAVALASPCTLKWTRKATWLRSLATRPPGAERPVVHVDLVTDKVDGPHKKKLGTYLGIVAHDKVDVTYKTRKEVPAA

SEQ ID NO: 151755 - protein, 201 aa, Glycine max
  Coding DNA Sequence Number=SeqID_34977
  Gene Ontology: Mol. function=acid phosphatase activity; Cellular component=intracellular; Biological process=translation
  Homolog annotation: Hit_ID=Q8S8Z7; Match level="QueryCoverage=86%, HitCoverage=75%, E-value=1e-76, Identity=77%"; Hit description =Syringolide-induced protein B15-3-5
  Pfam annotation: Domain name=Acid_phosphat_B; Domain location=31-201; Score=95.8; E_value=1.3e-25; Accession=PF03767.5; Description=HAD superfamily, subfamily IIIB (Acid
MRLKIKIVQRIVAGLTYLLALLTKLVLMNQKVKVQKKTDDESDRYGLSWRLAVETNNAYPWRTVPEKCYNHVQNYISGGQYHNDLEVIVEHILSYASKIPLAGDGMDAWILDVDDTCISNISYYKGRRFGCDPFDSAIFKAWIMKGMCPANPAVQRLFNELIERGFKVFLLTGRDEATLGEITIGNLRNEGFIGYQRLILR

SEQ ID NO: 151756 - protein, 117 aa, Glycine max
  Coding DNA Sequence Number=SeqID_34978
  Gene Ontology: Mol. function=protein serine/threonine kinase activity; Biological process=protein amino acid phosphorylation
  Homolog annotation: Hit_ID=Q1SWV5; Match level="QueryCoverage=57%, HitCoverage=11%, E-value=1e-11, Identity=56%"; Hit description =Tyrosine protein kinase, active site
  Subcellular localization annotation: CTP_CleavageSite=70; ConfidenceScore=5.39e-01
TGHVISRVFEKQYRLSVLFCSAPTSTPPPPPSRPSGHPYPPQLTRMQASRWQRRSHHRQESGQALNATTPSRHVKQPNPQAPFLFSHFSVDLLSRLIVSGSDKLDILLAIATRTLAE

SEQ ID NO: 151757 - protein, 1097 aa, Glycine max
  Coding DNA Sequence Number=SeqID_34979
  Gene Ontology: Mol. function=phosphotransferase activity, alcohol group as acceptor; Cellular component=chromosome; Biological process= response to DNA damage stimulus
  Homolog annotation: Hit_ID=Q9FNE4; Match level="QueryCoverage=65%, HitCoverage=89%, E-value=7e-64, Identity=30%"; Hit description =Arabidopsis thaliana genomic DNA, chromosome 5, P1 clone:MPO12
  Pfam annotation: Domain name=PWWP; Domain location=390-463; Score =38.4; E_value=2.5e-08; Accession=PF00855.8; Description=PWWP domain
MGTDESDSMVQGSSPMAESDSMVQGSEQEKEVREVLGGLRSEEGSCGVTVNGGGFSSSENQGLHDDGVIDVVVKNSSVLETKVSVLRENDCQVLADSEVNRVSSWLGMQESDMDAVFSSEGTQKLDFVYGSEKLDYMFASESRVPEVSVLSVDGSVGVGGEDGRGGKPEEEGIDEDLDGEVDSTASEGRVSEVSFLSVDSLIGVGGEDIRDGGESGEVEKEEDYDGNIVTLASESRVAQAAKLSVDGSVGLGGEHGREGKNKDSDGKIVTPASESRVAEAVDFIVDGLVGLGGEDKTDRDEIEGKVKDENYAAGNIMTVTSENKVAEAAVLSMDGLVRVGGEDIRNGGRWEGVAKDEDCGGNIVTIEVPVAETSENMDVDVEDSSVEGCGFVVGDFVWGQVESHPSWPGLIYDPSDASDFALKLKQKNKLLVAYFGNGTFAWCQPSQLKPFQDNFDDMVKQSSSIDFANAVQEAATEFGRLLYIKLSRPFVTKKTGPESSLPLAKNSGIKEGVLVPENDIERLDFLIEPAELLSNVKRISQFVEFGSILELEILKAQLSAFYLSKGGYKLADYMDPQPVLGVEDSVMDETVAVVNGKSTVEAPTQGPFDELGHSPGLSGSTSNPVRKQKSIAEIMGEDKDVHTAANREVDATVEMVNAIGLNVGKKRKGSEDNGMALKPVQKRRELLVDTDGDVLSAKNDGKGDEENSSIGSLLQSIEKKTEAFDEGKSEERNGKGNLSRERKRSKYLSPPFTIPIRGQREVYIEPESLKVSRKAKVSQRSAGADGPSSLPVYKGRSFDSSNYQTQDDGETIIDPKKIQAPVKEVLSQVLDAATSPLIRREGTSLDQFVDFTYAFRSSLYSQGSLCELYKKNQPGRKRKMLESEEDGMLKELNLSADEHLSSLKQNSGPKKRRKETASGKKGNDENAAGAVLFVSFWPGSSMPSRSDLVSVYSKFGALNEAETDMFRTNYTARVSFLRTSDAEKAYNHSQNNNPFGSPTDVTFQLQYSSDGSKSGVQQQGERSNNKPLPAAATAPVAFSQGTEASKLIFIQQKLQGMTLMLEEASGGGKSPDMMAKLESEMKALLEDVNKMVEASLF

SEQ ID NO: 151758 - protein, 237 aa, Glycine max
  Coding DNA Sequence Number=SeqID_34980
  Subcellular localization annotation: CTP_CleavageSite=12; ConfidenceScore=5.41e-01
MGSAGALRNIVRSLSVASSRALLPRISTNASMAPICFALPSPCKPPQRLLPLWSHFHSLTDTRFPKRRPSERPRRKRASLRPSGPYAWVQYTPGQPILPNKPNEGSVKRRNEKKRMRQRRAFILVRSPFTLYTLNFGGFMSVVCVFRLRLKKMTTGLQNLSRLNGVGYNHFFCQEVLVLVIKEAERKKRKAQLQEANRKKNIQRVERKMAAVARERDWAERLAELQRLEEEKKKSMA

SEQ ID NO: 151759 - protein, 66 aa, Glycine max
  Coding DNA Sequence Number=SeqID_34981
MENIKTGVRSLRLTRLKTQALSEGVKREELAKREELTKRDPTEQNALSERNSLSARSTHAKRGRTR

SEQ ID NO: 151760 - protein, 135 aa, Glycine max
  Coding DNA Sequence Number=SeqID_34982
  Homolog annotation: Hit_ID=Q5QLZ3; Match level="QueryCoverage=97%, HitCoverage=24%, E-value=1e-20, Identity=40%"; Hit description =Gastric mucin-like protein
  Subcellular localization annotation: CTP_CleavageSite=45; ConfidenceScore=5.64e-01
MAIRHMDVRNSSGTLRSVPSATLYPQSIRTSTPKTHHTRGLSVPVSMNINGSLQSRNNNNNNNRKNGREIGERQKQYLGKLSEVVDVYESYRYDSLLLKEDLNNTNWLRSVDDKCDQGPIFDNGFEYLPEPFGLF

SEQ ID NO: 151761 - protein, 186 aa, Glycine max
  Coding DNA Sequence Number=SeqID_34983
MNKTRQREERCVNGDGSSGDMQYTLRIMKKKKKHQSEEKNPRGRLAKEEEGGEEKIKCSSKHCGSCCGGYVADCVAVCCCPCAVLHCCAMAIVKGPSLVGRKCLGLGKNKNKNNNIKRVQEGCEDDVDVDVVVERNNSNIERVQRGVREIDSVIVNAGFDAEKVWKELYQIGHMDFGRVSSSSHDD

SEQ ID NO: 151762 - protein, 308 aa, Glycine max
  Coding DNA Sequence Number=SeqID_34984
  Homolog annotation: Hit_ID=Q5QLZ3; Match level="QueryCoverage=44%, HitCoverage=24%, E-value=2e-10, Identity=36%"; Hit description =Gastric mucin-like protein
MVLPNTLFSEAVVEDLADLLATTSEASAALAWPRLFAVYSDSLPLLAIGDGCLLDMLTGACISEFGFEGRVTTAPGRDLPAETGLSAGNVVLRFGGVSRGKSGGTTGWRRGVAGLRPTRVTEGDGDGSEWRRVGVEGRKVAGMDGFEVELGVDGLEPCDVLVLLVSVDDVLIGLGNERGSSTLGGVDVDVVREVGVESLAAVMGEDGLVLRMEEDLFGLRVTEPLLDGLDYSKEPVHVIGMYIQEKLNPPKANPSSLKHQYGYANGMKGNENILQEHTLETLMFDFNLPKLLLGGTKVGWDSPSDDGK

SEQ ID NO: 151763 - protein, 63 aa, Glycine max
  Coding DNA Sequence Number=SeqID_34985
MTLLNWFPGVDNPAWVGDPEKVDDFLVVGSGRASLDPLPVLHPPLREIPDALGGITTFLILMF

SEQ ID NO: 151764 - protein, 83 aa, Glycine max
  Coding DNA Sequence Number=SeqID_34986
MVKKEAGETQVRQEVAAIPERSREVTSDPPTPVVDLSSPQHEANPSTLILEIPKDPTTPVLTLNTSPPATPVLHLTDEEDVQT

SEQ ID NO: 151765 - protein, 168 aa, Glycine max
  Coding DNA Sequence Number=SeqID_34987
MEAMKEQMITMMEAMMSMRKMKEVNMATVIAKSIATEVREAKHWEVRVAPILCKSRASIPSHHMDCLPTIHHPMLHTFPMRMSITPLLYPLRANNPNLAKEEKVQAADDSLSEVDPLSEMNPLSEASSSLSGWETLEEDKPEMCSPSAQQARPAWMSSLLALSAPTLA

SEQ ID NO: 151766 - protein, 85 aa, Glycine max
  Coding DNA Sequence Number=SeqID_34988
MVQLWFGIRVKKPGGPFGPANKSYPEPHELLVIHASSTIESGASRIDCLAMFVYPPPSNLIWSPMNWLSFMRPPPSSPEPHELIA

SEQ ID NO: 151767 - protein, 113 aa, Glycine max
  Coding DNA Sequence Number=SeqID_34989
MVIDYNTHVIDYMLSKVFKIILKAFQEVFWPLVIDYILCLNSLAKPLVVSTWNSLPKFLEIILIIYLEFLGFLLMQSYPARALDRRLQEDWARDAREGPRVFMSLRVDFRPMG

SEQ ID NO: 151768 - protein, 76 aa, Glycine max
  Coding DNA Sequence Number=SeqID_34990
MAESGHPAAQLRAKQGEGLSVPPLHRREATCNRRWHWPTATRGATTPVLQPRHAPHQLRLCSHDIVHAEPLLPLAH

SEQ ID NO: 151769 - protein, 503 aa, Glycine max
  Coding DNA Sequence Number=SeqID_34991
  Gene Ontology: Mol. function=protein serine/threonine kinase activity; Cellular component=chloroplast; Biological process=protein amino acid phosphorylation
  Homolog annotation: Hit_ID=Q1RY80; Match level="QueryCoverage=92%, HitCoverage=86%, E-value=0.0, Identity=74%"; Hit description=Protein kinase
  Pfam annotation: Domain name=Pkinase; Domain location=142-484; Score =32.1; E_value=1.8e-10; Accession=PF00069.15; Description=Protein kinase domain
  Pfam annotation: Domain name=Pkinase_Tyr; Domain location=142-411; Score=-136.8; E_value=0.00044; Accession=PF07714.7; Description =Protein tyrosine kinase
  Pfam module annotation: Pfam domain module=Pkinase::Pkinase_Tyr; Domain location=142-484::142-411
  Subcellular localization annotation: CTP_CleavageSite=46; ConfidenceScore=5.79e-01
MASLLLPPTPTATSSTVKHNKIQTKLKPNSNAHAATCNFFLSSNSNANHRFNSAKCHALLDDVAKGLLESSSSVGVDQFQRLTEGLSHMQRWEILVFGGLTWIYLTARPGVLVGAIDAYLLAPLQLGLDNLSGRRNLKRSDFVVGDKLGEGSFGVVYSGILVPKNVDLDVVQKRGRGKTTQVDAKSKDKVILKKVKVGIQGAEEFGDYEEWFNYRLSRAAPETCADFLGTFVADQTNSQFTKGGKWLVWKFEGDRTLADYMKDRNFPSNLESVMFGRVLQGVDSSKRNALIIKQIMRQIITSLRKIHDTGIVHRDVKPANLVVTKRGQIKLIDFGAATDLRIGKNYVPNRTLLDPDYCPPELYVLPEETPSPPPEPIAAFLSPILWQLNSPDLFDMYSAGIVLLQMAIPSLRSPAALKNFNLELKTCGYDLKKWRDYTRLRPDFQILDSESGRGWDLATKLVSERGSLRRGRLSAAAALRHPYFLLGGDQAAAVLSKLSLNRK

SEQ ID NO: 151770 - protein, 306 aa, Glycine max
  Coding DNA Sequence Number=SeqID_34992
  Gene Ontology: Mol. function=hydrolase activity, hydrolyzing O -glycosyl compounds; Cellular component=membrane; Biological process =carbohydrate metabolic process
  Homolog annotation: Hit_ID=Q5ZP79; Match level="QueryCoverage=91%, HitCoverage=69%, E-value=1e-123, Identity=74%"; Hit description =Alpha-galactosidase 1 precursor
  Pfam annotation: Domain name=Melibiase; Domain location=16-303; Score= -116.3; E_value=3.1e-09; Accession=PF02065.9; Description=Melibiase
MEIRKTLVVVVMTLMFCSVSDSLRLFNNGKSESQHRRNLVANGLGATPPMGWNSWNHFHLKINETVIRETADALVSTGLSKLGYTYVNIDDGWGEMTRDVDGNLVAHKTKFPSGIKALADYVHGKGLKLGIYSAAGYFTCANVMPGSLGHEEQDAKTFASWGVDYLKYDNCNNGGIKPIDRYPIMTRSLMKAGRPIYFSLCEWGDMHPALWGYQVGNSWRTTDDIRDNWDSMLSKADMNEVYADYARPGGWNDPDMLEIGNGGMNKSQYIVHFSLWAISKVLSIANILMYFFYVYNFYESIHFRVK

SEQ ID NO: 151771 - protein, 384 aa, Glycine max
  Coding DNA Sequence Number=SeqID_34993
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9LZV3; Match level="QueryCoverage=97%, HitCoverage=85%, E-value=1e-163, Identity=70%"; Hit description=(1 -4)-beta-mannan endohydrolase-like protein
  Pfam annotation: Domain name=Cellulase; Domain location=13-348; Score= -17.4; E_value=3.1e-06; Accession=PF00150.8; Description=Cellulase (glycosyl hydrolase family 5
MEENEWQMVQTKGNQFVVNDQPFYVNGFNTYWLMVFAADESTRGKVTEVFKHASSVGMSVCRTWAFNDGQWRALQKSPSVYDEDVFKALDFVVSEARKYKIRLILSLANNWEAYGGKAQYVKWGNAAGLNLTSDDEFFSHPSLRSYYKAHAKAINTFTNITYKEDPTIFAWELMNEPRCTSDSSGDVLQDWIKEMAFYVKSIDPKHLVEIGLEGFYGPSTPQKYQFNPNSYAQEVGTDFIRNHQVLGVDFASVHIYPDSWISQSIADSHLPFIKSWMEAHIEDAEKYLGMPVVFAEFGVSAKAPGYNSTYRDNLINTVYKTILNSTKKGGSGAGSLVWQLFPDGTDYMDDGNAVGVVRREMSWKKYSFMTNCNSVCGKLPTSAM

SEQ ID NO: 151772 - protein, 149 aa, Glycine max
  Coding DNA Sequence Number=SeqID_34994
MRLENQGSHSIHYVSHQGNQGARKKFLKKHEKCKEPLKINDGLVKIQKKASIAIIVISMGNLDTSRRIAQSASIDGLYVEAMTSKIILMISENQELSKFQRIRSQKASRIKFQRIKFQDLRTIKFRESRFKNIQDQDSRIKRRLNQDKY

SEQ ID NO: 151773 - protein, 350 aa, Glycine max
  Coding DNA Sequence Number=SeqID_34995
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q10LU3; Match level="QueryCoverage=97%, HitCoverage=26%, E-value=1e-132, Identity=69%"; Hit description =Phospholipid-translocating P-type ATPase, flippase family protein, expressed
  Pfam annotation: Domain name=E1-E2_ATPase; Domain location=109-332; Score=-135.4; E_value=0.1; Accession=PF00122.10; Description=E1-E2 ATPase
MELKAQNIPPFEISHPRHRPRSSVQFDDTALFHDDNASLIYVNDPIKTNENFEFAGNEIRTSRYTLLTFLPKNIFIQFHRVAYVYFLAIAALNQLPPLAVFGRTVSLFPLLFVLCVTAIKDAYEDWRRHRSDRNENNRECLVLQSAQFCPKKWKNIQAGDVIKISADEMIPADMVLLGTSDPSGIAYIQTMNLDGESNLKTRYAKQETASAVLPDACAVSGVIRCEPPNRNIYEFTANMEFNGCKFPLNQSNIVLRGCMLKNTNWIVGVVVYAGQQTKAMLNSAASPSKRSKLESYMNRETFWLSVFLFIMCAVVALGMGLWLVRHKDQLDTLPYYRKTYFNGPDNGKKY

SEQ ID NO: 151774 - protein, 122 aa, Glycine max
  Coding DNA Sequence Number=SeqID_34996
MGVVRTWESRRAELEAFRRSLVAAAGIQRRKDDEGGRTHKFVSSYEHDDGKGTLICVTCGVSYFGLALVNHLLLLGYSLRVTVDNPDSRCERGRNFDSLNSDGMQVGGDSSFLVKLRFETEV

SEQ ID NO: 151775 - protein, 725 aa, Glycine max
  Coding DNA Sequence Number=SeqID_34997
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q10LU3; Match level="QueryCoverage=99%, HitCoverage=57%, E-value=0.0, Identity=64%"; Hit description =Phospholipid-translocating P-type ATPase, flippase family protein, expressed
  Pfam annotation: Domain name=Hydrolase; Domain location=66-454; Score= 7.3; E_value=0.012; Accession=PF00702.16; Description=haloacid dehalogenase-like hydrolase
MEFQRASVHGKKYGSSLLTADNNTAAANSGKRRWKLKSEIAVDSELMALLQKDSDRDERIAAHEFFLTLAACNTVIPIISSSTSSSCGKGESNEPRESIDYQGESPDEQALVSAASVYGYTLFERTSGNIVIDVNGEKLRLDVLGLHEFDSARKRMSVVIRFPDNVVKVLVKGADTSMFNILAPDNSGNNGIRHETQSHLREYSMQGLRTLVVASRDLSDAELEEWQSMYEDASTSLTDRAAKLRQTAALIECNLKLLGATGIEDKLQEGVPEAIESLRQAGIKVWVLTGDKQETAISIGLSCKLLSADMQQIIINGTSEVECRNLLADAKTKYGVKSSSREQQNLKCKIDSRHGGPDIPNDTKSLSMPKWNPGKEEETTAPLALIIDGTSLLFDLATSCRVVLCCRVAPLQKAGIVDLIKSRTDDLTLAIGDGANDVSMIQMADVGVGICGQEGRQAVMASDFAMGQFQFLNKLLLVHGHWNYQRVGYLILYNFYRNAVFVLMLFWYILCTAFSTTSALTDWSSVFYSVIYTSIPTIVVGVLDKDLSHKTLLQYPKLYGAGHRHEAYNMQLFWFTMIDTLWQSLVLFYIPVFIYKDSTIDIWSMGSLWTISVVILVNVHLAMDINQWALVSHVAVWGSIIITYGCMVILDSIPVFPNYGTIYHLARSPTYWMTILLIIIVALLPRFLCKAVYQIFCPSDIQIAREADTMRKQHGDLQSRLPVSN

SEQ ID NO: 151776 - protein, 86 aa, Glycine max
  Coding DNA Sequence Number=SeqID_34998
  Subcellular localization annotation: CTP_CleavageSite=32; ConfidenceScore=5.15e-01
MVKPSKKRKGSLSRSQRHSEAQDTPIPSSISSSSLFSSKEQRTKYINLFSSCSIIDPKFIDMDFFSDESFECIQAFQNSNLIPFMS

SEQ ID NO: 151777 - protein, 265 aa, Glycine max
  Coding DNA Sequence Number=SeqID_34999
  Gene Ontology: Mol. function=sequence-specific DNA binding; Cellular component=nucleus; Biological process=regulation of transcription
  Homolog annotation: Hit_ID=Q1RY84; Match level="QueryCoverage=75%, HitCoverage=69%, E-value=3e-53, Identity=55%"; Hit description=DNA -binding WRKY
  Pfam annotation: Domain name=WRKY; Domain location=103-165; Score =92.2; E_value=1.6e-24; Accession=PF03106.6; Description=WRKY DNA -binding domain
MDDRKVLEELVKGREFANQLRQVMINGKDNDSPFVRSLAKNVLRSFTNTLFLLDKYPSYEVSPSTKSEDSQESCKSFNSKNKRGCYKRKRNTQEREEVSQTPKLDGHQWRKYGQKEILNAKYSRNYYRCTHKYDQNCQAIKQVQRIQEDPPLYKTTYLGHHTCNDFLNSAIILDSNNDPSDTSILLSFNNTFPTPTKQECPFLSSFPSPSSGKKEEVIPSSSPPETSLDDSSRHNNVTLPPPDFWDVMFDSVDLDDVNLLLDCDD

SEQ ID NO: 151778 - protein, 840 aa, Glycine max
  Coding DNA Sequence Number=SeqID_35000
  Gene Ontology: Mol. function=DNA binding; Cellular component=nucleus; Biological process=regulation of transcription, DNA-dependent
  Homolog annotation: Hit_ID=Q1T199; Match level="QueryCoverage=96%, HitCoverage=48%, E-value=0.0, Identity=64%"; Hit description=Homeobox
  Subcellular localization annotation: CTP_CleavageSite=75; ConfidenceScore=5.05e-01
MDTDSFSIKYGKITSTFAPLQLVIQYVKHRAVLGARYHRINWKSISDLPASPSACMRRMNLLNSNLRFRTAVNGLCNMVSERYAKQLEKSQKLSLNKDDCKQFVRSQSCEGGILNHFSPDVEIQMTSLNRDAWDDFENKSIKAALDEILRCKMMAKLDASSSQKVQSQYEGWADANESQENEEITSAIPCEIIQSHHGNRANVYGQVNESLAVSNAVELVKIVFLSTSTRLQAPNLLADILRRYSEHDLIAAFNYLREKKIMPLCICKGKAAYNIPPPYLRIAKSLRAMGYKVGGTGSECVELSQQFLHSVSKSPFPFNTGKQAVKFSAWLEERDKDLTEVGVNLAEDLQCGDIFHLFALVSSGELSIMPSLPHNGVGEADLRSAKRKFDATEFSYSNKTKRPKSLFGIDGEIISRREKGFPGIFISAHRTAISRADILNLFKDNDNNGQPFEGQSSNYSLPDHMLEIIKSFDPITLEENHTKSPWESMAGYAQHLLSESFNQEHARAICAELFRVVYAAIQKSGDQGLSMGEISQVINLPGAEVDGLIVDALQAFGQALKVPPPFLVSIVYSMPGLEFATLGLTQRKVTSSPLLLLKPCLRASPGAAVKLCLGDLLVMGSNPETASLHMQGILKYKWAKINFSSWAREISGPALHLHFPSVEAIIQVNAYDTVRVVDALHLHKYFFTPVSDFHQHVVQPSSTKIIEKSDHICELYKSEERNTTSIDTLRERNTGIDNVHKVTILNLPHGDVDPENQACDRIEGSKQDRLGLSSVNHEKETLKFSAGEFCVPILPWINGDGTINTIVYRGLRHRVVGIVMQNPGILENLEMGLAVSVAAY

SEQ ID NO: 151779 - protein, 101 aa, Glycine max
  Coding DNA Sequence Number=SeqID_35001
  Pfam annotation: Domain name=DUF588; Domain location=3-100; Score =5.9; E_value=0.0016; Accession=PF04535.3; Description=Domain of unknown function (DUF588)
MVAKRVANSILVLRIVALVTAAATMALLVNDNYKFDNGGELKYQDFTSYSLVVAIAAIACAYCIVQLPFAIYYAIRRKRLISNGFFPEFDFYGDKVYKSLD

SEQ ID NO: 151780 - protein, 117 aa, Glycine max
  Coding DNA Sequence Number=SeqID_35002
MEVGKGGSGSKNQNVISPIKPRAKRIFGHALNQESLAISAQPLHLKLTWSTKLAKAELSPFQFDLNWAKRWPSREAHCIHWLSVTHKLAKRTYCAKRVHLSRMNTHPPVEIPMAKRG

SEQ ID NO: 151781 - protein, 215 aa, Glycine max
  Coding DNA Sequence Number=SeqID_35003
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=20%, E-value=4e-55, Identity=37%"; Hit description =Prefoldin
MLTDDSSPCVESHTLGVPCPNYCESKHAEKADSEVQTLRKGLAKIQSDKDAIFLQYQKSMDKLSEMERDLNNAQKDAGGLDDRASKAEIETRVLKEALAQLKSKKEAVLEAKITLTEENSRMLSEQLEKVELEVKALRKNLVELNGEKESLVVLYHQCLEKITKMENEILLAQQNSKKLNREIEKGAEKLKTAEEHSHMLEKSNQSLRLEAENLL

SEQ ID NO: 151782 - protein, 95 aa, Glycine max
  Coding DNA Sequence Number=SeqID_35004
MSLFTPKTRCAKEEGGRWWCDVMRRMQGLVPWRTRLLSSQEGEGGGLKYPSHVPFMSKGTMPLLYLIPFNSLCQPRWKMYWVKIHMLLTQLPMKM

SEQ ID NO: 151783 - protein, 104 aa, Glycine max
  Coding DNA Sequence Number=SeqID_35005
MRKSGLSPLSYEKEKRTTELDEISHEIGLQVVLGGYRFSFYSLQVNFSINYYRSAQDFVQHEDLSTVWSNVRRQVAMRCYPRIGWSSNVSFLHVRTTKMPKINV

SEQ ID NO: 151784 - protein, 68 aa, Glycine max
  Coding DNA Sequence Number=SeqID_35006
MLAHNNNLVIKDVTTNGALEKCPSLGESSGKGNRKRIIDGPPKEHGSNDEDHHDASSSTPKPNLNKEE

SEQ ID NO: 151785 - protein, 60 aa, Glycine max
  Coding DNA Sequence Number=SeqID_35007
MASRAEQPINEVKHSSGEWRGGTNVGNFVTATKVEAGQNVKEEPEAMVISSDDEPEAVKG

SEQ ID NO: 151786 - protein, 56 aa, Glycine max
  Coding DNA Sequence Number=SeqID_35008
MVEKHNQRVLSMRTTKNMEKQQKLIKELKFEHVKANRGRSHLKRRDYKDNGDSSMD

SEQ ID NO: 151787 - protein, 124 aa, Glycine max
  Coding DNA Sequence Number=SeqID_35009
MEVDMKKIKQGLWEPLRKYIVWFNWEAKGGTKSKPKHSLNVSKSWCAKRNIVLCLYIKNASSYHRGILEEEFKQASLDNPRSIRVHVNIDPGKYCQYHKAIGHESRSTIDTLLKQLKISFNNDN

SEQ ID NO: 151788 - protein, 113 aa, Glycine max
  Coding DNA Sequence Number=SeqID_35010
  Gene Ontology: Mol. function=RNA-directed DNA polymerase activity; Biological process=RNA-dependent DNA replication
  Homolog annotation: Hit_ID=Q1SMK1; Match level="QueryCoverage=98%, HitCoverage=5%, E-value=3e-13, Identity=38%"; Hit description =Integrase, catalytic region; Peptidase aspartic, active site; Ribonuclease H
MKIVRVESKLPPPILKKLSRFLAENVDIFAWIPTNMPKIDPGHFCHKLMVDSEEKLYAKREGRWIGPNLEDYVDNMIVKSRQEDKHLTDLQEVFTLLRKYNMVLIPTKCTFGV

SEQ ID NO: 151789 - protein, 232 aa, Glycine max
  Coding DNA Sequence Number=SeqID_35011
  Gene Ontology: Mol. function=RNA-directed DNA polymerase activity; Cellular component=mitochondrion; Biological process=RNA-dependent DNA replication
MIYIKKCNRCQRCSDLHNFPIEKRKVMNSPWPFSWWGINILGLFPQAVETIVNNNGTQFSRKRFNELLEGLKIKHKYSSLQHLETNKLVEAMNKVISKGLKRRLDIAKGCWAEQLPHVLWAYRKTLCSTVGESPFRLAYGMEAMILAEIREPSWRVLNYDQETKEEIIRFELDLAKERREMECIREASLKRRVKARNNKWVILGSFSEGNLVLNRVDISGRNVKEAKLAENW

SEQ ID NO: 151790 - protein, 341 aa, Glycine max
  Coding DNA Sequence Number=SeqID_35012
  Gene Ontology: Mol. function=protein serine/threonine kinase activity; Cellular component=integral to membrane; Biological process=protein amino acid phosphorylation
  Homolog annotation: Hit_ID=Q9FN93; Match level="QueryCoverage=70%, HitCoverage=28%, E-value=2e-25, Identity=29%"; Hit description =Receptor-like protein kinase
  Pfam annotation: Domain name=LRR_1; Domain location=188-209; Score =0.3; E_value=2.5e+02; Accession=PF00560.23; Description=Leucine Rich Repeat
  Pfam annotation: Domain name=LRR_1; Domain location=211-232; Score =5.4; E_value=28; Accession=PF00560.23; Description=Leucine Rich Repeat
  Pfam annotation: Domain name=LRR_1; Domain location=235-257; Score =16.2; E_value=0.12; Accession=PF00560.23; Description=Leucine Rich Repeat
  Pfam module annotation: Pfam domain module=LRR_1::LRR_1::LRR_1; Domain location=188-209::211-232::235-257
TPADGIGLSEVKSEASGIDISTAEDHPPEAALENSIVSSSTRQYMQFINRLPTKELPIYITAYFSEVMKSAVGKRSIQMYIDNKPFLSPIVPPFGSVKEVYITNMTASAETSFVLQASETSTLPPIINAVEVYTLSDTLTAGTDSRDVEGLLQLQLAFEVLVEWSGDPCLPYPYNWDWIQCTTDVKPRVIALYLSGYELRGTLPDFSSMNALETIDFHNNTMEGPILDFLGLLPNLKTLNLSYNRFNGTIPASLQNKNIELDTTNNCLSGMKCQPLSDFLIPPPPPPQPFSGDEQNIPSPPSELHAGDEPLGAGSLKINDLNIPFIVAMQTLLPLLFIKFL

SEQ ID NO: 151791 - protein, 142 aa, Glycine max
  Coding DNA Sequence Number=SeqID_35013
  Gene Ontology: Mol. function=inorganic phosphate transporter activity; Cellular component=1-2nm peptidoglycan-based cell wall; Biological process=phosphate transport
  Homolog annotation: Hit_ID=Q8PM58; Match level="QueryCoverage=75%, HitCoverage=37%, E-value=9e-52, Identity=91%"; Hit description=ABC transporter phosphate permease
MPRAARLTSNTKTVSTRAPAQASTCQDSYGLPANWFITTGTEAIGWKMLLFQYWLPKAVNSSGAVSPEMRASASRMPVMMPADALRYSTCTITFHCGIPSDRAASRICEGTRRSISSVVRTTTGSTMKASDRAPANAEKLPP

SEQ ID NO: 151792 - protein, 229 aa, Glycine max
  Coding DNA Sequence Number=SeqID_35014
  Gene Ontology: Mol. function=inorganic phosphate transporter activity; Cellular component=membrane; Biological process=phosphate transport
  Homolog annotation: Hit_ID=Q8PAG0; Match level="QueryCoverage=90%, HitCoverage=77%, E-value=4e-91, Identity=89%"; Hit description =Phosphate import ATP-binding protein pstB
  Pfam annotation: Domain name=ABC_tran; Domain location=64-213; Score =27.0; E_value=6.9e-10; Accession=PF00005.17; Description=ABC transporter
MTDLSVDNAMNDLSNAVPMQRIAVPSSHESLHTPSPVKLAARGLDFYYDKFHALKGINLEIPEKRVTALIGPSGCGKSTLLRIFNRIYALYPKLEARGEVLLDGENILSPKYPMNRLRSKVGMVFQKPVPFPMTIFENVAYGIRHHEKLSKADMADRVEQALRQGALWDEVKDKLGQSALGLSGGPAAAPVHRPCRRPAPVGAAAGRADLGAGPDLDQPHRAAREELKH

SEQ ID NO: 151793 - protein, 90 aa, Glycine max
  Coding DNA Sequence Number=SeqID_35015
MGCGMKKGQRAYGKQHKDWIWLPNLKTVRDNEVKASEESDEVQALKAKLERARVVKEKFKAAIVSSSSEEVKGIITGQRHDLEGRAKGLP

SEQ ID NO: 151794 - protein, 93 aa, Glycine max
  Coding DNA Sequence Number=SeqID_35016
MCGISCQMSGFTRDSPQISASPHQLDLAPYASEPYNAQWNVPGLLRDKAHVAFESYSRRNGGIAFVDNWAVGKDKEWQSQHGLLPHSHPLHLP

SEQ ID NO: 151795 - protein, 204 aa, Glycine max
  Coding DNA Sequence Number=SeqID_35017
  Gene Ontology: Mol. function=nucleotide binding; Cellular component =integral to membrane; Biological process=protein insertion into membrane
  Homolog annotation: Hit_ID=Q9FYL3; Match level="QueryCoverage=82%, HitCoverage=17%, E-value=9e-25, Identity=35%"; Hit description =Protein ARTEMIS, chloroplast precursor
MTSPPISFVLAIALLVLLFSKPSLTVFVSIDCGSSESSIDKNNIRWIGDDDYIQHGESHQVYLGSNPLSTLRVFTNRKKNCYSIRVGKGEKILTRASFYYGNYDDKFSPPVFDLQFDGNYWATVNTSSYYYYVDYEAIYVTKGNFTSICVAQTRPNQFPFISSLEVRSLDPKMYSHVDSNHALILKWRYASGGNQTIRYSELQC

SEQ ID NO: 151796 - protein, 1045 aa, Glycine max
  Coding DNA Sequence Number=SeqID_35018
  Gene Ontology: Mol. function=3'-5'-exoribonuclease activity; Cellular component=intracellular; Biological process=RNA processing
  Homolog annotation: Hit_ID=Q9H7Z3; Match level="QueryCoverage=91%, HitCoverage=76%, E-value=1e-65, Identity=24%"; Hit description =Uncharacterized protein C14orf102
  Pfam annotation: Domain name=DUF1740; Domain location=101-370; Score =340.3; E_value=3.3e-99; Accession=PF08424.1; Description=Protein of unknown function (DUF1740)
MRMDIARYKPYNPLKLSGLHVRGLYWWNRSGSLLERDGDVDALDAKMKCAGRYWSGKYMALERHKSFKRIHLVAPKLSPVTMQDEFIPLSESDAGASHGAVDSDSVSKTSASLEESWEDEMLNKTREFNKLTREHPHDEKVWLAFAEFQDKVAGMQRQKGARLQTLAKKISILEKAVELNPDNEEILLCLLKAYQMRDSSDVLIARWEKILLQHSGSYKLWREFLHIVQRNFSRFKVSEVRKMYAHAIEALSASCSKHSRQVYKLVTLYIRGHKVDVLQAANPSSPDPVFVQLELGLVDIFLSLCRFEWQTGYRELATALFQAEIEFSLFCPPLLLTEQSKHRLFEHFWNSGGARVGEEGALGWSTWLEKEEETRQRVMNEELSRENEGGGWTGWSEPWSKDNEGIANVEHETMNDVVMEDIQDEEEYTEVEPEVDTEDLLKMLGIDMNDGDGGEVNDTLTWIKWSKEESSRDCDQWMPVRGKSGTTSPANEADKTDEDEQLLRVVLYEDVNEYLFSLSTTEARLSLLSQFIDFYGGKMSQLFCSNSPTRADNILSLEDLPDSMLEKLKCIHEVLTKQQNSLAGFSFEFLSGSLSRNADIMKFIRNAVLLCLTVFPRNYMLEEAVLISEELYVTKMNSSNGMITPCRSLAKSLLKSDRQMIKMLRRFSKSDMRGPNGIIMDLLLCGVYARREATYGNIDHARKVFDMALLSVEALPVELQSNAPLLYFWYAEVELANNSANDRESSSRGIHILSCLGSGTKYNPFKSQASSLLLLRAHQGFKEKLRTVWSSWVRGIINDQSVALICSAALFEELTTGWDAGIEVLNQAFSMVLPEAVCTVTSLCCCIFGTYDVYLMLANLQKEEVKMLQRHQRQSSLMKVWESILHGLQIYPFSPELLKDVVEVGHYYTTSNKLRRILDDCSYKKPSVVLWLFALSYEIFKGGSHHRIRGLFEKALANDKLCSSVLLWRCYIMFEMEIAHDPSAARRAFFRAIHSCPWSKRLWLDGFLKLNSVLTAKELSDLQEVMRDKELNLRTDIYEILLQQS

SEQ ID NO: 151797 - protein, 1016 aa, Glycine max
  Coding DNA Sequence Number=SeqID_35019
  Gene Ontology: Mol. function=protein serine/threonine kinase activity; Cellular component=cytoplasm; Biological process=protein amino acid phosphorylation
  Homolog annotation: Hit_ID=Q9FX38; Match level="QueryCoverage=99%, HitCoverage=89%, E-value=0.0, Identity=49%"; Hit description=Protein kinase, putative
  Pfam annotation: Domain name=Pkinase; Domain location=845-1014; Score= 36.9; E_value=9.2e-11; Accession=PF00069.15; Description=Protein kinase domain
  Pfam annotation: Domain name=Pkinase_Tyr; Domain location=845-1015; Score=-159.1; E_value=0.01; Accession=PF07714.7; Description=Protein tyrosine kinase
  Pfam module annotation: Pfam domain module=Pkinase::Pkinase_Tyr; Domain location=845-1014::845-1015
VGKGLRMADTNSVEVILDFLKRNRFTRAEAALRSELSNCSDLNGFLQKLTLDEKNLHDGLQNDKGKPVVENQGLDSRDSVEVSKELIVKEIECGTGTSNAAESKWKIVAPTGERNKSNEVVETSDKNFTFSKSSEDSVLDMYSWKFNASNGPVELYQNDGGSRPNNALKAPVSQQSKYQTSEALDATNSNVKSKEENNVPAEKTSLWIGSSGKASTEPKYDLMQSKEPRELDRQFKFNASSLKENLTDNVLSRTDENVNSSTDPWKDCSVKTVFPFSKGDMSTSYNGSTYSDRKEEKRRAENSDVRASIKEQVDEVGRALYLGKLQGSSDSLSFPLAPENQKEEFPRLPPVKIKSEDKPLTFNWGEKFECDGLSVKLAGADNTLLIGSYLDVPIGQEIKTTGVRKAVGGSWLSVSQGIAEDTSDLVSGFATIGDGLSESVDYPNEYWDSDEYDDDEDVGYTRQPIEDEAWFLAHEIDYPSDNEKGTGHGSVPDPQERGPAKDEEDDQSFAEEDSYFSGEQYILPKNVEPVTASDDPIGLTVTEMYGRTNGDDVMAQFDRQLMDVEELNLMHMEPVRQGFVTHKNDLIMLGDGKVLNHSARSRIEDMEDDQHGSVRSIGVGINSDAADIGSEVHGSLVGGSSEGDLEYFRDHDTTTHSGSKHSHHDLDKNSINKSFKNNKKKDNTESNKYVIDSDKDACSQIKTHTDGNFSFPQSLRDSQMIHAGSSKTLWSSNCNVEADDCMNAFVGSDDMLSSWKRKSSDSSPVKSSRDENNAIVVRSRNSSPTTVSNYGYTDGELVKLEKDEKVSIVREDDIGASLEDEEAAAVQEQDKNFHVVLNSVLAGRYHVTEYLGSAAFSKAIQAHDLHTGMDVCVKIIKNNKDFFDQSLDEIKLLKYVNKHDPSDKYHLLRLYDYFYYRSITIQCLEALQFLHSLGLIHCDLKPENILVKSYSRCEVKVIDLGSSCFETDHLCSYVQSRSYRAPEVILGLPYDKKIDIWSLGCILAELCTGNVRSIDG

SEQ ID NO: 151798 - protein, 303 aa, Glycine max
  Coding DNA Sequence Number=SeqID_35020
  Gene Ontology: Mol. function=transferase activity; Biological process= paclitaxel biosynthetic process
  Homolog annotation: Hit_ID=Q8LE88; Match level="QueryCoverage=93%, HitCoverage=64%, E-value=4e-39, Identity=33%"; Hit description =Acyltransferase-like protein
  Pfam annotation: Domain name=Transferase; Domain location=1-290; Score=-83.9; E_value=6.8e-07; Accession=PF02458.6; Description =Transferase family
MVTNLRCGGMILCTAINHSLCDGIGSSQFLHAWAHLTREPNTELTILPFHGRHVLKPRNTSQVHFTHPQYTRTHPSSHVDLHKLMMQSQSLVATSFTFGPSEVHFLKKQCVLSLKCITTFETVAAHTWRAWVKSLNLCPMQTVKLLFSANIRKKVNLPEGYYGNGFVLACAESTVKDLVVANNNISHGLKVVQHAKANLDNEGYIRSMVDLLEDKTVRVDLSTSLVISQWSRLGLEDVDFGEGKPLHMGPLTSSIYCLLLPVVGDANSVRVLVSMPENVVESFRYHMVVKDENAYHESQHGLI

SEQ ID NO: 151799 - protein, 223 aa, Glycine max
  Coding DNA Sequence Number=SeqID_35021
  Gene Ontology: Mol. function=protein-S-isoprenylcysteine O -methyltransferase activity; Cellular component=integral to membrane; Biological process=negative regulation of abscisic acid mediated signaling
  Homolog annotation: Hit_ID=Q9FMW9; Match level="QueryCoverage=80%, HitCoverage=91%, E-value=2e-71, Identity=67%"; Hit description =Farnesyl cysteine carboxyl methyltransferase-like protein
  Pfam annotation: Domain name=ICMT; Domain location=80-176; Score =129.6; E_value=8.9e-36; Accession=PF04140.4; Description =Isoprenylcysteine carboxyl methyltransferase (ICMT) family
MTEILSYTASRQLSQMFLAIAFFHGSEYFLAVVIHGRSNVTLKSLLISKHYIVAMIFSLLEYIIEIVLVPELKEHWVISDLGLALVLIGEIIRKIGILTAGKAFTHLIKIYHEEQHQLITHGIYSYIRHPGYCGFLIWSVGTQIMLCNPISTIAFAAVVWRFFAKRIPYEEYFLRQFFGTRCACVKHLKIKIQGWIIHGLLASLLILPLATILECTDQACSNK

SEQ ID NO: 151800 - protein, 500 aa, Glycine max
  Coding DNA Sequence Number=SeqID_35022
  Gene Ontology: Mol. function=GTP binding; Cellular component =intracellular; Biological process=RNA-dependent DNA replication
  Homolog annotation: Hit_ID=Q6Z7U2; Match level="QueryCoverage=94%, HitCoverage=85%, E-value=1e-166, Identity=58%"; Hit description =Pentatricopeptide (PPR) repeat-containing protein-like
  Pfam annotation: Domain name=PPR; Domain location=167-200; Score =19.6; E_value=0.011; Accession=PF01535.11; Description=PPR repeat
  Pfam annotation: Domain name=PPR; Domain location=201-235; Score =33.6; E_value=7.1e-07; Accession=PF01535.11; Description=PPR repeat
  Pfam annotation: Domain name=PPR; Domain location=236-270; Score =36.7; E_value=8e-08; Accession=PF01535.11; Description=PPR repeat
  Pfam annotation: Domain name=PPR; Domain location=274-308; Score =32.6; E_value=1.4e-06; Accession=PF01535.11; Description=PPR repeat
  Pfam annotation: Domain name=PPR; Domain location=309-343; Score =29.0; E_value=1.6e-05; Accession=PF01535.11; Description=PPR repeat
  Pfam annotation: Domain name=PPR; Domain location=344-378; Score =38.1; E_value=2.9e-08; Accession=PF01535.11; Description=PPR repeat
  Pfam annotation: Domain name=PPR; Domain location=379-413; Score =33.7; E_value=6.3e-07; Accession=PF01535.11; Description=PPR repeat
  Pfam annotation: Domain name=PPR; Domain location=414-448; Score =25.3; E_value=0.00022; Accession=PF01535.11; Description=PPR repeat
  Pfam module annotation: Pfam domain module=PPR::PPR::PPR::PPR::PPR::PP R::PPR::PPR; Domain location=167-200::201-235::236-270::274-308::309 -343::344-378::379-413::414-448
METVSMNQDLSCSESGLVEGNGFESDVDKVYSTVMDNLAEFNNMEKALGQLGIPLSTPLVTGVLHRLRYDEKIALRFFTWAGHQEDYSHEPCAYNDMMDILSSTRYKVKQFRIVCDVLEYMKRNNKTTVPVEVLLVILRKYTEKYLTHVQKFARKRRIRVKTQPEINAFNLLLDALCKCCLVEDAETLYKKMRKTVKPNAETYNIFVFGWCRVRNPTRGMKLLEEMVELGHRPDNFAYNTAIDTYCKAGMVTEAVDLFEFMRTKGSSISSPTAKTYAIIIVALAQHDRMEECFKLIGHMISSGCLPDVTTYKEIIEGMCVCGKIDEAYKFLEEMGNKSYRPDIVTYNCFLKVLCDNKKSEDALKLYGRMIELNCIPSVQTYNMLISMFFEIDDPDGAFETWQEMDNRGCRPDIDTYSVMIDGLFNCNKVEDACFLLEEVINKGIKLPYKKFDSFLMQLSVIGDLQAIHRVSEHMRKFYNHGMARRYALSQKRKSMSLRGK

SEQ ID NO: 151801 - protein, 234 aa, Glycine max
  Coding DNA Sequence Number=SeqID_35023
  Gene Ontology: Mol. function=DNA binding; Cellular component=nucleus; Biological process=regulation of transcription, DNA-dependent
  Homolog annotation: Hit_ID=Q6R0C4; Match level="QueryCoverage=98%, HitCoverage=96%, E-value=3e-67, Identity=56%"; Hit description=MYB transcription factor
  Pfam annotation: Domain name=Myb_DNA-binding; Domain location=4-50; Score=52.4; E_value=1.5e-12; Accession=PF00249.21; Description=Myb -like DNA-binding domain
  Pfam annotation: Domain name=Myb_DNA-binding; Domain location=56-101; Score=54.6; E_value=3.2e-13; Accession=PF00249.21; Description=Myb -like DNA-binding domain
  Pfam module annotation: Pfam domain module=Myb_DNA-binding::Myb_DNA -binding; Domain location=4-50::56-101
MCSRGHWRPAEDEKLRELVEHYGPHNWNAIAEKLRGRSGKSCRLRWFNQLDPRINRNPFTEEEEERLLASHRIHGNRWAVIARHFPGRTDNAVKNHWHVMMARIRRERSKINNPKLQPLFAPNLKDDLEAIPSFVEKYYEKYSHPCVTLTHSSFQFPGKKFYFQDPSSAGSTVPPGKSQSVEFYDFLQVNTDSNESEVTDNARRDDEEVSQDAVGQKNKDNGVPFIDFLSTGGC

SEQ ID NO: 151802 - protein, 224 aa, Glycine max
  Coding DNA Sequence Number=SeqID_35024
  Gene Ontology: Mol. function=DNA-directed DNA polymerase activity; Cellular component=nucleus; Biological process=DNA replication
  Homolog annotation: Hit_ID=Q56XM7; Match level="QueryCoverage=92%, HitCoverage=42%, E-value=1e-45, Identity=46%"; Hit description=DNA polymerase epsilon subunit B-like protein
MNASMRKKVQRKCKIRGYNLKVDALNEILSFASRFEGPDEDEAIDLLLVELDSSLKSTIIDKETVQRVVSLLLEATEATEETSDAAAAIRVVDAFLIPKYKYDYSRKQFYEHTGSLSIHGEASAKSDLYRERFLLLFQRLSRDQHFSAPAFESEFSHFGSCEISPIQSLVGQTAQFFYKHGCIVICFFDKQYRITTGLFSENTIVVAEGEMLVEDNQFIQDGDY

SEQ ID NO: 151803 - protein, 183 aa, Glycine max
  Coding DNA Sequence Number=SeqID_35025
  Subcellular localization annotation: CTP_CleavageSite=34; ConfidenceScore=5.18e-01
MILGVQPPDYATDGLVTVFTRMGQAHQRAQHHPSCTSATGAFQHKMMMMQSESLVAISFTFGASNVVSLEEAVCACAKACHHHLRSRACAETTVKDLVVVDLHRGLEVVQEAKASLEDKGTKRCVPIFLRDWLHMGPVTSATFAVILPVLGDANAFRVLVSVLQTVIESFGYHMLVKDQHLGN

SEQ ID NO: 151804 - protein, 199 aa, Glycine max
  Coding DNA Sequence Number=SeqID_35026
  Gene Ontology: Mol. function=calcium ion binding; Cellular component =nucleus; Biological process=regulation of transcription
  Homolog annotation: Hit_ID=Q10BR5; Match level="QueryCoverage=99%, HitCoverage=47%, E-value=6e-29, Identity=29%"; Hit description =Calreticulin family protein, expressed
  Pfam annotation: Domain name=PPR; Domain location=132-166; Score =24.2; E_value=0.00045; Accession=PF01535.11; Description=PPR repeat
  Pfam annotation: Domain name=PPR; Domain location=167-199; Score=2.2; E_value=4.1; Accession=PF01535.11; Description=PPR repeat
  Pfam annotation: Domain name=PPR; Domain location=31-65; Score=37.6; E_value=4.4e-08; Accession=PF01535.11; Description=PPR repeat
  Pfam module annotation: Pfam domain module=PPR::PPR::PPR; Domain location=132-166::167-199::31-65
MIAGYSRLGLVEEAKELFGEMRSGGVEPNLVSWNGMLAGFGNNGFYDEAVGMFRMMLVQGFWPDGSTVSCVLPAVGCLEDVVVGAQVHGYVIKQGLGSDKFVVSAMLDMYGKCGCVKEMSRVFDEVEEMEIGSLNAFLTGLSRNGMVDTALEVFNKFKDQKMELNVVTWTSIIASCSQNGKDLEALELFRDMQAYGVVR

SEQ ID NO: 151805 - protein, 302 aa, Glycine max
  Coding DNA Sequence Number=SeqID_35027
  Gene Ontology: Mol. function=binding; Cellular component =intracellular; Biological process=protein kinase C activation
  Homolog annotation: Hit_ID=Q2HUK9; Match level="QueryCoverage=88%, HitCoverage=39%, E-value=3e-78, Identity=51%"; Hit description =Tetratricopeptide-like helical
  Pfam annotation: Domain name=PPR; Domain location=119-153; Score=5.1; E_value=1.8; Accession=PF01535.11; Description=PPR repeat
  Pfam annotation: Domain name=PPR; Domain location=17-51; Score=20.1; E_value=0.0082; Accession=PF01535.11; Description=PPR repeat
  Pfam annotation: Domain name=PPR; Domain location=53-86; Score=6.3; E_ value=1.3; Accession=PF01535.11; Description=PPR repeat
  Pfam module annotation: Pfam domain module=PPR::PPR::PPR; Domain location=119-153::17-51::53-86
MEMFHMMLQSGQKPDLVTFTCVLSACAQNGLTEEGWRCYNSMSEEHGIEPKMEHYACLVTLLSRVGKLEEAYSIIKEMPFEPDACVWGALLSSCRVHNNLSLGEIAAEKLFFLEPTNPGNYILLSNIYASKGLWDEENRIREVMKSKGLRKNPGYSWIEVGHKVHMLLAGDQSHPQMKDILEKLDKLNMQMKKSGYLPKTNFVLQDVEEQDKEQILCGHSEKLAVVLGLLNTSPGQPLQVIKNLRICDDCHAVIKVISRLEGREIYIFGKLILAVWGKRRVNSLPWVLTVDQKTDNNQDYLH

SEQ ID NO: 151806 - protein, 82 aa, Glycine max
  Coding DNA Sequence Number=SeqID_35028
MSYPKGLTADLLKGTNRKVSGKGPHEHDALSRFKLFTFCFCYLSSHLIQGSVVKIASKTQTQTQSPCKGFCEEEEKRQYELG

SEQ ID NO: 151807 - protein, 170 aa, Glycine max
  Coding DNA Sequence Number=SeqID_35029
  Gene Ontology: Mol. function=ion channel activity; Cellular component= integral to membrane; Biological process=response to nematode
  Homolog annotation: Hit_ID=Q9LD37; Match level="QueryCoverage=92%, HitCoverage=18%, E-value=9e-58, Identity=69%"; Hit description =Probable cyclic nucleotide-gated ion channel 20, chloroplast precursor
MTLRRRDVEQWMSHRHLAEDLRRKRKSIEGHVSMRILMDKKVRQAERYNWAATRGVNEEMLLENLPEDLQRDIRRHLFTFIKKVRIFALLDEPILDAICERLRQKTYIKGSKILYDGGLVEKMVFIVRGKLESVGEDGISAPLYEGSVCGEELLTWCLEHPLASKGTFHF

SEQ ID NO: 151808 - protein, 305 aa, Glycine max
  Coding DNA Sequence Number=SeqID_35030
  Gene Ontology: Mol. function=ion channel activity; Cellular component= integral to membrane; Biological process=response to nematode
  Homolog annotation: Hit_ID=Q9LD37; Match level="QueryCoverage=99%, HitCoverage=36%, E-value=4e-94, Identity=59%"; Hit description =Probable cyclic nucleotide-gated ion channel 20, chloroplast precursor
  Pfam annotation: Domain name=Ion_trans; Domain location=7-295; Score =17.4; E_value=0.0013; Accession=PF00520.21; Description=Ion transport protein
MAKMLVVLRSMNDFIHFLNIVLQFRLAYVAPESRVVGAGELVDHPKKIALHYLRTSFIIDLFVVLPLPQLSYIDICKANMKILTSKIFILFVLPKHLGSSGANYSKNILRIVILVQNIPRLCWFLPMLISPTGSIFESPWASFFINLFTFMLSGHVVGSWWYLFGLQRVNLCLRVVCKKQFKAYIDECAKFIDCGHGQAEANQNNAIMLNWRNSSVASVCFTEDGFPYGIYNKAVNLTADHNVITRYVYSSFWGFQQISTLASNLTPSYFVWEVIFTMIIIGSGLLLFALLIGNIQNFLQALERR

SEQ ID NO: 151809 - protein, 50 aa, Glycine max
  Coding DNA Sequence Number=SeqID_35031
MKKLQYKGYFRHVFIIPNGENVQKCIPNLVLKLQDDPTVNESEIIVFLRQ

SEQ ID NO: 151810 - protein, 742 aa, Glycine max
  Coding DNA Sequence Number=SeqID_35032
  Gene Ontology: Mol. function=ion channel activity; Cellular component= integral to membrane; Biological process=ion transport
  Homolog annotation: Hit_ID=Q6ZHE3; Match level="QueryCoverage=94%, HitCoverage=85%, E-value=0.0, Identity=60%"; Hit description =Putative cyclic nucleotide-binding transporter 1
  Pfam annotation: Domain name=Ion_trans; Domain location=224-492; Score=55.0; E_value=2.5e-13; Accession=PF00520.21; Description=Ion transport protein
  Pfam annotation: Domain name=cNMP_binding; Domain location=592-696; Score=21.7; E_value=0.0027; Accession=PF00027.19; Description=Cyclic nucleotide-binding domain
  Pfam module annotation: Pfam domain module=Ion_trans::cNMP_binding; Domain location=224-492::592-696
MQMSGPLYATTGTGNLLQKHIVSGNKAKERTTDNFATHHDTGSNYWNNDYDRKNEHLLKSGQLGMCNDPYCTTCPTYFNASQQRNPKPSTRWDPKAIGSWPVIKHVFVRKKKMGPGTSKNQINFHNALYGDAKSFVRKLLSFCYSYVPGVMNPHAKVVQKWNKCLAIFCLIAIFVDPLFFFLLYVEKDNKCIVINWPLTTALVLFRCVNDFVYFLNILLQSRSVLDSMFLLIYVLSFLKFRLAYVSRESRVVGAGDLVDHPKKIALHYLKGYFLIDLFVVFPLPQIMILFVLPNSLEGANYAKNLLRAAILVQYIPKLFRFLPLLIGQSPMGFIFESAWANFVINLLIFVLASHVVGSCWYLFGLQRVNQCLRDACHSSNIPECMKFIDCGRGHGNNQPGLRSDQWINNTQAVACLDPSPDGFSYGIYENAVPLTIETNVVKKYVYSLFWGFQQISTLAGNLEPSYFVWEVLFTMAIIGMGLLLFAILIGNIQNFLQALGRRKLEMQLRGRDVEQWMSHRRLPEDLRRRVRRAERYNWAATRGVNEEMLMENLPEDLQRDIRRHLFKFVKKIRLFALMDEPILDAICERLRQKTYIKGSKILSQGGLVEKMVFVVRGKLESIGEDGTRIPLSEGDSCGEELLTWYLEHSSVSTDGRKVRLPGQRLVSNRTVRCLTNVESFSLSASDIEEVTILFTRFLRSPCVQGALRYESPYWRSLAATRIQVAWRYRKKRLSRVNSSPSD

SEQ ID NO: 151811 - protein, 264 aa, Glycine max
  Coding DNA Sequence Number=SeqID_35033
  Gene Ontology: Mol. function=ion channel activity; Cellular component= integral to membrane; Biological process=response to nematode
  Homolog annotation: Hit_ID=Q9LD37; Match level="QueryCoverage=90%, HitCoverage=32%, E-value=5e-43, Identity=38%"; Hit description =Probable cyclic nucleotide-gated ion channel 20, chloroplast precursor
MANFEDRELLMMSETDAQSYDETLHSKFQRLLSRTQSASVSIPMESYERKTSIVGHSGSLYANATPGTDNLLQHSIVVTGNKTEESKTDKFATFISTDKFDSKNEHLLISGQLGICNDPYCTTCPTYFEASQLRNPKASILSDPKVSVFLPIIGYVSVAINYMFHNALYGDAKGFARKLFSFCSSFVPGVMNPHSKFIQHWNKVLATFCLVAIFVDPLFFFLLYVRQDFNCIVVNWKLTKALVIVRSMNDFIYCLNILLQRIVP

SEQ ID NO: 151812 - protein, 167 aa, Glycine max
  Coding DNA Sequence Number=SeqID_35034
MKSINRGIWSALVNGYTVPNHVVDSKTIEKPYESWPKEEIRKGEYDSKTMNIIPSSLNSNEFFRVRLQEDWTRAAKEGPRVLMNLKALDLLHQWSPCANRLACLWKAKGVDDHNLSPRANELTCLWKTKGADDHNLSPRANGLAYLWKAKGADDHDVSPRAIGLACL

SEQ ID NO: 151813 - protein, 70 aa, Glycine max
  Coding DNA Sequence Number=SeqID_35035
MSNEELKLQDPRCRIQCPDILPENTGVADPRCRIQCPDILPENTGVAVQCKIKVKCRSEAAGSTMSDTMS

SEQ ID NO: 151814 - protein, 199 aa, Glycine max
  Coding DNA Sequence Number=SeqID_35036
  Subcellular localization annotation: CTP_CleavageSite=27; ConfidenceScore=5.06e-01
MIDSGCPDGLQQLLAWVTGSASRKAVMQGSKRKRQRSKSRHQVQKPKKFHEQRPDDSHEEGPEDDDNSEDEYLKDFLESRPKLKGTAERPPKHLVMPPKSLGEVELNENYHQIERPKPIGTERITISREENEETLSLKLQELAVEIEAIASESAADYKGGGSQNLEDSYDFTRGQGDKLITLWLCSITDAAHVKELPKK

SEQ ID NO: 151815 - protein, 79 aa, Glycine max
  Coding DNA Sequence Number=SeqID_35037
MTWLWHSMTQEISRNSMFFSTAKEIWENLSHTYSMKKDIAASYEIENKDSTPIEDDKGPKPTSSPVQHKKDKRSGNQYE

SEQ ID NO: 151816 - protein, 273 aa, Glycine max
  Coding DNA Sequence Number=SeqID_35038
  Gene Ontology: Mol. function=ion channel activity; Cellular component= integral to membrane; Biological process=ion transport
  Homolog annotation: Hit_ID=Q6ZHE3; Match level="QueryCoverage=93%, HitCoverage=32%, E-value=3e-91, Identity=67%"; Hit description =Putative cyclic nucleotide-binding transporter 1
  Pfam annotation: Domain name=cNMP_binding; Domain location=123-227; Score=18.7; E_value=0.0054; Accession=PF00027.19; Description=Cyclic nucleotide-binding domain
MAIVGLGLFLFALLIGNIQNFLQGLGRRRLEMQLRSRDVEQWMSHRRLPEYLRRKVREAERYSWTATRGVNEAVLMENFPEDLQMTSNDYPNYHAYTLNGLQVRIFALMDEPILDAICTRLRQSTYIKGSRILSHGAVVDKMLFVVRGKLESIGEDGTRIPLSEGDACGEELLTWYLEHSSVSTDGRRVRLPGQRLLSNRTVRCLTNVEALSLRAANLEEVTILFTRFLRSLRVQGALRYESPYWRSLAAIRIQVAWRYRKKRLSHADSSLQD

SEQ ID NO: 151817 - protein, 424 aa, Glycine max
  Coding DNA Sequence Number=SeqID_35039
  Gene Ontology: Mol. function=extracellular ligand-gated ion channel activity; Cellular component=membrane; Biological process=transport
MNHFKPNDTSIDIEPLKRRVSFAEYHPNEQEPPPHQHQPNNNSVPLFLQPSYARSKSVIFDELRNFRISLRWCALDHSSCAGKIISYATFIFFTIIVPLLASIFVEIPASAPEDDPISFNKLVQLPKSGLAIIAFFTLSGFFKRYGLRQLLFLDALQEDTTYVRRGYTRELEKAFRYLTCIILPCLFVELAHKIIFFSAVKFSAPHISPGLPLNSIVFVLVLLSWLYRTGVFLLVCVLFRLTCELQKLRFEGVHKLFEGCGSEAGVIFKEHVRIRRQLWDTSHRYRFFIIGCVVTITISQLGALLLVLASKSDKTFFNSGDLVICSAVQLSGFFLCILGATRITHRAQGIVAIATRWHMLVTEASSESKQCKARVSEGLASDSDSDDSSNIHVSVIPSQLSSFQTRQTLGEFNLYEENVTGTFD

SEQ ID NO: 151818 - protein, 107 aa, Glycine max
  Coding DNA Sequence Number=SeqID_35040
MARDTNDNSQDIPLDEVQNFKMRTKWVDHQSPLNIEHVSPTKDVDGCVSMNPRVLHDMRILSKFWGDVVDETDEDKPPDRLTQELKQDANFSRVLPKTQKFKLKRRK

SEQ ID NO: 151819 - protein, 338 aa, Glycine max
  Coding DNA Sequence Number=SeqID_35041
  Gene Ontology: Mol. function=ion channel activity; Cellular component= integral to membrane; Biological process=ion transport
  Homolog annotation: Hit_ID=Q6ZHE3; Match level="QueryCoverage=84%, HitCoverage=31%, E-value=2e-80, Identity=55%"; Hit description =Putative cyclic nucleotide-binding transporter 1
  Pfam annotation: Domain name=cNMP_binding; Domain location=139-227; Score=5.2; E_value=0.1; Accession=PF00027.19; Description=Cyclic nucleotide-binding domain
MPQLKLGDIQEMKLIYNNLDALHIASNSVFHERTKHIEINCSFPKKSQLRLEMQLRGRDVEQWMSHRRLPEDLRRRVRHAERYSWAATRGVNEEILLENMQEDLQTDIRRHLFKFVKKVRIFALMDEPILDAICERLKQKTYIKGSKVLSQGSLVEKMVFVVRGTLESFGDDGTMVPLSEGDACGEELLTWYLEHSSVSTGITILDTMITCLLKWRLAEVAIFSNLASLQIQKHGLRKCFLTLADGKKVRVQGQRLLSNRTVRCLTNVEAFSLRAADLEELTILFTRFLRNPHVQGALRYVSPYWRSLAANRIQVAWRYRKKRLSRANTSQSDQTLIA

SEQ ID NO: 151820 - protein, 59 aa, Glycine max
  Coding DNA Sequence Number=SeqID_35042
MDGGMGIAREGDGPWKGDTSQEKIWEEKDLVRLGTRQVSCHRPMVMKSIFSHPKISYST

SEQ ID NO: 151821 - protein, 570 aa, Glycine max
  Coding DNA Sequence Number=SeqID_35043
  Gene Ontology: Mol. function=hydrolase activity, acting on glycosyl bonds; Biological process=polysaccharide catabolic process
  Homolog annotation: Hit_ID=Q1L5W8; Match level="QueryCoverage=99%, HitCoverage=100%, E-value=0.0, Identity=72%"; Hit description=Beta -amylase 1
  Pfam annotation: Domain name=Glyco_hydro_14; Domain location=107-530; Score=645.8; E_value=3.6e-191; Accession=PF01373.8; Description =Glycosyl hydrolase family 14
  Subcellular localization annotation: CTP_CleavageSite=32; ConfidenceScore=5.40e-01
MALNMTHQIGTLAAATVPVPNSSAGESTAAMSAATLWKPPAVSLKCKVTRTEGGAEGLSPPLSPCRSPVLRADLSAACQAFTAEVAAEEYIAGGKEKGEGKEGVPLFVMMPLDSVKTGNAVNRKKAMNAAMAALKSAGVEGVMMDVWWGLVEREKPGEYNWGGYVELMEMAKKHGLKVQAVMSFHQCGGNVGDSCTIPLPKWVVEEIDNDPDLAYTDQWGRRNYEYISLGCDTSPVLKGRTPVQCYADFMRAFRDTFKHLLGDTIVEIQVGMGPAGELRYPSYPEQNGTWNFPGIGGFQCYDKYMLSSLKAAAEAEGKPEWGSTGPTDAGHYNNWPEDTQFFRKEGGGWDGPYGEFFLTWYSQMLLDHGDRILSSATSIFDNTGVKISVKVAGIHWHYGSRSHAPELTAGYYNTRFRDGYIPIAQMLARHGAIFNFTCIEMRDHEQPQDALCAPEKLVKQVALATQKAQVPLAGENALPRYDEYAHEQIIRASQLDVDGDSGGREMCAFTYLRMNPHLFEPNNWRKFVGFVKKMKEGKSAHKCWEEVEREAEHFVHVTQPLVQEAAVLMH

SEQ ID NO: 151822 - protein, 66 aa, Glycine max
  Coding DNA Sequence Number=SeqID_35044
MEHETFLATWLAEIDFSPNGLRFSNVQPQPRLINHEKPMLCGWHKLNPLKIEGRRFALDSARDYFP

SEQ ID NO: 151823 - protein, 84 aa, Glycine max
  Coding DNA Sequence Number=SeqID_35045
MSPHVMQDGGSSQYCIIIVILQRILLGERAVYAMMLVFPPEFSPLKTILFGNPSQDTVEPLMEALVEDYKDENEINESRQFIGG

SEQ ID NO: 151824 - protein, 85 aa, Glycine max
  Coding DNA Sequence Number=SeqID_35046
MDTSKTYTGAMKGITHLESFDLIHQLKNPSTISRPWKILFARINCFFHSSSLRGCENKTTIGTAKPYTGAMKGTMQKPQANLGAD

SEQ ID NO: 151825 - protein, 717 aa, Glycine max
  Coding DNA Sequence Number=SeqID_35047
  Gene Ontology: Mol. function=nucleoside-triphosphatase activity; Biological process=defense response
  Homolog annotation: Hit_ID=Q1STU5; Match level="QueryCoverage=96%, HitCoverage=97%, E-value=6e-79, Identity=30%"; Hit description =Leucine-rich repeat
  Pfam annotation: Domain name=LRR_1; Domain location=104-127; Score =0.5; E_value=2.3e+02; Accession=PF00560.23; Description=Leucine Rich Repeat
  Pfam annotation: Domain name=LRR_1; Domain location=291-316; Score =8.0; E_value=9.1; Accession=PF00560.23; Description=Leucine Rich Repeat
  Pfam annotation: Domain name=LRR_1; Domain location=318-339; Score =3.1; E_value=74; Accession=PF00560.23; Description=Leucine Rich Repeat
  Pfam annotation: Domain name=LRR_1; Domain location=534-554; Score =4.4; E_value=43; Accession=PF00560.23; Description=Leucine Rich Repeat
  Pfam annotation: Domain name=LRR_1; Domain location=54-78; Score=2.5; E_value=97; Accession=PF00560.23; Description=Leucine Rich Repeat
  Pfam annotation: Domain name=LRR_1; Domain location=564-589; Score =0.2; E_value=2.6e+02; Accession=PF00560.23; Description=Leucine Rich Repeat
  Pfam annotation: Domain name=LRR_1; Domain location=592-615; Score =5.2; E_value=31; Accession=PF00560.23; Description=Leucine Rich Repeat
  Pfam annotation: Domain name=LRR_1; Domain location=616-640; Score =2.4; E_value=1e+02; Accession=PF00560.23; Description=Leucine Rich Repeat
  Pfam annotation: Domain name=LRR_1; Domain location=80-102; Score =5.3; E_value=29; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=104-127::291 -316::318-339::534-554::54-78::564-589::592-615::616-640::80-102
IFPNLEFLYIHFDEAQKWLLSNTVKHPMHRLKELRLRQVNDGERLCQILYRMPNLEKLYLSGAKYLFKESSESRLGTVLQLKELDLWSSEIKDIGFEREPVLQRLELLSIVSLAYLTNLKVWYCNGLRNLMASSTAKSLVQLKSMKISKCDELEEIVSNEGNEEAEQIVFGKLITIKLEGLKKLKSFCSYKKCEFKFPSLEVLIVRECPLMHTFTEGDARAAKLQNIVSANEEGKEEAKWQWEGDLNATIQKGFNKLLESESTESSLSLRYSPLQVIWLDSGRIPKSFFSNLTSLTVDGCQFLTDVVIPFYLLPLLSNLEQLEVSDCGSVKSIFDITQEREITTMGLGAAAFPRPLPFSLKKLTLERLPKLENIWNEDPHGILTMQLLQHVKVKNCKCLTSVFPASVAKDLEKLVVKDCEGLTEIVAEDNADPRRANLKLTFPCPCVWSLKLQDLPKFKYFYYSSLQCDMFQTPTKDEMPTSNLQCLSLGEKGLEMIKRGEFQRNFLHKLQVLTLCFNIGSNVFPYEILQLAPNIEKLVVCDCSFKEIFCFDSLNVDEAGLLLQLKVLCLESLPELVSIGLENSWIQPLLGNLETLEVIGCSSLKDLVPSTVSFSNLTYLEVERCPSLLFLFTSSTARSLGQLKTMKISCCYSIEEVVVSKDGDESHEEEIIFPQLNCLKLEELPKLRSFYKGSLLSFPSLEELSVIYCEWMETLCP

SEQ ID NO: 151826 - protein, 200 aa, Glycine max
  Coding DNA Sequence Number=SeqID_35048
MAGTFFLLKQQNSLEIISGKKEMTPNRVVNWPFRTLYVMARSPNKIKSINGSKESLKLSVRISDLWFIGTPNKSEQAEMVFVDSDGDEIHAICKQDQLKECVLGDIPFRKYRFAGFADVVTGQFEHGLLVDVIGVVEEVVFRQVLGKGRRVVFKLKDLSQQLLSCTLWDDYCLQFVKFLDDYVGDGPITVLLSHCRIKEA

SEQ ID NO: 151827 - protein, 121 aa, Glycine max
  Coding DNA Sequence Number=SeqID_35049
  Subcellular localization annotation: CTP_CleavageSite=39; ConfidenceScore=5.35e-01
MSPPPLGPHNHSQTHLKLSGRLPLPALVSTDLHTTKSLKLSGTWTFLSLELSRHAEASRKGQTPLRNLISGLNRRPSNMHNSSSFQILPRTQPRSVALSGWLAKPEDWLSERVKIIASKLA

SEQ ID NO: 151828 - protein, 200 aa, Glycine max
  Coding DNA Sequence Number=SeqID_35050
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=89%, HitCoverage=39%, E-value=2e-57, Identity=75%"; Hit description =Kinesin, motor region; Prefoldin
  Pfam annotation: Domain name=Kinesin; Domain location=8-200; Score= -87.3; E_value=9.3e-09; Accession=PF00225.13; Description=Kinesin motor domain
MSWLQKFPLLEESCNNSELEKVKESRKHSSTELDSLTLKANDLEEKCSLKDNQIKALEEQLATAEKKLQASQEEVFVEISQLVPSALDGYKVCIFACGQTGSGKTYTMMGRPGHLEEKGLIPRSLEQIFQTKQSQQPQGWKYEMIRDLISTTTRMENGTPGKQYTIKHDANGNTQVSDLKVVDVHSAKEVAFLLNQPANS

SEQ ID NO: 151829 - protein, 119 aa, Glycine max
  Coding DNA Sequence Number=SeqID_35051
  Subcellular localization annotation: CTP_CleavageSite=42; ConfidenceScore=5.79e-01
MKDCRNTSSGDVSSTSRTLQSLTKSSQALRTASSSSSGGFVRARAHSAILNRLARIGEFRLSATFLAQRMALCSANKHNSSFFQILPRALPRNVALSGWLAKPADSFSTRVKINTSKLA

SEQ ID NO: 151830 - protein, 167 aa, Glycine max
  Coding DNA Sequence Number=SeqID_35052
  Gene Ontology: Mol. function=hydrolase activity; Biological process =intracellular signaling cascade
  Homolog annotation: Hit_ID=Q69L69; Match level="QueryCoverage=94%, HitCoverage=23%, E-value=1e-15, Identity=29%"; Hit description =Calcineurin-like phosphoesterase-like protein
MCSATDYKIKSIEGMCILIQMWAWKRCTTLAPKRTPPVIENKPLGHRWLRRGNQQHIDNDDLIVFRRKLDIMKRHEFLWEPYTTTVIVAWCAVVPLICFHVVEWHQPDKVLRKFGMQKPIPKCPSQPLNFHGITLKGKQDENWFQLLAPMISQWNNRTEFRVDVYPR

SEQ ID NO: 151831 - protein, 297 aa, Glycine max
  Coding DNA Sequence Number=SeqID_35053
  Homolog annotation: Hit_ID=Q1T1F7; Match level="QueryCoverage=34%, HitCoverage=23%, E-value=1e-07, Identity=33%"; Hit description=IMP dehydrogenase/GMP reductase
  Pfam annotation: Domain name=DUF1723; Domain location=141-190; Score =30.6; E_value=5.4e-06; Accession=PF08330.1; Description=Protein of unknown function (DUF1723)
MALMITVRIRSLGRALSRVIGRVLGREDNRDSDEVLKRRRPTTSTRRQREVVVVAEDAHYMDNAAEEVFQQPEEAVFDAQGFLGEPRDTLVLTAYADHKCPELKLSSHERKVQKFGRSTAEIEGLVAPTGLSLLIACSFDIGDWRLISPFVEGWHKETSSFHLPVGEAIITLDDVAFLLHLRIINSFHSFKTLHVDEVVLMLVELLEVNGDEARAEAVQCYGTYCWIYEHFPSIAETFTDEDYDERSPCACHWTSTKALPMLTYRKRLDQLTTADPRDPPRHLPIVQDETYVEPEKP

SEQ ID NO: 151832 - protein, 401 aa, Glycine max
  Coding DNA Sequence Number=SeqID_35054
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=94%, HitCoverage=77%, E-value=1e-139, Identity=64%"; Hit description =Serine/threonine protein phosphatase 2A 57 kDa regulatory subunit B' beta isoform
  Pfam annotation: Domain name=B56; Domain location=64-399; Score =734.4; E_value=7.3e-218; Accession=PF01603.10; Description=Protein phosphatase 2A regulatory B subunit (B56 family)
  Subcellular localization annotation: CTP_CleavageSite=69; ConfidenceScore=5.58e-01
MFKKIMKGGHKKPAKSDASDPVPPPYAAANRSAPAAPSANAVSNHASRISSTPLTLSSGGSIEPVPLFRDAPVAERQNLFLRKLHVCCYVLDFSDTLKNVREKEIKRQALMDLVDFIQSGSGKINENCQEEMIRMISVNIFRCLPPASHENTGQEPTDPEEEEPSLDPSWPHLQLVYELLLRYIVSSDTDTKIAKRYIDHSFVLKLLDLFDSEDPREREYLKTILHRIYGKFMVHRPFIRKAINNIFYRFIYETERHSGIGELLEILGSIINGFALPMKEEHKLFLVRALLPLHKPKSVGMYHQQLSYCITQFVEKDFKLADTVIRGLLKYWPVTNCQKEVLFLGELEEVLEATQAAEFQRCMVPLFRQISRCLNSSHFQVRGLLLCLYDGVGLDLVVVWV

SEQ ID NO: 151833 - protein, 165 aa, Glycine max
  Coding DNA Sequence Number=SeqID_35055
MSGKGLQHVRKSLSQYERLRACLEIKWDTNWEREFLVYVKNSKTSTSLPLGTLERWQRHSKRHDFGYVAVVGAAGPLRLQVLHGGKQNVRMITGRSSRRDEVVQAIAGALGFWSVQERVFTARLYKLQNLRRCLMTPTLYVTISRTVYLQAPSLMTSIKTTTTGL

SEQ ID NO: 151834 - protein, 109 aa, Glycine max
  Coding DNA Sequence Number=SeqID_35056
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=12%, E-value=3e-45, Identity=83%"; Hit description =Kinesin, motor region; Prefoldin
  Pfam annotation: Domain name=Kinesin; Domain location=6-108; Score= -131.3; E_value=4.8e-06; Accession=PF00225.13; Description=Kinesin motor domain
METSGRAIDLAQNGKSVVIMPKNSFTFDKVFTPEASQEEVFVEISQLVQSALDGYKVCIFAYGQTGSGKTYTMMGRPGHLEEKGLIPRSLEQIFQTKQSQQPQGWKYEM

SEQ ID NO: 151835 - protein, 232 aa, Glycine max
  Coding DNA Sequence Number=SeqID_35057
  Gene Ontology: Mol. function=DNA binding; Cellular component=nucleus; Biological process=regulation of transcription, DNA-dependent
  Homolog annotation: Hit_ID=Q9SCP1; Match level="QueryCoverage=96%, HitCoverage=97%, E-value=1e-42, Identity=42%"; Hit description=MYB27 protein
  Pfam annotation: Domain name=Myb_DNA-binding; Domain location=61-106; Score=53.4; E_value=7.4e-13; Accession=PF00249.21; Description=Myb -like DNA-binding domain
  Pfam annotation: Domain name=Myb_DNA-binding; Domain location=8-55; Score=38.2; E_value=2.9e-08; Accession=PF00249.21; Description=Myb -like DNA-binding domain
  Pfam module annotation: Pfam domain module=Myb_DNA-binding::Myb_DNA -binding; Domain location=61-106::8-55
MQGEHLRKGTWLQEEDEQLTSFVTRLGERRWDSLAKVAGLKRSGKSCRLRWMNYLRPNLKHGHFSVEEEQLIVQLQQQLGNKWAKIARKLPGRTDNEIKNFWRTHLRNRAQAQQVPGDFKYKLEIATEEVNQKSIDMDSKDYKHGNVCCQDSEWETKDGSSIHTLPLSDWELGSSPYETRILDWIAELQNGYGDKELEQDCNSTGTCNNYSPQEFDEGCDSWDYSGSLWDMN

SEQ ID NO: 151836 - protein, 63 aa, Glycine max
  Coding DNA Sequence Number=SeqID_35058
MFVFNSAVKGLDNTQQTKPKPPTRWIVVKYFTDARPMEPERLKAFHIEWAKYYLKVKNETYDV

SEQ ID NO: 151837 - protein, 87 aa, Glycine max
  Coding DNA Sequence Number=SeqID_35059
MENLHEISHGNVSEALQKRLGLETIFFTNFKRIVNTRRAERNYSALFPLFIGKKREVVAAQLAQASWVASTRRHRLLLEHPGRAKWV

SEQ ID NO: 151838 - protein, 117 aa, Glycine max
  Coding DNA Sequence Number=SeqID_35060
  Gene Ontology: Mol. function=pectate lyase activity
  Homolog annotation: Hit_ID=Q9SCP2; Match level="QueryCoverage=55%, HitCoverage=13%, E-value=1e-21, Identity=72%"; Hit description =Probable pectate lyase 12 precursor
MEEEEKTFIVPINGSAYSCEHRYITGNAENTSGDSEKRNAIHVLRLGAVGVVISLGDRDPGGAHHGVDEAVLAAGEGAVVDSDVPRAQDGDSVAVGLRAVPVVLWAPTHVSVAFKSQ

SEQ ID NO: 151839 - protein, 94 aa, Glycine max
  Coding DNA Sequence Number=SeqID_35061
  Gene Ontology: Mol. function=pectate lyase activity
  Homolog annotation: Hit_ID=O24554; Match level="QueryCoverage=41%, HitCoverage=9%, E-value=1e-11, Identity=74%"; Hit description =Pectate lyase precursor
MTRREMLGVSEKDVASCVTGNPIDDCWKCDPDWANNRQRLADGAIGFATRPLMGVELMCTLWVEAALLFSILAMSSFTTFTSTIAIPRVRSIIQ

SEQ ID NO: 151840 - protein, 65 aa, Glycine max
  Coding DNA Sequence Number=SeqID_35062
MMENILYLANTPVTNSEKNKSHDDSTSGGFNPFSVSLTFGNSIGAVRGKKLEESQGTARDAAIAG

SEQ ID NO: 151841 - protein, 76 aa, Glycine max
  Coding DNA Sequence Number=SeqID_35063
  Gene Ontology: Mol. function=transferase activity, transferring hexosyl groups; Biological process=metabolic process
  Homolog annotation: Hit_ID=Q1RTR9; Match level="QueryCoverage=68%, HitCoverage=10%, E-value=4e-09, Identity=56%"; Hit description=IMP dehydrogenase/GMP reductase
MHEVESVTREAAWCTRMMNMFCEIAKRINEMMRNGTLRVKAGEIKEAARRAAGVGGSSEVIVKRQIEEWKMNAQST

SEQ ID NO: 151842 - protein, 278 aa, Glycine max
  Coding DNA Sequence Number=SeqID_35064
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=87%, HitCoverage=87%, E-value=2e-77, Identity=54%"; Hit description =Putative dioscorin class A
  Pfam annotation: Domain name=Carb_anhydrase; Domain location=43-273; Score=67.0; E_value=5.9e-17; Accession=PF00194.11; Description =Eukaryotic-type carbonic anhydrase
MKHPGKLRVFLPNLIILVTILLHSTWINAQEVEDESEFDYIKGSEKGPSHWGELKKEWETCKSGKMQSPIDLSSHRVRVVPKLGELKKYYKPQNATVKNRGHDIELKWEGDAGSININGTEFFLHQCHWHSPSEHTINGRRYDLELHMVHESKRINGKGKIAVVGLFYKIGRPDSVLNKLSKFIKTMVDEEEEKNIGVFDPSKIKLGGKKYYRYMGSLTVPPCIEGVIWTINKKIRTVSRAQVNLLREAVHDHAEKNARPIQPLNRRGIQLYAQKRKD

SEQ ID NO: 151843 - protein, 548 aa, Glycine max
  Coding DNA Sequence Number=SeqID_35065
  Gene Ontology: Mol. function=solute:hydrogen antiporter activity; Cellular component=integral to membrane; Biological process =regulation of pH
  Homolog annotation: Hit_ID=O22920; Match level="QueryCoverage=47%, HitCoverage=31%, E-value=3e-33, Identity=31%"; Hit description =Putative Na/H antiporter
MLGNKNILGQALFPVKGVVVVEKVASFGLMFFFFICCVKMNISTLMKIEKLAITVAISVFALTLVIPTGLAILLRKYATMDRSLAQALPFMALSQALIVFISIAMLLKHVKFLNTDIGRLTMSAAMFVDIAGFTFTVIIFVALQNQSGSFLTLAGLLQFIVARRDSKIGVTTLVIVKLQGRPRPILVDNQNQPHHDLRSMSCNASHIDNALRQYGQQNERCVSVQSFTSISTFETMYGDICRISLDSGSNILILLFHKRWVSDDTVEISHRTIQTMNINVLQTAPCLVGILVDKSMFNPSPSLLMARASFYVAVFFIGGQDVMETLAYATRMGRHQCVYVTVVRFLLFGEENSKDRKRDGNLIDEYRYYKARNGRFQILEELEKDEIDMSTCITTLIDYFDLVMVGNEHPESYNREIKSIGSRNSYGNDLLGILLDEMKKEGATFNVQLVMDECKTFFFVGHETTALLLTWTTMLLASNPYWQDKVRLEVKELFKGEIPSVDQLSKLTLGHDEWSECEELGVIGDMLPSPNFVTKASLLVVQQQRIRG

SEQ ID NO: 151844 - protein, 124 aa, Glycine max
  Coding DNA Sequence Number=SeqID_35066
MRNHVRENKVKVVTEGKTNVDDIEGAGLEGEGGKAKLEDAILMRGGGRCKEGKERRGEGGDRELAHGGTKGGATLAEDQPRKGEEVGRKDGRTLSVKLWKEGEVRKPVTVARRVAEEEEVSSSL

SEQ ID NO: 151845 - protein, 301 aa, Glycine max
  Coding DNA Sequence Number=SeqID_35067
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=87%, HitCoverage=94%, E-value=1e-73, Identity=53%"; Hit description =Putative dioscorin class A
  Pfam annotation: Domain name=Carb_anhydrase; Domain location=58-291; Score=42.7; E_value=4.9e-14; Accession=PF00194.11; Description =Eukaryotic-type carbonic anhydrase
MSASVIVSLSHLTSMKLQRVNTYIIPHLLVLFMILLASTSTRAQVEELEDEREFDYIGASEKGPRHWGEMKKEWSSCKNGHLQSPIDLSCARVKIIPRCRQPDIYYTATNATIINRGHDIAVYWKDDAGSVYLNGTEYFLKQCHWHSPSEHSMNGRRYDLEMHMVHVSPDNKIFVVGALYKFGHRPDRFLSQLEKDIKHLVDNEVEREIGETNPSGLQTRGNAYYRYVGSLTTPPCTEGVIWNIDRKIRTVSEEQVRLLREAVHDLWPLQHAERNARPMQRRYNRDILYFRSKSRAKPEYY

SEQ ID NO: 151846 - protein, 148 aa, Glycine max
  Coding DNA Sequence Number=SeqID_35068
  Gene Ontology: Mol. function=transporter activity; Cellular component= integral to membrane; Biological process=transport
  Homolog annotation: Hit_ID=Q9SM37; Match level="QueryCoverage=53%, HitCoverage=38%, E-value=3e-16, Identity=52%"; Hit description =Putative gamma tonoplast intrinsic protein
MVFPTPAHHCRPNQCSQKFKWLGRITGNPWPIPSKGPPTKIFAPTMNPITIGAITSKLRDAAEQGEVAADEGAERNSRIDVATGDVRTHRDGDEECGGLVDGDGGAGAGAGEDEDECGDEFGESGSPRVVVSDLLGSTHDGGETPLSM

SEQ ID NO: 151847 - protein, 59 aa, Glycine max
  Coding DNA Sequence Number=SeqID_35069
MVQRHHVGSFVARMRRQGQCGLGDEESGNKDEATTTLVEVIAFGVKIFPCHSNEANSPD

SEQ ID NO: 151848 - protein, 298 aa, Glycine max
  Coding DNA Sequence Number=SeqID_35070
  Gene Ontology: Mol. function=nucleic acid binding; Cellular component= intracellular; Biological process=regulation of transcription
  Homolog annotation: Hit_ID=Q43614; Match level="QueryCoverage=75%, HitCoverage=83%, E-value=4e-36, Identity=41%"; Hit description=DNA -binding protein
  Pfam annotation: Domain name=zf-C2H2; Domain location=118-140; Score =18.5; E_value=0.025; Accession=PF00096.16; Description=Zinc finger, C2H2 type
  Pfam annotation: Domain name=zf-C2H2; Domain location=204-226; Score =22.0; E_value=0.0022; Accession=PF00096.16; Description=Zinc finger, C2H2 type
  Pfam module annotation: Pfam domain module=zf-C2H2::zf-C2H2; Domain location=118-140::204-226
  Subcellular localization annotation: CTP_CleavageSite=54; ConfidenceScore=5.46e-01
MQVQEELLVVSKDHTQMMMVKGKRTKRQRAPSPLRLAMPYNSTSSNSSTNNSIDSATTSSPSPSPTNNTIEFREDQDMANCLILLAQGRYHVAAPTPHHNNNNNDDDNLKKSTSLYLYQCKTCNRCFPSFQALGGHRASHKKPKQNGTFSSEAVTNFIEENNDRYDPTTSTTLSLKTPNGVSNLCGTITATTTTTTTTKANKVHECSICGAEFSSGQALGGHMRRHRTLVNASMTTSMRGGNVVGSNEFQEAKKPLKLDLNLPALPEDDHHRESKFSFQQREKNVIVFSKSSLVDCHY

SEQ ID NO: 151849 - protein, 113 aa, Glycine max
  Coding DNA Sequence Number=SeqID_35071
  Subcellular localization annotation: CTP_CleavageSite=64; ConfidenceScore=5.57e-01
MKFDVNSNPKLKIMKPSISFPYVNSSPPQNPSSWVPKAYKSGFGPNKGTSTWGCYTENKRGYISCGSVQVEGSSTWFFKENKGGYIPCGSLACKGFYKVERNFKNHRLLGDWM

SEQ ID NO: 151850 - protein, 131 aa, Glycine max
  Coding DNA Sequence Number=SeqID_35072
MRGAPSEKSIAPFIARGFSDPNARMLQRVQKAWNAVQRKDKELGGSDNGIVGGYHKWLKARTQEITWHPMLKVSSEEEVEVLVESEGMQALKVELKRTQVVKEKFKTTTIRVRKECDELRDVNVAMAEALE

SEQ ID NO: 151851 - protein, 79 aa, Glycine max
  Coding DNA Sequence Number=SeqID_35073
MGDRLEDMIRDLGQESFQQEHAPIHEFEQMSKCPRRGVSRYKVKDDEECSIDENSKKGPPVKVLWYLPIVPRFKRPFAN

SEQ ID NO: 151852 - protein, 68 aa, Glycine max
  Coding DNA Sequence Number=SeqID_35074
MSWERKHFGFKAYRTKKHVLLGGHTCGHPNLIVPIYLMGPWAIGFPLWAAAGAPTFTPFCLSSKVFNR

SEQ ID NO: 151853 - protein, 201 aa, Glycine max
  Coding DNA Sequence Number=SeqID_35075
MASRKRKTTTSRPQQPYDTTKFISEEFYDNLYDPEDKFPRQVRVRGKLIKFDRESLNTFLETPVVLELGERYITYTRALEALEEGSHYFGSDLEARLVYGLVTKMDMDMGSFISGHICQMAYPAINLAYIRKNCWNLDDLTITFSGTRKTRAQGPSDASASSSTPPAPAPPAPTPAPTPAPSGPSAQSTKILVLLLKLSAL

SEQ ID NO: 151854 - protein, 156 aa, Glycine max
  Coding DNA Sequence Number=SeqID_35076
  Gene Ontology: Mol. function=aminocarboxymuconate-semialdehyde decarboxylase activity; Biological process=metabolic process
  Homolog annotation: Hit_ID=Q8S4Q4; Match level="QueryCoverage=96%, HitCoverage=34%, E-value=5e-73, Identity=99%"; Hit description =Nodulin 6l
  Pfam annotation: Domain name=Amidohydro_2; Domain location=1-156; Score=-23.1; E_value=0.048; Accession=PF04909.4; Description =Amidohydrolase
MDLHGQSIHLLKHMSQSITVTVAKEIHALKSIAAYYGGLEINLNVTKTDAEESLKEVLTNTTKPIFLLKYKNYKNLVDYLFLQSLEIALSYDLPMQIHTGFGDRLLDLRKTNPLHLRSVLEDKRYSKCRFVLLHASHPYSKEASYLASVYSQANIL

SEQ ID NO: 151855 - protein, 238 aa, Glycine max
  Coding DNA Sequence Number=SeqID_35077
  Gene Ontology: Mol. function=glutamate-ammonia ligase activity; Cellular component=cytoplasm; Biological process=nitrogen compound metabolic process
  Homolog annotation: Hit_ID=Q9SC91; Match level="QueryCoverage=86%, HitCoverage=45%, E-value=5e-82, Identity=71%"; Hit description =Glutamine synthetase I
  Pfam annotation: Domain name=Gln-synt_C; Domain location=2-162; Score= 12.3; E_value=5.7e-12; Accession=PF00120.14; Description=Glutamine synthetase, catalytic domain
MRASPSAAVKLCLGDLLVMGSNPKTASLHMQGYALDDLGSGSHVHLSLSRNGQNVYMASDRSSKHGISTLGKEFMAGILHHLPSILAFIAPLPNSYDRLQPNTWSGAYLFWGNENKEAPLRATSPPGTPDGLVSNFEMKSFDGSANPYLGLAAILAAGIDGLRRKLSLPEPVDTNPNPETLQRLPASLSESLDALNKDDFLKEFMSDKLLTTIKAIRKAEIDHYTKHKDAYKQLIHRY

SEQ ID NO: 151856 - protein, 1104 aa, Glycine max
  Coding DNA Sequence Number=SeqID_35078
  Gene Ontology: Mol. function=nucleic acid binding; Cellular component= chromatin; Biological process=DNA integration
  Homolog annotation: Hit_ID=Q1SEJ7; Match level="QueryCoverage=79%, HitCoverage=85%, E-value=0.0, Identity=57%"; Hit description =Integrase, catalytic region; Zinc finger, CCHC-type; Peptidase aspartic, catalytic
  Pfam annotation: Domain name=rve; Domain location=472-624; Score =47.4; E_value=4.8e-11; Accession=PF00665.16; Description=Integrase core domain
  Pfam annotation: Domain name=zf-CCHC; Domain location=268-285; Score =22.4; E_value=0.0002; Accession=PF00098.13; Description=Zinc knuckle
  Pfam annotation: Domain name=zf-CCHC; Domain location=286-303; Score =20.4; E_value=0.00043; Accession=PF00098.13; Description=Zinc knuckle
  Pfam module annotation: Pfam domain module=RVT_2::rve::zf-CCHC::zf -CCHC; Domain location=765-900::472-624::268-285::286-303
AKKSREVVFSVLRDACIDGDLSIPEAVEVAKDIFARNAIHFYKISSAIGVVSSHSNLPQKLNDGLDIDLSLVRILWVDGSGQHRCRAVPKKRFNDIVAKNGVGLAFATLGFSSYMDGPADGSGLTAVVLCSHLIRDSVSVLRLGPCLAARTTPALVCLRVLLFKMFLKGKGMRGHVNGSSSKPTAMAELAAWETQDAQIISWLLGCTCCSLKSPPTSFSGCVCVGELLREEQRLLTQPALSRDSSVSEAIVVAYTAQDKGKGCDTRQVQCYPCKQFGHIARHCTKKFCNYCKQRGHIITDCPTRPPWRQVQAFHAANSMTETPTSVPTNADALTPEMVQQMVLSALGIQGKSNDISSPWSVDSGASNHMTGTSEHLNNVGTYNDTQNIHIADGNTLSITAVGDITPSFRDVFVSPGLDQVSGKVIATGPKVGRLFPLQFTLPRLLSFNCTGVPNKYEDWHKKLGHPNSVVLSHLLKNGFLSSKITIPGSSFNCSVCKLTKSKTLPFPSNAHRADKCFDIIHSDVWDQVFSMFKTFLAYIANQFHTSIKILRTDSGGEYISAEFHTYLQQQGIISQRLCPYTPQQNGVAERKHRHLLDALTTVVYLINRLPSQVLGVDSPFFRLYNIQPSYDDFTVLVKGFLCYDVVVQRFRISRNVVFFYNQDFFPFVSPGANDFATLPSFPKVSHATERFKPGYVYTRHPLAPPLPDSEPSPECTPIAPCRSGRISRPPDRYGYSPTSLTATLSSIPIPTCYSQAVMDVCWVKAMQEELQALQENYTWDIVPCPPNVKPLGCKWEYGVDYDGTFSPVAKMTTIRTVLSIAASKGWSLHQMDVKNVFLHGDLAEDIYMTPPQGNLNYFLGLEVNSHPKGLFLHQHKYTDDLISLAGLQSAAPLDTPLEVNAKYLCDEGDILPNPLLYRLLVGSLNYLTITRPDISFAVQQVSQFMHTPRHLHLAAVRRIIRYLKGCPDTRRSVTGWCMFLGSALISWKSKKLAWVSKSSTESEYRAMSLACSKIIWLRGLLAELDFPQTEATPLYADNTSAIQIAANPVFHERTKHIEVDCHSIREALDNRIVSLPHITSQLQLADIFTKVVPHPRHQFLNDAP

SEQ ID NO: 151857 - protein, 151 aa, Glycine max
  Coding DNA Sequence Number=SeqID_35079
  Gene Ontology: Mol. function=aminocarboxymuconate-semialdehyde decarboxylase activity; Biological process=nitrogen compound metabolic process
  Homolog annotation: Hit_ID=Q9SCP3; Match level="QueryCoverage=90%, HitCoverage=16%, E-value=4e-55, Identity=73%"; Hit description =Nodulin / glutamate-ammonia ligase-like protein
MELSELRKAVEEVELVDAHAHNIVSLDSNFAFIHAFSEAYGDAVTFSPHTLSFKRNLREIAELYGSELSLQGVEEHRRVSGMQSICSTCFKAARISAILIDDGLQLDKKHDIEWHRSFTPLVGRILRIERLAEEILDEYFISTWLLMQEGE

SEQ ID NO: 151858 - protein, 222 aa, Glycine max
  Coding DNA Sequence Number=SeqID_35080
MLTPLPMPIAIPCPAPRQQSPTPIPTPLPMAGKGDGPSIGINSGTTYFPVRVWQHHRVDINHLFQFNRLLPLLLRNDHRRYQEISYEKDIILLGDAVVTHRIHPRWIWVLSATETQLCFVPHRCRCPPPHLPPCPPQLSKPLLARVYIHSPQHIIVCVSLTMVLRSSSSWLCVLHSQPSTQVINPTFSTFTRIDDNSQRTQEDCPKSPRLEDSWNKPEDITN

SEQ ID NO: 151859 - protein, 81 aa, Glycine max
  Coding DNA Sequence Number=SeqID_35081
MNVGFEAFSPHGQDHLGLPSGVETKHERHKPIKVLKDERKWGWGHDRPIVALLCAKQAENVAARQPRILCILQLSFTFCLF

SEQ ID NO: 151860 - protein, 147 aa, Glycine max
  Coding DNA Sequence Number=SeqID_35082
MEDGASKTKEEYIEESTSIELGLVSSLNCERQGTMWNNGAKEDSNSGIFQQQGFMATIVQIWKVRGGVEINEVGRNLYTFRFLNEKHRAQVEEGGVYDLLVGFKTKEMAERIGKSMGNFIKWDKCNESVMSDCKEEDTNEIDQDDLP

SEQ ID NO: 151861 - protein, 49 aa, Glycine max
  Coding DNA Sequence Number=SeqID_35083
DPAWFGDQDVVDELFLMVGLGRANLKPLPVLLPPLREVPDALGDMRIFR

SEQ ID NO: 151862 - protein, 122 aa, Glycine max
  Coding DNA Sequence Number=SeqID_35084
KTDLTPSCMLHSARGDIAQLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPGVADRP

SEQ ID NO: 151863 - protein, 802 aa, Glycine max
  Coding DNA Sequence Number=SeqID_35085
  Gene Ontology: Mol. function=transferase activity; Biological process= flavonoid biosynthetic process
  Homolog annotation: Hit_ID=Q69TU8; Match level="QueryCoverage=31%, HitCoverage=57%, E-value=3e-79, Identity=61%"; Hit description=Sac domain-containing inositol phosphatase-like
  Pfam annotation: Domain name=Syja_N; Domain location=376-697; Score =137.4; E_value=3.8e-38; Accession=PF02383.9; Description=SacI homology domain
  Pfam annotation: Domain name=Transferase; Domain location=1-446; Score=288.3; E_value=1.4e-83; Accession=PF02458.6; Description =Transferase family
  Pfam module annotation: Pfam domain module=Syja_N::Transferase; Domain location=376-697::1-446
MITIVASYNVTPNQPTPSDPIWLSDSDQIGHLRHVNTIYAYKSRPNNTIDIERMKNSLSKILVPYYPIAGRLKLTKNGRMEVDCNAKGVTLIEAESTATFGDYGDFAPSDSTMELVPKVDYTRPSEDMPLMLVQLTRFCGGEGLAIGVAFSHPLVDGTAAIFFINRWAKLVRGEELDPNEVPFLDRTLLKFPEPSEPCVDLPEWKPVRFMPDNIAEQNKISAILLKLSSSQVEKLKKKANEQPSKEGVRPYSRFEAISSHIWRCASKAHHAHASDENHQPTVVTFSVDIRNRLNPPLPQNYFGNALAKTLTPKCSVGDILLNPLSYGAQKIRDAVYAVTYEYIRSHISYVLGQEQLDNIRAFFSGQGDLINEPYSGNPHNILITSWMSLPVYDADFGWGKPVHFGLAKVFREVRAHIIISPDGDVARQSLQRDDDCSQMQSHVDRPCRRIGQPHSTKKGIGGDIAVAARGLDDAALAGAQVLNIFQREREVCLGLRATKLSRISPMASFSLHENAPPVILMIHAGAISHAHVGSASVLVGDIDDALDSEKRYLKRGVNDRGRVANDVETEQIVLDEESGSCKGKMSSVVQMRGSIPLFWSQEASRFSPKPDIILQRYDPTYQATKLHFEDLAKRYGNPIIVLNLIKTVEKRPREMMLRREFANDVGYLNQILPVENHLRFIHWDFHKFAKSKSANVLAVLGAIASEALDLTGFYYSGKPSIIKRANKSNQTSTGRDTSLRDLRASSVDLVRIGNSNEMINSVVSVFSAHLIYGSQVNGSVIHSPSEFDAASMAFEIPLLTYG

SEQ ID NO: 151864 - protein, 144 aa, Glycine max
  Coding DNA Sequence Number=SeqID_35086
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6Z8I7; Match level="QueryCoverage=64%, HitCoverage=11%, E-value=3e-32, Identity=66%"; Hit description =Putative beta-D-xylosidase
MHFEVLDVSDYATDLADLVPEVWVEGSGGENDLGETGGGFDGAVESDAEAGIGDAVQRFTPPLVTRDAEPGNRRCRVDELGEFLVESEPRDEVLGSFADGEPGVAEWVVGEEKERDENGSGKVRKSHAICSGRKVPEMGENKCE

SEQ ID NO: 151865 - protein, 85 aa, Glycine max
  Coding DNA Sequence Number=SeqID_35087
MAHSSLLRYSLLSLGLFSERICSSAARLGPREGDVVINKGREVAWTVAALSKKPRGVRGEELAALGFNCSIIRTRFSERKCTHTG

SEQ ID NO: 151866 - protein, 37 aa, Glycine max
  Coding DNA Sequence Number=SeqID_35088
MTELESFAGVNAVKGDRYGDELSKLLFETNLALLEKA

SEQ ID NO: 151867 - protein, 93 aa, Glycine max
  Coding DNA Sequence Number=SeqID_35089
  Gene Ontology: Mol. function=molecular_function; Cellular component =cellular_component; Biological process=defense response
  Homolog annotation: Hit_ID=P83332; Match level="QueryCoverage=78%, HitCoverage=30%, E-value=4e-20, Identity=70%"; Hit description =Thaumatin-like protein 1 precursor
MKDTRGEWDDRVFDAKTKGGAVSSGAVEPSVVVGAFGLSPERTRLYGDGMSTEFDAPEANSKPVVDNCGFLSPVRVTGHTVYVHLFVKVTLAP

SEQ ID NO: 151868 - protein, 138 aa, Glycine max
  Coding DNA Sequence Number=SeqID_35090
  Gene Ontology: Mol. function=molecular_function; Cellular component =cellular_component; Biological process=defense response
  Homolog annotation: Hit_ID=P83332; Match level="QueryCoverage=78%, HitCoverage=44%, E-value=2e-34, Identity=69%"; Hit description =Thaumatin-like protein 1 precursor
  Subcellular localization annotation: CTP_CleavageSite=30; ConfidenceScore=5.01e-01
MFSLPGINWAHIFSLVMNSGQCKLRRCLIVAQGAKVTFTNKCTYTVWPVTLTGDKKPQLSTTGFELASGASNSVDIPSPYSRVRSGLKPNAPTTTEGSTAPLLTAPPVKSHAMVPVQSRRQPRQKLPLQKTEDKISMR

SEQ ID NO: 151869 - protein, 243 aa, Glycine max
  Coding DNA Sequence Number=SeqID_35091
  Gene Ontology: Mol. function=molecular_function; Cellular component =cellular_component; Biological process=defense response
  Homolog annotation: Hit_ID=Q2VC78; Match level="QueryCoverage=59%, HitCoverage=100%, E-value=7e-52, Identity=71%"; Hit description =Thaumatin-like protein
  Pfam annotation: Domain name=Thaumatin; Domain location=47-238; Score= 70.2; E_value=6.8e-18; Accession=PF00314.8; Description=Thaumatin family
MRAGMFQKCEIIFKVVLSKTIFTKILLNLSVFTTVLVAQGAKVTFTNKYIYMLWPVTQTGDQKPQLSTTGFELSWLQEHQTLYVDLPSPWSSAFRARTECSNNNGRFNCATVDCTSDQVACNGAGSILPATKAEITVAENRGQDFYDVSNVDDFNIPMSLTAQGGSGDYKTLGCLRNINHVCPSQLQQPGPSGNVIACKSACVAFNADRYCHLGDYLGDRYCFGVLFMPAPFRLVFNIKPFKE

SEQ ID NO: 151870 - protein, 73 aa, Glycine max
  Coding DNA Sequence Number=SeqID_35092
MTLINYKTPDETRIEILLDLRRTMKDTRGEWDDRVFDAKTKGEETPSIVINYDQGPVHLHRNEVDNQYSLYFS

SEQ ID NO: 151871 - protein, 195 aa, Glycine max
  Coding DNA Sequence Number=SeqID_35093
  Gene Ontology: Mol. function=sugar binding; Cellular component =cellular_component; Biological process=protein amino acid phosphorylation
  Homolog annotation: Hit_ID=Q2PP74; Match level="QueryCoverage=99%, HitCoverage=70%, E-value=6e-71, Identity=68%"; Hit description =Lectin-like protein
  Pfam annotation: Domain name=Lectin_leg-like; Domain location=1-193; Score=-106.9; E_value=0.032; Accession=PF03388.4; Description=Legume- like lectin family
  Pfam annotation: Domain name=Lectin_legB; Domain location=1-192; Score=163.1; E_value=7.3e-46; Accession=PF00139.10; Description =Legume lectin domain
  Pfam module annotation: Pfam domain module=Lectin_leg-like::Lectin _legB; Domain location=1-193::1-192
  Subcellular localization annotation: CTP_CleavageSite=80; ConfidenceScore=5.11e-01
VGRALHVTPIHLWNKNNGELADFSSGFSFVVNPKGSTLRGDGFAFFLAPANLNFPKNSSGGYLGLFNPETALDPSKNQIVAIEFDSFTNDWDPNSPNQSPHVGIDVDSIKSVATVPWPSELEPDNAVAHASLNYNSESKSLSVFVGYPDNRNATVSTIVDLRNVLPEWIRVGFSASTGDLVETHDILNWSFEAAL

SEQ ID NO: 151872 - protein, 1025 aa, Glycine max
  Coding DNA Sequence Number=SeqID_35094
  Gene Ontology: Mol. function=nucleic acid binding; Cellular component= proton-transporting two-sector ATPase complex; Biological process=DNA integration
  Pfam annotation: Domain name=rve; Domain location=201-364; Score =193.0; E_value=7.1e-55; Accession=PF00665.16; Description=Integrase core domain
  Pfam module annotation: Pfam domain module=RVT_2::rve; Domain location=549-783::201-364
MVTTNDEGVIVDWWYLDTGCSNHLTGNRQWLINYDSSKESRIRCADDEYLVAEGMGDVLVKLKDGGTVLIENVWYVPGMKSNLMSVGQLLEKGYSVTMRDAVLQLFDNSDKLVLKSKLSRNRTFKCNVKDSGVKVLSTVTESQSWLWHRRFGHLNFKSLTQLSEKELVTGMPKIGVCDKTCDVCLKGKQTRLPFADQSPMRASSPLHAVSSDICGPIEVPTLGGNKYFITFIDEFTRMIWLYVIKQKSEALEVFKKFKAVAETQSGQKLKILRTDGGGEYTSKAFEEFCEAQGVVHEVTPPYTPQHNGLAERRNRTLLDMARSMLKQKNMPHEFWGEAVTTSAYILNRCPTKSLKLKVPMEVWSGKKPSVSHLRVFGSLCYNHIPDVKRTKLQDKSEVMVLIGYHSTGGYKLYNPKLKKTCISRDLLIKEDESWDWEIGEVKFKAAPEIDICSDSESDDHSAAEVNNDGVNGVVAPNDDVPGDVVHDVPATPAVRPQRQKQLPRRLQDCEVLPDSAVTDEGDLIHFALLADAEPVNFTEALKISEWRAAMEDELRSIERNHTWDLVQLPKNKKPISVKWVFKLKLDPEGRIVKHKARLVARGFLQKQGVDYTEIFAPVARHETVRVIVSLASNKGWSLTHLDVKSAFLNGALEETVFVTQPPGFELEGKEEMVYKLNKALYGLKQAPRAWNRRIDAYLAQLGFKRCVVEHGVYVMLKEDNKVLMVCLYVDDLLVTGKLSYFLGLEFLWTEYGIVMHQRKYAGEILKRFGMEDCNVAITPAETNQKLEDKPEEEGVDPTGYKQLVGSLRYLCNSRPDICYAVGVLSKFMNRPKKSHFLAAKRVLRYVKGTMQYGVMFPSSVDGAEMKLIGYSDADWCGDRTDRRSTSGYLFKFGEAAVSWSSKKQPVTALSSCEAEYISGSFAACQAIWLKSLLDELKCEVQMPLSLLIDNKSAISLAKNPVSHGRSKHIETRFHFIREQVNNGVLKLIYCPTEDQLADLLTKAVKPDRFIKLREEIGVICFEDLN

SEQ ID NO: 151873 - protein, 308 aa, Glycine max
  Coding DNA Sequence Number=SeqID_35095
  Gene Ontology: Mol. function=calcium ion binding; Cellular component =cellular_component; Biological process=protein amino acid phosphorylation
  Homolog annotation: Hit_ID=Q2PP78; Match level="QueryCoverage=81%, HitCoverage=90%, E-value=7e-88, Identity=64%"; Hit description =Lectin-like protein
  Pfam annotation: Domain name=Lectin_legB; Domain location=25-261; Score=185.5; E_value=1.3e-52; Accession=PF00139.10; Description =Legume lectin domain
MANHAAQNPLSVFLTTFLLLITSAKSDLFSFNIPRFEPGALNILLDGSAKTTGGVLQLTKKDKSGNPTQHSVGLSAFYAALHLSDAKTGRVANFATEFSFVVNTKGAPLHGDGFTFYLASLDFDFPDNSSGGFFGLFNKKTAFNTSLNQVVAVEFDSFANEWDPNFPQSDSPHIGIDINSIRSVATAPWPLDIQPQGSIGKARISYQSSSKILSVSVAYPNSPVNLNATVLSYPVNLGAVLPEWVLFGFTASTGVAVYAFEGIGMVLPLETKVKDKQRFGDGETVLRVKVLLVAEVGDGVGHKLGGAF

SEQ ID NO: 151874 - protein, 43 aa, Glycine max
  Coding DNA Sequence Number=SeqID_35096
MTTGDSTQQKTSQGNEKKKEDENITHVVAEFYAFKRYLSLLQT

SEQ ID NO: 151875 - protein, 217 aa, Glycine max
  Coding DNA Sequence Number=SeqID_35097
  Homolog annotation: Hit_ID=Q1SKD7; Match level="QueryCoverage=55%, HitCoverage=30%, E-value=5e-08, Identity=32%"; Hit description =Ankyrin
EMAPKKLYTKRSRRDTIREGSNAASEFDSHRFQSVEHQQRFGAIRGWSFHRERRVQLREDEYTDFQEEIALRRWTPLVTSMAKFDPEIVLEFYANAWPTEEGEGQQCEFSQRRSRADGFDEEAIAQLLCIPGNVLPSDHNSDLPLPKCQLVYAILTRMSAHVAQVIAGALYLFAGMAPTRHPLDPDMSNKALGGVQIAIRLTWAFQDVPTEGGAFWW

SEQ ID NO: 151876 - protein, 116 aa, Glycine max
  Coding DNA Sequence Number=SeqID_35098
  Subcellular localization annotation: CTP_CleavageSite=51; ConfidenceScore=5.24e-01
MCPPKGVVWNSSNRAVVKRLSNGSQIFPKKKMRSLLMVKLGANDLRHKFFQASMIGDDNERMSQKEGEVLTNSSESRLGGKYTQFECSFNLVMIPHGWSILAKYSDPDWSPYDFTW

SEQ ID NO: 151877 - protein, 69 aa, Glycine max
  Coding DNA Sequence Number=SeqID_35099
MLTTDLSALGSLVAKDHSHVALHVRFKVDGDADAIAGGGGGGGEGGGGGEAASSSPTTLGVICMDKGLT

SEQ ID NO: 151878 - protein, 374 aa, Glycine max
  Coding DNA Sequence Number=SeqID_35100
  Gene Ontology: Mol. function=ferric iron binding; Cellular component =chromatin; Biological process=aromatic compound metabolic process
  Homolog annotation: Hit_ID=Q9SPU5; Match level="QueryCoverage=62%, HitCoverage=62%, E-value=2e-59, Identity=48%"; Hit description =Putative transposase protein
  Pfam annotation: Domain name=Transposase_21; Domain location=123-316; Score=247.2; E_value=3.5e-71; Accession=PF02992.5; Description =Transposase family tnp2
MYEHLIINGIKRDYVIWEHHGEVISEPDEFDDDDDDDQNNCNDGVRDMLHDLGSAMNIENITGTEEINYTTGTDTNSVNEEEDKFSKLFFIAEQELYPAFPQGNKVHVSYYEARKFIRELGLDYVKIDACLNDCILYRADSITWKTLDSKYPSFAADPLPYNLPPWMCMKDPFFMMSLLIPSPTAPGNDIDVYLQPLIEELKELWEKGVVTYDASTKETFRLYASILWTINDFPAYGNLSGWSTKGRYACPCCNMDTWSSWLLNGGKFSYMGSRRFLPHDHSWRNNAKAFDGKKEKQSAPKPLFEDDIIEQYQHFDQARIAGPVQYRWMYPIERYLRRLKSYVKNKARPEGSIDILHKNVCISVLGTYMELRQD

SEQ ID NO: 151879 - protein, 202 aa, Glycine max
  Coding DNA Sequence Number=SeqID_35101
  Gene Ontology: Mol. function=thymidine kinase activity; Biological process=metabolic process
  Homolog annotation: Hit_ID=Q8LIR0; Match level="QueryCoverage=76%, HitCoverage=21%, E-value=4e-20, Identity=34%"; Hit description =Selenium-binding protein-like
  Pfam annotation: Domain name=PPR; Domain location=102-136; Score =20.3; E_value=0.007; Accession=PF01535.11; Description=PPR repeat
MECLKYVRKKKKKKRRSVYQKEQGTKRDPDSCFDCCGIKLQPQTNLDEARTLHALLLVLGFFQPTCPHTSSFASQLVNVFVNFGSLQHAFLTFRALLHKPNIAWNAILRGLVGVGHFTKAIHFSHSMLQHEVTPDNYTYPLVLKACSSLCVLELGRWVHDTMLYNELHCKTKANVYVKCVVIGMFAKCGSLERDTLYLDIYI

SEQ ID NO: 151880 - protein, 275 aa, Glycine max
  Coding DNA Sequence Number=SeqID_35102
  Gene Ontology: Mol. function=two-component sensor activity; Cellular component=integral to membrane; Biological process=two-component signal transduction system (phosphorelay)
  Homolog annotation: Hit_ID=Q31DJ5; Match level="QueryCoverage=91%, HitCoverage=26%, E-value=4e-63, Identity=47%"; Hit description =Diguanylate cyclase/phosphodiesterase (GGDEF & EAL domains) with PAS/PAC sensor
  Pfam annotation: Domain name=EAL; Domain location=19-260; Score =389.1; E_value=6.6e-114; Accession=PF00563.11; Description=EAL domain
MTLNYYRKGVMHDQVLPPDELAFASELEAAIAHQEFYLDYQPQIDFMTGKLVGVEALIRWRHPQLGVVPPAKFIGVAELTGLIVPMGAWVLKAACQQVAAWKTGALSKVKVSVNVSPLQLRTPGFNDFVLQVLRETGLSPERLVIELTESAFVHSDCTGIESLQALKQLGVKLAIDDFGTGYSCLAYLRDIPGDYLKVDRSFVNDVPGKERSEAVTSAIVVLGKNLHYQIVAEGVETQAQADYLKSLGCDLAQGYLYAKPMSEQALQHWVDERHS

SEQ ID NO: 151881 - protein, 43 aa, Glycine max
  Coding DNA Sequence Number=SeqID_35103
MAFNARVISNGVSWGSCPNSTPRPPSAIAHKNSAATIQRKCWP

SEQ ID NO: 151882 - protein, 127 aa, Glycine max
  Coding DNA Sequence Number=SeqID_35104
  Homolog annotation: Hit_ID=Q6CQF3; Match level="QueryCoverage=45%, HitCoverage=61%, E-value=7e-10, Identity=73%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVRRKEADWWDPPVGRCGCSVEPRHGIESSKWAIFGKQNWRCGMNRKLGYGAQLRANLDPTKGVGRLRQQDGGHGSRNPLRSV

SEQ ID NO: 151883 - protein, 157 aa, Glycine max
  Coding DNA Sequence Number=SeqID_35105
MTDACRRESTTLCELSETFELNNFCFAPEDLKRVYLLMIWAIELGRIDFGTCRGAEVSSSANTTRKRAFCDALTTSVQRNHRSRPTMSGNLQKRKIQLAKDVYSCPFCGREEESNSHLLLTCYATDRLRKWFYSWLDIRIVLSQAIHNHFWQHSSLV

SEQ ID NO: 151884 - protein, 131 aa, Glycine max
  Coding DNA Sequence Number=SeqID_35106
MTLSGQNSKTSTSLPSGTLERWQRHSKRHDFGYMAVVGAAGPLRLQVLHGGKQNVRVVAGWSSRRDEVVQAIAGALGFWRVRERVFTVRLYKLQNLRRCLMTSTLYVTISRTVYLQAPSFMTSIKTTTTGL

SEQ ID NO: 151885 - protein, 335 aa, Glycine max
  Coding DNA Sequence Number=SeqID_35107
  Homolog annotation: Hit_ID=UPI0000DBF0F4; Match level="QueryCoverage =84%, HitCoverage=86%, E-value=1e-18, Identity=33%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
MKVIVIFEHSEGEDFKTSKVFEPSKVEEFESSEGKDFGPSKGENFESCDGDDFEPSEDEDFEFSEGKNIDSSDGKNFEPNKDEDFESCEEFELSEGEDFESSKARTLSPLMARASSPLMAMTLNPKGEEFESSEGENFESSDGEDFEPFKGENFESSDGEDFELSKGGDFESHDGQDIEPSKGEDFESSTGENFETFDGEEFEPSKGEDFEPSEGEDFEPSEGEDFESSKVFEHSKGEEFESSEGKDFGPCKGENFESCDGDDFEPSKDEDFEFSKGKTFESFDGEDFESCKARTLSPLKERNLCPLMARTLSALKARTLSSLKARTLSPLRREL

SEQ ID NO: 151886 - protein, 56 aa, Glycine max
  Coding DNA Sequence Number=SeqID_35108
MHDAIKEQARGLSVTMHHQKRKTLDDASLLSSELETQHDHRSTSIPYGLHRPGYRA

SEQ ID NO: 151887 - protein, 248 aa, Glycine max
  Coding DNA Sequence Number=SeqID_35109
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=7e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLASRGLDVLALRGLHVLAFRGLRALTFKGLHVLAFRGLRALAFKGLHVLAFRGLHALTFRGLHPLAFRGLHVFPFRGLHVLAFRGLHAFAFRGPHALAVRGLHVLAFRGLHVLTFRGLHVLAFRGLHALAFIGLHALAIIRLHVLPFRGLHVLAFRGLHVLAIIRLHVLPFRGLHVLTFIGLHALTFRGLHILTFRGLHALVFRGLHVLTFRGLHVLAFGGLHALAFRGLRVLTFSGLHIHTLR

SEQ ID NO: 151888 - protein, 44 aa, Glycine max
  Coding DNA Sequence Number=SeqID_35110
QGTERSRSVGILGPALELATPSLVLLPASLVGLKAELSFSLRES

SEQ ID NO: 151889 - protein, 161 aa, Glycine max
  Coding DNA Sequence Number=SeqID_35111
  Gene Ontology: Mol. function=DNA binding; Biological process=DNA integration
  Homolog annotation: Hit_ID=Q1SIT1; Match level="QueryCoverage=80%, HitCoverage=42%, E-value=2e-30, Identity=48%"; Hit description =Integrase, catalytic region
MSPYRVVFGKTCHLPVEIEHKAYWAVKTCNFSMDQAGEERKLQLSELDEIRLEAYENSKFYKDKTKKFHDSLIAKKDFVVGQKVLLYNSRLGLMSVEIKSESTDKSFKVNGHRLKSFLTNPCLVDVVVEETSLLHPTSLLPRLRKFSFSVSFNFIALVQIY

SEQ ID NO: 151890 - protein, 105 aa, Glycine max
  Coding DNA Sequence Number=SeqID_35112
  Subcellular localization annotation: CTP_CleavageSite=24; ConfidenceScore=5.04e-01
MPLKGVGHLIAILASSTSYTKPTYASVYSTSSVPGRQHNNYDYNQESALDKKFREEVLMEEENARGKGGHMGSFIEKLKGSFHGKLEEENFLEKLERGYSHPSNS

SEQ ID NO: 151891 - protein, 102 aa, Glycine max
  Coding DNA Sequence Number=SeqID_35113
MSLATLFGKLQEHKMELLRLNQHEENDKKKKGISLKASSSIQEERDKEDDLNEDDDLSLFVKRFNKFLRIRGNQRRPNFKPKEGQKIHPLLQNALNAINLDI

SEQ ID NO: 151892 - protein, 70 aa, Glycine max
  Coding DNA Sequence Number=SeqID_35114
  Subcellular localization annotation: CTP_CleavageSite=24; ConfidenceScore=5.27e-01
MVFPLSFLDPSSPMLASSSLGPPNDFMVKEPARLGEPVTSGVSQLTLRREGDARLTGASSKEGKRTESSP

SEQ ID NO: 151893 - protein, 245 aa, Glycine max
  Coding DNA Sequence Number=SeqID_35115
  Gene Ontology: Mol. function=chromatin binding; Cellular component =chromatin; Biological process=chromatin assembly or disassembly
  Homolog annotation: Hit_ID=Q1SAV4; Match level="QueryCoverage=71%, HitCoverage=55%, E-value=6e-38, Identity=38%"; Hit description =Integrase, catalytic region
  Pfam annotation: Domain name=Chromo; Domain location=129-181; Score =25.5; E_value=0.00019; Accession=PF00385.14; Description='chromo' (CHRromatin Organisation MOdifier
MALAEWSYNTSLHSSMGVTPYEFTYGKPPPSIPHYILGTSTNEVVDSLLSTREAIHSSLKSCLLKAQAAIKKHVDAKRRDEEYETSVASANHHKLAKCFYGPFVILEHIRSMAYRLQMSENSKIHLPVLEPLSILSSKVDSSTDPSTRLVLVQWLGLPLEETSWENWDEIRDIYHPGWGGVATVVTKLFNIVEPGVDVFGKKDYQQWRLIQRMVEESAMRNAYLIINQQLFNYSVFTFTMLILSN

SEQ ID NO: 151894 - protein, 233 aa, Glycine max
  Coding DNA Sequence Number=SeqID_35116
  Gene Ontology: Mol. function=protein dimerization activity; Cellular component=nucleus; Biological process=regulation of transcription, DNA-dependent
  Homolog annotation: Hit_ID=Q7XD60; Match level="QueryCoverage=92%, HitCoverage=32%, E-value=1e-44, Identity=38%"; Hit description=HAT family dimerisation domain containing protein
MRRKKGQTILIPMFAHGKKELTCGSFSQEEAIRVLVCAIIMHEYPLSIMDHVGFRRLLDLLQPLFEVPSWNTLKKEIFNVYQDEEQMVMKMLDTKEGRVAITLDIWIERNKKKADRLYIALVNYLWDWNIDAKLSTITLDNCSTIICMIDKIKDKLQLNTLIKEGSLLHMHCCVHILNLIVKKGFGVLKDEVENILDNIAHYTATPKKVENFEETAKQLRTPYTKKLCLDCPT

SEQ ID NO: 151895 - protein, 97 aa, Glycine max
  Coding DNA Sequence Number=SeqID_35117
  Subcellular localization annotation: CTP_CleavageSite=48; ConfidenceScore=5.28e-01
MSSYSPFAKRQLHAKHIFGHALSRKSQALSVQPLHLRLIGSAKLAKVELSRKSQALSVQPLHLRLIGSAKLAKVELSRKSQALSAQPLHVLHALHAS

SEQ ID NO: 151896 - protein, 153 aa, Glycine max
  Coding DNA Sequence Number=SeqID_35118
MYKDKWTQPWPMGSEIYPEVHENPRAFFNSSSLILLEPLAHGSGDWSLLREDCITTQKTYITDKGEDGSSLTDVSSSKPSSSSLDTRSIKSTMDGATLQEPAPVKDMQQGLDGGTQGLGNTDCGEIETWRVASESLDEESNMVEDISSSTGSE

SEQ ID NO: 151897 - protein, 1248 aa, Glycine max
  Coding DNA Sequence Number=SeqID_35119
  Gene Ontology: Mol. function=RNA-directed DNA polymerase activity; Cellular component=chromatin; Biological process=chromatin assembly or disassembly
  Pfam annotation: Domain name=Chromo; Domain location=1152-1206; Score= 55.0; E_value=2.5e-13; Accession=PF00385.14; Description='chromo' (CHRromatin Organisation MOdifier
  Pfam annotation: Domain name=rve; Domain location=860-1016; Score =108.5; E_value=1.9e-29; Accession=PF00665.16; Description=Integrase core domain
  Pfam module annotation: Pfam domain module=Chromo::RVT_1::Retrotrans _gag::rve; Domain location=1152-1206::554-723::134-224::860-1016
MEGRVASLENEISKLKASVEVLRSQSEKQNTKQDTIAANQEKLMDLFTKSFGKDNPEDGESSVGKNSRGKGAKGDAEKSNFRTITLDGDALNEFRQSMKKIELPTFIGEDPAGWISRAEIYFQVQNTSEALKVSLAQICMEGGTIHFFNSLLNDYEDLTWEDLKRELMERYGGIEEGTVFEQLTSLRQTGTVEEYIRRFESFVAQVPRLMEGQYFAYFTNGLREDIRARLRSLNMAAPLSRGCLMNTTQALEAELAHGSRGWQTRVDTRGGGGFGFVPKSQHSGSNTGHGGLKGLVIGECPVKQLKLILVNEEIQVECEEEETPNDEGSDEDYVVLEGKCSVLTLRGLDTDNRDFPSTMKIRGTVGGIPNTKKMRILMGDGHKADTCGICRNICVEIEAGNVLIDAVLFELGDIDIVLGMSWLHSLGEMTIDWSKKIMKFKEGGMSKMLKGIAGEEPLLASLEGILNEEKGHRDGELNQQKRLELEEILKEFDDVFQEPRGISPERVKAHSITLKPGEAPVNVRPYRYPYHQKNEIERQVKELLENGWIRHSQSEYSSPVILVKKKSNQWRMCVNYRALNKATVPDKFPIPVIEELLDELHGAKYFSKLDLRSGYHQVRMKVEDIPKTAFGTHEGHCEYLVMPFGLMNAPATFQSLMNEVFRDLLRRGVLVFFDDILVYHEEWEEHIEGLRAVLGILRQHCLYANKEKCSFGQMSVGYLGHIITQQGVEVDPNKVKSIVEWLVPKNVKGVRGFLGITGYYRKFIKDYGKERRPIAYFSKALGSKNLAKSAYEKELMAVALAIQHWRPYLLGRKTYRRLALNVFWIGMRRDVMKFVQNCDICQRQKYLTTAPGGLLQPLPVPAQIWEDISLDFITGLPRSKGYEAVLVVVDRLSKYSHFIPLKHPYTARTVVELFIREVVCLHGVPSFVISDRDPLFMSVFWKEFFRLQGTVLKMSTAYHPQTDGQTEVTNRCLETYLRCFIGDKPRSWVQWLSWAEYWFNTTYHESIGITPFEAVYGQKPPALVRSVPGEIRVAAVFKDLQDRDEILRQLKIHLERARERMKHQVGDMVFLKLKPYRQASVKNRTNPKLCARYYGPYEVFERIGEVAYRLKLPATSRIHLVFHVSLLKKAHGEYPVETELLLDLEEGTVAIAEPEAVLEVREVSKGGKRVIQWLVSWKGQPSEEATWEDEVLMRSQFPELKLEDKQLFLGGGIDRDQGIIGPKEPLANETLKSPREWIVYTRRKKRAN

SEQ ID NO: 151898 - protein, 152 aa, Glycine max
  Coding DNA Sequence Number=SeqID_35120
  Gene Ontology: Mol. function=tetrahydrofolylpolyglutamate synthase activity; Cellular component=cytoplasm; Biological process=folic acid and derivative biosynthetic process
  Homolog annotation: Hit_ID=Q9FN53; Match level="QueryCoverage=88%, HitCoverage=27%, E-value=5e-50, Identity=69%"; Hit description =Folylpolyglutamate synthase-like protein
MKDFLDYLDSLKNYEKSGVPKGAGTDSSDGFDLGRMRRLMERFGNPHSKFKAVHIAGTKGKGSTAAFVSNILRNEGYSVGCYTSPHILTIRERILLGKSGHPVSAKLLNDLFRRIKPDIDQAMKEENGCISHFEVLNVEPHQCLNVVKKLLW

SEQ ID NO: 151899 - protein, 258 aa, Glycine max
  Coding DNA Sequence Number=SeqID_35121
  Subcellular localization annotation: CTP_CleavageSite=35; ConfidenceScore=5.68e-01
MVTPLASLPPPPPSPPPSPLAVASESPSTLKRTCKATRLQSLATRSPGANRPVVHIDPATGKADGPHKKKLRTYLGIVARDKVNVTYETWKQALAAQKDLIWEDIQAEFDIPEASDGNGHLRLTMTVWMTLLAKNMALARRNEPNFVRPAETPRWRTKVDAEKTKKKLEEAASSRSTEAVIDPPSPIRRHINWKMARTKKTNQMTSDAAMEIAEKIASQDSFVPHGRQDVLTAAIGRPEYPGHVHVAGAGVTIKQYFE

SEQ ID NO: 151900 - protein, 394 aa, Glycine max
  Coding DNA Sequence Number=SeqID_35122
  Homolog annotation: Hit_ID=Q1T493; Match level="QueryCoverage=56%, HitCoverage=47%, E-value=2e-24, Identity=28%"; Hit description =Nucleic acid-binding, OB-fold, subgroup
  Pfam annotation: Domain name=DUF223; Domain location=46-141; Score= -9.7; E_value=0.023; Accession=PF02721.5; Description=Domain of unknown function DUF223
GLRYKVMACFPDKIKLIDGSRETLKLFVRITDLWFIGIPEKSKQAEMVVVDSDGDEIHVVCKQDQLKSWKDDFKENLTYVMHNFKVMKNDGKFRICDHEYKLSFIGVTVVRQCNMEHLPFRKFRFVDFSTVIAGHFETGLLVLMAFQITCVYLVVALDVIGVVDEVVEDERLIVILLTHARIKEAQGSYPLSVSNSFRASKLMINELVLEIQEFRESLLDLGIEDRECAELIGQSVDEVNRLKIEDGDVDLNASPQALDRLLGCFLAFKVKVQPRFRNVVVLKYSDELDFINVVLDMLPDTETESSILDSTDPTELESQSVSVTVDDDRSMLDSAEPTELESQSVSVTADHDPLLRIPLTPTKRVSSDDDGHKNFEISPAEVSSNKLAKLCQPE

SEQ ID NO: 151901 - protein, 192 aa, Glycine max
  Coding DNA Sequence Number=SeqID_35123
MNNTSSTTSSEMKNPMIGPPLIIQFMATFNNDKNIIQLPAFYHTQWALQYPEFAHLRYNGAIYEIRVRRHKEKVYLVDGLKNFRKDLKIYESTTFNFFAHDHHCVFDIHFIPPLERQTCGRQRHSSRKHIWTVRFTQEMLDAPESLKFPRCTEVPLKAYGYHMIVLRRSGPPLQWKVETLNPAIGGKGVVQP

SEQ ID NO: 151902 - protein, 147 aa, Glycine max
  Coding DNA Sequence Number=SeqID_35124
  Homolog annotation: Hit_ID=Q1S159; Match level="QueryCoverage=62%, HitCoverage=25%, E-value=4e-23, Identity=65%"; Hit description=SH3
AIEVSKRQAKVRETPGNSENSMKLEAVETKLQDLKTNMAILGKEVAAAMVVVEAQQQRLTLHHLIAMVEAKRAYHQRVLQILDQLEEEISEVRDAHNLKKEATYLNECSQDMREAATYLKLADEETPNSRTAVTSRKMQCRGGGRRR

SEQ ID NO: 151903 - protein, 1465 aa, Glycine max
  Coding DNA Sequence Number=SeqID_35125
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=98%, E-value=0.0, Identity=56%"; Hit description=Chromo
  Pfam annotation: Domain name=Chromo; Domain location=1348-1402; Score= 35.7; E_value=1.7e-07; Accession=PF00385.14; Description='chromo' (CHRromatin Organisation MOdifier
  Pfam annotation: Domain name=RnaseH; Domain location=853-971; Score= -20.2; E_value=0.0044; Accession=PF00075.14; Description=RNase H
  Pfam annotation: Domain name=rve; Domain location=1101-1201; Score= -10.2; E_value=0.042; Accession=PF00665.16; Description=Integrase core domain
  Pfam annotation: Domain name=zf-H2C2; Domain location=1042-1083; Score=20.6; E_value=0.00066; Accession=PF09337.1; Description=His(2)- Cys(2) zinc finger
  Pfam module annotation: Pfam domain module=Chromo::RVT_1::Retrotrans _gag::RnaseH::rve::zf-H2C2; Domain location=1348-1402::593-762::124 -214::853-971::1101-1201::1042-1083
MAENTRMKELSSDIKRNAESIEKMYNDFHEKIDRLEIANASRFEAMQTNTESKFSQINNALDMLLNQSPHKSSHGVGNSSKQPFQVRNIKLEFPRFDGKNVLEWIFRAEQFFDYYGTPDPDRLTIASVHLDKDVVPWFQMMQRSHPFHSWVEFTRALELDFGPSIYECPRATLFKLSQTGTVADYYLQFTSLANKVYGLSNDALIDCFISGLIPEIRRDVMIHTPISMVKVVSLAKVYEEKYTSTSKPHKSTPSNSYNHRAPFNSNKPENTQKANHTPLLQTLPTRPMNPNQRNPNIKRISPAEMQLRREKGLCYWCDDQFSLTHKCPNRQVMMLQFDDSEKHIEPEPEKAQLDMTCNEPDPTTNDHHLSLNAMKGTNSMGILRFTGQIGQISVQVLIDGGSSDNFLQPRIAEFLKLPVEPGPCFKVLVGNVQTMTAEGVVPNLSITLQGHELIVPVFLLPVAGADIILGSSWLATLGPHVADYAALTLKFLYKGKFVTLQGERGTSPKLAQFNHCRRMQNTDAIAETFAVQLLQFHTEEDILKELPQDIAPEIALLLHTYSSVFQTPTALPPPRSQNHAIPLMEGIIQPSTSPFSSPILLVKKKDGSWRFCTDYRALNAVTIKDSFPMPIVDELLDELFGAKFFSKLDLRLGYHQILVQPEDRHKTAFRTHHGHYEWLVMPFGLTNAPATFQNLMNQIFHDALRKYVLVFFDDILIYSSTWNEHLTHLENVLRVIQQHVLFVKLSKCSFGVLEIEYLGHIVSGQGVSMDNSKVQAILQWPPPNNVKQLRGFLGLTGYYRRFIKAYARIAAPLTELLKKDGYLWTDETEIAFLRLKEAMMSAPVLGLPNFQQPFILETDASGVGIGAVLHQNGHPIAYFSKKLAPRTQKKSAYFREMLAIAEAIAKFRHYLLGHRFVIRTDQKSLRSLMDQSLQTPEQQEWLHKFLGYDFTIEYKPGKDNLAADALSRVMTLSWSEPENSIVLKLKEALQKDPKLQVIMQQCVEQPLLHPNYSVKGDLLYRKDKIVVPMDVDLRQHLLQEFHSSPIGGHSGITRTMARMTEQFYWPDMKQDVQKYVQSCAICQQAKTLHTKPAGLLQPLPIPSQVWEDISMDFITRLPNSYGFNTIMVVVDRLSKYGHFIALKGDYTSKSVAELFKYVEMFLRCFTFNNPKAWYKALSWAEFWYNTSFHTSIGMTPFKALYGRDPPALIRYTPEASDPVTLQEQLTNRDRILQQLKQHLERAQVYMKNQADKKRIDVSLEVGDLVLVKLQPYRQHSVTLRRNQKLGMRYFGPFPVTAKIGKVAYKLQLPDEAKIHPVFHISQLKPFKGVPHDQYMPLPLTTTDTSPIIAPVAILQTRSVKQGSSFIPQVLVQWENTTPAEATWENFNEMLDSFPNLNLEDKVVINGDGIAMNENREITFSAKSAKGDPHGNKGNHAVSIDPGIMVQKKGMRKRVTSSRLRDYVHT

SEQ ID NO: 151904 - protein, 93 aa, Glycine max
  Coding DNA Sequence Number=SeqID_35126
MGDVDFKHNQACACEMVGDQEGGVGKEFFQEDEEDIIAMNENREITFSAKSAKGDPHGNKGNHAVSIDPGIMVQKKGMRKRVTSSRLRDYVHT

SEQ ID NO: 151905 - protein, 154 aa, Glycine max
  Coding DNA Sequence Number=SeqID_35127
  Gene Ontology: Mol. function=protein disulfide oxidoreductase activity; Biological process=cell redox homeostasis
  Homolog annotation: Hit_ID=Q9LI27; Match level="QueryCoverage=83%, HitCoverage=32%, E-value=1e-09, Identity=32%"; Hit description =Peptide transporter protein-like
  Pfam annotation: Domain name=Glutaredoxin; Domain location=27-83; Score=2.1; E_value=0.09; Accession=PF00462.14; Description =Glutaredoxin
MLDATDAPNLGTRTGWRDKRKRRNSPSSIFEDCNYVCDVLDGHRVVLDERNMSLHGEFLKEVKELVDEEGVALPRVFMKGRCVGGLEELVELNETDRLGRILNATRVERGIGRQTCGGCGGARFVPCFNCAGSCKIVWRGDERVVAKGGGRKTG

SEQ ID NO: 151906 - protein, 133 aa, Glycine max
  Coding DNA Sequence Number=SeqID_35128
  Subcellular localization annotation: CTP_CleavageSite=21; ConfidenceScore=5.17e-01
MAVGMGTNLPSLLYWNILDPSGTYSGGSRMLGSTAFPCLTSGPSSLRTEECLVVAYIILALLLGIVAYDYQREVMCFVDFTADETSDLCTAQKVGEQLESYHKASSLTPAIQLGTLCCKLATMSFGFTDTFDI

SEQ ID NO: 151907 - protein, 159 aa, Glycine max
  Coding DNA Sequence Number=SeqID_35129
  Homolog annotation: Hit_ID=Q9STA6; Match level="QueryCoverage=36%, HitCoverage=14%, E-value=4e-12, Identity=65%"; Hit description=RAD23 protein
MDAGTDKEKDKGKKKEETPSSNPTTLVLKVDMHCKGCASRIAKCLRGFEEIAQGVDVYPGAQRMLIHQGKVLKDATTLEENKVVEDNSVVIMLSKIIYMDTSGTEIALGTIFALLCFFPHLSIADVMYHPVGLLTKDKIIIFFSTVNNILEVIFASNSI

SEQ ID NO: 151908 - protein, 80 aa, Glycine max
  Coding DNA Sequence Number=SeqID_35130
  Gene Ontology: Mol. function=oxidoreductase activity, acting on the CH-OH group of donors, NAD or NADP as acceptor; Biological process =malate metabolic process
  Homolog annotation: Hit_ID=Q1SRX6; Match level="QueryCoverage=70%, HitCoverage=9%, E-value=6e-18, Identity=77%"; Hit description=Malic oxidoreductase
MVVAGRIKQLTSLLANHNAFELLAKYGTTHLIFNDDIHGTASVVVAGVVAALKLIGGTLPEHTFLFLGAGEGREATKSNL

SEQ ID NO: 151909 - protein, 79 aa, Glycine max
  Coding DNA Sequence Number=SeqID_35131
MTQPPGFESFDKSLLLASRQHNLLRKEEGTKKKDSIKQGYSLIVCGAFADQAHHSSLDIVTEILLIVILRGNSMLTSIG

SEQ ID NO: 151910 - protein, 112 aa, Glycine max
  Coding DNA Sequence Number=SeqID_35132
  Gene Ontology: Mol. function=nucleic acid binding; Cellular component= intracellular; Biological process=regulation of transcription
  Homolog annotation: Hit_ID=Q9STM3; Match level="QueryCoverage=99%, HitCoverage=8%, E-value=6e-47, Identity=78%"; Hit description =Putative zinc finger protein
  Pfam annotation: Domain name=JmjC; Domain location=1-47; Score=-16.6; E_value=0.019; Accession=PF02373.13; Description=JmjC domain
MSPEVFISAGVPCCRLVQNAGEFVVTFPRAYHTGFSHGFNCGEAANIATPEWLRFAKDAAIRRASLNYPPMVSHFQLLYDLALALCSRIPAGISAEPRSSRLKDKKKGEGET

SEQ ID NO: 151911 - protein, 285 aa, Glycine max
  Coding DNA Sequence Number=SeqID_35133
  Gene Ontology: Biological process=regulation of transcription
  Homolog annotation: Hit_ID=Q1SG54; Match level="QueryCoverage=52%, HitCoverage=25%, E-value=7e-44, Identity=57%"; Hit description=GRAS transcription factor
  Pfam annotation: Domain name=GRAS; Domain location=29-215; Score= -93.7; E_value=0.00055; Accession=PF03514.5; Description=GRAS family transcription factor
MGLKPNKKEQHIPGQFPGPTGLRLPENRHVRFSLSPSTNTVFWSGLAPATTISFKKDYYAFYDKECSRIAEYMYLGSDTMAKTIELLRWYWRPFSFSFSLSISLKNPSNLPFSYKAVFVTDIAEIREDHFEIGEDEAMAVYSPYFLRSMVSRPDCMENLMRVIRNIKPVIMIVLEVEANHNSPSFVNGFIEALFFYSAYFDCLETCIKHEIECRMTIEAVLSEGIRDIVAMEGRERTVRNVKIDFWRRFFARYRMVETGEKRESGVKQKRQREVKKTLEFAEKWK

SEQ ID NO: 151912 - protein, 92 aa, Glycine max
  Coding DNA Sequence Number=SeqID_35134
  Gene Ontology: Mol. function=protein dimerization activity; Cellular component=nucleus; Biological process=regulation of transcription, DNA-dependent
  Homolog annotation: Hit_ID=Q1RWA7; Match level="QueryCoverage=95%, HitCoverage=13%, E-value=7e-33, Identity=67%"; Hit description =Transcriptional factor B3; Auxin response factor; Aux/IAA_ARF _dimerisation
  Pfam annotation: Domain name=B3; Domain location=35-92; Score=0.3; E _value=0.072; Accession=PF02362.12; Description=B3 DNA binding domain
MDQANKENDEGKELEELGTYEEGNETTPTKSTPHMFRKTLTTSDTNTHGGFFVPRRAVEDCFPRLDYKQQRPSQELVAKDLYGVEWKFRHIY

SEQ ID NO: 151913 - protein, 93 aa, Glycine max
  Coding DNA Sequence Number=SeqID_35135
MHVFDIKGYVLSSKSVFYLEHNLALIKKKVARHANESAIKGAVWWRKDSAREKEFDVNAHTTESPEEVRQAKGSAGDSGFPVRHNFCDISVRL

SEQ ID NO: 151914 - protein, 218 aa, Glycine max
  Coding DNA Sequence Number=SeqID_35136
  Homolog annotation: Hit_ID=Q9STM3; Match level="QueryCoverage=52%, HitCoverage=8%, E-value=3e-23, Identity=51%"; Hit description =Putative zinc finger protein
  Subcellular localization annotation: CTP_CleavageSite=38; ConfidenceScore=5.06e-01
MHSSKGFVSDDLAFNRSHGIKQGKSFYFVKDKFTTLCERNMISSFDVNGNISISSFNPLQRDTERETCQGDGLSDQRLFSCVTCGILCFSCVAIVQPREPAARYLMSADCSFFNDWVVGSGVSNNKFTIAREEATIPESNMYTGRYLPCYILCSSGNMPIYLFSVCLYDLGWMKKNVQDGIHDVPFQSSQLLHYWLQHMEILLTLRKIRLRLTVMNQM

SEQ ID NO: 151915 - protein, 109 aa, Glycine max
  Coding DNA Sequence Number=SeqID_35137
MALDGNSSVSESENTVLNEPGLLLQLLRYGQTHLSLGVGFKLLKFKPQRDQDLDPHYETVERVMLGRQREATVKGSRLPSMLKRDQQYEGFGAIYMTSASSSKQQATPL

SEQ ID NO: 151916 - protein, 482 aa, Glycine max
  Coding DNA Sequence Number=SeqID_35138
  Gene Ontology: Mol. function=nucleic acid binding; Cellular component= intracellular; Biological process=chromatin modification
  Homolog annotation: Hit_ID=Q9STM3; Match level="QueryCoverage=96%, HitCoverage=31%, E-value=5e-61, Identity=36%"; Hit description =Putative zinc finger protein
AANIATPEWLRFAKDAAIRRASLNYPPMVSHFQLLYDLALALCSRIPVSISAEPRSSRLKDKKGEGETVTKELFVQDVLQNNDLLHILGKGSDVVLLPRSSVDISVCSKLRVGSQQSINVRNSEGMHSSKGFVSDDLVFNRSPGIKQEKSFYFVKDKFTTLCERNRISTFNVNGNISTASSNPLQRDNDRETSQGDGPENQQLDILCQLIAASLMIGLLVLEYLAISLLLPMKMQLLPSQICIQAGWMKNNVQDGKHDVTVQSSREALNTESENGNTALALLASAYGNSSDSEEDHITDDSHESNVINSASECLLSHTQNSHASPMTALDRDDNIPSTSATCENFMHRRFECNLNHQSVDHSLKKQDYNITSEVKFENTKMVPNFTSNCSQHTHDADRSLSNKSMVPFDNKNTSMVLQSDEDSSRMHVFCLEHAAEAEQQLRPIGGAHMLLLCHPEFKLVKKQGKHGYNMSLVMGVMPVYVV

SEQ ID NO: 151917 - protein, 49 aa, Glycine max
  Coding DNA Sequence Number=SeqID_35139
MKLLELVWRDSDSRKAVRGLHAPEMMRDCGGAWMTFWPRDLQGWVALLK

SEQ ID NO: 151918 - protein, 189 aa, Glycine max
  Coding DNA Sequence Number=SeqID_35140
  Gene Ontology: Mol. function=nucleic acid binding
MAKIQGSKEGKTYSNIYKEEWTQPWPMGSEIYLEVHENPRAFFSSSSSILLESSIQYPWGVAWGCRASYILAMSVLISHIKSTEGYTTTYRKTWLTKKKAIENIYNNWERSFHDLSRFVASYATIFPGMVVEKEILPMPPQGGQTVEGFVKFHSLFWSFGSCIDGFQYCKPMVQVDETWLYRSTRRSSL

SEQ ID NO: 151919 - protein, 91 aa, Glycine max
  Coding DNA Sequence Number=SeqID_35141
MAICFHWDVLQLSYFFLDLLDLDEEAGMIQKSTNQIDQNENAEEQANAESTNQTLMPDFMKPAHNQYVYRHANGYILFIHSFEILLGIELC

SEQ ID NO: 151920 - protein, 110 aa, Glycine max
  Coding DNA Sequence Number=SeqID_35142
  Homolog annotation: Hit_ID=Q1T3I2; Match level="QueryCoverage=44%, HitCoverage=3%, E-value=4e-13, Identity=75%"; Hit description=AAA ATPase
MSVTGPVDWFRFEGYCNGRNKKQSLITDYTLKILRLDICKDTIVGDEMQRGVSGGQKKRVSTAVHIILTTNNDPLGQALAEELARRLGRVRLYILSFIFHVKQSGIEAAR

SEQ ID NO: 151921 - protein, 121 aa, Glycine max
  Coding DNA Sequence Number=SeqID_35143
  Subcellular localization annotation: CTP_CleavageSite=60; ConfidenceScore=5.29e-01
MQGTRTREATRKPRQDFSIQRKFQQPFFSLSRSFFFFLLLHHCSPLKLQNFSTFILQIARGSHFRSHEAHLYIVGLRISGLYGDALWYLYVEIVDAKLVEMMGRDNLGLNVSLGRANEEDE

SEQ ID NO: 151922 - protein, 110 aa, Glycine max
  Coding DNA Sequence Number=SeqID_35144
LSVIGLAPSHIAFKNEGGITAVDFNVGKSDRSRIKVTGKQKKKLEMQLLNPLLWFRSQFLRSWRKFGRGNWRFYRSVKGEGMMQSYPQGYWIEDSKSIELELLKKALGFS

SEQ ID NO: 151923 - protein, 278 aa, Glycine max
  Coding DNA Sequence Number=SeqID_35145
  Homolog annotation: Hit_ID=Q1S1N3; Match level="QueryCoverage=24%, HitCoverage=21%, E-value=8e-08, Identity=40%"; Hit description =Calcineurin-like phosphoesterase family protein, related
MYLPLLANLDRDDRYNWGSTCLAHLYREICRAIYPTSKNMGGYIVLLQSWARYRMSFTQPRVKNQTSYPLATRVMLQFGLCQDIPNPPHNLDKIHHTDMRGHIDTNWAEEHQQWIVIWKERCKYVLIGQPILGNIEHMSHYINWYQANSKIFLTQFATHQTLPPHLAQLQTWKLNNILHNKAHQLLPVCMMKDYNHMLNHMNSRYNLIIIKKIMGTIRSSSVLERRLYEQPHRYRSSNTGVFLYVHEKYAIPLFASLNQSIVGSSSIMTLSRKSNYCS

SEQ ID NO: 151924 - protein, 178 aa, Glycine max
  Coding DNA Sequence Number=SeqID_35146
MMPYYYFGHGSVGVQGILNRHILRQHNIPISPKIARKHDFEIKQTLDQHIESGSLSSEINSSASQVDSPQPIVTSPAPQLEPVVEEPHMLEGDKDMATTTDIQNQSQSHKQLEAEGRLKSKIVCNNQLLEEAQQLWDLGTSIGLEADTCHSDFIQSFADMEARDRNEAMELGERKTHR

SEQ ID NO: 151925 - protein, 123 aa, Glycine max
  Coding DNA Sequence Number=SeqID_35147
MEDSPSSGRAQTCGSDIDVLDLALWRTLLSPCHMRVIVLLPPFLISVSLMKAPCGLGNKVTRKHHLDSQNKVLGVQVTLSNDFVAKVIGCLCDGNSYHEGWEKAYDSHVTRALYNENVDKVGE

SEQ ID NO: 151926 - protein, 114 aa, Glycine max
  Coding DNA Sequence Number=SeqID_35148
MKGLGGLDNIYYVALIKKVLWDQEVYHVFEGMDDDSKHTIIVKGFVVAKQQFSKTNLKAMKVAIEQNLKEAPQVDFDAINKRKQKRLAKAITDEDRGLNSFGIAKKIQKIMNEK

SEQ ID NO: 151927 - protein, 137 aa, Glycine max
  Coding DNA Sequence Number=SeqID_35149
  Gene Ontology: Mol. function=zinc ion binding
  Homolog annotation: Hit_ID=Q1S5Q3; Match level="QueryCoverage=81%, HitCoverage=77%, E-value=4e-11, Identity=34%"; Hit description=Zinc finger, GRF-type
  Pfam annotation: Domain name=zf-GRF; Domain location=20-65; Score =29.7; E_value=7.4e-06; Accession=PF06839.3; Description=GRF zinc finger
  Subcellular localization annotation: CTP_CleavageSite=30; ConfidenceScore=5.29e-01
MSQRSNASSSRTRVSSQVVLFCGCDRRVVRRVAGTNINRGRAFFTCSINKDEVGYCGYFIWVDQLIETLGVDDSLGTFSMEQRRQFGREEDKTMWKAQVNSKLDCMGIEMKMFRTIVYGMFLIQLLSMVVFVCIHKY

SEQ ID NO: 151928 - protein, 106 aa, Glycine max
  Coding DNA Sequence Number=SeqID_35150
MVSSLLPSCPPYVVPLTLVPLPTPPFQQIRSGGSPHKGKGSKQECVCGGLCGIDSEPYSGDNAFRSWNQKFSVELGQHARHVTIEVKLRDWDSRGNKIVNFTIRVV

SEQ ID NO: 151929 - protein, 203 aa, Glycine max
  Coding DNA Sequence Number=SeqID_35151
  Homolog annotation: Hit_ID=Q1SDG1; Match level="QueryCoverage=34%, HitCoverage=6%, E-value=1e-10, Identity=45%"; Hit description =Integrase, catalytic region; Zinc finger, CCHC-type
  Pfam annotation: Domain name=zf-CCHC; Domain location=132-149; Score =20.3; E_value=0.00044; Accession=PF00098.13; Description=Zinc knuckle
MLCASSEEEYTKVHNFKSVKQIWDTLAVTYDGTSQVERNKLILFTHKYELFIMEEGEDTQSMFGHFQTILNKLRSSVGDSSHDDSEEDFDGYELAFISRKICKIWRSKGVPKWKNSSRRIPKEKKDKDKSSIICYECKNLGHFKSECLELEKGQDKKKHYKTKEKKGLISILEYLDETSSNEQDEEANICLMTNITSKEFESN

SEQ ID NO: 151930 - protein, 187 aa, Glycine max
  Coding DNA Sequence Number=SeqID_35152
MTLMLQGHYTRRMRRRIESKGGFSGGPGCHNKRKQKRLAKAITEEDRDLNSFGITKKIQKIMAKQQKKKKTRKQSQKEEEEEKIKDLSEADEEDEGLVQIALQKRKVAALVAPTPKGAKTIQPALKHREPVIPSTIPRHIKTRATKANPKIGNEWTVSFTRNKEDPSSSSSDSESTDETPISPLNKR

SEQ ID NO: 151931 - protein, 135 aa, Glycine max
  Coding DNA Sequence Number=SeqID_35153
MGEVEEVQEQMAIMLEAMMSMKKIMEANVVAVTTTSVVALVNPMPPSDLNQMNHPTSDMVGKDLGSMDNPMMCKFKTSMPSRHMACLPTIHHPMWRTLPIRMSITLLPYTLRVDNLIMYMSLNPWRRHMKFHTTI

SEQ ID NO: 151932 - protein, 125 aa, Glycine max
  Coding DNA Sequence Number=SeqID_35154
  Gene Ontology: Mol. function=ATP binding; Cellular component =intracellular; Biological process=transport
  Homolog annotation: Hit_ID=Q8PCV9; Match level="QueryCoverage=97%, HitCoverage=32%, E-value=2e-48, Identity=81%"; Hit description=Type II secretion system protein-like protein
CFLAHPQLLPGKRAQERADEPRAEPACSDQPAPGEEQGRPSPAGHRGADQHADDPRPAARRPGARDQGCDGRLAGGRHGELRPVPVPAGQVWHHRAGGGPARGRLARWPGAEVPPVRSQQRANTT

SEQ ID NO: 151933 - protein, 127 aa, Glycine max
  Coding DNA Sequence Number=SeqID_35155
MTKFGTSSSVGMFAIGGEGDGMDVDIRDGPCASIGDGDGVDVGTRDDLRASIRDWDGLTSIRGGDGVGATSEDLISLDIVDGDGVHDGRLSLGGSSLTTYHFFFPLVPFLLESCDRGQGGLAGSTFS

SEQ ID NO: 151934 - protein, 293 aa, Glycine max
  Coding DNA Sequence Number=SeqID_35156
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=4e-26, Identity=27%"; Hit description= UPI00006A17C9 related cluster
SRGSPHVLAFRGLHVLAFIGLYALIFRGLHVLAFRGLHVLALKELHAIAFRGLHTLAFRGLHVLGFRGQHVLAFRGLHVLPFRGLHVLTARGLHALPFRGLHAFTFRELLVLAFRGLHPLAFRGLYVLILRGLHVLMFRGLPSSLSEDCTSSPSEGYTPLPSEDSTSSPSEGSTPTPSDDKIGLHALAFRGLHVLAFRGLHALALKELHAIAFRGLHALALRGLHVLGFRGLHVLAFRGLHLLPFRGLHVLAIRVLHALPFRGLHALAFEDYTSSPSVDYTSSLSEGCTSSPS

SEQ ID NO: 151935 - protein, 286 aa, Glycine max
  Coding DNA Sequence Number=SeqID_35157
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=99%, HitCoverage=16%, E-value=1e-103, Identity=85%"; Hit description =Protein ycf2
MKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLV

SEQ ID NO: 151936 - protein, 290 aa, Glycine max
  Coding DNA Sequence Number=SeqID_35158
  Gene Ontology: Mol. function=transferase activity, transferring phosphorus-containing groups; Cellular component=membrane; Biological process=two-component signal transduction system (phosphorelay)
  Homolog annotation: Hit_ID=Q1CVM4; Match level="QueryCoverage=95%, HitCoverage=58%, E-value=2e-28, Identity=30%"; Hit description =Response regulator/sensory box histidine kinase
  Pfam annotation: Domain name=HisKA; Domain location=209-277; Score =81.9; E_value=1.9e-21; Accession=PF00512.15; Description=His Kinase A (phosphoacceptor) domain
  Pfam annotation: Domain name=PAS_3; Domain location=119-203; Score =9.2; E_value=0.012; Accession=PF08447.1; Description=PAS fold
  Pfam annotation: Domain name=PAS_4; Domain location=103-205; Score =5.9; E_value=0.053; Accession=PF08448.1; Description=PAS fold
  Pfam annotation: Domain name=Response_reg; Domain location=1-76; Score=-12.0; E_value=0.029; Accession=PF00072.14; Description =Response regulator receiver domain
  Pfam module annotation: Pfam domain module=HisKA::PAS_3::PAS _4::Response_reg; Domain location=209-277::119-203::103-205::1-76
VDTANSGEEALGKALKNDYALIILDVQMPGMDGFEVAEIFAAVNTEKRFITKGYASGGKDYVTKPEQNIEMKKTQQSLQLEVKGRRESQVTMKSQIDHFHLMLEGLPQIAFTLNDKGIIDFVNGRWYQYSTSDKNFPETFPDDLDIKEQFEISRKNGKSLQLETRIKNIESGEYRYHLLRISPVYEGNHVKNWVGTFTDIDDQKRVENEKDEFLSIASHELKTPLTSIKAYVQLLERKLKLDKDSAEAGYVTKVQDQIEKLNSLISDLLDVSKIENGKLKINRNLPILRR

SEQ ID NO: 151937 - protein, 79 aa, Glycine max
  Coding DNA Sequence Number=SeqID_35159
  Gene Ontology: Mol. function=catalytic activity; Biological process =metabolic process
  Homolog annotation: Hit_ID=Q53PY7; Match level="QueryCoverage=91%, HitCoverage=14%, E-value=5e-28, Identity=75%"; Hit description =Phosphoglycerate mutase family, putative
MGLLKHEGKERFGSAFRQWQVDAANFNIDGHYPVRELWDRARSCWTKILAHDSRSVLVVAHNAVNQALVATAIGTCFSL

SEQ ID NO: 151938 - protein, 63 aa, Glycine max
  Coding DNA Sequence Number=SeqID_35160
MGAKYLEAVKQRLHAINGWSPDKIKGSKDKTLISFERNTIRPVNLPVSGTCKNLKMISTDTSS

SEQ ID NO: 151939 - protein, 224 aa, Glycine max
  Coding DNA Sequence Number=SeqID_35161
  Gene Ontology: Mol. function=ATP-dependent helicase activity; Cellular component=nucleus; Biological process=regulation of transcription, DNA-dependent
  Homolog annotation: Hit_ID=Q1XTQ7; Match level="QueryCoverage=99%, HitCoverage=49%, E-value=3e-73, Identity=62%"; Hit description =Helicase-like:DEAD/DEAH box helicase-like
  Pfam annotation: Domain name=DEAD; Domain location=28-195; Score =216.5; E_value=5.9e-62; Accession=PF00270.19; Description=DEADDEAH box helicase
  Pfam annotation: Domain name=ResIII; Domain location=24-190; Score= -23.0; E_value=0.0039; Accession=PF04851.6; Description=Type III restriction enzyme, res subunit
  Pfam module annotation: Pfam domain module=DEAD::ResIII; Domain location=28-195::24-190
MEKLTFADFGLPVKILDVLADLELFEPTPIQEKSISPILSGRDVMGIAQTGTGKTLAYLLPVLKTWKYNKSGNPTVLVLVPTRELVVQVTEILEKLTANITARVIGIYGGKNINTQKLLFDNGCDILVGTPGRVMDLAIDNAISLKEVQKLIIDEFDEMLNLGFRPQLTHIFEMMKEKRQNILFSATMTEAVDEMLDEYFAHPIEISLAKSGTPLEKIEQTGYK

SEQ ID NO: 151940 - protein, 66 aa, Glycine max
  Coding DNA Sequence Number=SeqID_35162
MRENRITVSCGLSRWRIKVLVKSYDLLRLGCKKGCGSTMLRVEKTKRMLYKLLYLNMETRLQYVNV

SEQ ID NO: 151941 - protein, 197 aa, Glycine max
  Coding DNA Sequence Number=SeqID_35163
  Gene Ontology: Mol. function=receptor activity
  Homolog annotation: Hit_ID=Q9FVN5; Match level="QueryCoverage=99%, HitCoverage=29%, E-value=7e-66, Identity=65%"; Hit description=Beta -glucan binding protein
MSGEAMFREPFCVEYKWQKKGSENLLLLAHPLHLMLLSNRDSGITVLGDFKYISIDGDLVGVIGSSWILKIDPVVVTWHSTKGVKENSCDEIVSALCKDVNGLNSSIITTTSSYFYGKLVGRAARLALIAKEMSYLDMIPKVSKFLKETVEPWLEQKFDENMDFYMIKNGEAILPKKGLKMLVLILDLVFTIITTTI

SEQ ID NO: 151942 - protein, 161 aa, Glycine max
  Coding DNA Sequence Number=SeqID_35164
  Homolog annotation: Hit_ID=P93159; Match level="QueryCoverage=66%, HitCoverage=20%, E-value=9e-07, Identity=39%"; Hit description=Beta -glucan-elicitor receptor
MHQKCASKGVTQHDGRGSIKKPCLTIVETNDVLDTVTKGLLLKRKNLILEQETSKGLVLFWVLAIAVEEYGSGGGCGVNALLSYILEGFRYFEDFGNDGKLLYIALPVNEIQKGTCNFVGRIYVHIGTSHNGGEEMERFATFTQDAWRMLFIIDWSWKLEA

SEQ ID NO: 151943 - protein, 432 aa, Glycine max
  Coding DNA Sequence Number=SeqID_35165
  Gene Ontology: Mol. function=carboxypeptidase activity; Cellular component=proton-transporting two-sector ATPase complex; Biological process=ATP synthesis coupled proton transport
  Homolog annotation: Hit_ID=Q8RV74; Match level="QueryCoverage=81%, HitCoverage=85%, E-value=2e-95, Identity=46%"; Hit description=Leaf senescence protein-like
  Pfam annotation: Domain name=DUF231; Domain location=242-415; Score =132.1; E_value=1.6e-36; Accession=PF03005.6; Description=Arabidopsis proteins of unknown function
  Subcellular localization annotation: CTP_CleavageSite=52; ConfidenceScore=5.38e-01
MTMKFPANEVLNGKYTTRTTAKSVFLVPFTLLLIMLPLSLMRSSREPTPEISSVSVSSLDNNTEVKQCNIFSGRWMHNPAAPYYSNETCHWIIDQQNCLKFGRPDREYLHWRWKPDECELPLFNATRFLNLVRGKKMAFVGDSVGRNQMQSLLCLLSHVSEPEDVSHKYSSDVVYFKRYFYHDYNFTLGNLWSPYFVRSSDADPRGHTYNSIMKLYVDEADEAWTSLVENFDIVIISSGQWFFRPLLFYEEGKLVGCNKCRIDNVTDLTYLYGYKKAFRTAFRALSSLENYKGVTFLRTFSPAHFENGDWNKGGRCVRTMPFTKQEMRLEDGAVEYILEMYVTQVEEFREAQRVATKRGLEFLMMNTTEIMLLRPDGHPNNYGYSKDKNMTLNDCVHWCLPGPVDTWNEFLLYMLDTMGSEAFFSSKLERVF

SEQ ID NO: 151944 - protein, 35 aa, Glycine max
  Coding DNA Sequence Number=SeqID_35166
LILDDPKSSLVPCGFISFGNQSSGSRINTSFAGNI

SEQ ID NO: 151945 - protein, 71 aa, Glycine max
  Coding DNA Sequence Number=SeqID_35167
MAVLKHAACSLCAPILGTQTGGTKRLLVITPKRYHSLLQQCCGGRDYQRQHIIKEKKTLDEVSLSASKSKT

SEQ ID NO: 151946 - protein, 187 aa, Glycine max
  Coding DNA Sequence Number=SeqID_35168
MLVRPLLRYKPCTFLHVRVCIVLSHARCMLVSSFCHGKPDGLCHLLKCIQGALCCQLLQVRRDDFLGSRVRKIHSYHAPHRHLFMHSSISPMIDVGVLIQTGLFILVNMGSNQAPLLKKRFYQVKIKSLEVTSLRELGQLMGQLQRQAFRKVYGINEALGLNPELGLGLNPELGLDLKRADYFILQN

SEQ ID NO: 151947 - protein, 117 aa, Glycine max
  Coding DNA Sequence Number=SeqID_35169
MANFQYKIISKFLVDRGTKKNLIALMKLFTNMVKLRISLEGDRNLDKEIRMGYDIHTRKFVIVNWQKLCAPLMEEGLDLFPVSRINAFKKNFQLVLENSGWVLGSGIGLARNLKGVE

SEQ ID NO: 151948 - protein, 132 aa, Glycine max
  Coding DNA Sequence Number=SeqID_35170
  Gene Ontology: Mol. function=oxidoreductase activity, acting on single donors with incorporation of molecular oxygen, incorporation of two atoms of oxygen
  Homolog annotation: Hit_ID=Q2Z1Y9; Match level="QueryCoverage=82%, HitCoverage=35%, E-value=6e-21, Identity=47%"; Hit description=2 -oxoacid-dependent dioxygenase
MEAIVPVVDFQRLSEEEERKKLRKTCEKPGCFRIINHSIPLTLMADMKSVVKYLHDLPTEIKMRNKPSVPESGYRAASPTSPLYEGMGIYDMHASPQAFEDFCSNLNVSPRHRFSARLELNTQSLSLTHYLS

SEQ ID NO: 151949 - protein, 129 aa, Glycine max
  Coding DNA Sequence Number=SeqID_35171
  Homolog annotation: Hit_ID=O63067; Match level="QueryCoverage=64%, HitCoverage=9%, E-value=4e-33, Identity=84%"; Hit description =Aspartokinase-homoserine dehydrogenase
MTVVAAGSDCRISAPTVFPVVLVLVLGIVLPFLFVRITILILESAAACSSLDVKPGVSLEEKKLPKGETWSVHKFGGTCVGTSQRIKNVADIILKDDSGRKLVVVSAMSKVKNMMYDLIHKAQSRDELI

SEQ ID NO: 151950 - protein, 121 aa, Glycine max
  Coding DNA Sequence Number=SeqID_35172
  Gene Ontology: Mol. function=ribonuclease H activity; Biological process=RNA-dependent DNA replication
  Homolog annotation: Hit_ID=Q1RYI2; Match level="QueryCoverage=66%, HitCoverage=12%, E-value=3e-17, Identity=53%"; Hit description =Ribonuclease H
MKRKKGGQGWMAIKIDLERANHCLDWSFIRDTLLGIGCPSRVTLVKSVVQALPHAMQFAHLPRCLYDKVDKKHISFIWGDMVNHRHIHTTASNNLCKPKSVGGLGLRKSRDTNLTFMMKVG

SEQ ID NO: 151951 - protein, 75 aa, Glycine max
  Coding DNA Sequence Number=SeqID_35173
MVPMSGHKVMEIRMSYPRGHEAKQPSIKVLRYRSLNIQQERPMIKLVVRKMKNISLLEHQSPLILSSLCSKVPLF

SEQ ID NO: 151952 - protein, 121 aa, Glycine max
  Coding DNA Sequence Number=SeqID_35174
  Gene Ontology: Mol. function=ribonuclease H activity
  Homolog annotation: Hit_ID=Q1RYI2; Match level="QueryCoverage=98%, HitCoverage=22%, E-value=5e-14, Identity=39%"; Hit description =Ribonuclease H
MDQIFGKELLVVRPLFKKILAGTFTMELKLTFGLIYGFIHREDGSWNLQLLSSLLPIQTIDCIRAILPPKITKGDDILTWLGSHNGGFKMSILYGSIKEYDMLPHNPMHKAIWNWRGSERI

SEQ ID NO: 151953 - protein, 110 aa, Glycine max
  Coding DNA Sequence Number=SeqID_35175
MKLTSNPTVTMATRLAVRSMTMARRHEAYVIPQVTMSSLILAVETEKGKLAMDNKKQAVTVFSAMKNNKLRCRTREKIDINEHRLTSVFLKPDVNEEILTSILEKPMLTN

SEQ ID NO: 151954 - protein, 44 aa, Glycine max
  Coding DNA Sequence Number=SeqID_35176
MSGWTWLRWTLGLHTSVSKGTFVKRTGGGICKTKDFDAQIILGL

SEQ ID NO: 151955 - protein, 222 aa, Glycine max
  Coding DNA Sequence Number=SeqID_35177
  Gene Ontology: Mol. function=oxidoreductase activity; Biological process=electron transport
  Homolog annotation: Hit_ID=Q5WCU9; Match level="QueryCoverage=100%, HitCoverage=61%, E-value=4e-80, Identity=65%"; Hit description =Dehydrogenase
  Pfam annotation: Domain name=GFO_IDH_MocA; Domain location=26-143; Score=12.8; E_value=0.00018; Accession=PF01408.12; Description =Oxidoreductase family, NAD-binding Rossmann fold
MNKNDGMNYAPVGKPQPVVKEGEFVFAAAALDHGHIYGMSNGLIEAGATLKWVYDPDPAKVDKFIQQYPQARVATSLEQILADDEVRLVAGAAIPSERCALGLKTMAAGKDYFTDKAPLTTLEQLEDAKAMVEKTGRKYAVYYSERLHVESAVFAGQLVQQGAIGRVVQTLGTGPHREGTGRPDWFYDRRYFGGILCDIGSHQIEQFLFYTGNHDASVVASQ

SEQ ID NO: 151956 - protein, 130 aa, Glycine max
  Coding DNA Sequence Number=SeqID_35178
  Gene Ontology: Mol. function=oxidoreductase activity; Biological process=electron transport
  Homolog annotation: Hit_ID=Q5WKG0; Match level="QueryCoverage=91%, HitCoverage=30%, E-value=4e-26, Identity=50%"; Hit description =Oxidoreductase
MTNVAHDNAEVEDLSAAIFKYPSGALTQLTASVVHHGEDQKIIIQGEKARISAPWQAFASVSADNGFAQETHDQQREAQLDAVFQETPKLDWTLHTGQINDLLDAIGHGTAPLVDGLQGKTLPGADYRDL

SEQ ID NO: 151957 - protein, 86 aa, Glycine max
  Coding DNA Sequence Number=SeqID_35179
MGSSGFDPIPFRSVLLIEFCKRFRSFFGESRGLSDGCAQPNVIYVDPSQTSLQRFSKQEASGKTACYSESESRHIRCCIVIYSSNR

SEQ ID NO: 151958 - protein, 116 aa, Glycine max
  Coding DNA Sequence Number=SeqID_35180
  Homolog annotation: Hit_ID=Q1T493; Match level="QueryCoverage=89%, HitCoverage=19%, E-value=2e-08, Identity=32%"; Hit description =Nucleic acid-binding, OB-fold, subgroup
FLKFLDDYEGDGPITVLLSHCRIKEAQGSYPASINNSFKASKLIINQPMMEIQEFNERLAELGIEARSGFKSHGEGSTQLSGSIQLSSKESFFGKAEAKTIADINTISEIMILYRF

SEQ ID NO: 151959 - protein, 98 aa, Glycine max
  Coding DNA Sequence Number=SeqID_35181
  Gene Ontology: Mol. function=small conjugating protein ligase activity; Cellular component=nucleus; Biological process=protein modification process
  Homolog annotation: Hit_ID=Q5KQJ1; Match level="QueryCoverage=82%, HitCoverage=68%, E-value=6e-43, Identity=97%"; Hit description =Putative ubiquitin conjugating protein
  Pfam annotation: Domain name=UQ_con; Domain location=8-91; Score =53.5; E_value=6.8e-13; Accession=PF00179.16; Description=Ubiquitin -conjugating enzyme
MSTPARKRLMRDFKRLQQDPPAGISGAPQDNNIMLWNAVIFGPDDTPWDGGTFKLTLQFTEDYPNKPPTVRFVSRMFHPNSEYKTTLQFHFGVRMTIT

SEQ ID NO: 151960 - protein, 59 aa, Glycine max
  Coding DNA Sequence Number=SeqID_35182
MTVVAVGSDCQISTPTVFPVVLVLGIVLPFLFVRITILILESVAACSSLVFALKRKRIS

SEQ ID NO: 151961 - protein, 63 aa, Glycine max
  Coding DNA Sequence Number=SeqID_35183
  Subcellular localization annotation: CTP_CleavageSite=29; ConfidenceScore=5.29e-01
MHGHAGKPPLPLASSLRLAHVAWKPPLVVQSVIGTLMDSLFQRKGSCNSSWRFEFKLPLLLVI

SEQ ID NO: 151962 - protein, 184 aa, Glycine max
  Coding DNA Sequence Number=SeqID_35184
  Gene Ontology: Mol. function=oxidoreductase activity, acting on single donors with incorporation of molecular oxygen, incorporation of two atoms of oxygen
  Homolog annotation: Hit_ID=Q2Z1Y9; Match level="QueryCoverage=59%, HitCoverage=35%, E-value=4e-20, Identity=46%"; Hit description=2 -oxoacid-dependent dioxygenase
MQEAKHATIITINKSSFLHSHPSQRKEQEQEQQSNVKEREMEAIVPVVDFQRLSEEEERKKLRKTCEKPGCFRIINHSIPLTLMADMKSVVKYLHDLPTEIKMRNKPSVPESGYRAAMPTSPLYEGMGIYDMHASPQAFEDFCSNLNVSPRHRFFMLLSFNPSLFGSNNIEFIFVCLKIVIYES

SEQ ID NO: 151963 - protein, 108 aa, Glycine max
  Coding DNA Sequence Number=SeqID_35185
MVVSIFGGNGDNNNHHMVAMAVARVTMTIIVSATATTINYHFLKYLKLTHHHHHYNCWYHTSTAMTITIVVASIASNDAGFDGGGGGDSGGGGGDDDDGLTVVEMFKS

SEQ ID NO: 151964 - protein, 56 aa, Glycine max
  Coding DNA Sequence Number=SeqID_35186
MEEGHKHLSGWRGREVNVQRDGLRLSISWILYPDDAKPQAVHSTEAMEPDRGAHQV

SEQ ID NO: 151965 - protein, 256 aa, Glycine max
  Coding DNA Sequence Number=SeqID_35187
KECSLRCPYQTRARARVMSEVEEVQEKMKADMKVMKDQMAAMMEAMLSMKKIMESNAAMVAPTSTATEVDPTHPSSLNQVNPPVSNMVGSEQAFLPTIWPTSQLYTTQCGNAPDEDVNNSTPILLKMYYRKIGVYAKDEKLLMHFFQESPTRATYNSDMAPDRMQLQNMCKKEHESFKEYAQRWRDLAAQEAHPMTEKEMITMIVDTLPVLYYEKMVGYLPSSFADLVFTSERIEVGLRRGKFDHPALMNKKPGEN

SEQ ID NO: 151966 - protein, 224 aa, Glycine max
  Coding DNA Sequence Number=SeqID_35188
  Gene Ontology: Mol. function=peptidyl-prolyl cis-trans isomerase activity; Cellular component=integral to membrane; Biological process=protein folding
  Homolog annotation: Hit_ID=Q8W171; Match level="QueryCoverage=47%, HitCoverage=77%, E-value=9e-30, Identity=56%"; Hit description =Cyclophilin
  Pfam annotation: Domain name=Pro_isomerase; Domain location=5-142; Score=82.4; E_value=1.4e-21; Accession=PF00160.11; Description =Cyclophilin type peptidyl-prolyl cis-
MPHPKVFFYMTIGGQLVGRIMMELYANMTPRTAGNFYALYTDEKGGGHFTSEKGSGSKLIYGAKFAVKKHTGPNIRSMENASPITNRSQFFICAEKTKWLDEIGSHGGGGGGGLCITIHVANLVDGSAAPTKAMSVEVVAERDLAKDEGMYCGGSGGLVTVDVVLTIAFVRSCLHVVVLTCERNGGYGGGVVVANTMAMEGRHLYSQEASRTFYGFGSRRESGR

SEQ ID NO: 151967 - protein, 200 aa, Glycine max
  Coding DNA Sequence Number=SeqID_35189
  Subcellular localization annotation: CTP_CleavageSite=46; ConfidenceScore=5.07e-01
MTSLATERYKSRGAPGLSQLKISDVAMNGFAFSMNFGKNLGNVKFTMMMETSNNHGVILVDEVDALKSLSVKVMGWRLRCRDGVKVLLLGLAGLSSIGKSSIDGDDHGMQYYLKIEISDLDGYAPKYIHELSKGLVLCLSQIGQGNQGHARRPTSGVLCTESFNKGVKAVYRPSVRKVYKCLSGSVVSSYHLRLCGFHPQ

SEQ ID NO: 151968 - protein, 161 aa, Glycine max
  Coding DNA Sequence Number=SeqID_35190
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=32%, E-value=7e-77, Identity=71%"; Hit description=DNA -directed RNA polymerase beta' chain
  Pfam annotation: Domain name=RNA_pol_Rpb1_2; Domain location=59-137; Score=49.5; E_value=1.1e-11; Accession=PF00623.11; Description=RNA polymerase Rpb1, domain 2
STPGELVMCQEKLVQEAVDTLLDNGIRGQPMRDGHNKVYKSFSDIIEGKEGRFRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGL

SEQ ID NO: 151969 - protein, 61 aa, Glycine max
  Coding DNA Sequence Number=SeqID_35191
MVSTWSGLKRKTPLTDSHPRPTTMTNTDTLQQLRNRIAKMERRHKEELTKLKADHDHLEAR

SEQ ID NO: 151970 - protein, 223 aa, Glycine max
  Coding DNA Sequence Number=SeqID_35192
  Homolog annotation: Hit_ID=Q5ZDA3; Match level="QueryCoverage=27%, HitCoverage=17%, E-value=5e-24, Identity=74%"; Hit description =Membrane protein-like
MEERVLKQVVEEEEGGKSKMGEEREDPQKLKRLAADSYDYDNDSRWPDYWNNVLIPPHMASRDDVVSHFKRKFYQRYVDPDFVVEPMSVGGSSSQPVRSSTTSSSSPLTNNQPRARSSGSTNRTSGTSTTAGPGPSPTPLRWDRQTVLFSVNAWEVLGRALCLGGVKQFYPQYSDITCRDWTWIPADNLIVLAICEGRPIMPAPFIWQNFGLPSSAIGNTGFY

SEQ ID NO: 151971 - protein, 145 aa, Glycine max
  Coding DNA Sequence Number=SeqID_35193
MGEVDEVQERIKADIEALKEQMATMMEAMMSMKMMMEVNAAAVVVTSAVVEVDPTPPFDLNQINHPTSDMISQGGKKLGSTGGPHFVQVQNKHAFPPCGLPPNYAPPNVVHIPNENVNNSTPILVESQQPQADHAHVSQPMGGDT

SEQ ID NO: 151972 - protein, 192 aa, Glycine max
  Coding DNA Sequence Number=SeqID_35194
ERKVEIYHTELDEFKAELERHNFHKRLTNLADSSIDLALVKEIDADNLNAFLETPVALAEGESLPAYSRYYRMPIDIREIEAALCIPGRGFILKAEGHLGKILGKDLTTLARVWSVLSYSNLAPTSHTSDLTVDRARLIFGLVTQLDLNVGALISGQTISMAQPNSFRLGFPALITALCRSRGVVSDNLVFE

SEQ ID NO: 151973 - protein, 51 aa, Glycine max
  Coding DNA Sequence Number=SeqID_35195
ITEELLPEEAVCTSGRSSSVNFFQKNFFWKKQCALMEEVFINYGITSSVKI

SEQ ID NO: 151974 - protein, 58 aa, Glycine max
  Coding DNA Sequence Number=SeqID_35196
MALGVMAARSGELLLQPEVTLLAQASWGSKDKDTNFDRAILQFDWATGENQGSETEKT

SEQ ID NO: 151975 - protein, 124 aa, Glycine max
  Coding DNA Sequence Number=SeqID_35197
  Subcellular localization annotation: CTP_CleavageSite=76; ConfidenceScore=5.75e-01
MNVSNSLPRTSRIQFYLLFSHFSTPLYPSPFLQTLPFAFSCTDSSFNPLSFPSFSNYSTMESSEDPIIQVKDEQLMVSPLSGENPVHRTAYFIKPCVEDSATLPHSMFSSGRTGTVNSDHAKFA

SEQ ID NO: 151976 - protein, 426 aa, Glycine max
  Coding DNA Sequence Number=SeqID_35198
  Gene Ontology: Biological process=electron transport
MHLDYKCNLGTAPVHGGHGKIYLVVDNRILVISYGNIATSEPESKVFFGPGPGRVAEAEIIGLSVSTLGSTIYINVKNRGLFAYHSHGRLIWSVGPVLYQFGYRQGCRKNLTDCYFASVPVLDQCEGSIYAQAMWKRGISNTEGELYCLSVRSRYFRWIQDFSSLDKNFTITPGNNGHLFVTFPAKALVLALDVFSGNVLWQRSIGPLSKVDSAPVVDSNGWISIGSLDGFLYSFSPTGVLKKFSRMNAENSMIQVGPFLDCSGFAIYSSQIEMEGKVSRTIGEYTVVSAIRPKAALFTVLVPATGSIYWSESYPGHVSTLFSESDLSQFVMNEEILLAFLAASRIGTPLQCRTIGQKLASSCSQERTKLVSIYTGNERAIVLFLLFESALLLVLIGLVRFCCTFWAKEKLKDQGLGSFLDKRQTL

SEQ ID NO: 151977 - protein, 313 aa, Glycine max
  Coding DNA Sequence Number=SeqID_35199
MEELERIQSAIEHVVEVFSIDVVERQVEVEQRDKVDIGAHALDPKIQKLELEKHNLLNPRKEGFPMIDLFSYQYWDNLPEKEKHAYGFYGENEQVFNPNSLIFVHMPTDRKVYPFGASIWRSREAAFADMPFFIPLNLQQLGKELLIEDEEDAYSTQLDRLFKHKLEALKHKSELTTLDGYAIMRFFFTHHVDPIIEEVEFDTAFGFLAIQELVRTREALAQALNECAHVEKEACKWSLINDFFYKKSTGWKPPHSPTPLVSLVNFSFDSKTLVMSFLGSLMKKLPNKKGTKSKKVEAWHHLRRNAKSDESIN

SEQ ID NO: 151978 - protein, 92 aa, Glycine max
  Coding DNA Sequence Number=SeqID_35200
MEGGQGGSRLKGWGVKNLYFRFLGVGWSEGLGLNGGYLLDFLDWSEDLGLDDGAYSGKLSAIPILTKVNPLSCVGPADGSNTNTSTPLFLMI

SEQ ID NO: 151979 - protein, 136 aa, Glycine max
  Coding DNA Sequence Number=SeqID_35201
  Homolog annotation: Hit_ID=Q9FKM4; Match level="QueryCoverage=83%, HitCoverage=17%, E-value=4e-22, Identity=46%"; Hit description =Arabidopsis thaliana genomic DNA, chromosome 5, P1 clone:MUA2
MDLDGGSSFDFEDLVLNVHGGVDHLGDALVVHGCKHGDEAGVASAVEDDVEGHIDLDIFATELLPRDIDVVIGCGDVTNDLVEDLDGLKDDDKVFVVCDGDVKDIGVLTSTKYKCFIFMGTSPREAKIHGKMNTLG

SEQ ID NO: 151980 - protein, 346 aa, Glycine max
  Coding DNA Sequence Number=SeqID_35202
  Gene Ontology: Mol. function=protein binding
  Homolog annotation: Hit_ID=Q2HW84; Match level="QueryCoverage=68%, HitCoverage=55%, E-value=2e-16, Identity=31%"; Hit description =Cyclin-like F-box
  Pfam annotation: Domain name=F-box; Domain location=21-68; Score =22.2; E_value=0.0019; Accession=PF00646.23; Description=F-box domain
MNSIIATKRLPPEQTVVEGEGIISKLHESILGKILSFLPTTDAVHTSVLSKGWIHVWKSITGLQFNDALHPLGKKMQKEHFVCFVKKVILHLANSSIQSFSLCLTCYHYDSTLVSAWISSILQRGVQNLHIQYADEILFPSCSLFSCNSLVQLVLQMKCTISVPIFSSLPNLQNLSISGIRLVSESSNYSEDLILNFPVLKVLEARGCEWLTKQNIGIKAPLLERFSIAIWNSLSNKSHKSAIKIFAPNLADFSYGGDLEQEIILLNSASIHSASVVIVADEDKMTNVGKLGFQVHKLLAQIREVKQLKLLFYKSDGQIFEREDIKLFTKLLLQDLTDEKDLFRNY

SEQ ID NO: 151981 - protein, 168 aa, Glycine max
  Coding DNA Sequence Number=SeqID_35203
  Homolog annotation: Hit_ID=Q9SJV8; Match level="QueryCoverage=50%, HitCoverage=38%, E-value=3e-17, Identity=65%"; Hit description =Expressed protein
  Subcellular localization annotation: CTP_CleavageSite=64; ConfidenceScore=5.83e-01
MVTKNRHISFSSFPFLSLSSSLLFLPNTTPPSCWPSMSPSSPTSAASAHTPIASLTALTKLETRPASKKCAYLGRENQDGDDLSGAVRLLEEVEDGGFAQWDAMVDDGEVGLVVPDLDLVGVGGSEEEANGEREREAVERGLEVMPMYCTPTCSRSNCGFFGIIAKER

SEQ ID NO: 151982 - protein, 376 aa, Glycine max
  Coding DNA Sequence Number=SeqID_35204
  Gene Ontology: Mol. function=nucleic acid binding; Cellular component= spliceosome; Biological process=mRNA processing
  Homolog annotation: Hit_ID=Q651K8; Match level="QueryCoverage=91%, HitCoverage=46%, E-value=2e-53, Identity=38%"; Hit description =Proline-rich spliceosome-associated protein-like
  Pfam annotation: Domain name=PSP; Domain location=112-160; Score =74.4; E_value=3.6e-19; Accession=PF04046.7; Description=PSP
  Pfam annotation: Domain name=zf-CCHC; Domain location=52-69; Score =21.1; E_value=0.00032; Accession=PF00098.13; Description=Zinc knuckle
  Pfam module annotation: Pfam domain module=PSP::zf-CCHC; Domain location=112-160::52-69
MENQTRKDKNKDFIPLADNSVPLYDRGYTLGLTSADGSSNVDGGLEIIDAAARCFNCGSYNHSLRECPRPRDNTAVNNARNKHKSRRNQNSSSRNPTRYYQNSPAGKYDGLRPGALDDATRQLLGLGELDPPPWLNRMRELGYPPGYLGKMHFFHNTLPMIYPNDVDDEDQPSGITIYTDREIADQEDGEIMEADASKPKRKKTVKFPGINAPIPDNADERLWGTRAGPSSSDISRNLSLPQHRSNYSTDYGSRGYHREHRLGDLRDDGPPGDPGHSSSKFSFHPRFGGHDSALRSPSMARSQSDRSRSPMHDEESPMPFSFHSLHYSSSERHFSPLDPDSGRPGSRTSESMYYDRDRDLSSRVKDRPDDRHHRSW

SEQ ID NO: 151983 - protein, 729 aa, Glycine max
  Coding DNA Sequence Number=SeqID_35205
  Gene Ontology: Mol. function=translation initiation factor activity; Biological process=cellular metabolic process
  Homolog annotation: Hit_ID=Q9FFV8; Match level="QueryCoverage=98%, HitCoverage=96%, E-value=1e-134, Identity=55%"; Hit description =Similarity to guanine nucleotide exchange factor
  Pfam annotation: Domain name=IF-2B; Domain location=434-728; Score =325.3; E_value=1.1e-94; Accession=PF01008.8; Description=Initiation factor 2 subunit family
MDPSRRAPRAVIDPVPKIRQVGFFAPPESSQSGPLDPTHSSPPISNSLSPVMIPPPRHLSDNLLLHDPRPAASPLSSASAVAAAGSGNSFDSADFFPAPLSPAMPSSSYSSRIATGGASDGGYFKGNGAGGKLAASSFPRGGFDLTAMKAASLVPASELTTVSVVNDSLGIPEKEKGNKTGGSAVEVKDQPNSSKQQKPKPKTSKAERRALQEAQRAAKAAEKGEGSKASGTAASTNPKPAKAVKPAQKVDNAAIAASEKKGGEIPPEKDRKKDAPQPRLQYDDKSRVEKAKRRAVVKQTEARNRVELFRHLPQYERGSQLPDLEAKFFHLSPVHPLVYKLFLGFSNIFNVVCVALSIAMPNSTVSPSQNSMHQDFLNFLSEKNLCKLLDAIINFVDCYIALHLLACDTICNIGSHAEWHPNESKVGLQYLTGDISGGNARCIAMLQAFQEAIKDYKVPPEKTLVRDLTAKIGSYVSFLIECRPLSISMGNAIRFLKSRIAKLPLTLSESEAKASLESDIECFISEKIILANKVIVKHAVTKIRDGDVLLTFGSSSAVEMILLHAHELGRQFRVVVVDSRPKLRGQLLLRRLVENGLSCTYTHINAVSYIMHEVTRVFLGASAVLSNGTVYSRVGTACVAMVAHAFRVPVIVCCEAYKFHERVQLDSICSNELGNPDVISNVLGREDVKHLDGWANIENLQLLNLVYDATPSDYVSMIVTDYGMENYCE

SEQ ID NO: 151984 - protein, 90 aa, Glycine max
  Coding DNA Sequence Number=SeqID_35206
MPLPSTVHASSTNEPGAPRSAVHMSSTYEFGAMRIDCLVQFSILAFFPEPHECHCLALFMHPPPTSLEPHEGIAYHYSPILHSPLFFGAP

SEQ ID NO: 151985 - protein, 113 aa, Glycine max
  Coding DNA Sequence Number=SeqID_35207
  Gene Ontology: Mol. function=catalytic activity; Biological process =metabolic process
MGSRKEIRILWRTLLHLTTTFSQWRKAWPKPFPPASDRCSPNWRVQFYVSLRLYPIDALRAQTVFLKEDDHWRKGRVVSSRTRFRELSGGREDEYYKGNIQMFWKILLSKREF

SEQ ID NO: 151986 - protein, 153 aa, Glycine max
  Coding DNA Sequence Number=SeqID_35208
  Homolog annotation: Hit_ID=Q94LU7; Match level="QueryCoverage=38%, HitCoverage=6%, E-value=8e-11, Identity=55%"; Hit description =Putative outer envelope protein
MAKQLEAAEGDKKPPLDFCCTIMLIGKTGVGKSATINSIFHELWETNKVDQVVGTMEGIKFFLALLLGGGSLSTLELRVMNYWLGDLAVESKVQSQVPVVQTCKPCWPDQFEQQWRISIRLNSSEQSQIALIGLIPLLWKLRGYLQELLFGQS

SEQ ID NO: 151987 - protein, 63 aa, Glycine max
  Coding DNA Sequence Number=SeqID_35209
MALSDSHTTLKSLLILGEVKEMKLVSKSVVDVFYIVLVAVIHAFSVRAHNGSRKFGSGLTNSS

SEQ ID NO: 151988 - protein, 1159 aa, Glycine max
  Coding DNA Sequence Number=SeqID_35210
  Gene Ontology: Mol. function=DNA binding; Cellular component=beta -galactosidase complex; Biological process=DNA integration
  Homolog annotation: Hit_ID=Q1SDN3; Match level="QueryCoverage=96%, HitCoverage=93%, E-value=0.0, Identity=37%"; Hit description =Polynucleotidyl transferase, Ribonuclease H fold
  Pfam module annotation: Pfam domain module=RVT_2::Retrotrans_gag; Domain location=717-973::68-183
MASPVLSALEDSLNPHSPYYVHPSENPSTALINVHCTQCEKKLEFIDGSLPQPAPDHILHTEWKRSNNMVVSWLIHSVSPSIRQSILWLDNAVDIWRDMKSRYSQGDLLRISELQQEVASIKQGDVSVTEYYTKVRVIWDELESYRPDPKCSCVQKCLCDALEIVKQRKVQDQFIQFLRGLNDQYSNVKSNILMMDPLPSINKVLSYATQQERKLNGTVSMNNLSLINAANASHPRNLCSYCGKNGHAVEVAGKRMAIQVISHQIEEEEVELFLVMGEAPILTEMPKCAITAVPGANINNTATEPMNNENPATITAIQEGKNSEMKLTSQQYQALMSLLQQTSTNGSSSSTQIAHINQLGTVSKADSIIGSVLPIICNINNDSDLNTWLLDSGATDHIASSLDLYSECKQIPPITVSLPNGEQLIARYSGTVHISEFLVLTNVLYLPNFNFNLISISKLTNSMHYQLIFLANKCLIQEISTKKMIGTVDVESGLYKLKTTSNHHNSTPLAVLNPSNYANSFFGCLCYTSTLNANRKKLDPKALPCVFLGFKSHKKGYIVYNLHTRTIEVSRHVIFYENCFPFSTININDPTILAHPSITTHNPQAFSFPIYSPSPSPLPPQSEPVPINQPNTNHTSSAPTPRRTDRIQTRPTKYIDYQTSFTSAIVTNHPGTKHPISSVISYNKLSSSYHSFILNVSANSEPKSYNEACKHDSWVQAMHDEISALERNNTWVLTDLPQHKNVIGCKWVYKIKHNSDGSIERYKARLVAKGYTQIEGLDYLDTFSPVAKITIVRLLLALAASNNWYLKQLDVNNAFLHGDLPEEVYMVLPPGMKSAKPGQVCKLQRSLYGLKQASRQWYARLSTFLAHHGFKQSVADYSLFTLKRANSFTALLVYVDDIVLSGNDLSVISSITKLLDDTFKIKDHGNLKYFLGFEVARGTSGINICQRKYALDLLTNTDMLHCKPFIASPTTAHYTALYRILRYIKVAPGLGFFFPSTSELQLKAFSDYDWAGCVDTRKSITGFSVYLGSSLISWKSKKQVTVSRSSSEAEYRALASVTCEIQWLTYLLHDFDITHKPALVFCDNKSALHIAANPVFHERTKHIEIDCHIVCDKLLSGLIKLLPIASQQQLVDVYTKALAPGAFRFICSKLGMNDIHSRA

SEQ ID NO: 151989 - protein, 78 aa, Glycine max
  Coding DNA Sequence Number=SeqID_35211
MGLRSRIILGNSQMSGQIQRQRQIEVNGNATTVCYAMSFPALRYLGTDASRGNVVFMIDGLSSHAQLRTSGKHSWEVA

SEQ ID NO: 151990 - protein, 242 aa, Glycine max
  Coding DNA Sequence Number=SeqID_35212
  Gene Ontology: Cellular component=nucleus; Biological process =multicellular organismal development
  Homolog annotation: Hit_ID=Q84VX3-3; Match level="QueryCoverage=54%, HitCoverage=21%, E-value=6e-17, Identity=43%"; Hit description =Isoform 3 of Q84VX3
MTEIAVVVPVAASTTASKEKNAPKERRRGVEELKSAEDSDSPCPRITLELRIGAPVDFVAVEASKGGADTVVAVVLPIFSGKGTLKKIRIRNQNLIEKSTAEHLMSVESETGSFRDSETRNNLRRILESCSKLAEAGDFHESENTAVSELVEFLDSLLDAAMSDLDSENAENDAFEAISEIHRYICSPSIDQEVVDALSFELPKAVSKFVGISSRFLDLAISIIDQFIVKCGPRDMLSILCN

SEQ ID NO: 151991 - protein, 530 aa, Glycine max
  Coding DNA Sequence Number=SeqID_35213
  Gene Ontology: Cellular component=nucleus; Biological process =multicellular organismal development
  Homolog annotation: Hit_ID=Q84VX3; Match level="QueryCoverage=80%, HitCoverage=71%, E-value=4e-88, Identity=42%"; Hit description =Aberrant root formation protein 4
MERGVAKIRKALRCRLLSKLFLECKEQDVELWNSTIASAYGFHGQGQEAIKLFNEMEQENLPESEVIFLRWLTKEEMGFDDMSCGGTFATLGYSSKIIKAASYIVPPLSGLSKVLLSIQRRQFEQVKVAVPIILNILKAVSLESEEAELEDVFDTAVEIANSIYEVCNKLERDTKEKLRALLGLYVMQCMALVSASISYKASSCPSSVLQLSQISSYCGLSYLSLVTTYDVEIVAESVFGGEDKDHCTGCFSHVKHGAALSVVWGHVSKEVAQTAKEDLIAIRDELRNNQTKRWQAIGTLKHVLYFVNLPWELKKHAIDFLLSITDEGVSRNYNEERSEWSSYVPSLFSALQAVKMVIMYAPEPELRKKSFTVLKGVLADIPNSQRFDIMKALITNTDSSSMIAIFIDLVRKEMHTAICSSRSIVKDAPQIDNKAFPDTSFWNPGILELVELVLRPPQGGPPSLPEQSDAVLSALNLYRFVLMTESAGIMAESHSDYDEFAVDTVCTLNPLELVLYRCIELVDEKLKQST

SEQ ID NO: 151992 - protein, 70 aa, Glycine max
  Coding DNA Sequence Number=SeqID_35214
MTPPRLPLWHRGWATYQDVFLARHNNQMPLYYEFQFLVECVGAYLYREVDLPPNFSAGAVEGTDHHGTWL

SEQ ID NO: 151993 - protein, 131 aa, Glycine max
  Coding DNA Sequence Number=SeqID_35215
MAEKTKKKLEEAAQSGSTEGVINPPSPIRGHVKWKMTRMKKTGQMMSEAAKEIADKIDSLEEQTSQGSFVPHGRQDVLTTSIGRPKHPGHVRAAGASVTIKQYFRLAPQSSRNSSSIPPEELEKLTQQIRD

SEQ ID NO: 151994 - protein, 174 aa, Glycine max
  Coding DNA Sequence Number=SeqID_35216
MARTKQTSYIAKRDPSNEGSLQEGENIAERHHRQLELQPQPQPRSRLVADRIIRPPFGGGLVDWSLLQSYRDHCACHIWIGVVRIEACQPQCSSTTTLDSSIKMARGNVFHLPVREMTITLDYVSYPLHLPVINRLIDHVPSLFDRETMKILLMTHLVVPTKTKVVAMANTSVK

SEQ ID NO: 151995 - protein, 104 aa, Glycine max
  Coding DNA Sequence Number=SeqID_35217
MENVFAIVYCDGDILSSSKVVLFECPSGSKFITISENMSLDVVRKIIVDAPSKLHPVVKPSCDSCKAYCMSWGWLVSFGTTLRSNKLYIASTAIQNQSRNNNYN

SEQ ID NO: 151996 - protein, 297 aa, Glycine max
  Coding DNA Sequence Number=SeqID_35218
KYTKDVDISVPQCEEVDAEKCSDSVDHSVPQGVAADTEKSTDDVPLDDEVLAEKYAKDVHPNVQEVKGVTSKNAADEVEPLYDMPLDYAGLNEENVVAENISKFFDDFEDDNEEDEGYDDESEDYYDDDVNSDLDFVRNLSGVHADDSSGTSHYSYDSKSLRSIPSSDEEDNGKKRLESPQYNSDNGFGQVHFQLGMEFDTIAIFKDAVKDYTINLGREVKWIKNDLTRCKARCKVKDYPWEIYCAWSKAARSFQNSQANRKWVANKLVEKLKVHPTLTHHEAHAHMKVDYGVKVEE

SEQ ID NO: 151997 - protein, 259 aa, Glycine max
  Coding DNA Sequence Number=SeqID_35219
  Homolog annotation: Hit_ID=Q1SXB5; Match level="QueryCoverage=36%, HitCoverage=34%, E-value=8e-20, Identity=77%"; Hit description =Lissencephaly type-1-like homology motif; WD40 associated region in TFIID subunit
  Pfam annotation: Domain name=TFIID_90kDa; Domain location=154-259; Score=-35.9; E_value=0.038; Accession=PF04494.6; Description=WD40 associated region in TFIID subunit
MCVVFAFWVLGGGDGVTFWSHGKPPRSRKWPLEEAQPVSRMVCVATTRREEWVVREIERENIETGESERVFNHNEASLSLQTQFVVDVSEVCECFKSCKRKIDLNYARSRLPYMEKHLLRERFPPTLPCLANHFAHPLCICKGKAAYNIPPPYLRIAKSLWTMGLERGSARYHDGYGRLRSWAYRSLDSYKHELLRVLYPLFFHCVMDLVAKGHIQEDFKAPNEAISATCILCFCITIHNSIGYSQLETFSTPFVKTMK

SEQ ID NO: 151998 - protein, 158 aa, Glycine max
  Coding DNA Sequence Number=SeqID_35220
  Gene Ontology: Mol. function=RNA-directed DNA polymerase activity; Biological process=RNA-dependent DNA replication
MAAPWQKGVAKIKRLKGSIKTWNREQFGDPFKKYKKIEEELNQLEADTTDRHLQPQELLTRRKLQEELWVAALSHKSLMRQKARLRWIKEGDCNSRYFHLLINSSRKNNCLNGVMIDGSWIEEPSAVKEAVRMFFMNRFQESDYNRLRLDGICFRTID

SEQ ID NO: 151999 - protein, 33 aa, Glycine max
  Coding DNA Sequence Number=SeqID_35221
MGQKRCNQSDAARKRQEHSENAMQPVVLLVSID

SEQ ID NO: 152000 - protein, 370 aa, Glycine max
  Coding DNA Sequence Number=SeqID_35222
  Gene Ontology: Mol. function=nucleic acid binding; Cellular component= beta-galactosidase complex; Biological process=DNA integration
  Homolog annotation: Hit_ID=Q0KIN0; Match level="QueryCoverage=98%, HitCoverage=26%, E-value=2e-91, Identity=43%"; Hit description =Integrase core domain containing protein
MASLDASSTWELVPLPTSKTTVGCRWVYTAKVGLDGSTDHYKAHLVAKGCTQIFGLDYGDTFSPVAKFAYMDQPPSFTVGDSQLVCCLRRSLYSLKQSPCAWFGCFSSALLQFGMTRCEADPSMFFIHLPSDLCIYLVVYIDDIVIIGNDSAGILCLKSHLHSQFQIKDMGPLKYFLGIKVAQSSSGIAISQRQYALDILTETGMLDCCPSDTPMDPNVKLLPSQGEPLEDPGRYRRLVDRLNYLIVTRPDITFAVSLLSQFPKAPTDSHWNAAMRILRYIKNAQGHGLLYEDKGNAKIGTYLMEEQEAETVARSSAEAEYHVMVLSREITTDFVSSKEQLADMLTKSLKGTQVDDICNKLGSYDIYAPT

SEQ ID NO: 152001 - protein, 1998 aa, Glycine max
  Coding DNA Sequence Number=SeqID_35223
  Gene Ontology: Mol. function=RNA-directed DNA polymerase activity; Cellular component=chromatin; Biological process=chromatin assembly or disassembly
  Pfam annotation: Domain name=Chromo; Domain location=1278-1332; Score= 53.4; E_value=7.5e-13; Accession=PF00385.14; Description='chromo' (CHRromatin Organisation MOdifier
  Pfam annotation: Domain name=RVP_2; Domain location=307-454; Score= -61.3; E_value=0.059; Accession=PF08284.2; Description=Retroviral aspartyl protease
  Pfam annotation: Domain name=RnaseH; Domain location=794-917; Score= -29.9; E_value=0.035; Accession=PF00075.14; Description=RNase H
  Pfam annotation: Domain name=WD40; Domain location=1915-1953; Score =48.1; E_value=3e-11; Accession=PF00400.22; Description=WD domain, G -beta repeat
  Pfam annotation: Domain name=WD40; Domain location=1957-1995; Score =39.8; E_value=9.6e-09; Accession=PF00400.22; Description=WD domain, G-beta repeat
  Pfam annotation: Domain name=rve; Domain location=1005-1132; Score =65.5; E_value=1.7e-16; Accession=PF00665.16; Description=Integrase core domain
  Pfam annotation: Domain name=zf-CCHC; Domain location=276-293; Score =17.6; E_value=0.0013; Accession=PF00098.13; Description=Zinc knuckle
  Pfam module annotation: Pfam domain module=Chromo::RVP_2::RVT_1::RVT _1::Retrotrans_gag::RnaseH::WD40::WD40::rve::zf-CCHC; Domain location= 1278-1332::307-454::1381-1624::569-826::99-189::794-917::1915 -1953::1957-1995::1005-1132::276-293
MEARVEALETEISEVRSALVKVQKSVTTNHTNLIAMLEKCLGKSLLVDEGDVSFSFNGSPAVTKKRDPHSTVVNNLCGVALTEFRQSVKKDTTPKVKVSLAQLSMEGPTIHFFNSLIAVEENLTWDRLKEALLGRYGGHGEGDIYEQLTELKQEGTVEEYITEFEYLTAQIPKLPEKQFLGYFLHGLKEEICGKVRSLAAMGEINRTKILQVTRAVEKEVKGGGLGYNRGPRAGSGSFRTGSRRNGSDWVMVKGTEVESRFTHLSYNELMERKQKGLCFKCGGPFHPMHQCPEKQLRVLVVDDEEDGEEEAKILAVEVEDTEDEEKGEFSVLNLHHIAHETPHTIKFQVGLHNFISRKLVHQMEWPVEATPQMKVKLGDGFQTATQGVCEGLEMYIGDFKLNPDMHLFELGGIDVVLGIEWLNTLGDMIVNWKRQTMSFWKEKKWVTLRGNEGCKESIIALQSILNKPKPNMLGVLWEAEKVEPVEAQNPELTKVEQAELEEMLSKYAQVFQEPSGLPPRRKMEYAINIVEGQGAVNVRPYRYPHHHKNEIEKQVKEMLSTGIIRHSTSSFSSPVILVKKKDNTWRMCIDYRALNKVRVPDKFPIPVIEELLDELNGAKFYSKLDLKSGYHQVRVKESDVHKTAFRTHEGHYEFLVMPFGLMNAPSTFQSLMNHVLSLLSTHSLVANRKKCHFAQRAVEYLGHLITEEGVAVDPSKVASVIKWPQPKNVKGVRGFLGLTGYYRRFIKDYGKVARPLTELTKKDNFKWGEEAQQSFEALKEKLTTAPILALPDFSKNFVIECDASGGGVGAILMQDKRPIAYFSKALGTRNLVKSTYEKELMAVVLAIQHWRPYLLGRKFVVSTDQKSLKQLLQQRVINADQQNWAAKLLGYDFEIVYKQGRLNRGADALSRINEGLELNTINSYVKWTQEEQVRAENKQDEKLQRITKEVQEDPILWPGYERLAANVYWVGMKRTIQEFVKGCDTCQRQKYMASSPGGLLQPLPIPAQVWEDISIDFITGLPKSKGYEAILVVVDRLHGVPLSIVSDRDPIFMSSFWKELFKMQGTKLKMSTAYHPESDGQTEVVNRCLETYLRCFISDQPKTWMSWVHWAEYWFNTTFHAATEKTPFEIVYGRPPPVLTRWLQGETRVEAVQRDLLDRDEALRQLKSQLLRAQDRMRNQADKRRVDRSFVCGEWVFVKLRAHRQKSVVSRINAKLAARYYGPYPIIEKIGAVAYRLKLPEGSRVHPVFHVTLLKKAVGRYQEKEELPDLLEEHIEMYEPEAVLAARKVKQQGEEVKQVLIHWKGKTVEEATWEDEIMIISQFPKFGLEDKATSEEGGIDRTQPAAGMPHEQLIHHESNGPKVWKDVVGGGKGHMGLEEYSRMGSNASFIASISKVADPLLLNDYRPISLIGCMYKIVAKILANRLKKVVDEAKRSQKPCIVFKVDYEKAYDFVSWDFLIYMLRRMRFCTRWIQWIEGCLKSASISVLINGSPSSEFSPQKGLRQGDPLAPLLFNIVAEAITGMMSQAVGKGIFRGFLVGRNKVEINVLQYADDIIFFGEASMQNVKAIKAILRTFELVSGLKINFTKSSFGALGMSDQWKIEAANYLNCSLMSFPFTYLGVPIGANPRRCQTWDPIINKCGGQASAITEEIPMGILARSTSHCLANGNGICSSIRGKCGPGYWSLSMADLKLVFHHPQHGPVLDNAKLWRVRCGDKFMFWEDNWMGGAGPLLAKYPRLYAISCQQNHIIQQMGMYRDIGWEWDFRWRQSLFESEIDMTDSFLRDVECCIIQPQNSDQWVWLADTAGQYSAKSAYSVLRGESPEEVQVEAFQELWKLKAPNKISAFAWRLLNDRLLTRANLTWRQIDLEDNTCPFCSSMEESAGHLFFHCRKFLPGVQELTDGSGGVRLWDVQSGECVWVFIGHRSMILSLAMSPDGLNLASGDEDGTIMIWDLSSGCCITPLVGHTSCVWSLTFSCEGSLLASGSADCTVKFGDVTT

SEQ ID NO: 152002 - protein, 90 aa, Glycine max
  Coding DNA Sequence Number=SeqID_35224
MTADSLEDINFESPQAFDSNFLSEDENCQSNSNEPAIDTEGYSNLGDQAMQCRHCNAKMWYNERISKDKNTASSKFSLCCGDDKVELPLL

SEQ ID NO: 152003 - protein, 76 aa, Glycine max
  Coding DNA Sequence Number=SeqID_35225
MNNRKKPIHRKKKEKGFRIKETGLKIAYGFLNHMIIFTHKPMKCSVTSKQVHIHKQRPFEKKTTGVPKFQTFGTQQ

SEQ ID NO: 152004 - protein, 55 aa, Glycine max
  Coding DNA Sequence Number=SeqID_35226
MGTHGVLEHVTIAINSSSPNKLVDSKSNASIFPAFRGEVLCVKASMLLQVYHVWK

SEQ ID NO: 152005 - protein, 147 aa, Glycine max
  Coding DNA Sequence Number=SeqID_35227
  Subcellular localization annotation: CTP_CleavageSite=62; ConfidenceScore=5.33e-01
MACTQLICFCFVIWSLVVGASGPSNAGNGAGAVCFLLFFVFFFDLGAGTSTLGATTSARVVDASAGGEFTRTGAGGKLTETGTGGELTGVTAGGVVAGGVATRGVVVGVEVAALDGGDATVGDETGGVAVAALGDEVGETTAQLILV

SEQ ID NO: 152006 - protein, 480 aa, Glycine max
  Coding DNA Sequence Number=SeqID_35228
  Homolog annotation: Hit_ID=Q84N90; Match level="QueryCoverage=80%, HitCoverage=93%, E-value=1e-106, Identity=59%"; Hit description =LEGCYC1B
  Pfam annotation: Domain name=TCP; Domain location=88-343; Score =154.3; E_value=3.2e-43; Accession=PF03634.4; Description=TCP family transcription factor
  Subcellular localization annotation: CTP_CleavageSite=21; ConfidenceScore=5.14e-01
SNPSPSFPSSSSSYPPFPFLNLENASASNTLLHDALSVPYIPTHHNPSSIQEALNNFPVTDHNCGGGGGSGSAMTKPDPNGGGAPQYGISCFLTKKPPKKDRHSKIYTSQGLRDRRVRLSIEIARKFFDLQDMLGFDKASNTLEWLFNKSKRAIKELARSKHSNNNSDEGAKSFSSSSDCEDGCEVVSEIKHKQQQLITCDAAATTPHNLQQGLDSGDNKSPTTLMAAKERMKLKRTQKEPAKMKESREKARARARERTSNKIIMCNVNTNNTGGKVLQDLKKKCPAIENNHTQIMHQSRSSPTHHPHHLVGNETPRDDFNVIEESIVIKRKLKPSLMSSSDHHHHHHQNLVMPKEPPSFNNNNSEYHPFSNLSPNWDANGSTGRSNFCAIASMNLSTGLQIFGKSWEECINPLSSDSNETLVVGWPRNHMEASFCVFHQKLVLYSLSTMFVPLLPFAHHHLSQWRVTVGRKVAAACIGF

SEQ ID NO: 152007 - protein, 87 aa, Glycine max
  Coding DNA Sequence Number=SeqID_35229
MTGVVALPQRMRESESENESTRDEVDDKTESNNTANSQVCQMHRTLSMTQSYPLRTLDRRLQEDWAKDAREGPRVLMSLRVDFEPMG

SEQ ID NO: 152008 - protein, 64 aa, Glycine max
  Coding DNA Sequence Number=SeqID_35230
FLASSKSKESLAQNLKEVLQLLQQEVEEEPSKKEAESSETNDDQEDDPFYQNEDDCFGISLDED

SEQ ID NO: 152009 - protein, 1202 aa, Glycine max
  Coding DNA Sequence Number=SeqID_35231
  Gene Ontology: Mol. function=RNA-directed DNA polymerase activity; Cellular component=chromatin; Biological process=chromatin assembly or disassembly
  Pfam annotation: Domain name=Chromo; Domain location=1127-1175; Score= 28.0; E_value=3.3e-05; Accession=PF00385.14; Description='chromo' (CHRromatin Organisation MOdifier
  Pfam annotation: Domain name=rve; Domain location=824-980; Score =115.9; E_value=1.2e-31; Accession=PF00665.16; Description=Integrase core domain
  Pfam annotation: Domain name=zf-H2C2; Domain location=765-806; Score =15.7; E_value=0.003; Accession=PF09337.1; Description=His(2)-Cys(2) zinc finger
  Pfam module annotation: Pfam domain module=Chromo::RVT_1::Retrotrans _gag::rve::zf-H2C2; Domain location=1127-1175::356-567::103-193::824 -980::765-806
MADHATRKTTTDRLEDAITRLTHSKASLSDKYPELSGKVDSILDHLRLRDTNSNNPNTHASTAQRNHVKLDIPRFDGRDPLGWIFKITQLFDYQNTPEEERITVASFYLDGAALSWYQWMFRNGFITSWTGFLQALESRFAPTFYEDPKGALFKLAQRGTVNDYLTEFERLANRVIGLPPPFMLSCFISGLSPEIRREGIEWLKQFGPVITDYTALIMKFHHLGQAIELHADVSNRPEPVSVPQVKRLVRTGSTSALFHLNLLPVNRPEPPRHHLPQHHLPHPDPAIENLLRRYHQIFKTPTTLPPPRTVTHHINLLPSSSPINVRPYRYPHFQKTEIEKQVSDLLAAGLIRTSISPYSSPVLLVKKKDGTWRMCVDYRALNAVTVRDRFPIPTINELLDELGQSSWFSKLDLRQGFHEILMHEPDIEKTTFRTDQGHYEYRVMPFGLSNAPSTFQAAMNNLLTPFLRRCATVFFDDILVYSKGVEPEPSKIQAMLQWPTPTSVRELRGFLGLTGFYRKFVRDYASIASPLTTLLCKDAFEWNEDSQAAFDALKSAMTRAPVLALPNFSEPFTVETDASQTAMGAVLVQKDHPVAFFSKVFGPRLTHASTYICELHTIVTAVRKWRQYLLGRSFTILTDHKSIQELMTQVIQTPEQHYYLSKLLGFDYTIRYKSGASNIVADALSRAPPPSGQLLLLSVPHLDFISDLQRSLHSDQEFQTLLSKIQAQPSDYPNHQLHNGLILSQGRIWLPNTNPYIPTILLEYHATPLGGHMGVAKTTHRLESSFTWQNLKTDVKRFVRECKVCQQTKTSTRRPGGLLQPLSLPTGVWEDISMDFITHLPASHGYTIIFVIVDRFSKGVHLGALPTHFSAYKVATLFIDLVCKHHGFPRSIVSDRDPVFLSSFWRELFRLHGTLLRMSTAYHPQTDGQTEVMNRVLEQYLRSFVHSQPANWFRYLALAEWSYNTSLHTSSGFTPFEVIYGKPPPSLPHYLPGHTTNEAVDTLLTSRQEIHTKLRQRLLKAQEAMKHHADSKREDVSFTVGQWVYVKLHPHRQRSVTGDTHSKLSKRFFGPFQILERIGPVAYRLRLSDNARIHPVFHCSLLRAHHGPPPSSLDTWPLQVVDHRPIPHPLCFLDSKMDHTTSPPTRLVLTQWKGQPPEDTTWEPWSELRDSYHLEDKVVFGEGGIDMLMHNPAPEATNPSLG

SEQ ID NO: 152010 - protein, 313 aa, Glycine max
  Coding DNA Sequence Number=SeqID_35232
  Gene Ontology: Mol. function=protein binding; Cellular component =nucleus; Biological process=embryonic development via the syncytial blastoderm
  Homolog annotation: Hit_ID=Q3I4X9; Match level="QueryCoverage=98%, HitCoverage=50%, E-value=1e-129, Identity=78%"; Hit description =GAMYB-binding protein
MEDPRALYVAEQKAREAVAMRSKVQKEMMLKEKERKEQELRALAQKARSERIGGERIGVVPAAPPSVPVDEEDMRIDYDHEKENPRERERERSFVKESRDEREERMQREKIREERRKERERERRLEAKDAAMGKRSKITRDRDRDISEKVALGMASTKPGTEVMYDERLFNQDKGIASGFATDDQYNVYEHGLFTAQPTLSTLYRPKKNIDDETYGGADEQLEKIMKTDRFKPDKGFSGASERAGPRDRPVEFENEEADPFGLDQFLTEVKKGKKAMEKVGGGGTMRASAGSSMRDGNEGGSGRTRIGFERGH

SEQ ID NO: 152011 - protein, 396 aa, Glycine max
  Coding DNA Sequence Number=SeqID_35233
  Gene Ontology: Mol. function=RNA-directed DNA polymerase activity; Cellular component=chromatin; Biological process=RNA-dependent DNA replication
  Pfam annotation: Domain name=RnaseH; Domain location=192-295; Score= -20.4; E_value=0.0046; Accession=PF00075.14; Description=RNase H
  Pfam module annotation: Pfam domain module=RVT_1::RnaseH; Domain location=72-248::192-295
MQLFVRLVNKTSILTHGWVGQVEDFPSNIYNLARQRQAAQRGEVAAEMEGKTMDEEARNFLNVGFIREVQYTTWLANVVMVKKPNGKWTICTNYIDLNKACPKDSYPLLSIDRLVNGASKFLILNFFGVYSRYNHISMFKQDKQKTSFMIDTTNYYYYSVMPFDLENAGATYQRLMDKIFTNQLGRNLEVYVDDMMLYVDDSSNEKRSGAGVILESQNEVILERSLRFKFETTKNQAEYKALLVGLRFAKEVGAKYLKCWSNSKFITEAFSKFDLQHIVRENNERVNLLSKLASTKKKNQHRTVIKVVASVTPIDQEQMTKIWDFLEKGSLLKNPTATQRLKRNASYYVIGGGDLYKKSFIGPLLKCLTRDQSKYVMNEMRRGICGMHSGSQSMSP

SEQ ID NO: 152012 - protein, 135 aa, Glycine max
  Coding DNA Sequence Number=SeqID_35234
  Gene Ontology: Mol. function=RNA-directed DNA polymerase activity; Biological process=RNA-dependent DNA replication
MKNVATDLISSASSLVESRSKGHMAHSMLKFTILKALLVNIHPPKATLIKRFCQRVPGHVGFGQLFRDHSRGFIGGFSTYIGIQSPLYVEILDVILTLEIAKQKGWGNLWIECDSSSTIQAFKNPSLVPWSLRKQ

SEQ ID NO: 152013 - protein, 264 aa, Glycine max
  Coding DNA Sequence Number=SeqID_35235
EAWDCYSDNVLARNVLLERNFKLYINEFDDFRRELIRRNWHKQLTRLTEGSINVAIVKEFYANLYVPEDKFPKQVRVRGNLIKFDVDSLNTFLETPVVVEQGESLPSYSRFARLRPDPQELAARLCIPKRGFVLNAKGLLWKLLRKDLTTLAQTWSVLSYSNLASTSHTSYLNLDRAKLVYGLVMNMNMNLGSLISGQISLIAQSNSSWLGFPTLITALCKAQGVTSDCLTFEALGRRLQVDWARDPREGPRVLMSLRIDFEPM

SEQ ID NO: 152014 - protein, 67 aa, Glycine max
  Coding DNA Sequence Number=SeqID_35236
MKFLTTLSGCRKDVEVKFPLISGGSDVPPNYIETEEAVRKLNWETSKLAADKHREQQLLDYRKGKLH

SEQ ID NO: 152015 - protein, 73 aa, Glycine max
  Coding DNA Sequence Number=SeqID_35237
MAEECAILNCGGAYLHRAFLVACGVMIRNHDHEFIFYFSRRLGHCSVLEVELWAILHGLNVAFDADEAKGRIG

SEQ ID NO: 152016 - protein, 64 aa, Glycine max
  Coding DNA Sequence Number=SeqID_35238
MNRWMTMQNLMLEDTGTQRSDRIIYVRGRGCHNFGDGGRQQREGRVLRQRSEVSIDFEDEGVDL

SEQ ID NO: 152017 - protein, 206 aa, Glycine max
  Coding DNA Sequence Number=SeqID_35239
  Homolog annotation: Hit_ID=Q9LSA1; Match level="QueryCoverage=33%, HitCoverage=50%, E-value=6e-24, Identity=71%"; Hit description =Arabidopsis thaliana genomic DNA, chromosome 3, P1 clone: MVE11
MGAAGYKLEVQDLNAYNEALAHVVYQKQFFLRKRGRLGFGGLILTLPVTLVSLHRLRRSKWSFDFIGGVEGTIFRFHCFFYFPYIRTKRWRGLGRNGVVIDIKSLGRVQLGYGVKKLDGRYYQGLLMQMSMMATPEINKELHYLNKEDRLLRWLLVKQRNTKFGLDSYGDEGRYELSKFSQIGKHGDEDEDEDDEEYEVNEEETVN

SEQ ID NO: 152018 - protein, 196 aa, Glycine max
  Coding DNA Sequence Number=SeqID_35240
  Subcellular localization annotation: CTP_CleavageSite=33; ConfidenceScore=5.03e-01
MRPRFFSPSPFPTADQIMLAAFIPPLFAFIVVLASFETNLFNRYGGFGGRWEVGAPGSVVAERSLVQKERRMEGSTASGWRWHAVDVGLDLDERVVFFFFCFLIGFWFLDLRKRGRAVVVAIAATVGSRCGLLVDFLILHGGFVIVFAVVVSMVSWPLALGGSDAHFSGGLDLGEMRTEGQSGKNEGKNEKILAFN

SEQ ID NO: 152019 - protein, 44 aa, Glycine max
  Coding DNA Sequence Number=SeqID_35241
MAPIPPEGMTVPLACPAAATSGTHYPAISTGGSSFPPESMATPT

SEQ ID NO: 152020 - protein, 92 aa, Glycine max
  Coding DNA Sequence Number=SeqID_35242
MSIKAISIQAVSQRMFLILDSHGDLHLLSLSNSGIGVDITGNVLQLPHIMKVRSLAVLPDLSTKIWDQCNPRDKVSPNHALSSIRKGQSVRI

SEQ ID NO: 152021 - protein, 209 aa, Glycine max
  Coding DNA Sequence Number=SeqID_35243
  Homolog annotation: Hit_ID=Q8S8N9; Match level="QueryCoverage=37%, HitCoverage=14%, E-value=2e-25, Identity=62%"; Hit description =Golgin-84
MDVEEGTGKIEEKSFHEKLALDTILEQAAMEREVELEHRAVESSTALARIQLHVKLSMRLKNSVYELCNLELFQKTCNQILSTGSYHCQLLTGLHFCDIFTHLFVLAYLLRDEVGWSIFGQLWAAYIAFGILRVADERTAKATELEQKVALLEVECASLNQELQDMEARVRREQKKAPEEANQVIQAEMQKMRVEMAAMKRDAEHYSRQ

SEQ ID NO: 152022 - protein, 165 aa, Glycine max
  Coding DNA Sequence Number=SeqID_35244
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=10%, E-value=7e-52, Identity=61%"; Hit description=Chromo
  Pfam annotation: Domain name=RnaseH; Domain location=21-142; Score= -29.9; E_value=0.035; Accession=PF00075.14; Description=RNase H
AFDNLKAAITKAPVLALPDFSKAFTLETDASGIGIRAVLSQEQHPIAFFTKKFTPRMQRQSAYIRESYAIIEAVAKFRHYLHGHRFVIKTDQRSLKSLTEQAIQTPEQQKWLHKLLGYDFSIENKLDNENLVADSLSRSFFMAWSEPKLKLIQLLKEAIQADSQL

SEQ ID NO: 152023 - protein, 142 aa, Glycine max
  Coding DNA Sequence Number=SeqID_35245
MDTYVSPLTAQITPNVVGEEEADDRQRSPKQCSLQKKGETKDIELVEEEQARTNNNQTLGNSLSVSTRHSHLGNCADPPPIGDQPGSPKVFPTVGSSGLRIIKKGGLPPIPKRPAVLEISFNLVKILLQAKIHKGCTLPCSL

SEQ ID NO: 152024 - protein, 103 aa, Glycine max
  Coding DNA Sequence Number=SeqID_35246
MVFHLRLVMSFKTKKGEHRLKGAIKGINSRKYQQESSQGYCASNQWGKTHQKIMLMDDSNSHKGKLITFKLSFQNYHDMQRKNKDFKSQNVKRLLFSEQLPIS

SEQ ID NO: 152025 - protein, 121 aa, Glycine max
  Coding DNA Sequence Number=SeqID_35247
  Gene Ontology: Mol. function=citrate transporter activity; Cellular component=integral to membrane; Biological process=potassium ion transport
  Homolog annotation: Hit_ID=Q65VH9; Match level="QueryCoverage=59%, HitCoverage=11%, E-value=2e-25, Identity=79%"; Hit description=CitT protein
MTMITPSSKLTLTKGNKSWYRAPPRGESLVRTGIAYHVSDGILKVAGNSEAKVLILLMLSVAGLGAFMSSTGVVAVFIPVVIMICRQMNISPKRLMIEFLQPGGSTSSRAAATAVELQFAL

SEQ ID NO: 152026 - protein, 175 aa, Glycine max
  Coding DNA Sequence Number=SeqID_35248
GALIDEWKFDFSVHDARWLVCTNQVDMARRLLAGSLAFESRILHYLIVRILLPRSSNLAQVSEEDLIIMWTFHKGFQIDWAHLVRYRMHKALRLKAPLPYPHLITLFLQHFNIPLDSEPYVPIKRSFLIGASVIASFGYIKEHDGSWVKKGARNVGEEGHEGEDSSLLSKILERD

SEQ ID NO: 152027 - protein, 149 aa, Glycine max
  Coding DNA Sequence Number=SeqID_35249
  Gene Ontology: Mol. function=oxidoreductase activity; Cellular component=vacuole; Biological process=response to oxidative stress
  Homolog annotation: Hit_ID=Q9XFL6; Match level="QueryCoverage=92%, HitCoverage=41%, E-value=9e-60, Identity=81%"; Hit description =Peroxidase 5
  Pfam annotation: Domain name=peroxidase; Domain location=1-111; Score= -32.1; E_value=1.9e-06; Accession=PF00141.13; Description=Peroxidase
  Subcellular localization annotation: CTP_CleavageSite=49; ConfidenceScore=5.72e-01
MVDSNFTFSLGAHTFGRSQCQFFSQRLFNFSGTGSPDPTLNSTYLATLQQNSPQNGNGSTLNNLDPSTPDTFDNNYFTNLLINQGLLQTDQELFSTNGSSTISIVNNFANNQSAFFAAFAQSMINMGNISPLTGTQGEIRTDCKKVNGS

SEQ ID NO: 152028 - protein, 53 aa, Glycine max
  Coding DNA Sequence Number=SeqID_35250
  Gene Ontology: Mol. function=oxidoreductase activity; Cellular component=vacuole; Biological process=response to oxidative stress
  Homolog annotation: Hit_ID=Q9XFL6; Match level="QueryCoverage=88%, HitCoverage=14%, E-value=2e-15, Identity=87%"; Hit description =Peroxidase 5
MYCSYQPDNATRSVVSRPTAENLDETLARLSNGEGRELLAPAWFAVRPSLLPS

SEQ ID NO: 152029 - protein, 115 aa, Glycine max
  Coding DNA Sequence Number=SeqID_35251
MSISPAEVSIGLCRHDIGKDRAHKTPSGPGGAQQGLGVIVAPSKVIRPPTNRAFIKKYCSPRQAQGEAPQQPGDGRQRAIDAPPPPPEPLNSSTKARALPTTRGRLAGDQVQSQR

SEQ ID NO: 152030 - protein, 461 aa, Glycine max
  Coding DNA Sequence Number=SeqID_35252
  Gene Ontology: Mol. function=nucleobase transporter activity; Cellular component=membrane; Biological process=nucleobase, nucleoside, nucleotide and nucleic acid transport
  Homolog annotation: Hit_ID=Q6F9F8; Match level="QueryCoverage=96%, HitCoverage=95%, E-value=1e-160, Identity=61%"; Hit description =Putative purine cytosine permease
  Pfam annotation: Domain name=Transp_cyt_pur; Domain location=18-439; Score=57.2; E_value=5.3e-14; Accession=PF02133.6; Description =Permease for cytosinepurines, uracil, thiamine, allantoin
MNSQPEQTAFIEDKSIDFVPAGERHGHARSLFTLWFCTNIAPLAVVTGAISTQTFHLNILSALSAIIAGHLFGGIFLALTSAQGPQVGIPQMVQSRAQFGRYGSLLVIVFATVIYLGFFISNITLSGKVIHNVIPSLNMGVATVIGAVLATLIGVVGYRFIHKINKIGAWVMGSALILGLVLMFSQPLPADFWQRGSFSIAGWFATFCIGAVWQISFSPYTSDYSRYLPAEVGIAKPFLYTYLGACSGTILAFVFGVVAVNLVAGSDDAMEAVRQATGGLGPVLMVLFLINIICHNSMNLYGAVLSLITAVQTFLPQWMPNARIRTLFSALILLGAVWVALVASANFVHLFLNLIFALISVLLPWCMINLIDFYLLNRQRYDISAIFSADGGRYGLLNTRALGVYFGGIAVQVPFVENAFFSGPYANLIPGADISWVISMVLTGIAYPLCCSRRANWAVQL

SEQ ID NO: 152031 - protein, 148 aa, Glycine max
  Coding DNA Sequence Number=SeqID_35253
  Homolog annotation: Hit_ID=Q1RV39; Match level="QueryCoverage=43%, HitCoverage=6%, E-value=9e-17, Identity=69%"; Hit description =Calponin-like actin-binding; Kinesin, motor region
  Subcellular localization annotation: CTP_CleavageSite=44; ConfidenceScore=5.22e-01
MAATKSGLASSSSASVKKKRGCSSSYCYTYLLFNNIADFFKELPQFVVKAGPTLSNLYGIDWENRLEIVIYLSCNLHIKTSRGAVSQGNGSVSKFVMADKKIDNKILMVTKKEGFLHKNHVDVESKRQLLKQQMLFDNHQRDIQVGSN

SEQ ID NO: 152032 - protein, 135 aa, Glycine max
  Coding DNA Sequence Number=SeqID_35254
  Homolog annotation: Hit_ID=P51425; Match level="QueryCoverage=37%, HitCoverage=100%, E-value=3e-24, Identity=100%"; Hit description=60S ribosomal protein L39
  Pfam annotation: Domain name=Ribosomal_L39; Domain location=93-135; Score=100.6; E_value=4.7e-27; Accession=PF00832.10; Description =Ribosomal L39 protein
MMLAWHDGGVMVLDQGGGCDLDLGWVGVKKRLGGMSMVLIWLEGGRATVLEDSDGVTRDFGEGKSEGSIQLARLLRRVQQSAAKMPSHKTFRIKKKLAKKMRQNRPIPYWIRMRTDNTIRYNAKRRHWRRTKLGF

SEQ ID NO: 152033 - protein, 67 aa, Glycine max
  Coding DNA Sequence Number=SeqID_35255
MRCLCMSSDLPSPDDKGADNHEVRITIRCLYVSSNLLSPDDEGADNHEVSSHAIRVDCLWIVRARLK

SEQ ID NO: 152034 - protein, 356 aa, Glycine max
  Coding DNA Sequence Number=SeqID_35256
VPESSPGVKQLVEEGKVVGDPTNNIEIELENKKQGSITGVNVGKEKDGSDGGSVSNVIGSGGGNMRNTIFKDDVPKQVEIHITNGYKNSQGARASEIVAQVSAKDTTLWAGGRGGKNHTNDTLQLLKMNVPLNGISGDKLPIVKEMEENAMVPLNSMDHISGGHDEVMLQNIDSNEESGIKVEVIRHSCQLVHMRVRWRDNQAWFLTMVYGALKVVGMQTLWDDLFYISNGLTRKWDVIGDFNSTLSTTESIGSCNFHGHHEWLNRIMWWMKSNHRPLLLRLDNLANKNNHRRPFHFEATWTFHDGFQENWVNGPKQLEGTVTTYYKDLYSDDIVYYHFGVTHAFPRLDDHDLNEL

SEQ ID NO: 152035 - protein, 214 aa, Glycine max
  Coding DNA Sequence Number=SeqID_35257
  Gene Ontology: Mol. function=transferase activity; Biological process= RNA-dependent DNA replication
  Homolog annotation: Hit_ID=Q1RYI2; Match level="QueryCoverage=45%, HitCoverage=15%, E-value=5e-14, Identity=40%"; Hit description =Ribonuclease H
MTFLPKRVCDEIDKACRNFIWGDGREEGCCWYSVDEMENFVASLAHLERRHKAIFNSEVWSIMEVIQRPCNLAQAYKDNGLMFKSLSSSNSGASNIDGICWKSPKHDQVALNCDVVVIQLGNQAAYGGAIRDHHGAFICNFHAKNGSCAVIYAELWAILLGIKLAWSRGFRRIRVDSDSLNAIKLLEGSCSRFRPCYNLVRDIHQGYANSGNHY

SEQ ID NO: 152036 - protein, 74 aa, Glycine max
  Coding DNA Sequence Number=SeqID_35258
MRHCYSLQYTKSRNSFSSSHVKRTRSIYIVEPRHGIESSKWAIFGKQNWQCGMNRKLGYGAQLGANLDPTKGVG

SEQ ID NO: 152037 - protein, 109 aa, Glycine max
  Coding DNA Sequence Number=SeqID_35259
MASYGVASPLSLPFSIPLPFIFQEAKESIDEEDPRPTSSNGACISEGNCPFLVINLGFALVALVLIRLGIVEGMTHTFGSEIGWTLLAIFRAGATWAMLEIREQQHGTT

SEQ ID NO: 152038 - protein, 91 aa, Glycine max
  Coding DNA Sequence Number=SeqID_35260
MGCMPQFEEPLERMTFFSIWLCRAGEGASIWWHCRIMLHPKEEEGEAQTNEKGEREREKKGRGEGKGNNHTKRGKGKRGREKEGRGEGKKN

SEQ ID NO: 152039 - protein, 154 aa, Glycine max
  Coding DNA Sequence Number=SeqID_35261
  Homolog annotation: Hit_ID=Q53QG3; Match level="QueryCoverage=48%, HitCoverage=17%, E-value=1e-07, Identity=42%"; Hit description =Ribonuclease HII, putative
  Subcellular localization annotation: CTP_CleavageSite=51; ConfidenceScore=5.22e-01
MGSKILPKWASKPYVMGIDKAGRGPILGSFPFPFSTFPLFSSFKHISIIVSGLMVYGCLYCAQSYLRTLSMLSFAGLMRLLTQNFGVVFCSEHQGDTWMLLGLLLWFVRFTNVEPLKDARFNRCYVKVELLHNKGIDSKIGKVALDKTVYNDPF

SEQ ID NO: 152040 - protein, 87 aa, Glycine max
  Coding DNA Sequence Number=SeqID_35262
FESFLLDPKAKPKERAKWSFHKDFYPKFAQASNQLAWAKDLTSALSKKLAEPCIFQGMENPSAFNSEESMQRLRKKKEKKKSGVEAL

SEQ ID NO: 152041 - protein, 184 aa, Glycine max
  Coding DNA Sequence Number=SeqID_35263
  Gene Ontology: Mol. function=transporter activity; Cellular component= mitochondrial inner membrane; Biological process=transport
  Homolog annotation: Hit_ID=Q5W6Y0; Match level="QueryCoverage=87%, HitCoverage=73%, E-value=6e-37, Identity=44%"; Hit description =Putative mitochondrial carrier protein
  Pfam annotation: Domain name=Mito_carr; Domain location=16-113; Score= 91.3; E_value=2.9e-24; Accession=PF00153.17; Description =Mitochondrial carrier protein
MSSNDQTSGASLYIRALICNAAAGASAELHRAGAIAATFVCPLDVIKTRLQVHGLPHGQKGSVIITSLQNIVRNEGFRGMYRGLSPTIVALLPNWAVYFTSYEQLKGLLRSRDGCDELTTIGNIIAAAGAGAATAISTNPLWVVKTRLQESMIFSFIVLKPYGYLQVGRVQVWVYLPNGYGDEN

SEQ ID NO: 152042 - protein, 79 aa, Glycine max
  Coding DNA Sequence Number=SeqID_35264
MSEMRLGGSGVATHTEKRGDEWWWPQGNKVLVFQYERFFYDDIVERVEAFECYDGDACGVEAVHECIDGGGGSHARPRR

SEQ ID NO: 152043 - protein, 112 aa, Glycine max
  Coding DNA Sequence Number=SeqID_35265
  Homolog annotation: Hit_ID=Q9FKZ3; Match level="QueryCoverage=29%, HitCoverage=10%, E-value=6e-11, Identity=84%"; Hit description =Protein ASYMMETRIC LEAVES2
MVEDRWRGVVSDVNFAVEVDGPHPILCAVIQGNIVAVLLDLALSGGSGKRGQVGASEGRDDANVLVEGWGETVEEEDVVVLEFAVCGVQAPAAEVHTGVRVRAVLSAGQPTA

SEQ ID NO: 152044 - protein, 377 aa, Glycine max
  Coding DNA Sequence Number=SeqID_35266
  Gene Ontology: Mol. function=nucleic acid binding; Cellular component= mitochondrion; Biological process=DNA integration
  Homolog annotation: Hit_ID=Q9FKZ4; Match level="QueryCoverage=60%, HitCoverage=92%, E-value=4e-53, Identity=53%"; Hit description =Arabidopsis thaliana genomic DNA, chromosome 5, P1 clone:MUD21
  Subcellular localization annotation: CTP_CleavageSite=42; ConfidenceScore=5.06e-01
MAAQWWRSAAGHLRTVAAGRGSLSGFQRSTYHTIQAIPRECSGSKVSARDRTQGRIPCVVFLQNLLEKNPDARSESKKHLLTVEKKQIKAILDSADAPFFCSTRFPLQIRAGSGSSHLLESGTVLPIKIHRDEESGKILNLVFVWAEDGMKLKVDVPVVFEGEDACPGVQKASSMAENNSSAPSFSHHLHQSFPSISKKLDDSNYLFWQQVEPVIKSYKLHLFVANPTIPMQFLTENDRDAGIENPDYEIWEQQDHVLLTWLQSTLSKTILSLVLPCTHSYQVWEKILEYFHLQTRARAQQLRRELRRTMLDDKTMKEFLLRIKAICDSLNGVRDPVSHHEHVGIILEGLPTEYGPVIAVVESKFESPLIADAEALY

SEQ ID NO: 152045 - protein, 216 aa, Glycine max
  Coding DNA Sequence Number=SeqID_35267
  Gene Ontology: Biological process=multicellular organismal development
  Homolog annotation: Hit_ID=Q9FKZ3; Match level="QueryCoverage=87%, HitCoverage=70%, E-value=2e-17, Identity=32%"; Hit description =Protein ASYMMETRIC LEAVES2
  Pfam annotation: Domain name=DUF260; Domain location=1-48; Score=6.4; E_value=2.3e-06; Accession=PF03195.5; Description=Protein of unknown function DUF260
RDDAVKSLAYEAEACLRDPVYGCVGFISLLQQHLRQIQTELHNAKKELARYPSPQAMQVLLANPGMLQHGGIVVPHLHQPVFNALSNQMVGQNVGQQEFLETQQMFLANRDHQHQQQQQQQHVMLRSYEQQEFMKFNNGVFEPSVGGGFGNQAEEFLSPSLALGNFENVESYQMQQQGEQHHPIEAQLLLSPQQESQGQHQQQQCASEDGRNVVPA

SEQ ID NO: 152046 - protein, 133 aa, Glycine max
  Coding DNA Sequence Number=SeqID_35268
MTLLLSNILPSNRNADLPLRKYRLGSRPQDNQWIRRSPTGPWGFQLGLRASISPTGCPSPPARDRARKTPSGPEEVQQGLGVASSDYGPLSILRSVCRPQQVLRATDAPPPPPEPLSSSTKAGALPTTHVRPA

SEQ ID NO: 152047 - protein, 164 aa, Glycine max
  Coding DNA Sequence Number=SeqID_35269
  Homolog annotation: Hit_ID=Q5N8Y4; Match level="QueryCoverage=85%, HitCoverage=13%, E-value=6e-29, Identity=49%"; Hit description=SF21 -like protein
MAQKQWDETLVLVLGGIARILRLFFPFFSSLSNFWSDGFTIKRSCWESLLQFVENSILNGSKEVALAAIHCLQTTVNSHSSKLVLRKPSSYRANAADKVMQEILHGLGELYVQAQGLFNDVVYTQLIAIIDLAVKQAMLTNDNFEMEFFFQQYRGIRSKQIFFT

SEQ ID NO: 152048 - protein, 137 aa, Glycine max
  Coding DNA Sequence Number=SeqID_35270
MAEAIKIELSQIASPHSPPIDVPDPQVLGAHVSTKGSCVEAAANALPEEPPAIDVTTMGLYIVGKDCTRLVALGKEFYNAATIHNVPYTDDVVRDSHNNVSKSVGRVERCNIGDGEDPLGELMKILYAIYQKPVQLP

SEQ ID NO: 152049 - protein, 112 aa, Glycine max
  Coding DNA Sequence Number=SeqID_35271
  Homolog annotation: Hit_ID=Q5N8Y4; Match level="QueryCoverage=46%, HitCoverage=4%, E-value=6e-18, Identity=78%"; Hit description=SF21 -like protein
MSGINYPKNLSYRVKAHERLYLKCQCNMFLNNGMLHLGLGMHGQKLSKSMWEDCLCNYVFPTLDRASHMVATSSKDEWQGKELGTRGGKAVHMLILTLSLYYVFCLFVASVM

SEQ ID NO: 152050 - protein, 305 aa, Glycine max
  Coding DNA Sequence Number=SeqID_35272
  Homolog annotation: Hit_ID=Q8LM64; Match level="QueryCoverage=85%, HitCoverage=26%, E-value=7e-08, Identity=22%"; Hit description =Putative retrotransposable elements TNP2
  Pfam annotation: Domain name=Transposase_23; Domain location=207-274; Score=-11.4; E_value=0.02; Accession=PF03017.5; Description=TNP1ENSPM transposase
MAEKTNSRVNQGDGTDNTDVVVDPPSPIARHVKWKKARTNKFGQMTSAAAQEIADKIDDLQEQSTQGTFVPHGREDILNTAIGRPEHPGRVRVAGHGVTIGNYYGPRGSGSNTSSATMTADKLVEIIGSIKQELRKEVEDENKRTIDLLQKQLDAIKSELSQIQTQQSAPCRPSIPDVLVARVSTKESCAEAAANVVAKERSTLDASIVGLYIVCGDSTQVVAAGKMYGVGGIIHNVAYADDVVRICVDTIYDGDATVPFPTAEIQYVRDASSTFIAWPRHLVKPITDDSNHNARLPVGRLGETE

SEQ ID NO: 152051 - protein, 130 aa, Glycine max
  Coding DNA Sequence Number=SeqID_35273
  Gene Ontology: Mol. function=RNA-directed DNA polymerase activity; Biological process=RNA-dependent DNA replication
MGAYSADEKLLVHFFQDSLAGAAVAWYTNLEASQIQSWKDLATSFIRQYQYNADMAPDRNQLQSMTKREHESIKEYAQRWRHLAAQVVLPMTEREMITIMVDTLPTFYYEKLIGYMPANFADLVFAGRKN

SEQ ID NO: 152052 - protein, 237 aa, Glycine max
  Coding DNA Sequence Number=SeqID_35274
  Gene Ontology: Mol. function=oxidoreductase activity; Biological process=electron transport
  Homolog annotation: Hit_ID=Q4K4A2; Match level="QueryCoverage=48%, HitCoverage=30%, E-value=5e-15, Identity=38%"; Hit description =Nitroreductase family protein family
  Subcellular localization annotation: CTP_CleavageSite=66; ConfidenceScore=5.57e-01
MPPGHARSRTGTAAARCGRHPASPHDTPWRGCGTSRSSGRTAVPAPAAPVHRRTTPDRTASAVPARAMHQAAARAAAARRAAPGGSGTGPVPVLPRSAPAGNLRWDAGRHQRARSSSGTRYHARPSAPRGPSACAAAPGPAAAMAARAAGRNCGRSCAAPAARRTRPLHCAAAAGSRPAGPAPPVVAAPAAGAGRQRYAAPGDACPPRCPPPASAHGDGPVRPTATTGCVAMPHHAS

SEQ ID NO: 152053 - protein, 370 aa, Glycine max
  Coding DNA Sequence Number=SeqID_35275
  Gene Ontology: Mol. function=catalytic activity; Cellular component =extracellular region; Biological process=metabolic process
  Homolog annotation: Hit_ID=Q4V032; Match level="QueryCoverage=85%, HitCoverage=46%, E-value=4e-78, Identity=51%"; Hit description =Biotin carboxylase
  Subcellular localization annotation: CTP_CleavageSite=20; ConfidenceScore=5.43e-01
MPMSIVPSVSTASGRARWPSAAWAGAVPRWTRPNSILLAGWWWATTAERSPPRRSRRLEVHQYCTVTHLVAGLGAVTLHRAVRRCLQRVLHLHRFQHHQRRAALDLGTGGDQRRNDLARHRRQQAAGVGHGVVRFTHRIVQGETVLAVGAEQVQLVTVAQQLQRPAALAHLHRQALHTGRADHLHRRRIVALHAPAIGLRPHLQRVPALSLLQRQYARRGRAKAPAVLRLPRRMRVARIAAGTGSACNSGHGGQLPQGIIRIARCTQCRLFAFDQRGIQLGVRERIGVHQAAQEAGIGGHAHHLAVGQRLAHAAQRGVAVHVPDDQLGDHRVVVRGDAVAFLHAGIHAHMGRRSRQAQAAQGTGGGQEAA

SEQ ID NO: 152054 - protein, 173 aa, Glycine max
  Coding DNA Sequence Number=SeqID_35276
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=96%, HitCoverage=20%, E-value=6e-75, Identity=73%"; Hit description=Beta -galactosidase
  Pfam annotation: Domain name=Glyco_hydro_35; Domain location=1-91; Score=-144.1; E_value=6.3e-06; Accession=PF01301.10; Description =Glycosyl hydrolases family 35
MWTENWTGWFKNWGGPIPHRTARDVAYAVARFFQYGGTFQNYYMYHGGTNFGRTSGGPYITTSYDYDAPLDEYGNKNQPKWGHLKQLHELLKSMEDVLTQGTTNHTDYGNLLTATVYNYSGKSACFLGNANSSNDATIMFQSTQYIVPAWSVSILPNCVNEVYNTAKVILIRN

SEQ ID NO: 152055 - protein, 102 aa, Glycine max
  Coding DNA Sequence Number=SeqID_35277
MSVDRDYFSLHFINQRQVSPYTRRDIYGHLHPFVKESMSIDRDFFSLHFVKNRQRQASPYTRKDIYGHLHPFVKDSMSIDRDYFSLDFVNKRQVSLLTRRDK

SEQ ID NO: 152056 - protein, 35 aa, Glycine max
  Coding DNA Sequence Number=SeqID_35278
MALSTIKLSLGHKKLGDNRSRLAKDKLSLSDQAAA

SEQ ID NO: 152057 - protein, 86 aa, Glycine max
  Coding DNA Sequence Number=SeqID_35279
MTMSHTRWIDRVVTGEGRTIDWAVGTQIEQRQTKWRDPMDYNHSIRCSGRQRRRGEGRHHPLGNKPRKKELHHQELPWIRSLKRML

SEQ ID NO: 152058 - protein, 68 aa, Glycine max
  Coding DNA Sequence Number=SeqID_35280
MEMRNQPFMKRVCDLNQERTKVVATVRVCDLNEGCRDCERVRVRVLKSQGRVHVERNERERRSIKSQL

SEQ ID NO: 152059 - protein, 146 aa, Glycine max
  Coding DNA Sequence Number=SeqID_35281
MAPTDTSIMPCGRFNVEHDPSAALALASWLTQESRRPSFLTHNALGIMVRSQALPWCPMHAIKKVVTHNFRRFIEIPSSLISNIVAVRTTSDNVSSKRKTLDEASLSSSELETQHDHRSTSTTYVTMNPGIGDGSLLVGLLWRLDL

SEQ ID NO: 152060 - protein, 79 aa, Glycine max
  Coding DNA Sequence Number=SeqID_35282
MRAFGTKAAHPGELMLSPNETGSPRQAAAHPGKLVPSALSNLGAQVSKDKDTNFIQEILLSNQQLAKTKEVKPVKRING

SEQ ID NO: 152061 - protein, 76 aa, Glycine max
  Coding DNA Sequence Number=SeqID_35283
MDLVFGKEKLFEPPLEVGSNHGLYKEEDGPRGFMNENEVSFTTMLEDDTVFEKRGIGETQPLEFIIDEGELILILL

SEQ ID NO: 152062 - protein, 248 aa, Glycine max
  Coding DNA Sequence Number=SeqID_35284
  Homolog annotation: Hit_ID=Q1T4K6; Match level="QueryCoverage=33%, HitCoverage=15%, E-value=5e-23, Identity=73%"; Hit description =Unnamed protein product; contains similarity to nuclear protein ZAP gene_id:MQB2.8-related
MTNIIPETQIPDETVNPNYTTEHYPQQELLPPQIDPQFFETLSLPNHNSPNPNQDHDSTMQDLIPITLTIVVDDDLEPDATTDCSGGTTTQHTMKQKKKGPKRIAMERKSREKLQMATLEQMKVDKNVMKLTEDQKVCFAILIELHDLIILSSSFEASQSFTGSGKSYLAKILHDLEVENGGDAPRIHSMDDYFMTEVEDGKASKSSSSGRNKKPMTKKVMEYCYEPEMEEMTCGRAGERGHYMIDCA

SEQ ID NO: 152063 - protein, 54 aa, Glycine max
  Coding DNA Sequence Number=SeqID_35285
MASGQGKYHRPPYVVARGPQVYPSNLPNNWYQSRWFKLVTDSDEYASTTGGQNG

SEQ ID NO: 152064 - protein, 68 aa, Glycine max
  Coding DNA Sequence Number=SeqID_35286
MAILVDDKDFPSKGRLTCGRDSHFSGDVLGYKCEVYPSNLPNNWYQSRWFMLVTDSDEYASTTGGQNG

SEQ ID NO: 152065 - protein, 490 aa, Glycine max
  Coding DNA Sequence Number=SeqID_35287
  Gene Ontology: Mol. function=coproporphyrinogen oxidase activity; Cellular component=nucleus; Biological process=porphyrin biosynthetic process
  Homolog annotation: Hit_ID=Q6H6S9; Match level="QueryCoverage=81%, HitCoverage=63%, E-value=1e-73, Identity=39%"; Hit description =Putative DNA-binding protein Gt-2
MLEISTSHETPLENADGGSAAVSDGSKAEHGEDDDRNPAANRWPREETMALLKIRSEMDVAFKDANLKAPLWEQVSRKLSELGYNRSAKKCKEKFENIYKYHRRTKEGRFGKSNGAKTYRFFEQLEALDGNHSLLPPTTTVGDDVVLNAVPCSVSAAAHEHSSSTTSCSGKKKRKLTQFLEGLMREVIEKQETLQRKFVEVLDKCEKDRMAREEAWKKEELERIKKERELLAQERSIAAAKDEVVLAFLRKFAEAEGTVQLLEKIQVQNDKQKNMKQNGGNDNANGGGGVTVVTDMDKQECGNTNVRVSVGNFVHMSSSRWPKDEVEALIRLRTQIDVQAQWNNNNNNNDGSKGPLWEEISSAMKSLGYDRSAKRCKEKWENINKYFKRIKEKSKRKPQDSKTCPYYHHLEALYSKKPKKVDHGNELKPEELLMHIMVSQSQEQQQEMQTQTQSPSEDAERDQNQGDNEDQSEYQTQMVDNNSPSIAIMS

SEQ ID NO: 152066 - protein, 71 aa, Glycine max
  Coding DNA Sequence Number=SeqID_35288
  Gene Ontology: Mol. function=RNA-directed DNA polymerase activity; Biological process=RNA-dependent DNA replication
  Homolog annotation: Hit_ID=Q1SWC8; Match level="QueryCoverage=99%, HitCoverage=6%, E-value=6e-11, Identity=54%"; Hit description=RNA -directed DNA polymerase
MKNILQTYEAASDQAINLAKSEVFYCKNVPLPQRNMISSTLGVTKDLGSEVGGVCLDISGTEFGRRFKSGM

SEQ ID NO: 152067 - protein, 86 aa, Glycine max
  Coding DNA Sequence Number=SeqID_35289
MEIPTSFYLLDSMHMDIQFTHFTSEPILSIMLSYSPSQHGSTFAQQRPIGPPQCTCEAVATKTLSRIHFCSTKVEMLLRDVHICSR

SEQ ID NO: 152068 - protein, 86 aa, Glycine max
  Coding DNA Sequence Number=SeqID_35290
MSVMDLVLCLPLALDLTAYWSAMWWQCVCCPLPAIPRLLRCLTLRLPGGAVLLDESPVNRGPDELVGGDGHSVELIKARNHSWEVG

SEQ ID NO: 152069 - protein, 317 aa, Glycine max
  Coding DNA Sequence Number=SeqID_35291
  Homolog annotation: Hit_ID=Q9LS96; Match level="QueryCoverage=46%, HitCoverage=89%, E-value=1e-44, Identity=57%"; Hit description =Arabidopsis thaliana genomic DNA, chromosome 3, P1 clone: MVE11
MQSPIPLKLSEIGLRGFLVVNLELVVGNNGIVVGIGGGESDLDVPEFLGGQAEGELVAAALVGDGEEGDGDPAVAALEAGGLGQGQEDEAQEDEEYLEELVELLLLEVDGTLLLQGFLEVELDYGVQGLEGCFFRLVLVLDAAFVLCHGWNLRSSLVLVPTTTLPHFFAQGQPRQVRRFRDRKGQARIIFPSVAFLTGSDLVPGPAAGVFPSRGGHGIGGSMLVELLMLKFNTWKQGLMTPVGLVVLVEILLFLEDCQNKLASKLKRGVSSNKGVSFNCQQKYNFKAHILWAVACSFHDSYDVGEPERNEVSETTSA

SEQ ID NO: 152070 - protein, 158 aa, Glycine max
  Coding DNA Sequence Number=SeqID_35292
  Gene Ontology: Mol. function=heat shock protein binding
  Homolog annotation: Hit_ID=Q1SQA8; Match level="QueryCoverage=73%, HitCoverage=45%, E-value=1e-25, Identity=52%"; Hit description=Heat shock protein DnaJ, N-terminal
MDSKKEDRRSSDQINFQRGKIRRECFFEDFDGHEQIFQATFGNKWYTWSFNNWRSSSSEHSTSGFEWREHSNRTNKWKNESDTEHEDDDSCCEGSSSDRTVLGLPPTGPLKIEDVKNAIRLSALKWHPDKHQGPSQPTHPTRNSVSPTNCLLGCRCKV

SEQ ID NO: 152071 - protein, 57 aa, Glycine max
  Coding DNA Sequence Number=SeqID_35293
MVENLHEIAHGGGKEGGGCRPARPGELGCFHQKAQLSVGTPWKVQVGLVAICTPPVY

SEQ ID NO: 152072 - protein, 472 aa, Glycine max
  Coding DNA Sequence Number=SeqID_35294
  Gene Ontology: Mol. function=hydrolase activity; Cellular component =membrane; Biological process=proteoglycan metabolic process
  Homolog annotation: Hit_ID=Q6ZJE2; Match level="QueryCoverage=97%, HitCoverage=94%, E-value=1e-131, Identity=48%"; Hit description =Putative beta-glucuronidase
  Pfam annotation: Domain name=Glyco_hydro_79n; Domain location=12-295; Score=325.6; E_value=8.9e-95; Accession=PF03662.4; Description =Glycosyl hydrolase family 79, N-terminal domain
MEKAVYNNWLSSEDVKLEVKGVASIANTDDNFICATLDWWPANKCDYDQCPWGQAGILNLDLDNKILTNAVKAFNPLRIRLGGSLEDQIVYQFGKQKKCPHFKKKADGLFGFSQACLPKVRWDESEINFWVECSHWEEKFCRGQEELGNELCAEGISARVDSVEYAKDITRLRHIVNLLYPIASTRPKVLGPGGFYGKEWFSSFLMNVGPGVVDGITHHIYNLGAGVDKDLINRVQDPYLLSQVAETYKSVAQAVKEFTPWAGPWVGESGGAYNSGGKDVSNTFVNGFWYLDQLGMTSTLNHKVYCRQSLIGGNYGLLNTTTFIPNPDYYGALLWHRLMGSKVLSVSHEGSPFLRTYAHCSKKGPGITVLLINMSNSTTFNVFLINDMNLYPVLNTVRSVPMKMREEYHLTPRDGNIQSDVVMLNGTPLVLTKSLDIAEMKPKLVDPSSSIKAGPDSIVFVQIKSFNAPACA

SEQ ID NO: 152073 - protein, 175 aa, Glycine max
  Coding DNA Sequence Number=SeqID_35295
  Gene Ontology: Mol. function=hydrolase activity; Cellular component =membrane; Biological process=proteoglycan metabolic process
  Homolog annotation: Hit_ID=Q5SNA6; Match level="QueryCoverage=98%, HitCoverage=34%, E-value=2e-46, Identity=51%"; Hit description =Putative beta-glucuronidase
MTSTFNHKVYCRQALVGGNYGLLDTTTFIPNPDYYGALLWHRLMGSKVLSVSHEGSPYLRAYVHCSKKESGITVLLINMSNSTTFEVSLLNENLYHPEVGLRNRNTPREEYHLTPKDGNIQSKVVLLNGTPLVLTQSLHIPEMNPKLVDPSSPIKVKHDSIVFVHSKSFNAPACM

SEQ ID NO: 152074 - protein, 266 aa, Glycine max
  Coding DNA Sequence Number=SeqID_35296
  Homolog annotation: Hit_ID=Q10Q33; Match level="QueryCoverage=70%, HitCoverage=59%, E-value=7e-19, Identity=31%"; Hit description =Expressed protein
  Pfam annotation: Domain name=Remorin_C; Domain location=154-262; Score=102.7; E_value=1.1e-27; Accession=PF03763.4; Description =Remorin, C-terminal region
MENFLNQMRDSKITFQKTQSFKGEKKQGGENWLQKQFSRKRSGDHDSRDMDHAAAVAAAAFAINLQDVSEQKSETLEASLTKTKSKVDGPKPPIPLLNSASKRLSGSFRSKNDQGKKPEETITPAPSMRKSSTFSDEKPESSTKPSPVRQPTVTERRTKADEWERAEFQEIRQRYDKLREVIDSWENKKKMKARRKLDKEERGVAQRRMKALEDFQNKITAIDQIADGARTKAEESRRNEEQKTKEKANVIRTTGEMPGICFCFCF

SEQ ID NO: 152075 - protein, 90 aa, Glycine max
  Coding DNA Sequence Number=SeqID_35297
MHTSPTDNLVPLDLDIEAMLRRNRAERRRKLLQDRTVASILEEEAHSSDSASSDLPSSRESTTYLLEAVIMADEHQQRVTLEDYSSSSVP

SEQ ID NO: 152076 - protein, 80 aa, Glycine max
  Coding DNA Sequence Number=SeqID_35298
  Gene Ontology: Mol. function=ribokinase activity; Biological process =D-ribose metabolic process
  Homolog annotation: Hit_ID=Q1SXC3; Match level="QueryCoverage=95%, HitCoverage=20%, E-value=5e-17, Identity=55%"; Hit description =Carbohydrate kinase, PfkB
MAWTEASSIPRALVSIILRLPRLKFAIVTLGKDGCIMLERCVDDEGSHIEEMDVESCLTTLKERKDDSTAMPTCIASVIT

SEQ ID NO: 152077 - protein, 174 aa, Glycine max
  Coding DNA Sequence Number=SeqID_35299
  Gene Ontology: Mol. function=chitin binding; Cellular component =extracellular region; Biological process=chitin metabolic process
  Homolog annotation: Hit_ID=Q86AI8; Match level="QueryCoverage=65%, HitCoverage=37%, E-value=1e-18, Identity=37%"; Hit description =Similar to Homo sapiens (Human). Mucin 2
MHALTFRGLHALTFRGLHILTLRGLHAITLRGLHVLTIKGLQALTFRGLHVLAIRGLHALTFRGLHVLAIRVLHALTFRGLHVLTIRGLHALTFRGLHVLTIKGLYALTFRGLHDLRHQRNTHPRNQKAIRLHLQRATRPHLQRTTCPLHQRVAPLHLQRTTHPRHQRAALRNL

SEQ ID NO: 152078 - protein, 216 aa, Glycine max
  Coding DNA Sequence Number=SeqID_35300
  Gene Ontology: Mol. function=ribokinase activity; Biological process =D-ribose metabolic process
  Homolog annotation: Hit_ID=Q1SXC4; Match level="QueryCoverage=84%, HitCoverage=50%, E-value=7e-52, Identity=56%"; Hit description =Carbohydrate kinase, PfkB
MSSDSVLPLPENPIIVGFGGVGVDFLAVVPSFPKPDSKIRTTEFTFQGGGNNGNTMTCAARLGLKPRIISKVSNDGPGKTMLEELEAEGVDTSFFVVSKEGTSPFSYVIVDNQTKTRTCIFTPGYPEMVPQDLPRANLLSALDGARMVYFDARMPDSALVIAQEAFHQNIPILIDAERPREGLNDLLSLADYVDLLLEWRRGLALGHITHALHHKE

SEQ ID NO: 152079 - protein, 35 aa, Glycine max
  Coding DNA Sequence Number=SeqID_35301
MKIRKYPKGRSKGLTPGSPRLAPGLPGAPNSLGVK

SEQ ID NO: 152080 - protein, 74 aa, Glycine max
  Coding DNA Sequence Number=SeqID_35302
MVGAECQKIHRFHLHPFSLRAVTKGAAEEGGGGMGKEESNCMERVSMRRVGLGARIPMALAVASSTIQLHFTPV

SEQ ID NO: 152081 - protein, 120 aa, Glycine max
  Coding DNA Sequence Number=SeqID_35303
  Gene Ontology: Mol. function=zinc ion binding; Biological process =ubiquitin cycle
  Homolog annotation: Hit_ID=Q6DGJ4; Match level="QueryCoverage=76%, HitCoverage=16%, E-value=5e-08, Identity=32%"; Hit description=BRCA1 associated protein
MQLTKTNRTSWRKLLGIEIGIKCVGGKVIGELDQDAIAIFCSVVPDEEKVVETVEVGPTEGNEVVEGEVVGDGEDEEKRRGRGVGRGSEQVERASALAEFRVVGLGLEDGSGIQRVLLFH

SEQ ID NO: 152082 - protein, 913 aa, Glycine max
  Coding DNA Sequence Number=SeqID_35304
  Gene Ontology: Mol. function=protein binding; Biological process =primary shoot apical meristem specification
  Homolog annotation: Hit_ID=Q1S365; Match level="QueryCoverage=86%, HitCoverage=69%, E-value=0.0, Identity=72%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=LisH; Domain location=121-147; Score =19.0; E_value=0.008; Accession=PF08513.1; Description=LisH
  Pfam annotation: Domain name=WD40; Domain location=463-501; Score =11.5; E_value=1.7; Accession=PF00400.22; Description=WD domain, G -beta repeat
  Pfam annotation: Domain name=WD40; Domain location=524-562; Score =6.6; E_value=6.2; Accession=PF00400.22; Description=WD domain, G -beta repeat
  Pfam annotation: Domain name=WD40; Domain location=569-609; Score =29.4; E_value=1.3e-05; Accession=PF00400.22; Description=WD domain, G-beta repeat
  Pfam annotation: Domain name=WD40; Domain location=613-653; Score =26.6; E_value=8.9e-05; Accession=PF00400.22; Description=WD domain, G-beta repeat
  Pfam annotation: Domain name=WD40; Domain location=703-742; Score =8.4; E_value=3.8; Accession=PF00400.22; Description=WD domain, G -beta repeat
  Pfam module annotation: Pfam domain module=LisH::WD40::WD40::WD40::WD4 0::WD40; Domain location=121-147::463-501::524-562::569-609::613 -653::703-742
MIPSHLVLFKLSDDTIISSLTTILLFSLYLRFLFLLLVLLLQIPSPLLLYKYSARRALTQEKARERKWSEKNTETLPRHSCSAPSLSICVRDSLAGIVDLFGSRSFRAAFVDGTVMSSLSRELVFLILQFLDEEKFKETVHKLEQESGFFFNMRYFEDMVTNGEWDEVEKYLSGFTKVDDNRYSMKIFFEIRKQKYLEALDKQDRAKAVDILVKDLKVFAAFNEELFKEITQLLTLDNFRHNEQLSKYGDTKSARGIMLAELKKLIEANPLFRDKLQFPTLKNSRLRTLINQSLNWQHQLCKNPRPNPDIKTLFVDHSCGQVQPNGARAPSPVTNPLMGAVPKAGGFPPLGAHGPFQPTPAALPTSLAGWMANPSPVPHPSASAGPIGLAAANNAAILKRPRTPPSNNPAMDYQTADSDHVLKRTRPFGLSDEVSNLPVNLLPVAYSGQSHGQSSYSSDDLPKTVVMTLNQGSIVKSMDFHPLQQILLLVGTNMGDVMVWDIGSRERIAQRNFKVWELGACSVALQASLSNDYSASINRVVWSPDGTLCSVAYSKHIVHIYSYHGGDDLRNHLEIEAHAGSVNDLAFSYPNKQLCVVTCGEDRVIKVWDAVTGAKQYTFEGHEAPVYSVCPHHKESIQFIFSTATDGKIKAWLYDNMGSRVDYDAPGHSSTTMAYSADGTRLFSCGTNKEGESFLVEWNESEGAVKRTYHGLGKRSVGVVQFDTTKNRFLAAGDEFTIKFWDMDNTNMLTSVEAEGGLLASPCIRFNKDGILLAVSTNDNGVKILANAEGIRLLRTVENRTFDASRVASAAVVKAPTIGAFPSTNVTVGTSLADRAPPVAAMVGINNDTRNLADVKPRIVDESVEKSRIWKLTEINEPSQCRSLKLPDSLSSMRLMPVLVFYSHQCIHAFLPY

SEQ ID NO: 152083 - protein, 174 aa, Glycine max
  Coding DNA Sequence Number=SeqID_35305
  Gene Ontology: Mol. function=protein serine/threonine kinase activity; Cellular component=cytoplasm; Biological process=protein amino acid phosphorylation
  Homolog annotation: Hit_ID=Q53UK4; Match level="QueryCoverage=90%, HitCoverage=43%, E-value=8e-81, Identity=91%"; Hit description =Ser/Thr protein kinase
  Pfam annotation: Domain name=Pkinase; Domain location=1-174; Score =108.6; E_value=1.9e-29; Accession=PF00069.15; Description=Protein kinase domain
  Pfam annotation: Domain name=Pkinase_Tyr; Domain location=1-172; Score=-86.8; E_value=3.8e-07; Accession=PF07714.7; Description =Protein tyrosine kinase
  Pfam module annotation: Pfam domain module=Pkinase::Pkinase_Tyr; Domain location=1-174::1-172
MKIVRHPNIVRLHEVLASQTKIYIILEFVMGGELYDKIVQLGKLSENESRHYFQQLIDAVDHCHRKGVYHRDLKPENLLLDAYGNLKVSDFGLSALTKQGADLLHTTCGTPNYVAPEVLSNRGYDGAAADVWSCGVILYVLMAGYLPFEEADLPTLYRRVFYLFLIILKKRLER

SEQ ID NO: 152084 - protein, 75 aa, Glycine max
  Coding DNA Sequence Number=SeqID_35306
MAFLGETSSQTIANSRLAFIFPNGPITHNQTGVYFQSLTPTPITPDGILNLLQSTITPTHYAIMYYNRKWNIPRQ

SEQ ID NO: 152085 - protein, 91 aa, Glycine max
  Coding DNA Sequence Number=SeqID_35307
MQRTLANGRHSPKENVVVWFCSMHNRPDNYLKGILNSALKGLDDTPQPKSKAGARWIVVKYFNDVRPLEAERLKALRIQWAKFYLKVRNES

SEQ ID NO: 152086 - protein, 120 aa, Glycine max
  Coding DNA Sequence Number=SeqID_35308
MPSNGKADIRDRSKSNEKEHDARQNRYKENTASFSSTYRLTKKKGDRVEYGLNGIGLSLAARPIEGPVEFVRLKTSVKPTEEGDSVRFLSIAKKSKRQNSTRSEKASVNQRVEGEAVVVI

SEQ ID NO: 152087 - protein, 165 aa, Glycine max
  Coding DNA Sequence Number=SeqID_35309
  Gene Ontology: Mol. function=DNA binding; Cellular component =mitochondrion; Biological process=DNA integration
MANEAYEDFLMRLGVKHLITSVEHPHTNGQIEAANRVILRALHARLDKSKGLWKEVLPNILWAYHCSPQTTTNETPFQLTYSTDAMIPIEVGEPSTRRMMFQQQQNEENMMAELETKDESQEMAKIKEEVVKHRALRRYNTKVQPPTFQPISLVWRVRGEARKDP

SEQ ID NO: 152088 - protein, 129 aa, Glycine max
  Coding DNA Sequence Number=SeqID_35310
MATSKYLTAPGAFDSSPSVSIHHMAKGQRELKLWILSRGVHGMPMNCEVEDVYPECQQKVVGAHHFGCKGASFGLKVANPFMKFSRDIHPPNQEILVGCHPVWFLPFFCHNFLSVYAESLEGLLDDSLE

SEQ ID NO: 152089 - protein, 849 aa, Glycine max
  Coding DNA Sequence Number=SeqID_35311
NLQDSGTLKRVAWGLDVDTREGHEFIELLSMDKSCPMSRMLSRVDMLLVLQVRFNMSATSQSSARTLLLHMCHSLSGHILETWYVVTPSGPRGHLHRQFFLKGDSSAQPFAASSVGEPVLITMTLPISVFGKQEGVVMKLTGKVDWVSLNSVSKDLFEFDLNDVVADGLPLMFNWDMKPHFPFYWQSDPTRFKSFNEDLLTLVERVSKDILEQLLGSLNTQTILFLPSTSDLFTALDGWTCWWDCAAVYCSSHWKGGQPAAGVGPTDKVVDVSPNMPSIILAKRNHDDGVGVSCCKKLRASSNLHAMREAVRLTPGSSHPLSLQDPPSAPSIVQAFTPVVVPIPAPPPPPVVLVQEVSNALAAELSALAASSGPVMVPPSTITTSLLSANVATMSTLVVPPPLSLAPQVPSLTMLASVSPSTSFHPNVSLDHIYTSRDADSLVECPKVDNATVAFAEVMKSNHQLFSKVDSVLAKLLCTILDGGELFEHCKGLQREKSKLASEVENTATEKYRLAKVVSDLEASLKDLESRMEESEQKASRQKEANKELEDELLMYKKQAMEQHEKGFHKAVRQARFFVKDLDLGHFDPVKDMKDDVLLDEEDIAAEEEADEEQDVGTNDMLVIVPKELAYQGHALGFCRSAYQGWSLGFCTNGRPWVSDVPRGSTRADLGFNELWTRDTFILGFGEAHQGWTMDLTSQGRCIEAHKGRTLGIDKPLEKQDTPRTDLGSDEPLEKRDTPRKDLGFDKPLENKTRQGQTLGLMSLWRSETHQGQTLGLTSLWRNETHQGWTLGLTSLQRSNQGRLCPGFCQGSPWIDLGVDLEFDEPLKLRPVTRLSWVFSRLAKDVPLV

SEQ ID NO: 152090 - protein, 228 aa, Glycine max
  Coding DNA Sequence Number=SeqID_35312
MDDIYYVALMNKLLWDLGVYHVFNKLDDDSKHNIMVKGSIMAKKQWFNKTNLKAMKVAMEEEVRTKKRNEQQAMSNITHSNTRPRIAPVRQSPWKPSEKISTAQVLRDMSEIEDEVPLIIPWKCKQEIQLYKKHHLLGNKPWKEKLQHQESVLDKKLREEASMEEKNEREKGGSTKLKEKREGEKPWMFIINGVLCFLKINGSEMEKEERLLETPLQGEDESRTSSPP

SEQ ID NO: 152091 - protein, 107 aa, Glycine max
  Coding DNA Sequence Number=SeqID_35313
MADDVTENDGSKGHHFTRDAVCLHEGVGHHSRLVLAPPFQACARVVVPVGGCIAVRADIGCVLRADCRGCRDWVRLGAVGCGRVAVWTLGAGEGAAGLLLVGELRFD

SEQ ID NO: 152092 - protein, 108 aa, Glycine max
  Coding DNA Sequence Number=SeqID_35314
MHTRGSRPQDTQWTRKSPTGPWDFQLWLRASISPIGCPSPPARSCHRDIGITPARHPVDPEKSNRVLEFPALITSLYQFYGVPIAHSKVIRPPTNRAFIKKYCAPRQA

SEQ ID NO: 152093 - protein, 139 aa, Glycine max
  Coding DNA Sequence Number=SeqID_35315
MLNPQEKTTLELLMRIMKLAKYRQKAQVEKDEGLSGEGQSPRVEKDEGPSNPCGVYPDLSSFTGSDVYPDLSSFTGSGVYPELSSFTGSGVYPDLSSFTGSGVIQTFVACIKRSAPKDSHHLVSELRLLIQTFFKKNAV

SEQ ID NO: 152094 - protein, 398 aa, Glycine max
  Coding DNA Sequence Number=SeqID_35316
  Gene Ontology: Mol. function=nucleoside transporter activity; Cellular component=membrane; Biological process=transport
  Homolog annotation: Hit_ID=Q7XAU2; Match level="QueryCoverage=92%, HitCoverage=91%, E-value=1e-100, Identity=52%"; Hit description =Equilibrative nucleoside transporter ENT8 splice variant
  Pfam annotation: Domain name=MFS_1; Domain location=21-397; Score= -24.3; E_value=0.0041; Accession=PF07690.6; Description=Major Facilitator Superfamily
  Pfam annotation: Domain name=Nucleoside_tran; Domain location=127 -398; Score=227.1; E_value=3.8e-65; Accession=PF01733.8; Description =Nucleoside transporter
  Pfam module annotation: Pfam domain module=MFS_1::Nucleoside_tran; Domain location=21-397::127-398
MEAVKLVSSDPSERPDTYRVAYIIHFLLGAGNLLPWNALITAVDYFAYLYPTKHIEKVFSVAYMISSVMVLLGMISWGGWSKTTLRLRMNLGFSMFVMSLMVAPVIDWTSSSTKLNERPSGAYSLTVAAVVICGLADGLVGGSLIGSAGKLPKQYMQAVFAGTASSGIIISILRIITKASLPQTPKGLKISAHLYFMVATIFLLCCIIFSNLQHKLPVMQQYHQRLHQESTVCTGTKFWAVAGKIKGAAFGIFIIYIVTLSIFPGFIAEDLESKILRDWYPILLITVYNLADLMGKSLTAFYVMQSMTRAIWAATARLLFYPLFVVCLHGPKWLKTEVPMVVLTFLLGFSNGYLTSVLMILTPKSVPLSESELSAIVMTGFLGFGLVGGSVLGWFWIL

SEQ ID NO: 152095 - protein, 78 aa, Glycine max
  Coding DNA Sequence Number=SeqID_35317
MGRGSKSVWADNHRMSPHATGLTGRDSKSVCADYCIGRLCVPLDSQVTIAKGGVFDKSGAFAPTYPQFVMRNLDLRTS

SEQ ID NO: 152096 - protein, 52 aa, Glycine max
  Coding DNA Sequence Number=SeqID_35318
MDYLVTGRKKKRKEFAFSRMKNIAAVENVKMYINMRVKGHSNSEWVLQRSVL

SEQ ID NO: 152097 - protein, 182 aa, Glycine max
  Coding DNA Sequence Number=SeqID_35319
  Gene Ontology: Cellular component=chloroplast
  Homolog annotation: Hit_ID=O22773; Match level="QueryCoverage=65%, HitCoverage=59%, E-value=6e-34, Identity=59%"; Hit description =Thylakoid lumenal 16.5 kDa protein, chloroplast precursor
MCSVKRQLTLCKAVSQPAIHPPIILTKRGLSISFPTTFSLSLAGEDANAAILDADDDEELLEKVKRDRKKRLERQGYLQDLVYKLSEVGKAIENNDLATAASVFGSGTDTDWVQNANVALDKLSASPEEKTVVDTFNSSLASLISSVAANDVESSKLAFVSSASAFEEWSSLTGLAVQLKGF

SEQ ID NO: 152098 - protein, 125 aa, Glycine max
  Coding DNA Sequence Number=SeqID_35320
MHFQSFSLLIHIGAQKEPSHGPPDTQKQQHMMAQLRNVAILVVVVVAAVLLQSTEAKDYEVGGATGWTSFPPGGASFYSKWAANFTFKLNDSLVEVNVCESVMELFFCSLQLRIWKPQCGGTYQS

SEQ ID NO: 152099 - protein, 359 aa, Glycine max
  Coding DNA Sequence Number=SeqID_35321
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q4ZGK1; Match level="QueryCoverage=90%, HitCoverage=86%, E-value=1e-135, Identity=73%"; Hit description=Beta- 1,3-glucanase 1
  Pfam annotation: Domain name=Glyco_hydro_17; Domain location=30-343; Score=359.2; E_value=6.5e-105; Accession=PF00332.9; Description =Glycosyl hydrolases family 17
MACLRRKKHCVQGQQRVSFSNFDHPRQSNMIANNIPSPDEVVTLLRAEKIRNVRIYDADHSVLKAFSGTGLEIVVGLPNGQLQDMSSNPDHALNWVKENVQSFLPDTRIRGIAVGNEVLGGGDYSLWGVLLGAVKNIYNATVKLHLDQLVQISTANSFAVFSQSYPPSSGKFDDNVNQFMKPLLEFFQQIGSPFCVNAYPFLVYASDPEHIDINYALFEPTKGIYDPTYRLHYDNMLDAQIDAAYAALEDAGFDKMEVIITETGWASNGDQTEAGANATNARTYNYNLRRRLAKRKGTPHRPKNVVKAYIFALFNENEKPGHSSEKNYGLFKADGSISYDIGFHGLNAGHSSLLSLKVP

SEQ ID NO: 152100 - protein, 67 aa, Glycine max
  Coding DNA Sequence Number=SeqID_35322
MACLDQQHSEKEGQTIVVVFVVEDLSISDLDDSSNLDCIYCLKGHNYSTVVGFAAEEKNIDHRLLQQ

SEQ ID NO: 152101 - protein, 139 aa, Glycine max
  Coding DNA Sequence Number=SeqID_35323
MEEEMDSDKAISFNRSFPKRLVELQVSKQLRQLSAMELYDKSFDPNDHFLKFESTLYYKGALASIMCRMFPLSLKSTVLKWFQLKPLRSWGTIERIHFTIQQRGNSREKPTIWSCADVGKGRCERRISFLYIHIRNSSR

SEQ ID NO: 152102 - protein, 81 aa, Glycine max
  Coding DNA Sequence Number=SeqID_35324
MTTLVTTIDSTSDNDSGVSSGGGGGDIDDDNNGGSAGSDDNARCDNEINVGGGDNDYDCNSDNVSDNDISSVSDGGVNGHA

SEQ ID NO: 152103 - protein, 67 aa, Glycine max
  Coding DNA Sequence Number=SeqID_35325
MGDSAKVVIKQDMKGRRHKYGFNNNKREKAQKKRVVDDETADKHQLDEHQERLRKTLALEGGKDICS

SEQ ID NO: 152104 - protein, 72 aa, Glycine max
  Coding DNA Sequence Number=SeqID_35326
MKDIELVEEEQAQIGADPSSETSNKSENYKEEARKKTQKRKPKRVESVNAAAEAFGDDWKILIALCIVKPKQ

SEQ ID NO: 152105 - protein, 74 aa, Glycine max
  Coding DNA Sequence Number=SeqID_35327
MEGLRDTLDEAPKDQPCEAPKQYGNKSMLSKVGMPNSGYNITKYIYATLDINLPNMTCNNFYSSSARRIGYMAM

SEQ ID NO: 152106 - protein, 106 aa, Glycine max
  Coding DNA Sequence Number=SeqID_35328
STKVDVSLSELNALSEYHPLSEASTRLVDKRNLEGNLSRRHVLSASSARSVSHLSSSRLSVSLALSENSLTCAKRENDAKHDVEVSEPFSSIELQKREKRSEESVE

SEQ ID NO: 152107 - protein, 70 aa, Glycine max
  Coding DNA Sequence Number=SeqID_35329
METLTLSGKILRIATDFADIDKNLSSLLLTLCDMLGADTLVDLVISNATALVYPCQPGLGDTSNHPLSCL

SEQ ID NO: 152108 - protein, 56 aa, Glycine max
  Coding DNA Sequence Number=SeqID_35330
MLMLIRASMPYFGVIEQIWELDYNEFRVLVFKCKWVDGNTVVHQDELGFTLVDLNK

SEQ ID NO: 152109 - protein, 49 aa, Glycine max
  Coding DNA Sequence Number=SeqID_35331
MELMGRALYYNQKAFTTAASKLEKTGYDIVAHENAAKSGYSLKNFVIKV

SEQ ID NO: 152110 - protein, 126 aa, Glycine max
  Coding DNA Sequence Number=SeqID_35332
VYTDNHSGISARQRDSKVSMTDLVSAEDYAFRFTDSKKVYTDNHSGISARQRDSKVSMTDLVSAEDDAFRLTDSKKVYTDNHSGISARQRDSQVSMTDLVSAEDDIAKKNVYTDNHSGISARQRDS

SEQ ID NO: 152111 - protein, 161 aa, Glycine max
  Coding DNA Sequence Number=SeqID_35333
  Gene Ontology: Mol. function=hydrolase activity
  Homolog annotation: Hit_ID=Q9WZE7; Match level="QueryCoverage=96%, HitCoverage=58%, E-value=3e-23, Identity=37%"; Hit description =Dehydrase-related protein
MEQFDQNYFVEIGIDYFKPKLPDVIFDDIFEYEDGLKIKFVHAPGHTPDSSYVYIPEENILITGDTVINTIHPEIVEDSNLNVWIKTLEKLPKAKHVIPGHGEYGDYKLVTDMIDYIEKIKKIIIGELRPADFEADENFSKRLHPEMLEWSLKNLLSKTNF

SEQ ID NO: 152112 - protein, 239 aa, Glycine max
  Coding DNA Sequence Number=SeqID_35334
  Gene Ontology: Mol. function=transferase activity
  Homolog annotation: Hit_ID=Q4CCH7; Match level="QueryCoverage=51%, HitCoverage=16%, E-value=1e-13, Identity=36%"; Hit description =Glycosyl transferase, group 1:Polysaccharide pyruvyl transferase
  Pfam annotation: Domain name=ExoV; Domain location=26-186; Score= -98.2; E_value=0.05; Accession=PF08871.1; Description=ExoV-like protein
  Pfam annotation: Domain name=PS_pyruv_trans; Domain location=2-229; Score=3.1; E_value=1e-07; Accession=PF04230.4; Description =Polysaccharide pyruvyl transferase
  Pfam module annotation: Pfam domain module=ExoV::PS_pyruv_trans; Domain location=26-186::2-229
MGYYGYGNYGDELMRLGITDFLKKFNIQYVTALPKRISKDTISRFNIFEILEYIYDSDAVIYGGGGLLQDITSTRSFLYYASVINLSLIMRTPVILFGNSIGPVKKKAPAQRTDMEISKKLAKKLECELFEDIEDVDKFTSLILSSKFVISERFHPVVVASYYGIPFISLENSKSQRFFRKYTSRREFFARNLIDIEKRLVPILNEPLKLKEIMDKECDESYKKLYKTLLRATSNIIYK

SEQ ID NO: 152113 - protein, 94 aa, Glycine max
  Coding DNA Sequence Number=SeqID_35335
MAHLLILVIPFIINPAVSLNFATVLRESKLLLTDSTSYQTLRKNHPFSDFLQCRKDKQFHLLGSGNALQSGMMEKRWFQNHMVTQNRQKPGNQR

SEQ ID NO: 152114 - protein, 79 aa, Glycine max
  Coding DNA Sequence Number=SeqID_35336
WRLLAYSFLGTRTRESRVALPPKDGPWRRWLAAAVVKDDPFRFFDDFVGSGGTKEECGCAAPLHFVSIYRGGCDVIDYK

SEQ ID NO: 152115 - protein, 205 aa, Glycine max
  Coding DNA Sequence Number=SeqID_35337
  Homolog annotation: Hit_ID=Q9FNE4; Match level="QueryCoverage=86%, HitCoverage=16%, E-value=1e-23, Identity=36%"; Hit description =Arabidopsis thaliana genomic DNA, chromosome 5, P1 clone:MPO12
  Subcellular localization annotation: CTP_CleavageSite=93; ConfidenceScore=5.26e-01
MLKGLNLSADEHISSLKQNSGQKKRRKETASGKKGTDKNAAGAVLFVSFWPGSSMPSRSDLVSVYSKFGALNEAETDMFCTNYTARVSFLRTSDAEKAYNHSQNNNPFGSPTDVTFQLQYSSDGSKSGQQGERSKNKSLPAATAPVAFSQGTEASKLIFIQQKLQGMTLMLEASGGKSPDMMAKVESEMKALLEDVNKMVEASLF

SEQ ID NO: 152116 - protein, 81 aa, Glycine max
  Coding DNA Sequence Number=SeqID_35338
  Gene Ontology: Mol. function=identical protein binding; Biological process=negative regulation of enzyme activity
  Homolog annotation: Hit_ID=Q1SX60; Match level="QueryCoverage=82%, HitCoverage=27%, E-value=2e-13, Identity=69%"; Hit description =Proteinase inhibitor, propeptide
GTCVGKNGQLHFSPYSFVVSSFYFPAGSCSWQQKGKLVVAHLAITCYIVYLGAHSHGPSPTSLDLEIATHSHYDLLASVLG

SEQ ID NO: 152117 - protein, 82 aa, Glycine max
  Coding DNA Sequence Number=SeqID_35339
  Homolog annotation: Hit_ID=Q1RXP4; Match level="QueryCoverage=97%, HitCoverage=5%, E-value=8e-34, Identity=83%"; Hit description=AAA ATPase
MRRYLRPLVANVAIVAKCHLSAVYRHEKGKLFAQFVDLLQFYEWFEINDHTGTQLTDDKVLESHYSRMQSFQLLAFKKMEKI

SEQ ID NO: 152118 - protein, 143 aa, Glycine max
  Coding DNA Sequence Number=SeqID_35340
MGAESESENVRSFEEKRKNWEWKERQKTLTFVRMTLLRMNCVCWGEIKPRFSAISDPRTYGMEGLLLRALDQNCMKKVSDHICSGCNYFLKLAKGSRKKSFGSKGGGGMANIVDNNTLEVLNTPFKHEEVKEFVLQTFLGGSG

SEQ ID NO: 152119 - protein, 563 aa, Glycine max
  Coding DNA Sequence Number=SeqID_35341
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=90%, HitCoverage=92%, E-value=0.0, Identity=46%"; Hit description =Pentatricopeptide repeat
  Pfam annotation: Domain name=PPR; Domain location=128-162; Score =39.2; E_value=1.4e-08; Accession=PF01535.11; Description=PPR repeat
  Pfam annotation: Domain name=PPR; Domain location=163-197; Score =40.6; E_value=5.4e-09; Accession=PF01535.11; Description=PPR repeat
  Pfam annotation: Domain name=PPR; Domain location=198-232; Score =41.9; E_value=2.1e-09; Accession=PF01535.11; Description=PPR repeat
  Pfam annotation: Domain name=PPR; Domain location=23-57; Score=26.6; E_value=8.7e-05; Accession=PF01535.11; Description=PPR repeat
  Pfam annotation: Domain name=PPR; Domain location=233-267; Score =32.7; E_value=1.3e-06; Accession=PF01535.11; Description=PPR repeat
  Pfam annotation: Domain name=PPR; Domain location=268-302; Score =50.9; E_value=4.1e-12; Accession=PF01535.11; Description=PPR repeat
  Pfam annotation: Domain name=PPR; Domain location=303-337; Score =44.7; E_value=3.1e-10; Accession=PF01535.11; Description=PPR repeat
  Pfam annotation: Domain name=PPR; Domain location=338-372; Score =52.9; E_value=1e-12; Accession=PF01535.11; Description=PPR repeat
  Pfam annotation: Domain name=PPR; Domain location=373-407; Score =30.4; E_value=6.5e-06; Accession=PF01535.11; Description=PPR repeat
  Pfam annotation: Domain name=PPR; Domain location=408-442; Score =53.1; E_value=9.2e-13; Accession=PF01535.11; Description=PPR repeat
  Pfam annotation: Domain name=PPR; Domain location=443-477; Score =17.7; E_value=0.042; Accession=PF01535.11; Description=PPR repeat
  Pfam annotation: Domain name=PPR; Domain location=58-92; Score=31.3; E_value=3.5e-06; Accession=PF01535.11; Description=PPR repeat
  Pfam annotation: Domain name=PPR; Domain location=93-127; Score=23.9; E_value=0.00056; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=128-162::163 -197::198-232::23-57::233-267::268-302::303-337::338-372::373 -407::408-442::443-477::58-92::93-127
MKHYSTVSLSHRLELKGIQPDLFTLNILINCFCHMGQITFGFSVLAKILKRGYPPSTVTLNTLIKGLCLKGQVKKALHFHDKLLAQGFQLNQVGYGTLINGVCKIGDTRAAIKLLKKIDGRLTKPDVVMYSTIIDALCKYQLVSEAYGLFSEMTVKGISADVVTYNTLIYGFCIVGKLKEAIGLLNVMVLKTINPDVYTYTILVDALCKEGKVKEAKSVLAVMLKACVEPNVITYNTLMDGYVLLYEVRKAQHVFNAMSLMGVTPDVHTYTILVNGFCKSKMVDEALNLFKEMHQKNMVPNTVTYNSLIDGLCKSGRISYVWDLIDEMRDRGQPADVITYSSLIDGLCKNGHLDRAIALFNKMKDQGIRPNMFTFTILLDGLWKGGRLKDAQEVFQDLLTKGYHLNVYTYNVMINGHCKQGLLEEALTMLSKMEDNGCIPNAFTFETIIIALFKKDENDKAEKLLRQMIARGLLAFKFHSLSLGFISIYIVESGTTSDLRIIDAPFHDQLYFAVANQPCLLDVGIDAMKNSKHKVGFCVLTLGLVEVVNSVVGWKGGQVLLEL

SEQ ID NO: 152120 - protein, 61 aa, Glycine max
  Coding DNA Sequence Number=SeqID_35342
MVVVFKWRYDLKVWVLLLLAPPRSTTDPNACTSFGGARGQFQYHVLIFSSAIGIGIGRQRL

SEQ ID NO: 152121 - protein, 136 aa, Glycine max
  Coding DNA Sequence Number=SeqID_35343
  Gene Ontology: Mol. function=protein kinase activity; Cellular component=integral to membrane; Biological process=protein amino acid phosphorylation
  Homolog annotation: Hit_ID=Q1T089; Match level="QueryCoverage=83%, HitCoverage=11%, E-value=2e-38, Identity=71%"; Hit description =Protein kinase
MGKIASTQGDVYSFGVLVLEIVTGRRPTDVLVHEGSCLHEWVKKQYPHELGNIVEQAMQRCCSSPSGMPNQYHKFGQDVMLELIELGLLCTHHNPSTRPSMLDVAQEMGKLKDYLSHLSSSLLRLTEDKFSQKINN

SEQ ID NO: 152122 - protein, 75 aa, Glycine max
  Coding DNA Sequence Number=SeqID_35344
MMDIDCAILLLISVKDNLTYQRNNQAFDLDNLIFVELNDDAQSEEDLDDDDGDGDDDESDDIHGDDPLRGLDMLL

SEQ ID NO: 152123 - protein, 45 aa, Glycine max
  Coding DNA Sequence Number=SeqID_35345
MDRSLNNMVTMTSRKGSDFVSKAIDIAANEILGVATPGQGLLLCS

SEQ ID NO: 152124 - protein, 251 aa, Glycine max
  Coding DNA Sequence Number=SeqID_35346
  Subcellular localization annotation: CTP_CleavageSite=43; ConfidenceScore=5.23e-01
MYALHVGNSRHNNLSNVKGRLGIVARSQGTTYELMTRFVVSVCLSGASAKTCASIGTLSFYVNCLVMDDRTKGKEDGVNCSTLLVFEDSLEISEQNCFREKNLSRGASVTLPRRFHERFREDSSPFFIVLRRSSVFNRLLSLVTDAWGANTLPMRKNNSRTFHTFRRSTTPFSIFLTFSSNNRWWRLRAFSFLGRRTREPRIALPSKACIPDAILPRKGPITRTMSKRLQEDWARAAEEGPRVLMNLRVDF

SEQ ID NO: 152125 - protein, 811 aa, Glycine max
  Coding DNA Sequence Number=SeqID_35347
  Gene Ontology: Mol. function=protein kinase activity; Cellular component=integral to membrane; Biological process=protein amino acid phosphorylation
  Homolog annotation: Hit_ID=Q1T089; Match level="QueryCoverage=99%, HitCoverage=85%, E-value=0.0, Identity=65%"; Hit description=Protein kinase
  Pfam annotation: Domain name=LRRNT_2; Domain location=27-68; Score =41.1; E_value=3.7e-09; Accession=PF08263.3; Description=Leucine rich repeat N-terminal domain
  Pfam annotation: Domain name=LRR_1; Domain location=122-144; Score =16.2; E_value=0.12; Accession=PF00560.23; Description=Leucine Rich Repeat
  Pfam annotation: Domain name=LRR_1; Domain location=146-168; Score =11.8; E_value=1.8; Accession=PF00560.23; Description=Leucine Rich Repeat
  Pfam annotation: Domain name=LRR_1; Domain location=172-193; Score =9.9; E_value=4; Accession=PF00560.23; Description=Leucine Rich Repeat
  Pfam annotation: Domain name=LRR_1; Domain location=197-219; Score =7.4; E_value=12; Accession=PF00560.23; Description=Leucine Rich Repeat
  Pfam annotation: Domain name=LRR_1; Domain location=221-244; Score =9.3; E_value=5.2; Accession=PF00560.23; Description=Leucine Rich Repeat
  Pfam annotation: Domain name=LRR_1; Domain location=246-273; Score =10.4; E_value=3.2; Accession=PF00560.23; Description=Leucine Rich Repeat
  Pfam annotation: Domain name=LRR_1; Domain location=278-300; Score =7.7; E_value=10; Accession=PF00560.23; Description=Leucine Rich Repeat
  Pfam annotation: Domain name=LRR_1; Domain location=304-326; Score =9.7; E_value=4.3; Accession=PF00560.23; Description=Leucine Rich Repeat
  Pfam annotation: Domain name=LRR_1; Domain location=328-350; Score =13.5; E_value=0.77; Accession=PF00560.23; Description=Leucine Rich Repeat
  Pfam annotation: Domain name=LRR_1; Domain location=352-374; Score =15.6; E_value=0.18; Accession=PF00560.23; Description=Leucine Rich Repeat
  Pfam annotation: Domain name=LRR_1; Domain location=376-398; Score =14.4; E_value=0.42; Accession=PF00560.23; Description=Leucine Rich Repeat
  Pfam annotation: Domain name=LRR_1; Domain location=400-422; Score =15.8; E_value=0.15; Accession=PF00560.23; Description=Leucine Rich Repeat
  Pfam annotation: Domain name=LRR_1; Domain location=424-446; Score =18.6; E_value=0.022; Accession=PF00560.23; Description=Leucine Rich Repeat
  Pfam annotation: Domain name=LRR_1; Domain location=473-495; Score =3.5; E_value=63; Accession=PF00560.23; Description=Leucine Rich Repeat
  Pfam annotation: Domain name=LRR_1; Domain location=497-519; Score =19.6; E_value=0.011; Accession=PF00560.23; Description=Leucine Rich Repeat
  Pfam annotation: Domain name=LRR_1; Domain location=521-543; Score =10.6; E_value=2.9; Accession=PF00560.23; Description=Leucine Rich Repeat
  Pfam annotation: Domain name=LRR_1; Domain location=546-569; Score =5.3; E_value=30; Accession=PF00560.23; Description=Leucine Rich Repeat
  Pfam annotation: Domain name=LRR_1; Domain location=74-96; Score=4.6; E_value=39; Accession=PF00560.23; Description=Leucine Rich Repeat
  Pfam annotation: Domain name=LRR_1; Domain location=98-120; Score =16.6; E_value=0.089; Accession=PF00560.23; Description=Leucine Rich Repeat
  Pfam annotation: Domain name=Pkinase; Domain location=633-809; Score =26.8; E_value=3.7e-10; Accession=PF00069.15; Description=Protein kinase domain
  Pfam annotation: Domain name=Pkinase_Tyr; Domain location=633-806; Score=-3.0; E_value=2.8e-12; Accession=PF07714.7; Description =Protein tyrosine kinase
  Pfam annotation: Domain name=RIO1; Domain location=646-788; Score= -92.6; E_value=0.037; Accession=PF01163.12; Description=RIO1 family
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase _Tyr::RIO1; Domain ...
  Pfam module annotation: Pfam domain module=location=27-68::122 -144::146-168::172-193::197-219::221-244::246-273::278-300::304 -326::328-350::352-374::376-398::400-422::424-446::473-495::497 -519::521-543::546-569::74-96::...
  Pfam module annotation: =98-120::633-809::633-806::646-788
MLPFSMVLFLFITIVHSGVYGEENVTLVSEKESLVSFMSGIFSDPKNVLKSWKSPSVHVCNWYGVRCNNASDNKIIELALNGSSLGGTISPALANLSYLQILDLSDNFLVGHIPKELGYLIQLQQLSLSGNFLQGEIPSELGSFHNLYYLNMGSNQLEGEVPPSLFCNGSSTLRYIDLSNNSLGGQIPLSNECILKELRFLLLWSNNFVGHVPLALSNSRELKWFDVESNRLSGELPSEIVSNWPQLQFLYLSYNGFVSHDGNTKLEPFFSSLMNLSNMQGLELAGNNLGGKLPQNIGDLLPSSLLQLHLEDNLIHGSIPSNIANLVNLTLLNFSSNLLNGSIPHSLCQMGKLERIYLSNNSLSGEIPSTLGGIRRLGLLDLSRNKLSGSIPDTFANLTQLRRLLLYDNQLSGTIPPSLGKCVNLEILDLSHNKISGLIPKEVAAFTSLKLYLNLSSNNLDGPLPLELSKMDMVLAIDLSMNNLSGRIPPQLESCIALEYLNLSGNSLEGPLPDSLGKLDYIQALDVSSNQLTGVIPQSLQLSLSTLKKVNFSSNKFSGSISNKGAFSSFTIDSFLGNDGLCGSGYPTIKCSKERMQMAIVSKGDFDDEDEETKELKYPRISYRQLIEATGGFSASSRIGSGRFGQVYKGILRDNTRIAVKVLDTATAGDIISGSFRRECQILTRMRHRNLIRIITICSKKEFKALVLPLMPNGSLERHLYPSQRLDMVQLVRICSDVAEGMAYLHHYSPVRVVHCDLKPSNILLDDDFTALVTDFGIARLVKSDDNMPTSDSSFCSTHGLLCGSLGYIAP

SEQ ID NO: 152126 - protein, 168 aa, Glycine max
  Coding DNA Sequence Number=SeqID_35348
MDSGHKPTFSKSEIFVPFHLSADTFITCVMVESHLNCGHPWLALTAAATSELLHCDGCRHYFILLQELFKFHSLSLGFISIYIVESGTTSLLRIIDAPFHDELYFAVANQPCLLDVRIDAMYTKPSNQSNFICRHQIKKVMLEPRGKNSKHKVGFCMLTQGLVEVVNM

SEQ ID NO: 152127 - protein, 80 aa, Glycine max
  Coding DNA Sequence Number=SeqID_35349
MKYPNYYQCFSLDEVNSSELSVLDNLEADDEQSFIEKWDRDNSILHQLKVAHDSRLKNCLSLSDNVRDWETKREVAMEMY

SEQ ID NO: 152128 - protein, 36 aa, Glycine max
  Coding DNA Sequence Number=SeqID_35350
MIKKTTIDTIEPYTGAIRGTMHEPQADLGADQKFSP

SEQ ID NO: 152129 - protein, 53 aa, Glycine max
  Coding DNA Sequence Number=SeqID_35351
MVPEIDVGKVTSDPLSIYMDVALEVNGAFKSNPIQEDAYDWVIKSDSMSSGEY

SEQ ID NO: 152130 - protein, 54 aa, Glycine max
  Coding DNA Sequence Number=SeqID_35352
MEDLITTLHQLGELKLEKAMPTDDSSVWNDLMATYERVLQLKQDKFKSPTSQWW

SEQ ID NO: 152131 - protein, 120 aa, Glycine max
  Coding DNA Sequence Number=SeqID_35353
  Gene Ontology: Mol. function=transmembrane receptor activity; Cellular component=membrane; Biological process=defense response
  Homolog annotation: Hit_ID=Q1SWS7; Match level="QueryCoverage=98%, HitCoverage=47%, E-value=9e-33, Identity=62%"; Hit description=TIR
  Pfam annotation: Domain name=TIR; Domain location=16-120; Score= -18.3; E_value=0.0032; Accession=PF01582.10; Description=TIR domain
METSSSSNDSKKGHEVLLSFRGDGTRNTFTGHLNVALKRCDIRTYINDHDLKRGDEISYTLLKEIEDANLSVIIFSKNFATSKWYLKVVLGRGCQNTRVQTKARANSAACFLPCGAIHGA

SEQ ID NO: 152132 - protein, 244 aa, Glycine max
  Coding DNA Sequence Number=SeqID_35354
  Gene Ontology: Mol. function=transmembrane receptor activity; Cellular component=membrane; Biological process=defense response
  Homolog annotation: Hit_ID=Q1SWS7; Match level="QueryCoverage=65%, HitCoverage=66%, E-value=2e-56, Identity=61%"; Hit description=TIR
  Pfam annotation: Domain name=TIR; Domain location=17-149; Score =159.9; E_value=6.4e-45; Accession=PF01582.10; Description=TIR domain
MASASSFSFIPQETDDVFISFRGEDTRHTFTAHLLAAFYRLKIRTYVDYKLGRGDEISPTLIRAIEESKVSVIVLSKNYATSKWCLEELVKIMECRRTKGQIAIPVFYHVDPSDVRNQTGSYADAFANHEQRFKDNVQKVELWRASLREVTNLSGWDCLVNRSDDVHKIPHKMSIKNVQKEPSSLLISIVSRHISKKLPQMSTALHHHPGTSKNNIKTPYICNSYFLPRNLIIPSTSNAYILED

SEQ ID NO: 152133 - protein, 54 aa, Glycine max
  Coding DNA Sequence Number=SeqID_35355
MERGRQATPRRLGDGEHDGCVVETYKNIQNKLCDIITHYLPKLIVEQALSLPRA

SEQ ID NO: 152134 - protein, 673 aa, Glycine max
  Coding DNA Sequence Number=SeqID_35356
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=75%, HitCoverage=92%, E-value=0.0, Identity=64%"; Hit description =Pentatricopeptide repeat
  Pfam annotation: Domain name=PPR; Domain location=130-164; Score =31.3; E_value=3.5e-06; Accession=PF01535.11; Description=PPR repeat
  Pfam annotation: Domain name=PPR; Domain location=165-199; Score =23.9; E_value=0.00056; Accession=PF01535.11; Description=PPR repeat
  Pfam annotation: Domain name=PPR; Domain location=200-234; Score =38.7; E_value=1.9e-08; Accession=PF01535.11; Description=PPR repeat
  Pfam annotation: Domain name=PPR; Domain location=235-269; Score =40.0; E_value=8.2e-09; Accession=PF01535.11; Description=PPR repeat
  Pfam annotation: Domain name=PPR; Domain location=270-304; Score =40.7; E_value=5.1e-09; Accession=PF01535.11; Description=PPR repeat
  Pfam annotation: Domain name=PPR; Domain location=305-339; Score =31.7; E_value=2.6e-06; Accession=PF01535.11; Description=PPR repeat
  Pfam annotation: Domain name=PPR; Domain location=340-374; Score =52.2; E_value=1.8e-12; Accession=PF01535.11; Description=PPR repeat
  Pfam annotation: Domain name=PPR; Domain location=375-409; Score =38.7; E_value=2e-08; Accession=PF01535.11; Description=PPR repeat
  Pfam annotation: Domain name=PPR; Domain location=410-444; Score =54.7; E_value=3e-13; Accession=PF01535.11; Description=PPR repeat
  Pfam annotation: Domain name=PPR; Domain location=445-479; Score =37.0; E_value=6.4e-08; Accession=PF01535.11; Description=PPR repeat
  Pfam annotation: Domain name=PPR; Domain location=480-514; Score =53.1; E_value=9.2e-13; Accession=PF01535.11; Description=PPR repeat
  Pfam annotation: Domain name=PPR; Domain location=515-549; Score =19.0; E_value=0.017; Accession=PF01535.11; Description=PPR repeat
  Pfam annotation: Domain name=PPR; Domain location=60-94; Score=9.7; E_ value=0.52; Accession=PF01535.11; Description=PPR repeat
  Pfam annotation: Domain name=PPR; Domain location=95-129; Score=27.9; E_value=3.5e-05; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=130 -164::165-199::200-234::235-269::270-304::305-339::340-374::375 -409::410-444::445-479::...
  Pfam module annotation: Domain location=480-514::515-549::60-94::95 -129
  Subcellular localization annotation: CTP_CleavageSite=51; ConfidenceScore=5.41e-01
MSLPTRLRFSVSLSIPNFSSFLQNSSHSHFHSQPPSIQNVDDAVSQFNRMLCMRHTPPIIQFNKILDSFAKMKHYSTAVSLSHRLELKGIQPNLITLNILINCFCHMGQINFGFSLLTKILKRGYPPSTVTLNTLIKGLCLKGQVKKALHFHDKLLAQGFQLNQVGYGTLINGVCKIGDTRAAIKLLKKIDGRLTKPDVVMYSTIIDALCKYQLVSEAYGLFSEMTVKGISANVVTYTTLIYGSCIVGKLEEAIGLLNEMVLKTINPNVHTYTILVDALCKEGKVKEAKSVLAVMLKACVEPNVITYNTLMDGYVLLYEMRKAQHVFNAMSLVGVTPDVHTYTILINGFCKSKMVDEALNLFKEMHQKNMIPNIVTYGSLIDGLCKSGRIPYVWDLIDEMRDRGQPANVITYSSLIDGLCKNGHLDRAIALFNKMKDQGIRPNTFTFTILLDGLCKGGRLKDAQEVFQDLLTKGYHLNVYTYNVMINGHCKQGLLEEALTMLSKMEDNGCIPNAVTFDIIIIALFKKDENDKAEKLLRQMIARGLLAFKFHSLSLGFISIYIVESGTTSLLRIIDAPFHDELCFAVANQPCLLDVRIDAMYTKPSNQSNFICRHQIKKVMLEPRRKNSKHKLDILTKLKEWEKSEGINRRKTIELDWIWSVVGWKGGLVLLEL

SEQ ID NO: 152135 - protein, 160 aa, Glycine max
  Coding DNA Sequence Number=SeqID_35357
  Gene Ontology: Mol. function=RNA-directed DNA polymerase activity; Cellular component=nucleus; Biological process=RNA-dependent DNA replication
MRSHMRMGIPIILVDKGREIRVRGVKTQVPSSQGKNDLKAYLEWETKLEQIFFYTRRNEERKVKVAAHEFSDYALIWWDQVEKERERNRDYPIDTREEMKSLMRRRFVPSCYHRELHNKLQRITQGSRSVDEYFKEMEVAMIRANVVEEREATMACFLHG

SEQ ID NO: 152136 - protein, 264 aa, Glycine max
  Coding DNA Sequence Number=SeqID_35358
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=23-40; Score =18.1; E_value=0.001; Accession=PF00098.13; Description=Zinc knuckle
  Subcellular localization annotation: CTP_CleavageSite=53; ConfidenceScore=5.24e-01
MASKTSNMFPSTNESSSSKSRNIKCFKCLGNGHIVSQFPNKKIMVLRENERISSDSYPNSPTTNEGEVEYKAYAMDGDLLMVRRLLGGQAITKEQDKEKISFILDVSFKRSKGMVAKLNLKTTAHPKPYKLRWLSEEGELLMDQKVLINFSIRKYADKILCDAIPMKTCHILLGRPWQFDRCTIYDGHSNNFSFVHNDSKFTLVSLTPREKIGSVNPRKKGNNDSLSLVAAAPLLRRPTWERIRYWRINLRMNFLKEGMNDGDQ

SEQ ID NO: 152137 - protein, 88 aa, Glycine max
  Coding DNA Sequence Number=SeqID_35359
  Gene Ontology: Mol. function=sequence-specific DNA binding; Cellular component=nucleus; Biological process=regulation of transcription, DNA-dependent
  Homolog annotation: Hit_ID=Q1SSH7; Match level="QueryCoverage=71%, HitCoverage=24%, E-value=2e-17, Identity=72%"; Hit description =Leucine zipper, homeobox-associated; Homeodomain-related
MKDLVAKRHDVLQIQREQSNRKMGFRGGAPFMVKQSMSFSGIENKCDEVHGEDELSDDGVFQCGEKKKRLNLEQVKALEKSSDLANKL

SEQ ID NO: 152138 - protein, 52 aa, Glycine max
  Coding DNA Sequence Number=SeqID_35360
KSKGGGLAAMVSGIYYEGLCKEIHNDSILIVIFFTFFSTEQGHLLCKGCLSR

SEQ ID NO: 152139 - protein, 129 aa, Glycine max
  Coding DNA Sequence Number=SeqID_35361
  Gene Ontology: Mol. function=metal ion binding; Cellular component =intracellular; Biological process=metabolic process
  Homolog annotation: Hit_ID=Q1S7U1; Match level="QueryCoverage=97%, HitCoverage=37%, E-value=6e-16, Identity=36%"; Hit description =Tetratricopeptide-like helical
  Pfam annotation: Domain name=PPR; Domain location=76-109; Score=27.2; E_value=5.8e-05; Accession=PF01535.11; Description=PPR repeat
MELYKVMMNVEEKTAVPDNHTFHFVLKACAYTFSLCEGKQVHAHVLKHGLVHFYATWGCLNLAKKIFHKMSERNEVSWNIMIDSYAKGGIFDTALRMFGEMQKVHDLDGYTMQSVISACAGLGAFSLGL

SEQ ID NO: 152140 - protein, 266 aa, Glycine max
  Coding DNA Sequence Number=SeqID_35362
  Gene Ontology: Mol. function=diacylglycerol kinase activity; Cellular component=intracellular; Biological process=protein kinase C activation
  Homolog annotation: Hit_ID=Q6Z4H7; Match level="QueryCoverage=97%, HitCoverage=47%, E-value=5e-78, Identity=55%"; Hit description =Putative pentatricopeptide (PPR) repeat-containing protein
  Pfam annotation: Domain name=PPR; Domain location=148-182; Score=4.9; E_value=1.9; Accession=PF01535.11; Description=PPR repeat
  Pfam annotation: Domain name=PPR; Domain location=43-77; Score=4.7; E_ value=2.1; Accession=PF01535.11; Description=PPR repeat
  Pfam annotation: Domain name=PPR; Domain location=7-41; Score=11.6; E_ value=0.31; Accession=PF01535.11; Description=PPR repeat
  Pfam annotation: Domain name=PPR; Domain location=79-113; Score=14.8; E_value=0.13; Accession=PF01535.11; Description=PPR repeat
  Pfam module annotation: Pfam domain module=PPR::PPR::PPR::PPR; Domain location=148-182::43-77::7-41::79-113
MAYRDVNSWNSMILDFAMHGEAEAALDYYVRMVKVEKLVPNSITFVDVLSACNHRGMVDKGIVHFDMMTKEYNVEPKLEHYGCLVDLFARAGRIDEALNLVSEMPIKPDAVIWRSLLDACCKQHASVELSEEMAKQVFESEGSVCSGGIYVLLLKVYASACRWNNVGLLRKLMSEKGVTKDSGCNPIEIDGEVHEFVAGDTTDPQSENVYKFVNEIEKLESIGYLPDYLGAPMVDEINDGKQNTLRVHSERLAIAFGILNSIWRAN

SEQ ID NO: 152141 - protein, 174 aa, Glycine max
  Coding DNA Sequence Number=SeqID_35363
  Homolog annotation: Hit_ID=UPI00006A2900; Match level="QueryCoverage =99%, HitCoverage=68%, E-value=5e-46, Identity=62%"; Hit description =UPI00006A2900 related cluster
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGISKITLKSQAQQGLLSPLIPPSPFPWLWFRWIVDRDSGNLVNPFMRVTN

SEQ ID NO: 152142 - protein, 218 aa, Glycine max
  Coding DNA Sequence Number=SeqID_35364
MVEISSRQPVVTGDFFRTTRRANQLDEMSESSEEEGQIVNKERVREEKGEDERLRRGGREDEGDGWGGRDSRPGNNQGERFATTALPHVILTRLVVASSSHTNPNSIRRKPNPKSKNTEKAQISKTSLRARDKNNCIEGVGGAEGGKVSCVVGEGEADLDQVEAIHVGFEHGVVRGGLAMAERGVTSVGAYIRIPHNPVAIIKSGPFNIFIIKSDGPK

SEQ ID NO: 152143 - protein, 402 aa, Glycine max
  Coding DNA Sequence Number=SeqID_35365
  Homolog annotation: Hit_ID=Q1SWU2; Match level="QueryCoverage=73%, HitCoverage=97%, E-value=1e-124, Identity=72%"; Hit description =Cytosolic fatty-acid binding; Actin-crosslinking proteins
  Pfam annotation: Domain name=DUF569; Domain location=109-250; Score =376.7; E_value=3.6e-110; Accession=PF04601.4; Description=Protein of unknown function (DUF569)
MIPDALIEGTMISKSPGEAIVIIDSIATGDYQSHHDKAPIQRKDVIFVVVTIRMTTAQHLVIANMGRRPIICRIKANLNKVFKEIIKAKEVIKTTTSSNTAATTFRSGMELFHRAKAVRLRSHHDKYLLADEDEESVTQDRNGSSRNAKWTVELIPEFDNIIRLKSCYGKYLTASNQPLLLGVTGRKVVQSVPRRLDSSVEWEPVRDGAQVKLKTRYGNFLRANGGVPPWRNSVTHDIPHRTTTQDWILWDVDVLEIHVVFPAPPPIPHSDSLDFESNTPSAVNIKSTTFSRQESTDSNVSSPPKVEGRTIYYHVAEDNGDVDDENVQGYSLNFKGNGVEQLARKFEEETGLEGVIVCTRSPLNGKLYPLRLQLPPNNVTMQVVLVLPSSKVAREFEEQGIL

SEQ ID NO: 152144 - protein, 166 aa, Glycine max
  Coding DNA Sequence Number=SeqID_35366
PPPAEVSAGLGHHDSGITPPRHPVDSEKSNRALGFPALIMGLCQFYGVSVTPIKLIRPSINRAFIEKYCMPRQVHGQALQHPEEDPQQPAADAPLLPLEEGAGAVERDIIPPGDETDLETRLEPARAPRDDRGAQGLQVLTIIISKTITVFFASETIKSVGMQRQP

SEQ ID NO: 152145 - protein, 74 aa, Glycine max
  Coding DNA Sequence Number=SeqID_35367
MSGVATNVYLRKMLEKPKRKVEGLRVLKMRVQELFTHGKAKQGIWDEGQLVQATCYFILKQPCSPKRGGYFTMK

SEQ ID NO: 152146 - protein, 80 aa, Glycine max
  Coding DNA Sequence Number=SeqID_35368
MRGTMHEPQANLGADQNFSPDDDKKPKRMTSRLNQESSFKNQESRIKNDQDQDSRLKIQESRKDSIKISTKKFFKTLSST

SEQ ID NO: 152147 - protein, 109 aa, Glycine max
  Coding DNA Sequence Number=SeqID_35369
MEHFNKAKAKAMKLRSHLSKYLVADDDKLCQSKQGATKRAGEQGGAGEFRLGHGLEVGVGTHNKQFPHEAEKLFPVKIVSFTESKFSSLDSEDKLPGSEGESLRSQNSQ

SEQ ID NO: 152148 - protein, 191 aa, Glycine max
  Coding DNA Sequence Number=SeqID_35370
  Subcellular localization annotation: CTP_CleavageSite=75; ConfidenceScore=5.41e-01
MLDPASELVPPPSSPTISSISSSDLDTESTGSFFHDRSTTLGTLMGVNFPTIAFRVPSQHRNPNSAAEDTGGARRAAAAVKKKKKATSIATVAERRRRWWQLCRDGDARPASLGEFLEVERRFGDGAFYGTAAELEGVVAGHQQRNGSRVLFADGRVLPPPEDVDDRAPPTESLCNRFPVSLAGICSGGAA

SEQ ID NO: 152149 - protein, 77 aa, Glycine max
  Coding DNA Sequence Number=SeqID_35371
MAESVLKDETLPECLFLILDEIIKTVLIFLPGSPLLSSNMLNDQDQLRELENAVVKETEAKMNYRKRVVVEHTNDNR

SEQ ID NO: 152150 - protein, 76 aa, Glycine max
  Coding DNA Sequence Number=SeqID_35372
  Subcellular localization annotation: CTP_CleavageSite=41; ConfidenceScore=5.77e-01
MGSAWKTLNISNNFFNRCSSFNSSAVVGGSSTTRSCCHCLQADTAGLRHWGTSSSLGSLFPMAFPIARSKVRPRPL

SEQ ID NO: 152151 - protein, 91 aa, Glycine max
  Coding DNA Sequence Number=SeqID_35373
MLNSTTDGRGCIVIKRVNKATASSIASNPDFFFAFCFWESEKNLRKTLNLEIAYLNLVVVAAYNMAAFLPKLKKKIGFFGDSIQCLFPNFE

SEQ ID NO: 152152 - protein, 311 aa, Glycine max
  Coding DNA Sequence Number=SeqID_35374
  Gene Ontology: Mol. function=calcium ion binding; Cellular component =mitochondrion; Biological process=protein amino acid phosphorylation
  Homolog annotation: Hit_ID=Q1RSC6; Match level="QueryCoverage=99%, HitCoverage=86%, E-value=3e-93, Identity=33%"; Hit description =Pentatricopeptide repeat
  Pfam annotation: Domain name=PPR; Domain location=129-163; Score =37.5; E_value=4.6e-08; Accession=PF01535.11; Description=PPR repeat
  Pfam annotation: Domain name=PPR; Domain location=164-198; Score =36.8; E_value=7.3e-08; Accession=PF01535.11; Description=PPR repeat
  Pfam annotation: Domain name=PPR; Domain location=199-233; Score =45.4; E_value=2e-10; Accession=PF01535.11; Description=PPR repeat
  Pfam annotation: Domain name=PPR; Domain location=234-268; Score =39.2; E_value=1.5e-08; Accession=PF01535.11; Description=PPR repeat
  Pfam annotation: Domain name=PPR; Domain location=24-58; Score=26.5; E_value=9.3e-05; Accession=PF01535.11; Description=PPR repeat
  Pfam annotation: Domain name=PPR; Domain location=269-303; Score =44.6; E_value=3.2e-10; Accession=PF01535.11; Description=PPR repeat
  Pfam annotation: Domain name=PPR; Domain location=59-93; Score=26.9; E_value=6.9e-05; Accession=PF01535.11; Description=PPR repeat
  Pfam annotation: Domain name=PPR; Domain location=94-128; Score=45.0; E_value=2.6e-10; Accession=PF01535.11; Description=PPR repeat
  Pfam module annotation: Pfam domain module=PPR::PPR::PPR::PPR::PPR::PP R::PPR::PPR; Domain location=129-163::164-198::199-233::234-268::24 -58::269-303::59-93::94-128
MKHYPTAISLSKQMGLRGITPSIVTLSILINCYCHLGHMGFAFSVLGMVLKRGYQLNAITLTTIMKGLCINGEVRKALEFHDSVVAQGFLLDEVTYGTLINGLCKIGLTREAFELLHKMEGQVVRPNVVIYNMIVDGLCKDGLVTEARDLYSDVVGRGIDPDVFTYTCLIHGFCGLGQWREVTRLLCDMVDRNVNLNVYTYNILIDALCKKGMLGKAHDMRNLMIERGQRPDLVTFNTLMSGYCLYNDVVEARKLFDTFAECGITPDVWSYNILIIGYCKNNRIDEALSLFNKMNYKKLAPNIVTYSSLID

SEQ ID NO: 152153 - protein, 70 aa, Glycine max
  Coding DNA Sequence Number=SeqID_35375
MDVVEGDGLDDEGMSSVLALFLDAIDKKRICPLPWAFVNAWLSARITPLSEVLQIRKAATFAKPGYGWLS

SEQ ID NO: 152154 - protein, 229 aa, Glycine max
  Coding DNA Sequence Number=SeqID_35376
MKVPSELSSEEKDLVDISNKNIKGGEDIVFSRESSKLISYEDVIDMNEETKLYFEVVSNSKELCFSKGNSMDIKDDLDTDDEEEEKEEGITIQERKFRECECTTLILLENEQRRIRRPWLTVVIVKLLGRKIWFKALESRLKQMWVKKGVLHALGDRIGCTVRVDKNIYSLEARKYARLCVKVVLKRIEFKVGLEIKLVLVKKIRVNKMNLFGASEENQGQQDESVKNP

SEQ ID NO: 152155 - protein, 74 aa, Glycine max
  Coding DNA Sequence Number=SeqID_35377
MDEDQWMYDSMMSEEVEMNVENEEDADVKVDCSYVFNSSQLFGSRDEVLQWARSLAHDIGFVAIIMRSDTNIGV

SEQ ID NO: 152156 - protein, 321 aa, Glycine max
  Coding DNA Sequence Number=SeqID_35378
  Gene Ontology: Mol. function=cytochrome-c oxidase activity; Cellular component=mitochondrion; Biological process=cytochrome c oxidase complex assembly
  Homolog annotation: Hit_ID=Q9SE51; Match level="QueryCoverage=83%, HitCoverage=76%, E-value=1e-94, Identity=60%"; Hit description =Surfeit 1
  Pfam annotation: Domain name=SURF1; Domain location=1-321; Score= -23.7; E_value=2.1e-08; Accession=PF02104.6; Description=SURF1 family
  Subcellular localization annotation: CTP_CleavageSite=35; ConfidenceScore=5.61e-01
MLTHLSRTPAACGGATSKHFLVLRQFSSAAGAAVSSVSDSDPTLPSSSESQRKASRWLLFLPGAITFGLGTWQIIRREEKIKMLEYRENRLQMEPLKFSSAYSSNEELDSLEFRKVVCKGYFDDKKSIYVGPRSRSISGITENGYYIITPLMPVPNCPDSVSFPILVNRGWVPRSWKDKFLEASEDEDLEDALPSPSHDDGTKSWWRFWSRKPVIEDQVASVTPIEVVGVVRESEKPSIFVPANDPKASQWFYVDVPGIARACGLPENTIYVEDINEDVNPSNPYPVPKDVNTLIRSSVMPRDHLNYTLTWYATYFSLAEY

SEQ ID NO: 152157 - protein, 191 aa, Glycine max
  Coding DNA Sequence Number=SeqID_35379
  Homolog annotation: Hit_ID=Q1PFD8; Match level="QueryCoverage=43%, HitCoverage=57%, E-value=1e-13, Identity=42%"; Hit description =Protease inhibitor/seed storage/lipid transfer protein family protein
  Pfam annotation: Domain name=Tryp_alpha_amyl; Domain location=54-126; Score=20.1; E_value=0.00087; Accession=PF00234.12; Description =Protease inhibitorseed storageLTP f
MKNRAYYSNNKVFFLFVMFFSSSLLHLGMCDSAASLDQLLPGLAQGDFLQDAKCMQRLLPCQEFLKSPNNPSPACCEPLKEMHENNTQCLCNFVNNTPLFQSLGASKDEILKLPQACGIDVELSKCNNTTAGGGSSQESSSSPASEGEYAASEEESSESTSSTNMITPHGIVYFGVPGFVALLTALVFSSY

SEQ ID NO: 152158 - protein, 91 aa, Glycine max
  Coding DNA Sequence Number=SeqID_35380
  Gene Ontology: Mol. function=D-alanyl-D-alanine endopeptidase activity; Cellular component=integral to membrane
  Homolog annotation: Hit_ID=Q945B8; Match level="QueryCoverage=64%, HitCoverage=10%, E-value=7e-25, Identity=86%"; Hit description =Growth-on protein GRO10
MGWFKHAGESYIKVPFLGAISYLTLAVSPFCITFSILWAVYRNESFAWIGQDILGIALIITCRFRDPSNEVYFCVIPMSKRKRKSHHQTKI

SEQ ID NO: 152159 - protein, 729 aa, Glycine max
  Coding DNA Sequence Number=SeqID_35381
  Gene Ontology: Mol. function=extracellular matrix structural constituent; Cellular component=cell outer membrane; Biological process=multicellular organismal development
  Homolog annotation: Hit_ID=Q6RYR9; Match level="QueryCoverage=22%, HitCoverage=59%, E-value=4e-26, Identity=41%"; Hit description=GD3 protein
MAFEMPLDQIKHLRTLLRREANLSWYEPEKEENLALPKLPSVAETIAKLDSSPNYLRCKNCNGRLIRDLQSSVCVFCGTNPQNDLPPEPFKFKSTIGYRWLLESLQLDGSEMVAPVVNENEWNRGRSESKDEIPLSELLDLEIRWPSEAERVQTSTSDPAVFQGKSSLNLAGVDLDSFFDRRESDSDMFEQNLASERQVGGASDKSLQASENLSLFQNVQASEVDAGSVENQSGNSFSSWEASFTSASSGPVHEVSKSVDHSKVELDMASGFSKHSVGVNKNDDFNLSASTEDDYFQGDGWSTSNSEVHCQTGKSESTMDISGTKTAESANGSSRNLDWMQDDLWQGSDNKTTDTVATAEDKDSFDEWNDFTGSGSTQDPSSTISNSKTNAQTGNVGYSVDFNVTKTLKDANSSSNKDFDWMQDQWQDNNNKTTNTISANEAADSFDAWNDFTGSANTQHSYFGLSNSEITGQAGKCQFTQDHNDMKTTESATGSSSNFDWMQDNQLQGSDNKATGIATTNEVADEFDAWNDFTGSAISQNPSSGVSNSAITAQIGKSEITADLNDMKTEEGTNASSHRSFDWMQDDQWQVSNSKTNDTRTTNDIDSFDLWNDFTSLASTQDHSNNVLKQTVNSAEKTSETNLLSSSNSSHDKDFSGFSQHDLFSGQFGSSLSSFPATSSNRVAEVDITRGNSGDVSTAVGSKDDVEMLMSQMHDLSFMLENNLSIPPK

SEQ ID NO: 152160 - protein, 174 aa, Glycine max
  Coding DNA Sequence Number=SeqID_35382
  Homolog annotation: Hit_ID=O64897; Match level="QueryCoverage=22%, HitCoverage=10%, E-value=1e-10, Identity=82%"; Hit description =Trehalose-6-phosphate phosphatase
MKPYLDLQQLEREFHRSQEKLQFAFLWHYILSVQRCSELKGDKAAKSGEIEAESGDEHNYTENHKPCNMSKESGNSIPIPHKGQGIAEKLTLEFTFHLWCLMGLHGTSSSQCGVRKLDLQCTEKTQQQTIEISAFGRFYLQLILWHTYLLMSGIGTLLATLEAVETTLEAAEPL

SEQ ID NO: 152161 - protein, 120 aa, Glycine max
  Coding DNA Sequence Number=SeqID_35383
MVIEEDEVEQAPTVTKEEEQPPTEEEEQATSTNRGRGRRRTNMTKEEEDEEATVGGEGIALYRQKTRSFYNIRVKDNFAILSQVLGAPAKMLGAPNSSSQNPSSANLIASMGTHVLKFVS

SEQ ID NO: 152162 - protein, 90 aa, Glycine max
  Coding DNA Sequence Number=SeqID_35384
  Gene Ontology: Mol. function=transferase activity
  Homolog annotation: Hit_ID=Q9M6R4; Match level="QueryCoverage=70%, HitCoverage=22%, E-value=2e-14, Identity=59%"; Hit description =Glutathione S-transferase
MAFYGGNQIGFLDIALGSFLGWLRVTEISNGVKLLDQSNTPELVKCDERFCAHGVVKDVMPEIWKEEFYTIARFWAAFLNPMPKFFSFYI

SEQ ID NO: 152163 - protein, 110 aa, Glycine max
  Coding DNA Sequence Number=SeqID_35385
MEGRGILMEEETMRTSPFRSIVFSVFHFIEQFESRCCRRKGFKEGLQVPYDETRPDHQVQKLQLISGVRAFLSEQQGLIIKWKKRGDDNKKKSRQQGLPHTILSQQEPPA

SEQ ID NO: 152164 - protein, 267 aa, Glycine max
  Coding DNA Sequence Number=SeqID_35386
  Gene Ontology: Mol. function=transferase activity, transferring hexosyl groups; Cellular component=mitochondrion; Biological process= metabolic process
  Homolog annotation: Hit_ID=Q84NV9; Match level="QueryCoverage=95%, HitCoverage=68%, E-value=6e-95, Identity=39%"; Hit description =Putative CRP1 protein
  Pfam annotation: Domain name=PPR; Domain location=126-160; Score =37.1; E_value=6.2e-08; Accession=PF01535.11; Description=PPR repeat
  Pfam annotation: Domain name=PPR; Domain location=161-195; Score =17.8; E_value=0.039; Accession=PF01535.11; Description=PPR repeat
  Pfam annotation: Domain name=PPR; Domain location=196-230; Score =36.1; E_value=1.2e-07; Accession=PF01535.11; Description=PPR repeat
  Pfam annotation: Domain name=PPR; Domain location=21-55; Score=49.8; E_value=9.2e-12; Accession=PF01535.11; Description=PPR repeat
  Pfam annotation: Domain name=PPR; Domain location=231-265; Score =27.0; E_value=6.5e-05; Accession=PF01535.11; Description=PPR repeat
  Pfam annotation: Domain name=PPR; Domain location=56-90; Score=48.0; E_value=3.1e-11; Accession=PF01535.11; Description=PPR repeat
  Pfam annotation: Domain name=PPR; Domain location=91-125; Score=46.6; E_value=8.2e-11; Accession=PF01535.11; Description=PPR repeat
  Pfam module annotation: Pfam domain module=PPR::PPR::PPR::PPR::PPR::PP R::PPR; Domain location=126-160::161-195::196-230::21-55::231-265::56- 90::91-125
MKEAFSLHNQMVEKGLTPNVVTYTALVDGLCKRGEVDIANELLHEMSEKGLQPNVCTYNALINGLCKVGNIEQAVKLMEEMDLAGFYPDTITYTTLMDAYCKMGEMAKAHELLRIMLDKGLQPTIVTFNVLMNGLCMSGMLEDGERLIKWMLDKGIMPNATTFNSLMKQHCIRNNMCATTEIYMRMCAQGVMPDCNTYNILIKGHCKARNMKEAWFLHKDIVEKGFSLTDASYNALIKGFYKRKKFVEARKLFEEMRTWVHCRKRDI

SEQ ID NO: 152165 - protein, 63 aa, Glycine max
  Coding DNA Sequence Number=SeqID_35387
MVIVNVIKLKNEAHTNHEIDTEEEQAQMRVKTQPCVLDETANAGADAVGVEIAYAEIGATMHC

SEQ ID NO: 152166 - protein, 82 aa, Glycine max
  Coding DNA Sequence Number=SeqID_35388
MHKQNQKDFHRLLMRLGYKKSLVFLGFKGLDSKRAQILDLSNNLAHKGCKGYNYHSSQAKHALCAKPECLSLEAELSASMLR

SEQ ID NO: 152167 - protein, 48 aa, Glycine max
  Coding DNA Sequence Number=SeqID_35389
MEEEETQIGKDAVRLRRDEKDGWDDIEAMVNHQLHLCSAGERMQRKRY

SEQ ID NO: 152168 - protein, 229 aa, Glycine max
  Coding DNA Sequence Number=SeqID_35390
  Gene Ontology: Mol. function=oxidoreductase activity; Biological process=metabolic process
  Homolog annotation: Hit_ID=Q7Y249; Match level="QueryCoverage=36%, HitCoverage=16%, E-value=3e-16, Identity=63%"; Hit description =Polyphenol oxidase
  Subcellular localization annotation: CTP_CleavageSite=49; ConfidenceScore=5.40e-01
MVIIVSLVGTLVQPLVLHCPLQSQLTVFNQRCRFSFSCNKQMFIVPIVMVAINKRVAIFLRENLGSLIADPTTFALPFWNWDHPNGMKMPFMIYTDEYSYLYDHLREAIDLPWLHVSPDIHVKPENLAPRVGAKQALDLKALRFPLTLNSIERTTVNMPKVESRNEELMEELLLIDVEYDRSEDVRFDVYINDKATIVTDLLKELEVKDDDSTIAVTLVPKYGNKPVTV

SEQ ID NO: 152169 - protein, 61 aa, Glycine max
  Coding DNA Sequence Number=SeqID_35391
MTSFGTPAIFVVLQISMYVAMEEIVMNQLDEGICIFNVGCLNFWSDYAGEVLRCRGNRVIL

SEQ ID NO: 152170 - protein, 761 aa, Glycine max
  Coding DNA Sequence Number=SeqID_35392
  Gene Ontology: Mol. function=protein serine/threonine kinase activity; Biological process=protein amino acid phosphorylation
  Homolog annotation: Hit_ID=Q9LVI5; Match level="QueryCoverage=96%, HitCoverage=55%, E-value=0.0, Identity=65%"; Hit description=IRE homolog; protein kinase-like protein
  Pfam annotation: Domain name=Pkinase; Domain location=623-761; Score =8.9; E_value=4.3e-09; Accession=PF00069.15; Description=Protein kinase domain
  Pfam annotation: Domain name=Pkinase_Tyr; Domain location=623-760; Score=-96.3; E_value=1.5e-06; Accession=PF07714.7; Description =Protein tyrosine kinase
  Pfam module annotation: Pfam domain module=Pkinase::Pkinase_Tyr; Domain location=623-761::623-760
MCAKYECKGVVNSPILVGYAQVSSRAQSGGLKSADICTPETAYDFENPKESESPRFQAILRVTSAPRKRFPSDIKSFSHELNSKGVWPFPFSKPRRLNNLEEILVVIRAKFDKAKEDVNSDLAIFAADLVGILEKNADTHPDWQETIEDLLVLARSCAMTSSGEFWLQCESIVQELDDRRQEHPPGMLKQLHTRMLFILTRCTRLLQFHKESGLAEDEPVFNLRQSRVLHSAGKFIPPSVGRDTKSSSAAKALKPSSKKAFSQEQSMMGWKKDVMQPENLSIPADDDNAKLFDSSSGRNRMASWKKFPSPTGRSPKEAVQLKDQNYGRVESSKASNNKRFTSDVDLSTAKPSELLPVKDSLDHASKHQHKVSWGYWGDQQNNNSEENSIICRICEEDVPTSHVEDHSRICAVADRCDQKGLSVNERLVRISDTLEKMMESCTQKDTQQMVGSPDVAKVSNSSMTEESDVPSPKLSDWSRRGSEDMLDCFPEADNSVFMDDLKGLPLMSCKTRFGPKSDQGMTTSSAGSMTPRSPLMTPRTSQIDLLLAGKDRRKFDALTVETFGTRIEKLIREKYLQLTEMVDVEKIDTESTVDDDILEDDVVRSLRTSPIHSSRDRTSIDDFEIIKPISRGAFGRVFLAKKRTTGDLFAIKVLKKADMIRKNAVESILAERDILITVRNPFVVRFFYSFTCRENLYLVMEYLNGGDLYSLLRNLGCLDEEVARVYIAEVVLALEYLHSLRVVHRDLKPDNLLIAHDGHIK

SEQ ID NO: 152171 - protein, 225 aa, Glycine max
  Coding DNA Sequence Number=SeqID_35393
  Gene Ontology: Mol. function=transferase activity, transferring hexosyl groups; Cellular component=mitochondrion; Biological process= metabolic process
  Homolog annotation: Hit_ID=Q84NV9; Match level="QueryCoverage=89%, HitCoverage=59%, E-value=4e-23, Identity=28%"; Hit description =Putative CRP1 protein
  Pfam annotation: Domain name=PPR; Domain location=111-145; Score=7.6; E_value=0.95; Accession=PF01535.11; Description=PPR repeat
  Pfam annotation: Domain name=PPR; Domain location=154-188; Score =34.8; E_value=2.9e-07; Accession=PF01535.11; Description=PPR repeat
  Pfam annotation: Domain name=PPR; Domain location=189-223; Score =42.6; E_value=1.4e-09; Accession=PF01535.11; Description=PPR repeat
  Pfam annotation: Domain name=PPR; Domain location=40-74; Score=6.9; E_ value=1.1; Accession=PF01535.11; Description=PPR repeat
  Pfam module annotation: Pfam domain module=PPR::PPR::PPR::PPR; Domain location=111-145::154-188::189-223::40-74
MAHRLVFEFWEKSHLDVGNSFDRFTERLIYTYKDWGAHPRVFDVFFLVLVEAGLLLEAGKLFDKLLNYGVLVSVDSCNLFLARLSNSFDGIKTGIRVFREYPEVGVCWNTVSYNIILHSLCQLGRVKEAHNLVEGKVLKLMEELQRKGLKPNQYTYISIISLLCKTGRVVEAGQVLREMKNQRIFPDNVVYTTLISGFGKSGNVSAEYKLFDEMKSKKIVPDFVT

SEQ ID NO: 152172 - protein, 71 aa, Glycine max
  Coding DNA Sequence Number=SeqID_35394
MEIRGDSYSLHVQERGFFIVNSNMQATTFGRVLSRKPVARHKVAAIVSGKRFRSLGEDGAWPRLPGKERNE

SEQ ID NO: 152173 - protein, 379 aa, Glycine max
  Coding DNA Sequence Number=SeqID_35395
  Homolog annotation: Hit_ID=Q8LD58; Match level="QueryCoverage=48%, HitCoverage=28%, E-value=5e-50, Identity=54%"; Hit description =Receptor kinase, putative
  Pfam annotation: Domain name=GRP; Domain location=280-369; Score= -18.0; E_value=0.005; Accession=PF07172.2; Description=Glycine rich protein family
  Pfam annotation: Domain name=LRRNT_2; Domain location=28-65; Score =38.6; E_value=2.2e-08; Accession=PF08263.3; Description=Leucine rich repeat N-terminal domain
  Pfam annotation: Domain name=LRR_1; Domain location=119-141; Score =9.8; E_value=4.2; Accession=PF00560.23; Description=Leucine Rich Repeat
  Pfam annotation: Domain name=LRR_1; Domain location=143-165; Score =14.1; E_value=0.5; Accession=PF00560.23; Description=Leucine Rich Repeat
  Pfam annotation: Domain name=LRR_1; Domain location=167-188; Score =14.5; E_value=0.38; Accession=PF00560.23; Description=Leucine Rich Repeat
  Pfam annotation: Domain name=LRR_1; Domain location=190-212; Score =6.6; E_value=17; Accession=PF00560.23; Description=Leucine Rich Repeat
  Pfam annotation: Domain name=LRR_1; Domain location=70-93; Score=1.3; E_value=1.6e+02; Accession=PF00560.23; Description=Leucine Rich Repeat
  Pfam annotation: Domain name=LRR_1; Domain location=95-117; Score =15.6; E_value=0.18; Accession=PF00560.23; Description=Leucine Rich Repeat
  Pfam module annotation: Pfam domain module=GRP::LRRNT_2::LRR_1::LRR _1::LRR_1::LRR_1::LRR_1::LRR_1; Domain location=280-369::28-65::119 -141::143-165::167-188::190-212::70-93::95-117
  Subcellular localization annotation: CTP_CleavageSite=63; ConfidenceScore=5.34e-01
MQQHSHTLFTTITIILFSFFFPLTFSDLSSERAALLALRSAVRGRTLLWNATAASPCAWPGVQCDAANATVVELHLPAVALSGELPANVFPALKNLHTLSLRFNSLSGTLPADLAACAALRNLFLQQNHFSGEVPAFLSAMTGLIRLNLASNNFSGPIPVRFGNLTRLRTLFLENNRFNGSLPNFEELNELAQFNVSYNMLNGSVPKKLQTFGEDSFLGNTLCGKPLAICPWDDGGGESGANGNSNSSGVGGGEGSVIGGEKNKKGKLSGGAIAGIVVGSVVVLLLVVFALILLCRSGTKTRNVDNVNNIVGLKEEQHQHQHGEVGIESGNSENGGGGGGGNLVAAAVAAVSGGSGGGGGGGGGGGGGGDKKLVFYGNK

SEQ ID NO: 152174 - protein, 77 aa, Glycine max
  Coding DNA Sequence Number=SeqID_35396
MEIRKYNRLVHMENKGMQVRLVQNNKKREMDLISENLSSSMIVKTLVLKLMNDNLKNPKATPSTKSKATRFYSTHST

SEQ ID NO: 152175 - protein, 316 aa, Glycine max
  Coding DNA Sequence Number=SeqID_35397
  Homolog annotation: Hit_ID=UPI000065EAA5; Match level="QueryCoverage =25%, HitCoverage=19%, E-value=4e-08, Identity=37%"; Hit description =Homolog of Homo sapiens "C-Myc target JPO1
MLLESTKCNVMGEDLSEQKKRMGRVREKEKCGDYEALRKARILENQARLESLGVANTVSQLRQQAKKQQQPRTHPKKLYGLTPLRRSQRINNLTPPPFQPSTPIKQEKKVTVCEEKEEEQRPANAPFINLSNADLLLSAESSARRCDSKGRGSVYNPVLGICCHFCRQKKLCGEEDCKRCGNFDVNEPCLGKTDCSVCHSSTGVFCRACLKIRYGEEIEEVRKNKEWTCPHCIEAKGINPHWICNSVQNSSGVKTHIKLQDVENIEFNMPEETKNASNWNSSIQRSSNTIFKQVSYKIPTCEEINYFIEGLWMLRP

SEQ ID NO: 152176 - protein, 134 aa, Glycine max
  Coding DNA Sequence Number=SeqID_35398
MASEEPIIRDNVSDFSDEDQEHDVHESGEPSNQSQYESSSYFETINSQLLEDLQYSNPYQNRGSGSTNDLYECMIFESKQATLNAIKQFHFLHSFNFDVEENKSDNDWYPNQNLDCRHATMLWLYCDIQKSLHS

SEQ ID NO: 152177 - protein, 168 aa, Glycine max
  Coding DNA Sequence Number=SeqID_35399
  Gene Ontology: Biological process=protein transport
  Homolog annotation: Hit_ID=P93353; Match level="QueryCoverage=78%, HitCoverage=60%, E-value=6e-29, Identity=46%"; Hit description=Hin1 protein
  Pfam annotation: Domain name=Hin1; Domain location=26-165; Score =118.5; E_value=1.9e-32; Accession=PF07320.4; Description=Harpin -induced protein 1 (Hin1)
MPCKPRCIYCTIYIFIFIFMLCFFLFLIIINPSSVKFYVTEATLTQFNLTSNNTLYYNFKVNITVTNPNKHMIVYYRTIKAIAWYKDNEFDRVSLTPFDQGYKNTTFLRAVFVGQSVIMLKPKQLGEYKDETSIGIYNDLAVDFDLRIRAKFGRIKSRRFSPTLCSVS

SEQ ID NO: 152178 - protein, 259 aa, Glycine max
  Coding DNA Sequence Number=SeqID_35400
MTEIEEVQEQMKADMEAMKEQMTTMMEAIMSMRKMMSMRSKHSFPPYGLPPNYTPPNVAPTLDENVDNSAPIPMGETHEAPRDHTLADSEPHLGYSTEGQAFGGIPLPNTLGGPQYRPQPLHFAAERLPPAMVEREKIDHIEERSRPIEGGRDYTFADMAKLFLVPDMIIPLKFKVPDFDKYKGTTCPKNHLKIYCRKMGAYAKDEKLLVHFFQESLTRVAVTWYTNLESSRVRSWKDLMVAFIRQYQYNSDMTPNRMQ

SEQ ID NO: 152179 - protein, 61 aa, Glycine max
  Coding DNA Sequence Number=SeqID_35401
MALRVMAARPGKLLLQPTVTLLAQGSKDKDTNFVRANLLFDRATGENQGSETEKHENIEVL

SEQ ID NO: 152180 - protein, 53 aa, Glycine max
  Coding DNA Sequence Number=SeqID_35402
VFSFSWVACGNLLRDDDTGKNLKGFICNMASIQQYSKMNFAGCDVGIMYGATY

SEQ ID NO: 152181 - protein, 87 aa, Glycine max
  Coding DNA Sequence Number=SeqID_35403
MLWYITPPFVEELMEDHHREKVLPNPIRTFGAYRGASENFSFDPYSQPRKTTMGVGIHHTWNAYHRDPRKWESGNRGGPPASGARRS

SEQ ID NO: 152182 - protein, 298 aa, Glycine max
  Coding DNA Sequence Number=SeqID_35404
MLSLEVFLIGESLNNDPAQLHGDSDVPSDQVSNVHAGDVITSCIVVCPNAGTTASTGGLTIEKKTHPYFVVCFIPMEDEVESPRSNPPRNTIDLCLEAMTIQVIPRWPFIPSLPPLRKPSVTKEYLPIALLAYSLVHEEVRSYASSFLTYESIVEFLNLIEFCHIGRSYVMFVESCRESEHVFIRAFLCETHVMYIYSSFFSIHLLTIPFDKFKVDVLRELNVAPTPKFLHHYTIKEIIKSGWISFTDIFDKVVIRPYTTFYKNYQEDIVVLHKFPRGLHCKTLADLPFPMTLDADLD

SEQ ID NO: 152183 - protein, 401 aa, Glycine max
  Coding DNA Sequence Number=SeqID_35405
  Gene Ontology: Mol. function=transferase activity, transferring glycosyl groups; Cellular component=membrane; Biological process =protein amino acid glycosylation
  Homolog annotation: Hit_ID=Q10BV0; Match level="QueryCoverage=99%, HitCoverage=60%, E-value=0.0, Identity=73%"; Hit description =Galactosyltransferase family protein, putative, expressed
  Pfam annotation: Domain name=Gal-bind_lectin; Domain location=1-121; Score=3.4; E_value=0.00068; Accession=PF00337.12; Description =Galactoside-binding lectin
  Pfam annotation: Domain name=Galactosyl_T; Domain location=167-360; Score=42.5; E_value=7e-10; Accession=PF01762.12; Description =Galactosyltransferase
  Pfam module annotation: Pfam domain module=Gal-bind_lectin::Galactosyl _T; Domain location=1-121::167-360
MQWGSALRCEGWKSRADEDTVDGQVKCEKWIRDDDSHAEEAKATWWLTRLIGRTKKVTIDWPYPFVEARLFVLTVSAGMEGYHVSVDGRHVTSFPYRTGFSLEDSTGLSIKGDVDVHSIYAASLPTSHPSFAPQMHLELLPQWKAPPLVHVNVELFIGILSAGNHFAERMAVRKSWMQHKLIKSSNVVSRFFVALHGRKDLNMEIKKEADYFGDIIIVPYMDHYDLVVLKTIAITEYGIRSVAAKYIMKCDDDTFVRIESIISEARKVGSGRSLYIGNMNYHHRPLRSGKWAVTYEEWSEEEYPTYANGPGYTISADIAQFIVSNFEEHRLKLFKMEDVSMGMWVEQFNSSRPVEYVHSFKFCQFGCIEDYYTAHYQSPRQMTCMWDKLQQKGKPLCCNMR

SEQ ID NO: 152184 - protein, 122 aa, Glycine max
  Coding DNA Sequence Number=SeqID_35406
  Gene Ontology: Mol. function=catalytic activity; Biological process =metabolic process
  Homolog annotation: Hit_ID=Q386L9; Match level="QueryCoverage=70%, HitCoverage=35%, E-value=9e-08, Identity=42%"; Hit description =Glycerolphosphate mutase, putative
GNRDTAAYTIIPDHNIQSTAQGMAQAFRVVLRVPLHPHPIDAPRAQTVFLEEDDHWHEGRVRSSRTRFRKLSGGIEDEGYKGKTFWKTSKIKFAVSKARSTFMRDTSDKGVASSDIDQDAMV

SEQ ID NO: 152185 - protein, 201 aa, Glycine max
  Coding DNA Sequence Number=SeqID_35407
  Gene Ontology: Mol. function=galactosyltransferase activity; Cellular component=membrane; Biological process=protein amino acid glycosylation
  Homolog annotation: Hit_ID=Q1SGZ2; Match level="QueryCoverage=52%, HitCoverage=14%, E-value=6e-07, Identity=37%"; Hit description =Glycosyl transferase, family 31; Arginase/agmatinase/formiminoglutama se; Concanavalin A-like lectin/glucanase
MKRVKKLYPFLVLPNRPKPLQIFMAVMFLYLLFTTFEIETSLGFRTRFVSVSSLLGNEDQHQRTHSSKASNFPSQGVFQGSLHRKALQGLQKVSTLSFIEALNDTTVEENMFSELHKAARHAWVEGKRLWEQVESVKETMNVARFKAENLSDSCQHSISLSGSELRKQNKGVMVMVLPCGLTLGSHVTVVGPHVGSLGGRS

SEQ ID NO: 152186 - protein, 66 aa, Glycine max
  Coding DNA Sequence Number=SeqID_35408
MSCLQFIRSCPLGKTWSLIKVVAGWVVNNTSLKQKLQANDHGYLANQTTVKKPRSSKKFIARVNGS

SEQ ID NO: 152187 - protein, 222 aa, Glycine max
  Coding DNA Sequence Number=SeqID_35409
  Homolog annotation: Hit_ID=Q1SKD7; Match level="QueryCoverage=95%, HitCoverage=56%, E-value=2e-08, Identity=23%"; Hit description =Ankyrin
MASRKRKKPSTPTQVRFDRSRFTSQEAWERYTYVIVPRKHLLERNVVVYYTEFDEFKEELKRRHWDEELADFEDDNIDVAIMKEFYANLYDPEDKSPKQVRVRGHLIKFDEDMLNTFLKTHIIMKEGESLCAYSKFALLRPVKLCIPGRGFELNVDGQPLKILRKNMTTLAQTWSVLSFSNLIHTSHTSNVTLDRARLIYGIIMKMDMNVGYLISHQISLTA

SEQ ID NO: 152188 - protein, 144 aa, Glycine max
  Coding DNA Sequence Number=SeqID_35410
MTHSLNDVEAIHATPVSICNPTNYDIGCDDVVNNQKNENEIPPATQNSKPKRGRPFKTPPESIKNWYVIRKERKIANRFDTTYIHMETDFRCRSLKEIKNNEKYGSPPRRQKVKAQAKEESNDKTKNETEFTENYKLMSRTESG

SEQ ID NO: 152189 - protein, 39 aa, Glycine max
  Coding DNA Sequence Number=SeqID_35411
MRLHSYQASQRASMTTDQPSLSMAHIDPEQPKYITCRLS

SEQ ID NO: 152190 - protein, 95 aa, Glycine max
  Coding DNA Sequence Number=SeqID_35412
  Gene Ontology: Mol. function=protein kinase activity; Biological process=protein amino acid phosphorylation
  Homolog annotation: Hit_ID=Q1S7R4; Match level="QueryCoverage=87%, HitCoverage=12%, E-value=9e-17, Identity=57%"; Hit description =Protein kinase
MKNLWLCFSYLFPATIILVLLTPSSVAQLSPSEGRILFQVQKLLEYPQALQGWNRWTNLCFLPSSPSLKIVCSNGHVTELTIIGIICCIYFSYTN

SEQ ID NO: 152191 - protein, 334 aa, Glycine max
  Coding DNA Sequence Number=SeqID_35413
MYHMRLVSSEYPPTNHHYPDNVLVDIMGSYQLESLFRYLTPPLEKELRNNGRSLLTDQTKKNLVRTFGTHSGARVKFPSITKVYGSDQEFNVKVNYHGRKFRNTRIQIAIGGSTEEECKGNGCIMTKTRSRYASSVPRKRGWKPLNIDRYDGTKNNDEHLEAYIAQGPALTRLHQLPPRMIDSFDTLAECFGAQYVTCQPHHSIGSTDQPTSSPSCHDSGTKAKSVHRQSVQEEESKVAAEANSEVDTLEVGATIINSLREKASKDNKKIPLVPPITFIDADFVGNDPTQDDPMAIPYNVLHGKPTLNKLGAIISTPHLAMKFPLFVGGIVTVK

SEQ ID NO: 152192 - protein, 80 aa, Glycine max
  Coding DNA Sequence Number=SeqID_35414
  Homolog annotation: Hit_ID=Q1RT77; Match level="QueryCoverage=95%, HitCoverage=12%, E-value=9e-07, Identity=38%"; Hit description=Zinc finger, CCCH-type
MIEDFESYKGEDFESSKGEDFEPSEGKDLESSEGEDLEPAEGEDLKPSEGEDLESSEGEDLESSEGEKFEPSEGKDFESS

SEQ ID NO: 152193 - protein, 281 aa, Glycine max
  Coding DNA Sequence Number=SeqID_35415
  Gene Ontology: Mol. function=RNA-directed DNA polymerase activity; Biological process=RNA-dependent DNA replication
MGEKHEVPHHNLADFKPCLGCATEEQAVSGMPPPNTLEGPQFRPQLQPLHFAAGRIPPTMMEKGKLDHIEEKLRAIEGGGDHAFADMAELFLVPKVVIPPKFKVPNYDNYKGATCPKNHMKMYYQKMGACSKGEKLLMHFFQESLTGVVVTWYTNLEPSRVHSWKDLMVAFVRQHQYNSDMALDRMQLQNICKKEHESFKEYAQRKGDDNNDSRHLMVFYCEKMVGYTPSSFVDLVFDGERIKVGLKRGKFDHPALMNEKTGANGENEMEGGTHVVTVVPI

SEQ ID NO: 152194 - protein, 126 aa, Glycine max
  Coding DNA Sequence Number=SeqID_35416
  Homolog annotation: Hit_ID=Q9SLT5; Match level="QueryCoverage=88%, HitCoverage=27%, E-value=8e-16, Identity=40%"; Hit description=CW14 protein
MAAGSIEEAWFDSVAVFDSDCDDDYQSVIDANRGVSTEHVHKPGELSKRHSAHISESIRNSDAEFLDVDAANSHGSKRDDGDLHNCGILPCNCLSCLPSTDQASLSSSPPNSTRKKENKYEEDVQS

SEQ ID NO: 152195 - protein, 258 aa, Glycine max
  Coding DNA Sequence Number=SeqID_35417
  Homolog annotation: Hit_ID=Q9SLT5; Match level="QueryCoverage=94%, HitCoverage=60%, E-value=9e-59, Identity=47%"; Hit description=CW14 protein
  Pfam annotation: Domain name=DUF1336; Domain location=124-257; Score =67.6; E_value=4.1e-17; Accession=PF07059.3; Description=Protein of unknown function (DUF1336)
MQEENATNSHGKCDKRVNEANEPVFLDEFSSVDAGSKRDDGDLHNCGILPCNCLSCLPSTDQGSLSSSPPNSTRKKDPTKHSFKWSGKATLFTIPNAPLPSQNNESYSAKFPQRQFYKDHSQVLRDKKKEFASNHAGYYPLGVDVFLCPRKIDHIARFVELPVMSSSGKLPAILVVNVQIPIYPATLFKRLMDDEVEKVKSFRGDTIVPFRERLKILGRVVNPEDLHLSAPERKIMQTYNEKPLLSRPQHEFYSEISA

SEQ ID NO: 152196 - protein, 91 aa, Glycine max
  Coding DNA Sequence Number=SeqID_35418
  Gene Ontology: Mol. function=DNA binding; Biological process=DNA integration
MIPVEIQEEACKRIATRKHESKLNKKGFRVGDLVWRMRGEAQKDHARGKITPNWEGPFRITAKMQNRAYRLKKLVGKEIPRTWKATHLNDM

SEQ ID NO: 152197 - protein, 80 aa, Glycine max
  Coding DNA Sequence Number=SeqID_35419
MVALLGYTCRNLSYDESVAKSQRSVSQKGKHRRESLMRWTLKRSQVMFDEKRRELLRRWTLKRSFKLEKQRESLRRWTLK

SEQ ID NO: 152198 - protein, 166 aa, Glycine max
  Coding DNA Sequence Number=SeqID_35420
MEGFVVVCYDGDMVLASEEVLFNCPNGPKFIKISEEMLLPTLRKAITNAIKGDGCMEYDCIELKDDNDVGKMFFIFSKFSSKGSIKLYPMVGQFAKEIFVLLHKPRSSEEIIALTPIEPYVAQPRPMTPNVDPTHPMLDCISHIEDMGMYLWSSRGSRALRDAHED

SEQ ID NO: 152199 - protein, 73 aa, Glycine max
  Coding DNA Sequence Number=SeqID_35421
MATRPSELMLSPEETGLPRRASPFSPKQFGGLGDGGFVGIEGRSIKNFYSGFYIQNSHYMFKAHPKFWGSLGK

SEQ ID NO: 152200 - protein, 71 aa, Glycine max
  Coding DNA Sequence Number=SeqID_35422
MRHSLSEPRAKLKLVNHGGKVMPYPTQAMVNAYVDGSCLSSLYDARYTTANKGIMNTFIERWDNETSSFHL

SEQ ID NO: 152201 - protein, 703 aa, Glycine max
  Coding DNA Sequence Number=SeqID_35423
  Homolog annotation: Hit_ID=Q1SRN1; Match level="QueryCoverage=31%, HitCoverage=16%, E-value=3e-35, Identity=37%"; Hit description =Integrase, catalytic region
  Pfam annotation: Domain name=RRM_1; Domain location=550-620; Score =1.8; E_value=0.097; Accession=PF00076.12; Description=RNA recognition motif. (a.k.a. RRM, R
  Pfam module annotation: Pfam domain module=RRM_1::RVT_2; Domain location=550-620::430-554
MASASNPPPPPPPPRNGGTPVESVIKGHRLHHLLTNPQIPLDTPLLPIVILEIPHLSSYLGGNKISSYTCGYNPPFPAKFFQDSLVANRPNIFGTSFICIFSPLSENVNIVLDGLPDEFESLITFVSGKFESLSVDEGQSSSSSNSGSNYNNYNGGNRFFNSGCGGGRGRGCYSNVQCQICHKNGHEASFCYYRHDDDYVPTQPMDYPNQYPNYSQSLPSPKIPIPLPIRIKIRTLIAIPIRILINLSTTNIISYKCMAADGRVYISKDVVFDELRFPFPKLMGEPASEPSSIASHSQQILTVLPISHTEASSVSASLTSAPSASASPAASIQSPAASTSVNINHASASQDLPLPVQETLPSVTVSVQENLSQAGDSSPAVLFRPDNIHPMCTRAKAGVVKPRLQPTLHLTHSEPKSTKTALSNPTWFAAMKTEYEVLIKNGTWSLTELPPNRSAVGCKWVFRVKENPNGTVSKYKARQPKCPLTTRKIERMSRERIRGWERVRHRGKVFERQRVRLRVDSQQTQARNRDGQQQHYNQTNWRDRNEISSFYFTRFSDDVSEKDLWYQFKKWGHVREVFVSKQRNKNGRRSGFARFKGVNDVYILERQLDSIVIEGMKLYANIPKYGRQRGRKTISEDKQKGQVQRNENEASRPIQRGARTNHGSYAKVVARKGNMKAPHSREGGLLSVYLETSSDMQKWFSEA

SEQ ID NO: 152202 - protein, 93 aa, Glycine max
  Coding DNA Sequence Number=SeqID_35424
  Subcellular localization annotation: CTP_CleavageSite=36; ConfidenceScore=5.24e-01
MGVVTQSVKFRNVSERNQQKNTKGGGSNRRRCLLVEATQLAQASWAATTSLFSPINRGKMVEQKCSAVLVFRILSKLVRKIVSMKKVQAEALP

SEQ ID NO: 152203 - protein, 157 aa, Glycine max
  Coding DNA Sequence Number=SeqID_35425
  Homolog annotation: Hit_ID=Q6YUW7; Match level="QueryCoverage=39%, HitCoverage=7%, E-value=3e-15, Identity=59%"; Hit description =Chromosome structural maintenance protein-like
MASKDRVQEWNHRLESTWCEGASLSVYVQLCCYGMPLVDEAKLVGYSCRREWISTMELSKDVIFLEMGMDEDDQPEMENNSNNYGELLAESSIRFIFYDEIKKLEDFRTQWVEKISLVIFKGFDCHSRDYVNNKRQWQEGEEGWTVSKTLIEALDYL

SEQ ID NO: 152204 - protein, 242 aa, Glycine max
  Coding DNA Sequence Number=SeqID_35426
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SCY9; Match level="QueryCoverage=47%, HitCoverage=8%, E-value=3e-15, Identity=34%"; Hit description =Integrase, catalytic region; Zinc finger, CCHC-type
MENAIVKGWLIGAMEPDLMNLYVPMPIPKSIWTALSQTYYEGTDRSAIYDLSRRVMQMSQDGRPVSIYYPNLRAIWKELEYRKPITFSQPNDILHTKPFPNLDNAFVVVKSEEQRRNTMLHSQVTSSVTMATKTALTRNLLRTKGQVSDSNSHPFNAKIKQILKLLLNNNKWEHPKRKELVLKPTPPPRVATMQTYEKSQKGQEVVESKPTSTMLNKGEEEFEAKPTPTMLTKVSTTERPQK

SEQ ID NO: 152205 - protein, 82 aa, Glycine max
  Coding DNA Sequence Number=SeqID_35427
MESVSVVAYSDGYILSSSEGVLLECPSDPKVFTISEDMSLDALRKTIMNIVGETINQALSMHGLLATKYRVIGEEEKLIRIQ

SEQ ID NO: 152206 - protein, 274 aa, Glycine max
  Coding DNA Sequence Number=SeqID_35428
  Gene Ontology: Mol. function=nucleic acid binding; Cellular component= mitochondrion; Biological process=DNA integration
  Homolog annotation: Hit_ID=Q1S077; Match level="QueryCoverage=88%, HitCoverage=84%, E-value=9e-49, Identity=39%"; Hit description =Asp/Glu racemase
MEFSAIRCQQCLLNGILEEDIYMTQPPGLKIPTSTSCDPSLFIYTDSNNTGLYATDLGSLDYFLGIEVRSQPNGALILTQSKYIRDLLSKTKMDEANLISSPMVSGCKLTKSGYESFPDPTHYRSVVGALQYSTITRPEISFYVNKFLPSSTGPPFSYMHTVMLTELLTQMTEETQAEYHSLALAIAEVTWIKSLLSELHIPHATPVIFCDNMSTVALAHNSVMHSCTKHVELELFFFREKVMAEQHQVIHVPAIDKKADILTKARTPSNLTTY

SEQ ID NO: 152207 - protein, 56 aa, Glycine max
  Coding DNA Sequence Number=SeqID_35429
MAIQKLLEQLWLLGVIFENSLLALKIKFKFLKVVIKCLKLLVIDYKPCVIDYWLEI

SEQ ID NO: 152208 - protein, 78 aa, Glycine max
  Coding DNA Sequence Number=SeqID_35430
  Homolog annotation: Hit_ID=Q9XIE6; Match level="QueryCoverage=73%, HitCoverage=4%, E-value=2e-22, Identity=77%"; Hit description =Putative phospholipid-transporting ATPase 3
VKQDAFFPADLLFLASTNADGVCYIETANLDGETNLKIRKALEKTWDYVTPEKASEFKDGSVKFGITTGFKQENRGRY

SEQ ID NO: 152209 - protein, 96 aa, Glycine max
  Coding DNA Sequence Number=SeqID_35431
  Subcellular localization annotation: CTP_CleavageSite=21; ConfidenceScore=5.65e-01
MASATNNGASPPPPTPPPTLLAATGSSTSMAFLHTVTAKLTDSNYLLCRSQTLLDSLLLIGDSVSMNEHIDIILDGLHEEYETIVTILGSKTEPDS

SEQ ID NO: 152210 - protein, 130 aa, Glycine max
  Coding DNA Sequence Number=SeqID_35432
MTKNRVLKEHNKIFLNWFKDTIFGDDNASETLRKLADGSKGNVRTWQGYNINKYLFYTKSQDDKNPCDERWSVVLHGKIIGINPKDDDSTLDTCHAPFSTHMPNLNGEEEVDDVHANHNDHDEVELINIV

SEQ ID NO: 152211 - protein, 271 aa, Glycine max
  Coding DNA Sequence Number=SeqID_35433
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9XIE6; Match level="QueryCoverage=100%, HitCoverage=22%, E-value=1e-130, Identity=84%"; Hit description =Putative phospholipid-transporting ATPase 3
MGKVQDVSYEILNVLEFNRKRQSVVCRYPDGRLVLYCKGADNVVYERLADGNNNIKKVTREHLEQFGSAGLRTLCLAYKELHPDVYESWNEKFIQAKSSLNDREKKLDEVAELIENDLILIGSTAIEDKLQEGVPACIETLQRAGIKIWVLTGDKIETAINIAYACNLINNEMKQFVISSETDAIREVEDRGDQVEIARFIIEEVKRELKKCLEEAQSSFQSLSGPKLALVIDGKCLMYALDPSLRVMLLNLSLNCHAVVCCRVSPLQKAQ

SEQ ID NO: 152212 - protein, 127 aa, Glycine max
  Coding DNA Sequence Number=SeqID_35434
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9XIE6; Match level="QueryCoverage=79%, HitCoverage=8%, E-value=5e-40, Identity=75%"; Hit description =Putative phospholipid-transporting ATPase 3
MDTAASSLIVLEIFCILTMETYFMDRVQRWFFPYDYQIIQEMHRDEVDSTGRAQLLEIGNQLTPAEARSHAISQLPREISKHTGFAFDSPGYESFFASQLGVYAPPKAWDVARRASMRSRPKIGQQK

SEQ ID NO: 152213 - protein, 95 aa, Glycine max
  Coding DNA Sequence Number=SeqID_35435
MQRRSDFEHWYHGPAPNACISGCRNVMHNDGGVIGEHMEVAMSTQADCTTELKVAKSKLRYRSRWDLIRILATVARWHVQVVVVREDENKKKEMG

SEQ ID NO: 152214 - protein, 84 aa, Glycine max
  Coding DNA Sequence Number=SeqID_35436
  Homolog annotation: Hit_ID=Q1SGW7; Match level="QueryCoverage=45%, HitCoverage=6%, E-value=4e-07, Identity=66%"; Hit description =Protein kinase
  Subcellular localization annotation: CTP_CleavageSite=55; ConfidenceScore=5.11e-01
MDQEYIPWSPHANPHSPFSQLHQQLLLRPNSSLQQTWSLQGPLLSSQLCPPNDEQGSHVGGGASARAEFKPQQGLRGGEQEGVY

SEQ ID NO: 152215 - protein, 64 aa, Glycine max
  Coding DNA Sequence Number=SeqID_35437
MSTTSSTASTERKNAIMRPPLIMQFIAAFNNDKNTIQLPAFYHTQWAPNYPEMVHLRYNGAIYE

SEQ ID NO: 152216 - protein, 127 aa, Glycine max
  Coding DNA Sequence Number=SeqID_35438
MKAQVEKDEGPEAETLSRLLIVAEGPSNPCGVYPDLSSFTGSDVYPDLSSFAGSGIYPDLSSFTGSGVYPDLYSFTGSGVIQKKTLQPVSNDPLLLKFASIGQPIEVIHKKPKRFKYKWMNSLAKVG

SEQ ID NO: 152217 - protein, 128 aa, Glycine max
  Coding DNA Sequence Number=SeqID_35439
MTGVKPWVKVPCMHSLSHSHLERWLKESDREVYVGPYFHHVMTKLKTTLSPKSKVAAPKWIEVKSHVQTGCYECGYYVMHWMWNIITSEIKSDWSMWFADATSLDIDNITTIRNKWARYFLKTACKKG

SEQ ID NO: 152218 - protein, 62 aa, Glycine max
  Coding DNA Sequence Number=SeqID_35440
MSMCKKENILGVGPESGSESDRVNPLCGVLCHVLLSAPVLFFTDMVRLHMMSHMLKMERLSL

SEQ ID NO: 152219 - protein, 84 aa, Glycine max
  Coding DNA Sequence Number=SeqID_35441
MSFRTCGKAWAEQMRKMSDQRNACALLVMGKLGGVDGDLVLRGTRIRATWGYASSVEGGQLGMVGSCVICGCGRVDLHHLPIAT

SEQ ID NO: 152220 - protein, 97 aa, Glycine max
  Coding DNA Sequence Number=SeqID_35442
MEAKAQKWWPMGENLQNPWVLHFLNEGGEFWVERNSPSPRFYVSRCRGARPGELTRAPPLGILDCLPAALPTCPELGMGRRIIDHGSSLYSRPSLST

SEQ ID NO: 152221 - protein, 133 aa, Glycine max
  Coding DNA Sequence Number=SeqID_35443
  Gene Ontology: Mol. function=hydrolase activity, acting on ester bonds; Cellular component=cytoplasm; Biological process=lipid metabolic process
  Pfam annotation: Domain name=Transposase_21; Domain location=79-133; Score=-131.0; E_value=0.002; Accession=PF02992.5; Description =Transposase family tnp2
MGMEYQKIHACPNDCILYRHEFEEISKCPRSGVSRYKVKDDEECSSDENSKKGPPAKVLWYLPIVPRFKRLFANGDDAKDLTWHANDRNCDGMIRHPDDCSQWKKIDRPRQPGNDIDVYLSPLIEDMRKLWDE

SEQ ID NO: 152222 - protein, 206 aa, Glycine max
  Coding DNA Sequence Number=SeqID_35444
LLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPDVSIEDFIQAPVVTTRSFQRGVRTSLMLRLRLIENCCGETIAEAGLDPKPLTILGSRLGGSEKTKGDADYSIADSEEITDIVGTNLIFMTGPVIDLLLVMQHRVP

SEQ ID NO: 152223 - protein, 97 aa, Glycine max
  Coding DNA Sequence Number=SeqID_35445
  Subcellular localization annotation: CTP_CleavageSite=45; ConfidenceScore=5.15e-01
MVPNAWLTKKGCFFGHLNFIITFSMHSLKKGHALRRPYRTRARARVMGEAEEVQEKMKAEMEAMKEQMATMMEAMMSMKKIMEANAVIVAATCAVAK

SEQ ID NO: 152224 - protein, 125 aa, Glycine max
  Coding DNA Sequence Number=SeqID_35446
  Gene Ontology: Mol. function=RNA-directed DNA polymerase activity; Biological process=RNA-dependent DNA replication
EFKNVFPKEIPHGLPPLSGIEHQVNLFPGASLPSRPTYNSKPQETQHKDAQAKVKYVKRLYDQVKVQIAKKNESYAKQAHKKRKEVVLEPGDDPGYLRANVFQEGGNDENPETGQIQAKGPSGEG

SEQ ID NO: 152225 - protein, 193 aa, Glycine max
  Coding DNA Sequence Number=SeqID_35447
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=2e-23, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MIGPIDESISYKGGPLEGYTPSPSDDYTFSPSEGYSPSPSEDYTSSLSDDYTSSPLHDYTTSPSEDYTSSPSEDYTPSPSEDYTLHALAFRGLHALAFRGLHTLAFKGLHTVALRGIHVLAFKERHVLAFSGLNVLVFRGLHVLTSRGLHALAFRGLHALAFRGRHVLAFRGLQALAFRGLSSLPSEDYTSSP

SEQ ID NO: 152226 - protein, 158 aa, Glycine max
  Coding DNA Sequence Number=SeqID_35448
MASRKRKATTSRPQEPYDTTRFTSEGAWERYSQNIHSWNILLERNVNLFVTEYDEFCRELIRRNWHKALTQFMDGQIDVALVKEFNSNLSRTDPQEVASKLCIPGHIFVLNAEGAPWKLLRKDLTTLAQNCVEANFMMMNQAILMMPNDAILPPKGIG

SEQ ID NO: 152227 - protein, 84 aa, Glycine max
  Coding DNA Sequence Number=SeqID_35449
MMGVKHFEVVKRRSHADKQWSPDEIKLSDAIHPRKGPVTRVMSKRLQEDWARAAEEGPRVLMNLRVGYPRNIGFFSTCILEHLD

SEQ ID NO: 152228 - protein, 53 aa, Glycine max
  Coding DNA Sequence Number=SeqID_35450
CPRGVLKGSKVQKWRELRELRKKKKKEEETKPRRCRIMTMINLYIVPCSVFFV

SEQ ID NO: 152229 - protein, 176 aa, Glycine max
  Coding DNA Sequence Number=SeqID_35451
  Gene Ontology: Cellular component=integral to membrane; Biological process=transport
  Homolog annotation: Hit_ID=Q9FVU0; Match level="QueryCoverage=52%, HitCoverage=68%, E-value=1e-24, Identity=50%"; Hit description =Integral membrane protein, putative
  Subcellular localization annotation: CTP_CleavageSite=66; ConfidenceScore=5.41e-01
MPPPPLGISQSLKNSQIFLKDQNLASLLCSLPLCISLFKPLRLFSSLLFSSIPGLKRLTNLTILVRRNSGWLLKDNLLIQLVIKVTSPYGNNLHHKENTRHAKDWDSIARKEKIEGFKLELRKLEGAVNSIHQNLLYLKGREAEMRTVSEKTNGRVACFWFAIVVFEAVLSEEELI

SEQ ID NO: 152230 - protein, 106 aa, Glycine max
  Coding DNA Sequence Number=SeqID_35452
VEFDIPEACDLRTKKKILQIVRERWRQFKSDLTLKWALVADKESVNDTVCEKYDISKEKWAQFFQTHKDPSWEDVRKKAQAIQKQNTTPHVLSRGGYEYLENKLMG

SEQ ID NO: 152231 - protein, 79 aa, Glycine max
  Coding DNA Sequence Number=SeqID_35453
MTSEAVKEIVEKIDSLEGQASQGSFVAHGRQDVLTAAIGRPEHPGCVRATGAGVTIKQYFGPAPRTSLTSSSMAPEDLE

SEQ ID NO: 152232 - protein, 183 aa, Glycine max
  Coding DNA Sequence Number=SeqID_35454
  Homolog annotation: Hit_ID=Q1SWX1; Match level="QueryCoverage=88%, HitCoverage=36%, E-value=8e-11, Identity=26%"; Hit description=IMP dehydrogenase/GMP reductase
MGSSQAPSLKKRFYQVKVKSLGVSSLKELGRLMGQLQRQSFRKAYGKIWDLAMAEVSTEAIASLAQYYDQPLRCFTFGDFQLSPTVEEFEEILGCPLGGRKPYLFSGFYPSLARISKIVQISTQELDHRKQVKMWWLEYQGNVWKQKPESWQEKAAIDAFLAFHDRKESPVVTILADLYDTFD

SEQ ID NO: 152233 - protein, 251 aa, Glycine max
  Coding DNA Sequence Number=SeqID_35455
  Homolog annotation: Hit_ID=Q66A30; Match level="QueryCoverage=43%, HitCoverage=27%, E-value=2e-38, Identity=71%"; Hit description =Putative MFS Superfamily multidrug efflux pump precursor
TSGGVVISATATDPECSDWCDSQTAQQEGDGLRNIAQANVRRAQTRGGEDKRRAAGLRRAFVARTRRAGQFQCAEQQHQRHQREREEDGAPVKMGHQPGTQQRCQRRACQLTAAAHTPTACTKRSASISQTLVTHSMARQLSANRLRPASKIGLRPKRSDSTPHSTCAQAKPPRNRLRLALMVPGAEAKSRCMAPKAGKYISVARKPSMLSTARLNGGECKRRGGAGAAPRALCHKLYRAPAGRLAGGTAV

SEQ ID NO: 152234 - protein, 281 aa, Glycine max
  Coding DNA Sequence Number=SeqID_35456
  Homolog annotation: Hit_ID=Q8TGM5; Match level="QueryCoverage=13%, HitCoverage=58%, E-value=2e-07, Identity=74%"; Hit description =Uncharacterized protein ART3
  Subcellular localization annotation: CTP_CleavageSite=49; ConfidenceScore=5.50e-01
MSRVDRRTGSHRSTSDRDTSPAPIRFPPDNFKHSLTLFSKSFSSFPRVTCSLSVSRQYLALDGNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCSGIL

SEQ ID NO: 152235 - protein, 518 aa, Glycine max
  Coding DNA Sequence Number=SeqID_35457
  Gene Ontology: Mol. function=binding; Cellular component =intracellular; Biological process=protein kinase C activation
  Homolog annotation: Hit_ID=Q1SV87; Match level="QueryCoverage=97%, HitCoverage=93%, E-value=1e-100, Identity=36%"; Hit description =Pentatricopeptide repeat
  Pfam annotation: Domain name=PPR; Domain location=141-175; Score=3.8; E_value=2.6; Accession=PF01535.11; Description=PPR repeat
  Pfam annotation: Domain name=PPR; Domain location=203-237; Score =22.6; E_value=0.0014; Accession=PF01535.11; Description=PPR repeat
  Pfam annotation: Domain name=PPR; Domain location=238-272; Score=1.4; E_value=5.1; Accession=PF01535.11; Description=PPR repeat
  Pfam annotation: Domain name=PPR; Domain location=304-338; Score =48.1; E_value=2.9e-11; Accession=PF01535.11; Description=PPR repeat
  Pfam annotation: Domain name=PPR; Domain location=339-373; Score=3.2; E_value=3.1; Accession=PF01535.11; Description=PPR repeat
  Pfam annotation: Domain name=PPR; Domain location=375-409; Score=4.4; E_value=2.2; Accession=PF01535.11; Description=PPR repeat
  Pfam annotation: Domain name=PPR; Domain location=445-479; Score=5.7; E_value=1.6; Accession=PF01535.11; Description=PPR repeat
  Pfam annotation: Domain name=PPR; Domain location=71-105; Score=16.8; E_value=0.077; Accession=PF01535.11; Description=PPR repeat
  Pfam module annotation: Pfam domain module=PPR::PPR::PPR::PPR::PPR::PP R::PPR::PPR; Domain location=141-175::203-237::238-272::304-338::339 -373::375-409::445-479::71-105
MSSCSKRCLVLLEKCKNVNHLKQAHAQVFTTGLDTNTFALSRLLAFCSHPYQGSLTYACRVFERIHHPTLCICNTIIKTFLVNGNFYGTFHVFTKMLHNGLGPDNYTIPYVLKACAALRDCSLGKMVHGYSSKLGLVFDIFVGNSLMAMYSVCGDVIAARHVFDEMPRLSAVSWSVMISGYAKVGDVDSARLFFDEAPEKDRGIWGAMISGYVQNSCFKEGLYLFRLLQLTHVVPDESIFVSILSACAHLGALDIGIWIHRYLNRKTVSLSIRLSTSLLDMYAKCGNLELAKRLFDSMPERDIVCWNAMISGLAMHGDGASALKMFSEMEKTGIKPDDITFIAVFTACSYSGMAHEGLQLLDKMSSLYEIEPKSEHYGCLVDLLSRAGLFGEAMVMIRRITSTSWNGSEETLAWRAFLSACCNHGQAQLAERAAKRLLRLENHSGVYVLLSNLYAASGKHSDARRVRNMMRNKGVDKAPGCSSVEIDGVVSEFIAGEETHPQMEEIHSVLEILHMQLD

SEQ ID NO: 152236 - protein, 513 aa, Glycine max
  Coding DNA Sequence Number=SeqID_35458
  Gene Ontology: Mol. function=hydrolase activity; Cellular component =membrane; Biological process=proteoglycan metabolic process
  Homolog annotation: Hit_ID=Q6ZJE2; Match level="QueryCoverage=98%, HitCoverage=98%, E-value=1e-149, Identity=51%"; Hit description =Putative beta-glucuronidase
  Pfam annotation: Domain name=Glyco_hydro_79n; Domain location=20-340; Score=470.2; E_value=2.6e-138; Accession=PF03662.4; Description =Glycosyl hydrolase family 79, N-terminal domain
MNVKTTICCVLLLLFSTSSAKDVDLRVKGVTSIATTDENFICATLDWWPPNKCDYNDCPWGNAGILNLDLYNDIFLNAVKAFNPLRIRLGGSLEDWLVYQFGKQRECPLFQKKNDGLFGFSKGCLPKKKWDEINHFFNKTGVKLTFGLNALSGKKPSKEDKKNWKGDWDPTNAIDLMEYTISKGYNIDSYELGNELCADGVSARIDSVQYAKDITQLRKTVNLLYQDANTRPKVLGPAGFYGKEWFDSFLQNVGHGVVDGVTHHIYNLGSGNDKDLINKIQDPYYLSQVAQTFKDVSDAVKEFEPSSGPWVGESGGAYNSGGKDVSNTFVNGFWYLDQLGMTSTFNHKVYCRQALVGGNYGLLDTTTFIPNPDYYGALLWHRLMGSKVLSVSHEGSPYLRAYVHCSKTESGIAVLLINMSNSTTFEVSLLNDMNLYPEVVFKNTQREEYHLTPKDGNIQSKVVLLNGTPLVLTQSLHIPEMKPKLVDPSSPVKVKHDSIVFVHSKSFNAPACM

SEQ ID NO: 152237 - protein, 252 aa, Glycine max
  Coding DNA Sequence Number=SeqID_35459
  Homolog annotation: Hit_ID=O04237; Match level="QueryCoverage=49%, HitCoverage=32%, E-value=7e-27, Identity=50%"; Hit description =Transcription factor
  Pfam annotation: Domain name=HABP4_PAI-RBP1; Domain location=184-245; Score=21.6; E_value=8e-05; Accession=PF04774.5; Description =Hyaluronan  mRNA binding family
  Subcellular localization annotation: CTP_CleavageSite=41; ConfidenceScore=5.43e-01
MTLMPLLRSCPPYFTRVVHSLPHLGRALTSSFTHRLTKCLLCVTSSSCATIIKEVRTLLYFVAVSFNIRSLLFQQSKARVNNPKTLLLRIVVEIGCIERALWYKGIELPIGCTTTTCGIRDSSNDENSFPTSGDPYNQVSFKGDAGKSFERRGYGGPRGPYRGGGGHRGGFSNGEIGEAEEGQPQRAFDRCNGIGRGNEFKREGSGRGNWGTQTDELAQVTDKVANETEKNLGDEKPTIEEDIVDGNITNLY

SEQ ID NO: 152238 - protein, 404 aa, Glycine max
  Coding DNA Sequence Number=SeqID_35460
  Gene Ontology: Mol. function=protein binding; Cellular component =integral to membrane; Biological process=protein amino acid phosphorylation
  Homolog annotation: Hit_ID=Q9FLK9; Match level="QueryCoverage=93%, HitCoverage=93%, E-value=1e-118, Identity=52%"; Hit description =Leucine-rich repeat disease resistance protein-like
  Pfam annotation: Domain name=LRRNT_2; Domain location=28-70; Score =22.9; E_value=0.0011; Accession=PF08263.3; Description=Leucine rich repeat N-terminal domain
  Pfam annotation: Domain name=LRR_1; Domain location=101-123; Score =17.0; E_value=0.07; Accession=PF00560.23; Description=Leucine Rich Repeat
  Pfam annotation: Domain name=LRR_1; Domain location=125-147; Score =14.5; E_value=0.38; Accession=PF00560.23; Description=Leucine Rich Repeat
  Pfam annotation: Domain name=LRR_1; Domain location=149-171; Score =17.9; E_value=0.036; Accession=PF00560.23; Description=Leucine Rich Repeat
  Pfam annotation: Domain name=LRR_1; Domain location=173-195; Score =14.8; E_value=0.31; Accession=PF00560.23; Description=Leucine Rich Repeat
  Pfam annotation: Domain name=LRR_1; Domain location=197-218; Score =10.0; E_value=3.8; Accession=PF00560.23; Description=Leucine Rich Repeat
  Pfam annotation: Domain name=LRR_1; Domain location=224-246; Score =15.3; E_value=0.22; Accession=PF00560.23; Description=Leucine Rich Repeat
  Pfam annotation: Domain name=LRR_1; Domain location=248-270; Score =10.8; E_value=2.7; Accession=PF00560.23; Description=Leucine Rich Repeat
  Pfam annotation: Domain name=LRR_1; Domain location=371-394; Score =1.3; E_value=1.6e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=28-70::101 -123::125-147::149-171::173-195::197-218::224-246::248-270::371-394
MARAPFTSFPFVLIILLSIVHLSHCKTLKRDVKALNEIKASLGWRVVYAWVGDDPCGDGDLPPWSGVTCSTVGDYRVVTELEVYAVSIVGPFPTAVTSLLDLTRLDLHNNKLTGPIPPQIGRLKRLKILNLRWNKLQDAIPPEIGELKSLTHLYLSFNNFKGEIPKELANLPDLRYLYLHENRLAGRIPPELGTLQNLRHLDAGNNHLVGTIRELIRIEGCFPALRNLYLNNNYFTGGIPAQLANLTSLEILYLSYNKMSGVIPSTVAHIPKLTYLINYRRKVIENHKMSKVRKVVKVDLGESKVLGKDKWWNGKKIKKFVPRVIEEKVLVIWIKISKKDENYFYKLFKDGYLDHNQFSGRIPEPFYKHPFLKEMYIEGNAFRPGVNPIGFHKVLEVSDGDFLV

SEQ ID NO: 152239 - protein, 97 aa, Glycine max
  Coding DNA Sequence Number=SeqID_35461
RDKFCECYVCNILLVFNYIYYLIINYQVRTLDPKAVNDENCTGNTSDGGNNTCNSPSLSLSWGIRRCKNLVKCRLGEEQDESEEEAKRATVLFPNKK

SEQ ID NO: 152240 - protein, 286 aa, Glycine max
  Coding DNA Sequence Number=SeqID_35462
  Gene Ontology: Mol. function=protein binding; Cellular component =membrane; Biological process=protein transport
  Homolog annotation: Hit_ID=Q9LMG8; Match level="QueryCoverage=99%, HitCoverage=99%, E-value=6e-91, Identity=62%"; Hit description =Putative SNAP25 homologous protein SNAP30
  Pfam annotation: Domain name=SNARE; Domain location=227-286; Score =57.1; E_value=5.7e-14; Accession=PF05739.9; Description=SNARE domain
MFGFRKAPAPTESDKKTTLTAEKRTTSEPVLPVAKSKGNYFDDDDDDWGRKPSSSTASKDKDRYKNGFSNSGGLENQSVQELENYAVYKSEETTNSVNNCLRIAEDIRGDATRTLDMLHQQGEQITRTHNMVVDTEKDLSRPCVPSVGEKLLNNLGGMFSKPWKPKKTREIQGPIITPDKPSKKNVHNKEDREKLGLAPLPKGRSAPTTPPNESSNAYQKVEHEKAKQDDALEDLSGILGDLKGMAIGMGSELDKQNKALDHLGDDVDELNSRVKGANQRARKLVG

SEQ ID NO: 152241 - protein, 83 aa, Glycine max
  Coding DNA Sequence Number=SeqID_35463
MVVVGVGDGCPPCPRCWWWLSSKHWLHKRNIMDELGIYFGHVLVNEQLNEVVNDTMIEDFPIVEDDTIVNVNGIVEVDEDVTY

SEQ ID NO: 152242 - protein, 83 aa, Glycine max
  Coding DNA Sequence Number=SeqID_35464
MEMVLWGSFEENMVGGVGHEDPMSFINMEPPKDKDISIYGFWSVSEVKLGSFLAPCRIFPRIAPEKLQCLYMHDDMQYVRGHN

SEQ ID NO: 152243 - protein, 82 aa, Glycine max
  Coding DNA Sequence Number=SeqID_35465
  Homolog annotation: Hit_ID=Q9C507; Match level="QueryCoverage=68%, HitCoverage=7%, E-value=2e-09, Identity=50%"; Hit description=PPR -repeat protein, putative
MAKQILGRRQQKILMTDVIHPPMYSTPIKQSTPYASIYRLTCRLNYLISSTDIANMAYKINYRGKMFCIKHYAMLDQVASIT

SEQ ID NO: 152244 - protein, 1081 aa, Glycine max
  Coding DNA Sequence Number=SeqID_35466
  Homolog annotation: Hit_ID=Q2QN61; Match level="QueryCoverage=99%, HitCoverage=99%, E-value=5e-18, Identity=28%"; Hit description =Expressed protein
  Pfam annotation: Domain name=DUF863; Domain location=148-1071; Score =324.8; E_value=1.6e-94; Accession=PF05904.2; Description=Plant protein of unknown function (DUF863)
MGTKVQNLPGYNSMRDLNEESSSCGWPLFYGDKSLTNGQYYNNYLPSSTTDACSAYDKDVVKQMMLEHEAVFKNQVYELHRLYRIQRDLMNEVKRKEIHRNKIPVEASFSAGHMTSQLTTEDGQKWHISGFPVGNSTCAKTSVSGVEVIHSPLGSMKGIGKQTSPFPSPNGCSSSKDVEVLESRPSKLRRKMFDLHLPADEYIDTEESEKLSDEKTSDPSFFLPDRNCKNGKDGDAKLFCGNGEKTGSQEDTSRSEQSLRRRNGLADLNEPVPVEETYNSPYVPLLNRNPCQGATEYSDISAATKQKLEFFGLSREQLLNSHGTDSWARSNGHLENNGGGKGWHQSMAESGQAKSNTQPVPQVLKSPLSSQTMQDALSKVHKPTSDYLNGRNKADMWREKTVSDLHISERNHEYSINKQPESVIPLHRPGLFAAAPSSDFSKSWSHSASSWEMANSSLSQKLISIQTPPCINASGALSRSSQSHQINGILEECWPLNINSKPNQGFRSDAPIQNGFYPGSSSGSKEPSMNISSISYDYLNHKNDCKIIPDHFINNVSSKSCKGSDSNCNDMTSGKDFDLNVLLPNGSSNSLVPQSGVRIIDGEKNNEERHAVLPWLRGKTTCKNGEHNTAGESRLFHDASLSNKDETGKGPSRKFMHNITSILCSNDIEARRKELNESSSNKKILGVPIFDMAHISPKKELSSITSLSVSNPNPSDVEAAGNKKKRIFDMNLPCDAAVVELDKEAFTETAVGKTRSPTTEADSRNQIDLNLSMSEDEGSFTTIPSDNVKMKAQIDLEAPALPETEEDAVLEEKLLETSLASLQVPQDTVELAKDELMTNAAEAIVVLSSLTCDQGDDCVISKSPSESPKVDLLNWFADVVSSCKDNVEGNCDVSREKDGEDNEGHSSEGMDYFEAMTLNMPETKEEDYMPKPLLPENFKLEETTTLLPTRTRKGPARRARQRRDFQRDILPGLASLSRHEVTEDLQTFGGLMRATGYQWNSGLTRRSSSRNGGGRGRRRVQVAPSPLTLVATNETSTPLIQQLNNIEVGLEDRSLTSWGKTTRRPRRQRCPAGNPPLIQLT

SEQ ID NO: 152245 - protein, 327 aa, Glycine max
  Coding DNA Sequence Number=SeqID_35467
  Gene Ontology: Mol. function=nuclease activity; Biological process =response to DNA damage stimulus
  Homolog annotation: Hit_ID=Q2G5F9; Match level="QueryCoverage=28%, HitCoverage=69%, E-value=4e-08, Identity=37%"; Hit description =Hemimethylated DNA-binding region protein
  Pfam annotation: Domain name=UVR; Domain location=150-185; Score =28.8; E_value=1.9e-05; Accession=PF02151.9; Description=UvrBuvrC motif
  Pfam annotation: Domain name=YccV-like; Domain location=200-307; Score=165.7; E_value=1.2e-46; Accession=PF08755.1; Description =Hemimethylated DNA-binding protein YccV lik
  Pfam module annotation: Pfam domain module=UVR::YccV-like; Domain location=150-185::200-307
  Subcellular localization annotation: CTP_CleavageSite=63; ConfidenceScore=5.44e-01
MVQVVSLSTLATCGNSRLCGSSPSWMAPFEPYKRSQITSSNGRHLVWNNSVQSLFLTRHSDFRAEAAWMFRGGEQGLDASSEHSESANEDILMFFFQLDLATRVQYALNMEQYDIAKQLRNKLAEVEEEVIKQQQSKRGLSSKGEAQDKAISIIRLRSDLQKAIENEDYALAAELRDEISKLEAESLAASATALAHENAQYAFRLGQKVRHKKFGYRAVICGMDPVCSESSSWMENAQVKKLSRGSAQPFYQVLVDVHAEPNLLVAYVPEENLLTPDKPDTGRFDHPYISFLFYGMDSAGDFIPIKQLREKYNKPRHEIPIDPPNDE

SEQ ID NO: 152246 - protein, 56 aa, Glycine max
  Coding DNA Sequence Number=SeqID_35468
  Gene Ontology: Mol. function=hydrolase activity, hydrolyzing O -glycosyl compounds; Biological process=carbohydrate metabolic process
  Homolog annotation: Hit_ID=Q6XD74; Match level="QueryCoverage=73%, HitCoverage=14%, E-value=5e-10, Identity=76%"; Hit description=Class III chitinase
MTASQNNSQVAKDSSASGEAGSPKKILLAGISDVHCFYASSRLVISLEYWQGGLLL

SEQ ID NO: 152247 - protein, 598 aa, Glycine max
  Coding DNA Sequence Number=SeqID_35469
  Gene Ontology: Mol. function=hydrolase activity; Cellular component =intracellular; Biological process=protein amino acid phosphorylation
  Homolog annotation: Hit_ID=Q9C507; Match level="QueryCoverage=100%, HitCoverage=87%, E-value=1e-173, Identity=39%"; Hit description=PPR -repeat protein, putative
  Pfam annotation: Domain name=PPR; Domain location=169-203; Score =31.7; E_value=2.5e-06; Accession=PF01535.11; Description=PPR repeat
  Pfam annotation: Domain name=PPR; Domain location=204-238; Score=3.3; E_value=3; Accession=PF01535.11; Description=PPR repeat
  Pfam annotation: Domain name=PPR; Domain location=270-304; Score =37.3; E_value=5.1e-08; Accession=PF01535.11; Description=PPR repeat
  Pfam annotation: Domain name=PPR; Domain location=305-339; Score=0.6; E_value=6.3; Accession=PF01535.11; Description=PPR repeat
  Pfam annotation: Domain name=PPR; Domain location=372-406; Score =46.7; E_value=7.8e-11; Accession=PF01535.11; Description=PPR repeat
  Pfam annotation: Domain name=PPR; Domain location=472-506; Score =35.4; E_value=2e-07; Accession=PF01535.11; Description=PPR repeat
  Pfam annotation: Domain name=PPR; Domain location=507-541; Score =13.7; E_value=0.18; Accession=PF01535.11; Description=PPR repeat
  Pfam annotation: Domain name=PPR; Domain location=542-576; Score=9.9; E_value=0.5; Accession=PF01535.11; Description=PPR repeat
  Pfam annotation: Domain name=PPR; Domain location=65-99; Score=6.6; E_ value=1.2; Accession=PF01535.11; Description=PPR repeat
  Pfam module annotation: Pfam domain module=PPR::PPR::PPR::PPR::PPR::PP R::PPR::PPR::PPR; Domain location=169-203::204-238::270-304::305 -339::372-406::472-506::507-541::542-576::65-99
MTLYMPLFRSCSTLRSLSQLHAHLVVTGLHSDPLASTKLLESYARMGSLHSSRLVFETHPSPDSFMFGVLIKCYLWHHLFDQVVSLYHHHIQKGSRLTQNCTFLYPSVIKAISVVGGLVVGRKVHGRIVKTGLGTDHVIGTSLLGMYGELGCLSDARKVFDEIRVRDLVSWSSVVACYVENGRPREGLEMLRWMVSEGVGPDSVTMLSVAEACGKVGCLRLAKSVHGYVIRKEMAGDASLRNSLIVMYGQCSYLRGAKGMFESVSDPSTACWTSMISSCNQNGCFEEAIDAFKKMQESEVEVNAVTMISVLCCCARLGWLKEGKSVHCFILRREMDGADLDLGPALMDFYAACWKISSCEKLLCLIGNSSVVSWNTLISIYAREGLNEEAMVLFVCMLEKGLMPDSFSLASSISACAGASSVRFGQQIHGHVTKRGFADEFVQNSLMDMYSKCGFVDLAYTIFDKIWEKSIVTWNCMICGFSQNGISVEALKLFDEMCFNCMDINEVTFLSAIQACSNSGYLLKGKWIHHKLVVSGVQKDLYIDTALVDMYAKCGDLKTAQGVFNSMPEKSVVSWSAMIAAYGIHGQITAATTLFTKM

SEQ ID NO: 152248 - protein, 254 aa, Glycine max
  Coding DNA Sequence Number=SeqID_35470
MNVNKEYDALDLNGNHLAKKVALKVLTIVHHNSKVMSDRRVGWVYMMGVLLSVVIIINDDKENPRGAFVVAVELLIVIEAKVALVPLEGVGNNGGGSVEEVGKGGEQGTGFNGCKAWTSGRISDVSPEMKQLKRNDEGRPIMRLAKSSNSESESCLKGLQEDWPGRELTIIGHPLKPGQSATIHVERSNGQALVFWSGVCTEVAEEGGAVEEEGEEVAESLVAKLWISSSSLSVWDNESTKMLGSSLTTLDFEG

SEQ ID NO: 152249 - protein, 166 aa, Glycine max
  Coding DNA Sequence Number=SeqID_35471
  Gene Ontology: Mol. function=RNA-directed DNA polymerase activity; Cellular component=chromatin; Biological process=RNA-dependent DNA replication
  Homolog annotation: Hit_ID=Q8H7X6; Match level="QueryCoverage=94%, HitCoverage=17%, E-value=8e-27, Identity=40%"; Hit description =Putative retroelement
VEWHHLELIVTMMSLKGSFTDIVLMHEDLTETILDRYGIQCMVAHTEASCVVMLLNQQNRGGERAGTRADKSFLQHEVYLGFNLLFLKMGVPLQPHINGFRIGDKKNLGRGRLGQRKLCRGNGNVKICIDVLCVDDVMKLWWSKHLKCRVNFAFELHEMVIMEKLH

SEQ ID NO: 152250 - protein, 65 aa, Glycine max
  Coding DNA Sequence Number=SeqID_35472
  Homolog annotation: Hit_ID=Q10RP7; Match level="QueryCoverage=87%, HitCoverage=14%, E-value=5e-07, Identity=46%"; Hit description=Appr -1-p processing enzyme family protein, expressed
MAGQPDLGWMRRLQQILGRKHQHNLHAIYVLHPTLGLKLTVLALQLLVDNMVRYESDFINRFKPI

SEQ ID NO: 152251 - protein, 295 aa, Glycine max
  Coding DNA Sequence Number=SeqID_35473
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=90%, HitCoverage=88%, E-value=1e-133, Identity=85%"; Hit description =Class III chitinase
  Pfam annotation: Domain name=Glyco_hydro_18; Domain location=25-283; Score=178.3; E_value=1.9e-50; Accession=PF00704.18; Description =Glycosyl hydrolases family 18
MANLATSLSFFTLALLALASGSNAGSIAIYWGQNGNEGTLAETCATGNYEYAILAFLPTFGNGQTPMINLAGHCDPYSNECTKLSSDIKSCQAKGIKVLLSLGGGAGSYFLASPQDARQVATYLWNNFLGGSSPSRPLGPAVLDGIDFDIEGGSNLYWDDLARYLKGYSNKGRKVYLTAAPQCPFPDAWIGNALKTGLFDNVWVQFYNNPPCQYSSEVTNLEDAWKQWTSDISANKIFLGLPASTEAAGSGFIDVNDLTSKVLPAIKGSSKYGGVMLWSRYYDGQSGYSSSIKSH

SEQ ID NO: 152252 - protein, 459 aa, Glycine max
  Coding DNA Sequence Number=SeqID_35474
  Homolog annotation: Hit_ID=Q10RP7; Match level="QueryCoverage=95%, HitCoverage=69%, E-value=4e-66, Identity=54%"; Hit description=Appr -1-p processing enzyme family protein, expressed
  Pfam annotation: Domain name=A1pp; Domain location=100-212; Score =143.3; E_value=6.7e-40; Accession=PF01661.11; Description=Appr-1"-p processing enzyme family
MYGPVATSDSATSRGGLPNDCGDSVVTLDQVPRWIDAEHSLQYDNGDSSFSSSYFPDPLAFKLGTESGGGVSRFPVDHEVNSKIYLWRGNPWNLEVDAVVNSTNEVLDEALSSPGLHAAAGPGLAEECATLGGCRTGMAKVTNAYDLPARKVIHTVGPKYASKYQTAAENALSHCYRSCLELLIDHGLKSIAMGCIYTEAKNYPREPAAHVAIRTVRRFLEKQKDNITAVVFCTTSTTDTEIYKRLLPLYFPRDKQEEEMALSKLPADVGDENGETVIDERKIRIKPLPQKKVSKESKPAKAPVDLPVSDVGSVRRTSSHLDTYLDPAFMSLIKDPDERRMEQWEKTVQAQRGWNFANVLGFGDLGGPPLSAAEEYSLHSRYLSKAKSLNLSEIAEMKIIYRGGVDSEGRPVMVVVGAHFLLRCLDLERFVLYVVKEFELIMQKPYTIVYFHSASSLQM

SEQ ID NO: 152253 - protein, 267 aa, Glycine max
  Coding DNA Sequence Number=SeqID_35475
  Gene Ontology: Mol. function=protein binding; Cellular component =protein complex; Biological process=anti-apoptosis
  Homolog annotation: Hit_ID=Q9ZQ79; Match level="QueryCoverage=99%, HitCoverage=99%, E-value=4e-87, Identity=63%"; Hit description =Putative ankyrin
  Pfam annotation: Domain name=Ank; Domain location=119-151; Score =32.0; E_value=2.1e-06; Accession=PF00023.20; Description=Ankyrin repeat
  Pfam annotation: Domain name=Ank; Domain location=152-184; Score =37.3; E_value=5.2e-08; Accession=PF00023.20; Description=Ankyrin repeat
  Pfam annotation: Domain name=Ank; Domain location=185-241; Score =23.2; E_value=0.00092; Accession=PF00023.20; Description=Ankyrin repeat
  Pfam annotation: Domain name=Ank; Domain location=50-82; Score=22.0; E_value=0.0022; Accession=PF00023.20; Description=Ankyrin repeat
  Pfam annotation: Domain name=Ank; Domain location=86-118; Score=41.2; E_value=3.6e-09; Accession=PF00023.20; Description=Ankyrin repeat
  Pfam module annotation: Pfam domain module=Ank::Ank::Ank::Ank::Ank; Domain location=119-151::152-184::185-241::50-82::86-118
MEMEVDIEKKQQDVVKEKDLFKAAEEGEASTFEALSSEILSKALSLRNEDARSLLHVAASSGHSQVVKIVLSCDASAGVVNCADEEGWAPLHSAASIGSVEIVETLLSKGADVNLKNNGGRAALHYAASKGWVKIAEMLISHDAKINIKDKVGCTPLHRAASTGKSELCELLIEEGAEVDAVDRAGQTPLMNAVICYNKEMHRGAWRVTLTANSCAESANECFGVALLLIRHGADVDVEDKEGYTVLGRATHEFRPILIDAAKAMLE

SEQ ID NO: 152254 - protein, 90 aa, Glycine max
  Coding DNA Sequence Number=SeqID_35476
GIEGVAEVDAGVGATEVEGSSDGLALTFLAPRIETVNDRAQALEGKAVRDNPSGFANNAVIRAGNPSLEVLDWAIEVIWPEISAPMFISK

SEQ ID NO: 152255 - protein, 236 aa, Glycine max
  Coding DNA Sequence Number=SeqID_35477
  Gene Ontology: Mol. function=signal transducer activity; Cellular component=membrane; Biological process=signal transduction
  Homolog annotation: Hit_ID=Q8G0N2; Match level="QueryCoverage=99%, HitCoverage=89%, E-value=1e-104, Identity=81%"; Hit description =GGDEF domain protein
  Pfam annotation: Domain name=GGDEF; Domain location=52-209; Score =190.1; E_value=5.3e-54; Accession=PF00990.12; Description=GGDEF domain
AFSAGATPGIIALSLSAGIPAATAFPSLAYIFHQHGKLKDAYLQLERAHVELQARSRIDHMTGLLNREALFEAMKISRSRIETGTLLVIDADHFKAINDTFGHGVGDRALKLIAFALQNVTRKGDLVGRIGGEEFCVFLPGASGETGMRVAQRIRAEVENTPFHTTEYQVYPLTISIGVASAPKNETNSQVLSRADRCLYMAKQRGRNCVVFDEESGRLASASIVSIASVREVARG

SEQ ID NO: 152256 - protein, 193 aa, Glycine max
  Coding DNA Sequence Number=SeqID_35478
  Gene Ontology: Mol. function=transcription factor activity; Biological process=regulation of transcription, DNA-dependent
  Homolog annotation: Hit_ID=Q9I461; Match level="QueryCoverage=90%, HitCoverage=94%, E-value=3e-40, Identity=48%"; Hit description =Probable transcriptional regulator
  Pfam annotation: Domain name=TetR_N; Domain location=20-66; Score =46.1; E_value=1.2e-10; Accession=PF00440.13; Description=Bacterial regulatory proteins, tetR family
MESKKLQKTVRPRSIDRDHVLDMPEKLFEEAGILALTMDAVAQAAGVTKGGVQYCFGNKDGLMKAMIERLGDRFDDQVAARKRHKNDAISHIAAHIAVTRESDADDDSRFAAMMASLIPNSHYLEETRAWYRRQWDGLDVSTPEGRRARLAFIANEGAFWLRSFNLFELTQKEWQSIFDDIEELLGEHSKGRE

SEQ ID NO: 152257 - protein, 79 aa, Glycine max
  Coding DNA Sequence Number=SeqID_35479
MKNKRRMDEEWQKTFTDLLTETSRKRYRSTSAWIFFTETIFSPKTAEMHSIGEKGGGGCSPARPGELNSPNELDDFLFK

SEQ ID NO: 152258 - protein, 224 aa, Glycine max
  Coding DNA Sequence Number=SeqID_35480
VRVRGHLIKFDADTLNTFLKTPVVIEEEESLPAYSRFANLRPVPQELAARLCLPWRGFELNADGLPLKILRKNLTTLAQTWSVLSFSNLAPTSHTSNITLDRAKLIYGLVMKMDMNLGSLISGQISLIAQHDSSRLGFPALITALCMARGVTSDSLTFESLSPAINLAYIKKNCWNLDDPSVTFRGTHKFRARGSKAPSTSAPHTSTPSTFPLPSPPATPVLPM

SEQ ID NO: 152259 - protein, 186 aa, Glycine max
  Coding DNA Sequence Number=SeqID_35481
VWHCTNSCVKLQKYSSFDDQSGEKPLLLPIRSLKSRLSEEDIDVQSLNMSMSSKRFSSYSNRKAEVEAVDVDVDADVQYLNRSTTFKSFSINSNRNAEVEADGVDTDVQSLNRSTISQGFSSNSNRRAEVIMLSSNTYVIMLSSNAEDSVRKKGFYKSCPPPPPPPPPTMFQKSMFMKPRFDGSSN

SEQ ID NO: 152260 - protein, 160 aa, Glycine max
  Coding DNA Sequence Number=SeqID_35482
MDNLLMQFKETTKSTQRAFQSAEIQVGELAEEVTQFMARREEDFVEVEAQEENPIKEHESREKDEEKDEEQAQQQWEKYSIVENQQECIFQIINLPHQLIVKKGRQGEHEETLSAILSLITNTSPTMIWNVLSEYMKFMEFLAKRRNCKEDVFCVTFMPP

SEQ ID NO: 152261 - protein, 532 aa, Glycine max
  Coding DNA Sequence Number=SeqID_35483
  Gene Ontology: Mol. function=chitin binding; Cellular component =extracellular region; Biological process=chitin metabolic process
  Homolog annotation: Hit_ID=UPI00006A17C9; Match level="QueryCoverage =69%, HitCoverage=100%, E-value=2e-44, Identity=31%"; Hit description= UPI00006A17C9 related cluster
GLYALAFRGLHILASKRMYILTFRGLHILDSRGPHVLTFRGLHVLAFRGLYVLTFRGLHVLSSRGLGLYILAFRGLHVPTFRGLNVLAFKGLHVLAFRGLYILAFRGLHILAFRGLYILALRGLHVLALRGLHILTSRGMHVLAFRGLHVLASEGYTGLYILASRGLYVLALRGLYILALRGLHVLALRGLHVLTSRGLHILAFKGLHVLASEGYTSSPPEGSTSLPPEGLHILAFRGLHILAFRGLLVLAFRGLYVLAFKGLHVIAFRGLHVLASIGLHVPASRGLHVLASRGLHILAFTGLCVLAFRGLHILASRGLHVLAFRGLATRPRLRGLHVLAFRGLYFFAFRGLHVLAFRGLYVLAFRGLHILAFRELKFLGHPPDLGGGLTVRAQPEEETATGRRVWIMRTNTWIMLLLSNILPSDNNSDLLLPKWIVPPRHPVVPEKSNRALGFPALITGLCQFYEVSVSPNKVIRPLINRAFIKKYCAPRLAQAGDRRTAATSRVHLSSSTKAGALPTTHGRPPGGQPMGA

SEQ ID NO: 152262 - protein, 56 aa, Glycine max
  Coding DNA Sequence Number=SeqID_35484
  Gene Ontology: Mol. function=nucleic acid binding
  Homolog annotation: Hit_ID=Q0PEL6; Match level="QueryCoverage=89%, HitCoverage=3%, E-value=1e-10, Identity=58%"; Hit description =Putative integrase
MTGDASKFTHISPKKNGHVTYGDNNKGRILGVGKIGLKHNLLSVSQLCDKGLSSII

SEQ ID NO: 152263 - protein, 274 aa, Glycine max
  Coding DNA Sequence Number=SeqID_35485
  Homolog annotation: Hit_ID=Q2HSE9; Match level="QueryCoverage=63%, HitCoverage=40%, E-value=1e-45, Identity=54%"; Hit description =Pollen Ole e 1 allergen and extensin
  Pfam annotation: Domain name=DUF1210; Domain location=30-256; Score= -36.4; E_value=0.005; Accession=PF06735.2; Description=Protein of unknown function (DUF1210)
  Pfam annotation: Domain name=Pollen_Ole_e_I; Domain location=30-152; Score=19.5; E_value=1.5e-06; Accession=PF01190.8; Description=Pollen proteins Ole e I family
  Pfam module annotation: Pfam domain module=DUF1210::Pollen_Ole_e_I; Domain location=30-256::30-152
  Subcellular localization annotation: CTP_CleavageSite=52; ConfidenceScore=5.06e-01
MYWFLVLFLNLTYGSVLDASHGKTLPSTVVVGTVYCDTCFQHTFSTRSHFISGALVAVECKVGDSVPSFNKEVKTNEHGEFKVEVPLKVWKHAKRIKGCTFKLISSSEPHCSVASVATSSSVSLKTREQGELIFSAGLFSFKPTKKPNFCNHKQSVPNSKAHVKNEFPPNTNPSTLDKKSAEDTFFPFPPIPFLPPIPFLPPLPFPFPPFPFPFPPLSPPPTPTPVLPPTPLPAPLNPPLPAPLSPPPLPPLSPPPYTSPWPQLSSPLRIPNRV

SEQ ID NO: 152264 - protein, 42 aa, Glycine max
  Coding DNA Sequence Number=SeqID_35486
MATEAKMAHLHVAIESLQAVMLIDDFMHSKGYFMEPPNFNTN

SEQ ID NO: 152265 - protein, 68 aa, Glycine max
  Coding DNA Sequence Number=SeqID_35487
MAATSHFECVVPILVSTVVLAEFPKLVEFVVAACEKGITTTNFGGSCLGALNVFLQNEQQEVLAKWPC

SEQ ID NO: 152266 - protein, 86 aa, Glycine max
  Coding DNA Sequence Number=SeqID_35488
MTNLSFCAKYATLLTVLNFVFSSFRDTFVSELHIEGQKWLFTPLYLVGLVVLEVMLEGEMGVGVGMEVEELGMGMEGEKGLGKMYL

SEQ ID NO: 152267 - protein, 73 aa, Glycine max
  Coding DNA Sequence Number=SeqID_35489
MECFMLVLVGFLDNVNGGVEFGYQQNGIEEARRGRKTERGFSTSRSWMCLLESLGKMKETLKEGKRAKQGERN

SEQ ID NO: 152268 - protein, 99 aa, Glycine max
  Coding DNA Sequence Number=SeqID_35490
MEDVGELNTLVRYLERLGETREKLVLLFLNKRKNNEFWDLVKKTKENGVAKRKEIEGKWLVVVVAGDAPKFTRSISISSLYLAFLNEATDKVRAKIGSL

SEQ ID NO: 152269 - protein, 106 aa, Glycine max
  Coding DNA Sequence Number=SeqID_35491
MAWGYLDVGRNGVGAGRSGFGGRNGFGGRNGIGGRNGIGGNWIGGRKGIGGRNGIGGKGKKVSSVDFSSNVEGCLNENNPAENMRSPCFIALRFTEEEVSTEATEQ

SEQ ID NO: 152270 - protein, 68 aa, Glycine max
  Coding DNA Sequence Number=SeqID_35492
MEILESCVKVVEKTSTNIWSRRGKATIGPQVRTSKSILKNASNVEVAMSSDKDIRNRTDKENISPNTN

SEQ ID NO: 152271 - protein, 313 aa, Glycine max
  Coding DNA Sequence Number=SeqID_35493
  Gene Ontology: Mol. function=methyltransferase activity; Cellular component=cytosol
  Homolog annotation: Hit_ID=P75782; Match level="QueryCoverage=94%, HitCoverage=96%, E-value=8e-87, Identity=54%"; Hit description =UPF0049 protein ybiN
  Pfam annotation: Domain name=Methyltransf_10; Domain location=9-303; Score=536.4; E_value=3e-158; Accession=PF05971.2; Description =Protein of unknown function (DUF890)
  Pfam annotation: Domain name=Methyltransf_12; Domain location=115 -221; Score=13.1; E_value=0.03; Accession=PF08242.2; Description =Methyltransferase domain
  Pfam module annotation: Pfam domain module=Methyltransf _10::Methyltransf_12; Domain location=9-303::115-221
MSGESMNKPAATALFHPRNRHQGRYDFAALTAAHPPLADKVRPNGYGELSVDFADPHAVLLLNQALLKLFYNLNWQLPEGYLTPPVPGRADYIHALADLLASDNGGVLPRDLDVMDIGCGANCIYPLIGHAEYGWRFTGTDISADAVNAASQIVASNPGLQRAIRLRRQKQESAIFTGVVHKNERYHAVLCNPPFHASAADAAAGSQRKVRNLGLSRQAPLNFGGQHNELWCDGGERAFIGRMIDESVALGDRIVWFTSLVSRKEHLPELRDRLKAQDAYQVRIVDMAQGQKQSRFIAWTFLPPATRAQRLAR

SEQ ID NO: 152272 - protein, 140 aa, Glycine max
  Coding DNA Sequence Number=SeqID_35494
AEFDIPEESDVRTKKKILKTVGKRWRQFMSDLTSKWALAKSTTLARRNEPNYDVRKKAQAIQKQNIAPHVLSHGGYEYLEKKLMDEKKKKKLEEVAQSGSTDTVIDPPSPIKRHVKWKLARTKKIDHMTFKVAKETADKI

SEQ ID NO: 152273 - protein, 78 aa, Glycine max
  Coding DNA Sequence Number=SeqID_35495
  Gene Ontology: Mol. function=RNA-directed DNA polymerase activity; Cellular component=chromatin; Biological process=RNA-dependent DNA replication
MAPYEALYGKRCRTPLHWLEPQEDLTLGLEVMRTAESRQKNYQDKRRKDLEFKPIIAQSTRPTREIMKDVIHGMNAEI

SEQ ID NO: 152274 - protein, 68 aa, Glycine max
  Coding DNA Sequence Number=SeqID_35496
MFSTGFFADGENAYSFGSSGFYSLFFDNDNILRLLYDGLEVSAMTSPIHGWHLGKLIRTQCMLDGVVK

SEQ ID NO: 152275 - protein, 51 aa, Glycine max
  Coding DNA Sequence Number=SeqID_35497
MKPPRKHATFKESSASYEICKLTGTMTYDAQQIHFFEMADRSRQGRPHYAY

SEQ ID NO: 152276 - protein, 205 aa, Glycine max
  Coding DNA Sequence Number=SeqID_35498
  Homolog annotation: Hit_ID=Q8TGM5; Match level="QueryCoverage=17%, HitCoverage=53%, E-value=3e-07, Identity=77%"; Hit description =Uncharacterized protein ART3
SGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAERRGGRAHGAPWSSPPSTT

SEQ ID NO: 152277 - protein, 72 aa, Glycine max
  Coding DNA Sequence Number=SeqID_35499
  Subcellular localization annotation: CTP_CleavageSite=41; ConfidenceScore=5.27e-01
MGSKWTLRKSRPSKNGPPLKVWEILGVSIASSSPNSLLMVRQSVFPEPQSVVGFDSKNPCAFLMVPPFEGFN

SEQ ID NO: 152278 - protein, 157 aa, Glycine max
  Coding DNA Sequence Number=SeqID_35500
  Homolog annotation: Hit_ID=Q09JM0; Match level="QueryCoverage=36%, HitCoverage=98%, E-value=1e-10, Identity=63%"; Hit description=10 kDa putative secreted protein
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHGIGLKFLNRDVAADGNVRESGDVGGGPGK

SEQ ID NO: 152279 - protein, 195 aa, Glycine max
  Coding DNA Sequence Number=SeqID_35501
MVKTRELGRALARVMGRALGREDHHDLDDVLQRRRPTTSARRQREAAPIAEDDPMLTEDVHAHAEEVVDDVEGFPSGLCDPSVLTDYGDHVVVIVWNEEFSSHGRKVQKFGRPVPKIEGLVAALEARMRHLSGVSRVGSALDTHSGPTSVRRGVRCFRRHRTRLDAGRARLDATHQVDMHDWTRPNKPQPLFLFI

SEQ ID NO: 152280 - protein, 109 aa, Glycine max
  Coding DNA Sequence Number=SeqID_35502
MAGNGQQTHRHHLQSPSAHLQRLERCLRPMADQQATKSKAKGSKIPWIRMSFDDNKDDHKKLKSQDHFMITKMMTFKNEFKIESRTLQGSRGNLISRIKNQDSIFKIQE

SEQ ID NO: 152281 - protein, 132 aa, Glycine max
  Coding DNA Sequence Number=SeqID_35503
  Gene Ontology: Mol. function=actin binding; Biological process =cytoskeleton organization and biogenesis
  Pfam annotation: Domain name=Transposase_21; Domain location=50-130; Score=-93.7; E_value=1.3e-06; Accession=PF02992.5; Description =Transposase family tnp2
MSLKKCTTAPCVGYHGTKVKDDDECSNDESIKKGPLAKVQASVASADDTKNLTWHADGKNYDKMLYHLTYSSHWKKINSIYLEFGKERKYMMLSMMISGPRQPRNDIDVYLNPLIEDLTKLCDEEVVVFDGY

SEQ ID NO: 152282 - protein, 296 aa, Glycine max
  Coding DNA Sequence Number=SeqID_35504
  Gene Ontology: Mol. function=glutamate synthase (NADPH) activity; Cellular component=membrane; Biological process=nitrogen compound metabolic process
  Homolog annotation: Hit_ID=Q1GXP0; Match level="QueryCoverage=100%, HitCoverage=15%, E-value=1e-109, Identity=71%"; Hit description =Glutamate synthase
  Pfam annotation: Domain name=Glu_synthase; Domain location=85-296; Score=34.8; E_value=2.4e-17; Accession=PF01645.7; Description =Conserved region in glutamate synthase
MHAERKRRPAALRDILALPCDLTHVDSEAEFGRKLGRYSLVNNGFAIRGLRCEAVNGSLNQFELRLIDAIAGLKPESERLAALSRALKTRFNDEIESSSITEGVLHITAYGQAADYLAKIFTALPSLPLEEVQPAHEITRTFASGAMSHGALVAPAHEAVAHGTNMVGGMSNCGEGGEHYSRHGTIRASRIKQLASGRFGVWAAYLADPMLEELEIKIGQGAKPGEGGQLPAPKVTVEIAAARGGTPGVELVSPPPHHDTYSIEDLAQLIHDCKAARVRVIVKLVSSERIGTIAVG

SEQ ID NO: 152283 - protein, 90 aa, Glycine max
  Coding DNA Sequence Number=SeqID_35505
MVFGTGCGARPRGRSGLMFHCQTREQKPQGKGQNAMQGEWLRDLQLKEQKEKRREKEKKKKEKLRLHRIEPWIVSYILSLASLIPCATVD

SEQ ID NO: 152284 - protein, 129 aa, Glycine max
  Coding DNA Sequence Number=SeqID_35506
MDTTSKLIIICTIHIVNCWHQHRIGTRKDVTSNWKIRAISKKMHSRIGAQRERGSDFAKGQRRSRRGEIDSELPPWRKGNATVQDSVAEKGKCPLRIQKESSRVFDGGFAKDSERGLEGFGERIMNFVS

SEQ ID NO: 152285 - protein, 180 aa, Glycine max
  Coding DNA Sequence Number=SeqID_35507
  Homolog annotation: Hit_ID=O21999; Match level="QueryCoverage=37%, HitCoverage=44%, E-value=5e-22, Identity=75%"; Hit description=LacZ -alpha
RVPFAIQAAQLLGRAIGAGLFAITPAGERGMCCKAIKLGNARVFPVTTLNSIRWHHREECQHLRRGCGCLVKRARVRTPGNTNTGGTSRSRISDQEQASAPGAEDQAYRYRRPRGGARYQLLFPLVRVNFELGVIMVIAVSFGKPVVPAALMNRPTRGERRFAYWALAECILAYYVGTDE

SEQ ID NO: 152286 - protein, 268 aa, Glycine max
  Coding DNA Sequence Number=SeqID_35508
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q9TKI7; Match level="QueryCoverage=99%, HitCoverage=65%, E-value=1e-133, Identity=79%"; Hit description=ATP synthase subunit beta
  Pfam annotation: Domain name=ATP-synt_ab; Domain location=112-268; Score=168.2; E_value=2.1e-47; Accession=PF00006.15; Description=ATP synthase alphabeta family, nucleotide-binding domain
  Pfam annotation: Domain name=ATP-synt_ab_N; Domain location=1-56; Score=44.3; E_value=4.1e-10; Accession=PF02874.13; Description=ATP synthase alphabeta family, beta-barrel domain
  Pfam module annotation: Pfam domain module=ATP-synt_ab::ATP-synt_ab _N; Domain location=112-268::1-56
MPNIYNALIVKGRDTVGQQINVTCEVQQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPTRRGGKIGLFGGAGVESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAK

SEQ ID NO: 152287 - protein, 102 aa, Glycine max
  Coding DNA Sequence Number=SeqID_35509
IAPARHPVDPKKSNRVLELSSSKYGSLSVQGSACCPQQGHQAPYQSSFHLEVLRPQAGAGRDTTAALGWTVAGNRHTAITTKVHLSSSIKRLERCLRHMADQ

SEQ ID NO: 152288 - protein, 58 aa, Glycine max
  Coding DNA Sequence Number=SeqID_35510
MPQNFTNCPMMGAKYLKVVKRGSHPNNGSSPDEIRACLVAVLGMAFVDDWVVEMILVE

SEQ ID NO: 152289 - protein, 71 aa, Glycine max
  Coding DNA Sequence Number=SeqID_35511
  Subcellular localization annotation: CTP_CleavageSite=51; ConfidenceScore=5.41e-01
MSLPNAVHVSPLSSAKLLVTGKHVILLFSRSVPSPKEKKKEWRRESSSQKRAGRTKSVSYLCFLLSPMRGK

SEQ ID NO: 152290 - protein, 116 aa, Glycine max
  Coding DNA Sequence Number=SeqID_35512
MLGFTCDSPQISASLHQLDLAPYASGPYHAQWNAPGLLHDKHTLRSSRILREMEVDEPWLGLWLTLNYQVDMGARIAFVDNWAVGKDKEWQSQHGLLLHPHPLHLPQFSHSSKQDD

SEQ ID NO: 152291 - protein, 128 aa, Glycine max
  Coding DNA Sequence Number=SeqID_35513
MYGYWCEVENCYAKGVFGLIWGCTGSSALAIGIGGVLGSEGRVVAIDLSLLVVVAVYNDKMTQDMSQSDNFIEISANDGVGLGGLHSVAFQSTTSFSGSGSSFSNSNSAEYCRLKEEVTCLRDKLTTS

SEQ ID NO: 152292 - protein, 85 aa, Glycine max
  Coding DNA Sequence Number=SeqID_35514
  Subcellular localization annotation: CTP_CleavageSite=48; ConfidenceScore=5.77e-01
MLSNHVNFSATPLCAISGRTSPGNSSHNSSQCKKLGLTTTRPLTLMLRCSASSSSVMVHSPYGRLKEDKVQVADVSLSEAYVLNK

SEQ ID NO: 152293 - protein, 372 aa, Glycine max
  Coding DNA Sequence Number=SeqID_35515
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-44, Identity=29%"; Hit description= UPI00006A17C9 related cluster
  Subcellular localization annotation: CTP_CleavageSite=69; ConfidenceScore=5.44e-01
TTCPHLQWATGPRLQRTTRPRLKRTTHPPLLRTTRLTLQRATRPRLHRNTCPPFQRVTHLHLQKATHPRLQRATRPHLQSSTRPRLQRTTHLNLQRTTRPPHQRTTHPHFQWTTCPSLQMTTRCRLERTTRPPPLRGQHTLAFRRLHVLLFRGLHTLTFIGLHVLTFSGLHVLAVKGLHVLPVRGLHVLAFRGQHALAFRGLYALAFRGWLRVLAFRGLHVLTFRGLDALAFRALHVLAFRGLHVLPFRGLHALTFRRLHVLTFRGLHALTFRGLHVLAFRGLQALPLRRLHVLTFRGLHVLTFRGLHALALRELHVLAIRGLYALPFRGPHTLTFRGLNALAIRGQHALTIRGLHVLAFRGLHVLNFRGLH

SEQ ID NO: 152294 - protein, 121 aa, Glycine max
  Coding DNA Sequence Number=SeqID_35516
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=98%, HitCoverage=15%, E-value=3e-46, Identity=85%"; Hit description =Phosphoenolpyruvate carboxylase
MEDLAEMLEKQLASELSKMTLEEALPLARAFSHHLTLMGIAETHHRRLKLFSLLIPLKLTIVPCNINTLKLLIFWIIMIDLILALKIEICGLKIWWERKLQYGRQMNLGVHNPLQLMKLGQ

SEQ ID NO: 152295 - protein, 53 aa, Glycine max
  Coding DNA Sequence Number=SeqID_35517
MSKQNPQLRLQPPAVRSGFGDTKLRAPHPIYRVCPSQSSLNLLSEREIGSYQT

SEQ ID NO: 152296 - protein, 302 aa, Glycine max
  Coding DNA Sequence Number=SeqID_35518
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-39, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTPSPSEDDTSSPLEDCKPSPLEDYRPCLQRTTRPHLKRATRPCLQRIARPGLQRTARPRLQRATHPHLQRATRPRLYRATCRPFRGLHALAFGGLHALAFRALHALAFIGLHVLAYRGRDALVFRGLHVLAFMGLHALAFRGLHALAFRGLHTLALRGLHVFAIIGGYVLAFKGLHILIFRGLHVVTFRGLHALAFRGLHDLAFRGRLVLAFRGLHALAFRGLHVLAFRGLHVLIFRGLHVLTFRWLHPLAFTGLHVVAFRGLHALAFRGLHTLAFRALHALAFIGLDVLTVKR

SEQ ID NO: 152297 - protein, 173 aa, Glycine max
  Coding DNA Sequence Number=SeqID_35519
  Homolog annotation: Hit_ID=Q84VH5; Match level="QueryCoverage=72%, HitCoverage=18%, E-value=2e-62, Identity=96%"; Hit description =Envelope-like protein
MSKFNFGNYIFDQTVKHSESFAVKLPIAFPTVLCGILLSQHPNILNYTDSVMKRESPLSLHYKLFEGTHVPDIVSTSGKDASGAVSKDALIAELKDTCKVLEATIKATTEKKMELERLIKRLSESGIDDGEAAEEEEAAEQEEEEAEEEEEEADDEDAAEDTESDDDDSEATP

SEQ ID NO: 152298 - protein, 67 aa, Glycine max
  Coding DNA Sequence Number=SeqID_35520
MKTVQAEASISSPSLLRSRILSEQSEKKLEESKGTAVDAAIVVGRHVSPLRVDVPMRNCYEIDVFLC

SEQ ID NO: 152299 - protein, 169 aa, Glycine max
  Coding DNA Sequence Number=SeqID_35521
  Homolog annotation: Hit_ID=Q6FZ67; Match level="QueryCoverage=21%, HitCoverage=21%, E-value=4e-10, Identity=75%"; Hit description =Probable chorismate--pyruvate lyase
  Subcellular localization annotation: CTP_CleavageSite=26; ConfidenceScore=5.45e-01
MAVPSQQEKVARQNWLRPSLVARRSSAASAASAVCGVASVVSLMTVLSSFVLRLEGRGDHRIVIVPGNEDREYGWQKDDRTPVFPADRPAVFATNQPAAFAFLRYNGGLLTVCIVWRAVPAAVQARSKAMSGIRDSILPPLEWMSEQDPPAPAAVSDWLMELGSMTPPI

SEQ ID NO: 152300 - protein, 159 aa, Glycine max
  Coding DNA Sequence Number=SeqID_35522
  Gene Ontology: Mol. function=transporter activity; Cellular component= integral to membrane; Biological process=transport
  Homolog annotation: Hit_ID=UPI00005F7683; Match level="QueryCoverage =98%, HitCoverage=33%, E-value=4e-59, Identity=70%"; Hit description =COG0477: Permeases of the major facilitator superfamily
MVFGDVFFPEATPLVALLASFATYSVGFVARPIGALVFGWIGDRKGRRVVLITTVALMGISTTLIGLIPSYAQIGVWAPTCLVILRFAQGFGAGAELSGGAVMLAEYAPAKRRGLVASIIAIGSNSGTLLASLVWLLVLQLDQEDLMSWGWRIPFLASF

SEQ ID NO: 152301 - protein, 65 aa, Glycine max
  Coding DNA Sequence Number=SeqID_35523
MEGRLRSIEGGGYHSFVDMAELCLVPDVIIPSKFKEVSLVIRGVWVVKTLASQRSLSRKLLKEAS

SEQ ID NO: 152302 - protein, 78 aa, Glycine max
  Coding DNA Sequence Number=SeqID_35524
MGRPPLYESFFKGTFRMPGCFSSFHRVLGKGLVSDVVLSMNWRGAVVVLVYATALWYFFERVGYNFLSFVTKVFANKL

SEQ ID NO: 152303 - protein, 112 aa, Glycine max
  Coding DNA Sequence Number=SeqID_35525
VYGHWTYSCLPFRDMIQKTIDEEMLKFEEKPMQVDTNPFQVQANYVEPVKILMVRALIGTSKLETLFSEDEVNQALEKFKKEEEYVFPYTGDMLLEFLTKKHKAGKEVMICP

SEQ ID NO: 152304 - protein, 89 aa, Glycine max
  Coding DNA Sequence Number=SeqID_35526
  Gene Ontology: Mol. function=aspartic-type endopeptidase activity; Cellular component=riboflavin synthase complex; Biological process =proteolysis
MESQDPLEEINLGTEEDRRPLILEFKDCFAWDYDEMDGLNRDMVEHRLPIQEGRKLVKQAPRRLAPNVVEAIKEEIERLLNAKFIQTMR

SEQ ID NO: 152305 - protein, 213 aa, Glycine max
  Coding DNA Sequence Number=SeqID_35527
  Gene Ontology: Mol. function=ATP-dependent DNA helicase activity; Cellular component=intracellular; Biological process=DNA repair
  Homolog annotation: Hit_ID=Q2WWF8; Match level="QueryCoverage=98%, HitCoverage=32%, E-value=2e-49, Identity=47%"; Hit description =Similar to ATP-dependent helicase
MTPNELENKIQKELFSCVDGFNSFYFSAGAGAGKTHALIEQVACITYTNIAVSEITKRLGNSDAVMVSTIHDRLWDIIKRYQPELIICHKEKITKVIQACQHDLANEKRAQFYKELNGSEKEEFKKYVIETKGIFYRKNFLSSRDFKELYNNYEEIKKPDFFDRCIKNLENFSFVVKRIHKIDSLEVAITRINDGKIKRVNYDSNINTDMLIE

SEQ ID NO: 152306 - protein, 83 aa, Glycine max
  Coding DNA Sequence Number=SeqID_35528
MRTRSPLKARACNPLQVRTYSPLKVIGTSTQGSTFMRKQEIDSSRGQIDCPFEKGDNSCNLILSFANLSGNSLRVYVLFDLVT

SEQ ID NO: 152307 - protein, 297 aa, Glycine max
  Coding DNA Sequence Number=SeqID_35529
  Gene Ontology: Mol. function=protein binding; Cellular component =nucleus; Biological process=defense response
  Homolog annotation: Hit_ID=Q2QR00; Match level="QueryCoverage=91%, HitCoverage=34%, E-value=1e-35, Identity=34%"; Hit description=NB -ARC domain containing protein, expressed
  Pfam annotation: Domain name=LRR_1; Domain location=162-183; Score =5.9; E_value=22; Accession=PF00560.23; Description=Leucine Rich Repeat
  Pfam annotation: Domain name=LRR_1; Domain location=185-207; Score =7.3; E_value=12; Accession=PF00560.23; Description=Leucine Rich Repeat
  Pfam annotation: Domain name=LRR_1; Domain location=209-231; Score =14.9; E_value=0.29; Accession=PF00560.23; Description=Leucine Rich Repeat
  Pfam annotation: Domain name=LRR_1; Domain location=279-294; Score =0.7; E_value=2.1e+02; Accession=PF00560.23; Description=Leucine Rich Repeat
  Pfam module annotation: Pfam domain module=LRR_1::LRR_1::LRR_1::LRR _1; Domain location=162-183::185-207::209-231::279-294
MGSLAVRTLGSSLFSKFEANEWEYDYQFLSEEVAIHWGALGLLASPRKNETPENVVKQYLDELLSRSFLQDFVNFGTIYRFKMHDLVHDLALFVAKDECLVINSHIQNIPVNIRHLSFAEYNFIGNSFTSKSVAVRTIMFRNGAQGANVEALLNTCVSKFKLLRVLDLRDSTCKTLPRSIGKLKHLRYFSIENNRNIKRLTNSICKLQNLQLLNVSGCKELEALPKGLRKLISLRHLEITTKQPVLPYSEITNLIKLAHLYIASSHNMEPIFGGVKLPTLKTLNVADCHSLKSLPLD

SEQ ID NO: 152308 - protein, 88 aa, Glycine max
  Coding DNA Sequence Number=SeqID_35530
  Homolog annotation: Hit_ID=Q2QTS8; Match level="QueryCoverage=93%, HitCoverage=20%, E-value=1e-18, Identity=55%"; Hit description =Regulator of chromosome condensation, putative, expressed
MVQELMTSTLSFDRTVRTAESPTYGAWHAVVVGRDDLPKAVEALSNVNAYHVVAGDYTTFVVFDDGDVYSFGCGQSASLGHNAVGNDE

SEQ ID NO: 152309 - protein, 239 aa, Glycine max
  Coding DNA Sequence Number=SeqID_35531
MKNSRGRSMKHAHLFHCEDQRSQEHKKIVRDRLEGNSNNTFRTREIPIKRLFNVGHFTNASGDLSGYSKGKNFSAGMNVMDYDIPELVVFIQEDHQQFVKDNCIGKGVSPEGKCMSEDCALDHDIMSRHFENDMTSRRDSNLRTMEAMSINSNGPEYASKPLTLKDAMEFYDSRGLVMDGEVDSGYKISIDHLTKKTTPETLREKRVWFTGYSSLYSIFCHGQFEILENNREGLMKKHF

SEQ ID NO: 152310 - protein, 36 aa, Glycine max
  Coding DNA Sequence Number=SeqID_35532
MALSLTSRGFSIERCIVSLELDRAGLGYRMSGHGVR

SEQ ID NO: 152311 - protein, 99 aa, Glycine max
  Coding DNA Sequence Number=SeqID_35533
MVRYSNRCFFSAVEEWPRFNFVDFNVNTNSTEGIYGYWLLSKTLSDAVGEAVKAGTKKFATKNATVFGSQRVHTLVQCTPDLSSEDCREVEWFYFQAAL

SEQ ID NO: 152312 - protein, 261 aa, Glycine max
  Coding DNA Sequence Number=SeqID_35534
  Homolog annotation: Hit_ID=O21999; Match level="QueryCoverage=20%, HitCoverage=34%, E-value=7e-22, Identity=92%"; Hit description=LacZ -alpha
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIQESKLAVSLFLNLLSLLSSGKKIKVLFKQAPDVVRSRADIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152313 - protein, 246 aa, Glycine max
  Coding DNA Sequence Number=SeqID_35535
  Gene Ontology: Mol. function=oxidoreductase activity; Cellular component=mitochondrion; Biological process=arginine catabolic process to glutamate
  Homolog annotation: Hit_ID=UPI00005F8EBE; Match level="QueryCoverage =99%, HitCoverage=55%, E-value=1e-94, Identity=75%"; Hit description =COG1012: NAD-dependent aldehyde dehydrogenases
  Pfam annotation: Domain name=Aldedh; Domain location=2-243; Score= -186.8; E_value=1.1e-07; Accession=PF00171.12; Description=Aldehyde dehydrogenase family
MIGKVGISLQAYQTRTGFSQTAMADGASVLRHRPHGVLAVFGPYNFPGHLPNGHIVPALLAGNCVVFKPSELTPLTAEETLKLWLQAGLPDGVINLVQGGRETGEALAASADIDGLLFTGSAGTGYHLHRQLAGQPEKILALEMGGNNALIVDGGGRRRLYRTFGPGGGRTARRPLGCRTAAVHGRGGVGSRGGKHAERAAALAGAGRQIAAEHAPAGTGQFAAQPGHRRSDRRGPAYRTKSISAP

SEQ ID NO: 152314 - protein, 162 aa, Glycine max
  Coding DNA Sequence Number=SeqID_35536
  Gene Ontology: Mol. function=metal ion binding; Biological process =cell wall catabolic process
  Homolog annotation: Hit_ID=P0ADE6; Match level="QueryCoverage=75%, HitCoverage=83%, E-value=7e-45, Identity=69%"; Hit description =Protein ygaU
  Pfam annotation: Domain name=BON; Domain location=10-73; Score=51.3; E_value=3.2e-12; Accession=PF04972.7; Description=Transport -associated domain
  Pfam annotation: Domain name=LysM; Domain location=81-127; Score =28.2; E_value=2.9e-05; Accession=PF01476.10; Description=LysM domain
  Pfam module annotation: Pfam domain module=BON::LysM; Domain location= 10-73::81-127
TGNASAEDQGAKLKEHLNKSGLPDTDKVNVQVIDGKAVVTGDAVSQELKEKILVAVGNVAGISGVEDKVAVTQPDAESRFYTVKKGDTLSAISKEMYGNANQYNKIFEANKPMLSSPDKIYPGQRHPPVEPERPRRQRWRLILRGCFAPSNSNAAVERVKPI

SEQ ID NO: 152315 - protein, 259 aa, Glycine max
  Coding DNA Sequence Number=SeqID_35537
  Gene Ontology: Mol. function=metal ion binding; Cellular component =nucleus; Biological process=transcription from RNA polymerase II promoter
  Homolog annotation: Hit_ID=Q2V6P0; Match level="QueryCoverage=99%, HitCoverage=82%, E-value=1e-147, Identity=96%"; Hit description =Pirin-like protein
  Pfam annotation: Domain name=Pirin; Domain location=36-139; Score =158.9; E_value=1.3e-44; Accession=PF02678.6; Description=Pirin
  Pfam annotation: Domain name=Pirin_C; Domain location=190-259; Score=- 24.3; E_value=0.026; Accession=PF05726.3; Description=Pirin C -terminal region
  Pfam module annotation: Pfam domain module=Pirin::Pirin_C; Domain location=36-139::190-259
MSQSRPTLSSPARECPVVDGVRQIQRIAVRNAEVGGIPINRALPTRERRTVGAWCFLDHAGPTVFNGTSPGMDVGPHPHIGLQTFTWMIEGEVLHRDSLGSEQVIRPGQVNLMTAGRGIAHTEQSVGEQRRLHAAQLWIALPAEHADMAPRFDHYPDLPQWQNNGVNHRLLVGEFGAYRSPVFTLSPLIAIDLEWQEAARIELPLRDDYEIGFLPLIGAFELNGETFSPDEFAYLGMKNNSIGLNAQKGSRGLLIGGAP

SEQ ID NO: 152316 - protein, 158 aa, Glycine max
  Coding DNA Sequence Number=SeqID_35538
  Gene Ontology: Mol. function=helicase activity
  Homolog annotation: Hit_ID=Q1SRJ5; Match level="QueryCoverage=97%, HitCoverage=23%, E-value=6e-37, Identity=50%"; Hit description =Probable helicase [imported]-Arabidopsis thaliana-related
MAENLLLKDCTSIFQANIVLSTKTMMILMMYCLSKKKRCWHLRKKGYTIGRLLWVPPIIGKLFYLRMMLTVCKGPTSFEDLRTVDNVQYPTYREACFAMGFLQDDKEFIEAIKEAKDWGSAHYIRKLFVLLLLTATMNKPEQVWDQTWHWMADDIVYN

SEQ ID NO: 152317 - protein, 261 aa, Glycine max
  Coding DNA Sequence Number=SeqID_35539
  Homolog annotation: Hit_ID=Q3BMS9; Match level="QueryCoverage=95%, HitCoverage=9%, E-value=4e-08, Identity=28%"; Hit description =Filamentous hemagglutinin-related protein precursor
  Subcellular localization annotation: CTP_CleavageSite=42; ConfidenceScore=5.05e-01
MFSENRSLALLTYRLPPDCVVSWRVSVCTALPAPPMDCAAVSVSAGVTKRPAPCVIEPLVTLTWAELVALLSSSVRLLLFDTHRLPRMFEDSARHRAGVERQRASGDIRRAGAVAVDGAVAGQSDRAAGGGGDLVDGQRAVRRDRQCQVVGIDDVAECQARDVGRIIQRELRHAGGADGRIELLVVSHVHIASGGDRQVGRAGLGKNAAVGAQGAQADAVAGDQARAADAGGQVAVDVARGQRHRAAAGVDGVRGGSRCRC

SEQ ID NO: 152318 - protein, 305 aa, Glycine max
  Coding DNA Sequence Number=SeqID_35540
  Gene Ontology: Mol. function=RNA-directed DNA polymerase activity; Biological process=RNA-dependent DNA replication
  Homolog annotation: Hit_ID=Q8H6Q8; Match level="QueryCoverage=98%, HitCoverage=10%, E-value=7e-38, Identity=32%"; Hit description=CTV.20
MEPKYWDKNPFKATAKVFPQGFHYRPIALNKTRKFYEFILVDTNSVSIKHFKDSKDPSLNTHSTIQILKVMQPRHYGTNLNQPKKFSAPFDPAGYIYWDYIDAWTNVFWHQNNKFKHSWLIYLKNNTVYNFPNWFLQWWTYFGPIPQIFPEEVQQGFQQFNRLFNNQESRIPADLMYGKTENNKQYPPLQRHAFVKWWTQFDTSKAAPDKVKNWFQSHPEFLKPANPETSLFLNQKSQLAAFLASSKSKESLAQNLKEVLQLLQQEEEEESSKKDAGSSEDIDDLDDDPVYQNEDDCFGISLEDD

SEQ ID NO: 152319 - protein, 159 aa, Glycine max
  Coding DNA Sequence Number=SeqID_35541
  Gene Ontology: Mol. function=nucleoside-triphosphatase activity; Cellular component=membrane; Biological process=defense response
  Homolog annotation: Hit_ID=Q1SI25; Match level="QueryCoverage=98%, HitCoverage=17%, E-value=3e-47, Identity=61%"; Hit description=NB -ARC domain, putative
MATSDGGGCLLPGDSYPDWLTFNTEGSSVTFEIPQVKGRNLKKMMCHVHYSSPENITSDGLKNLLVINHTKAIIQLYKRNALVSFEDEEWQGVLSKIEPGNKVQIVVVFWSKLTVCKTTIYLIYEPMNEKIEHSHAPNKNVMDSSGDDHECVVGTISLQ

SEQ ID NO: 152320 - protein, 160 aa, Glycine max
  Coding DNA Sequence Number=SeqID_35542
MLQVNADLDMELNPQAQPWPYQAKSLNRMFGNGLMSSRPEIGNKSNTQNNAENEGFAESQGNEFIPAGFPVGPWDDSAIMSDNMTGLKRFRDEDVKPFSGLNAPESQVEYHWTKGFSYGFMEFEVASVAQSALEALIPSLEKPDLTSVFDKTDVNVNAVA

SEQ ID NO: 152321 - protein, 70 aa, Glycine max
  Coding DNA Sequence Number=SeqID_35543
MAKSNRSDTLGRSLFDQKKYMFFMIYRSWLEHERRRPTASSRRRRVHITVDEGVPQVTEDVPHMEEDVPQ

SEQ ID NO: 152322 - protein, 247 aa, Glycine max
  Coding DNA Sequence Number=SeqID_35544
  Homolog annotation: Hit_ID=Q1RUD8; Match level="QueryCoverage=66%, HitCoverage=32%, E-value=1e-15, Identity=34%"; Hit description=IMP dehydrogenase/GMP reductase
MVGTNWKSPNVKHLKGFSNSAQRCEKSSARIICCLPALCVWLVSHLFQQDTRHPCPLLSHRSCTEKRRIDWDQLLAGIGGRTISWFPRWKEGKEGVLFSCGGYPNIPLVGTRGCINYNPALAIRQLGYPMRGAPTEESMSPFLVRDFGAQNSKTIQRIHKAWETPLRKDHELRGIRNGIIGGYHEWLKLKVVSEESFEAPEEDEEVQALKSELGKAKLAEEKFKLAATHIRKECAGLREENALPQEP

SEQ ID NO: 152323 - protein, 111 aa, Glycine max
  Coding DNA Sequence Number=SeqID_35545
MGEESWSLVRNHLLKELAKFLDDYIKLFGDIDRLNELRRSLLINGLTKVTMDKWMDITEMRYVIASSYIKYMMQSYLARALDRRLQKDWAIDAREDPRVLMNLRVDFGHMG

SEQ ID NO: 152324 - protein, 35 aa, Glycine max
  Coding DNA Sequence Number=SeqID_35546
MPTSSRQLGGSSPESYTLHPAIVILLPRTMFAIIT

SEQ ID NO: 152325 - protein, 124 aa, Glycine max
  Coding DNA Sequence Number=SeqID_35547
  Pfam annotation: Domain name=zf-CCHC; Domain location=15-28; Score =7.0; E_value=0.069; Accession=PF00098.13; Description=Zinc knuckle
MDEIQLPKGKIIALKCNKVGHIKTDCPFLKKDIKRSDLKKKAMMNTWDDIDSTSSEKDEEHATNLCLMADLAKYEKYAHLKEQLSDAQKENAKLKMDNEKNHCLQESHLKLFEQLTLRRETTTK

SEQ ID NO: 152326 - protein, 190 aa, Glycine max
  Coding DNA Sequence Number=SeqID_35548
MAYHASSKANQNSMQNQEIHVGKSYSMENYQWEQKLQPYNQYVEERSSNMDNLLMQFKETTESTQRAFKSLKIQVSKLAKEVAKFVATREENFVEVEAHEESLVEEHDSREKDEEKKSILQVNTPPHQLIVKEERHGEHDKSLSVIISLTTNTSLATIWKVFPGYMNFMESLAKRQKCKEDVFYVTFMPP

SEQ ID NO: 152327 - protein, 133 aa, Glycine max
  Coding DNA Sequence Number=SeqID_35549
MVPRMSSGPPPPDDKSVGPNGSRMSSGPPPLDDKSADDHNCLCVPSDTTVSEWQKVSRMTIICLCVSSGPPPLDDKRAQNDHNLPLRAIGHDCVWMAKGERNDHNLSPHVTGPQGQYDKDCGAADKSEALALT

SEQ ID NO: 152328 - protein, 359 aa, Glycine max
  Coding DNA Sequence Number=SeqID_35550
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=0.0, Identity=97%"; Hit description=Protein ycf2
MPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHL

SEQ ID NO: 152329 - protein, 183 aa, Glycine max
  Coding DNA Sequence Number=SeqID_35551
MASKKHQASTNRPQVAESTWYSTRFTSERNIQLAYTDYDELLEELERRHWDRKLTKLPEKNINVALVKEFYANVYGFEDGSPKQCNIRFNAQTLNTFLETPEAPPTPQPVVIPLAPTTEHQSVLASSTVEPPTYWPLAPAIDHPIATTEPTDVTTKTKHVAVVEPDTTEQGLDVDYIVDVSTD

SEQ ID NO: 152330 - protein, 83 aa, Glycine max
  Coding DNA Sequence Number=SeqID_35552
  Homolog annotation: Hit_ID=Q1S3Z1; Match level="QueryCoverage=69%, HitCoverage=4%, E-value=4e-10, Identity=52%"; Hit description =Integrase, catalytic region; Zinc finger, CCHC-type
MGCSKQMLTSPLGWIASQASSTKEEMSMMVRYMNGSLKGGSRYKTTQSEDAIEGYVTANYVENMDTRKSLFQYVLILFGIATC

SEQ ID NO: 152331 - protein, 480 aa, Glycine max
  Coding DNA Sequence Number=SeqID_35553
  Gene Ontology: Mol. function=galactosyltransferase activity; Cellular component=Golgi stack; Biological process=lipid biosynthetic process
  Homolog annotation: Hit_ID=Q2HUE1; Match level="QueryCoverage=56%, HitCoverage=99%, E-value=2e-91, Identity=55%"; Hit description =Glycosyltransferase sugar-binding region containing DXD motif; Alpha 1,4-glycosyltransferase conserved region
  Pfam annotation: Domain name=Gb3_synth; Domain location=286-417; Score=203.9; E_value=3.8e-58; Accession=PF04572.3; Description=Alpha 1,4-glycosyltransferase conserved region
  Pfam annotation: Domain name=Gly_transf_sug; Domain location=191-283; Score=107.8; E_value=3.2e-29; Accession=PF04488.5; Description =Glycosyltransferase sugar-binding region containing DXD motif
  Pfam module annotation: Pfam domain module=Gb3_synth::Gly_transf_sug; Domain location=286-417::191-283
MFVHRLLKHAKLSVLPLITFSAIIFHIYADGIVYHDSLHSAANTEAPEKLEVHNHRTKGIGSTLVHIPLHSIQEKDEANSRNQKALVAPFNATEEERIAWLQGQLHNFKIFKSNNLTRQFNARVLGFLGRKCEVQFFMTWISPASLFGGRELLSVESIFKNHPKACLIILSRTLDSRHGYRILKPLLDRGFKVQATAPDLSFLVKGTPVEAWFRELRKGRKDPGEIPLSQNLSNLIRLAVLYKYGGIYIDTDFIVLKPLTGLRNSIGAQSMNLDSKHWTRLNNAVLIFDIGHQLLHRFINEFALTFDGNKWGHNGPYLVSRVIKRLGKRHDFNFTVLPPMAFYPVDWNKINGLFMKPKTQEESKWVEAKLLQLRRKTYGIHLWNKHSSRLTIEEGSIMGRLASDYCVICNKWRLREKERKWRAVRKEFGSERRKGDRWNCAIERRVEKVMLAVETPWPRITERDKVLEGGKKWRWLAIFY

SEQ ID NO: 152332 - protein, 85 aa, Glycine max
  Coding DNA Sequence Number=SeqID_35554
MYNSIIIYIGLHCSAHWQMVVILPKENVVIWFCSLHNKPDNYLKGIINRALKGLTILNKVNPSLLLGGLLLKQKGNTEYGYYVMQ

SEQ ID NO: 152333 - protein, 42 aa, Glycine max
  Coding DNA Sequence Number=SeqID_35555
MVWHHQGSKWVSSSSPSAAIAIGSSGSGSWAVEAPPPPEGEG

SEQ ID NO: 152334 - protein, 216 aa, Glycine max
  Coding DNA Sequence Number=SeqID_35556
  Gene Ontology: Mol. function=oxidoreductase activity; Biological process=electron transport
  Homolog annotation: Hit_ID=Q0Z5C6; Match level="QueryCoverage=61%, HitCoverage=57%, E-value=4e-45, Identity=69%"; Hit description =Nitroreductase
  Pfam annotation: Domain name=Nitroreductase; Domain location=2-112; Score=-26.7; E_value=0.018; Accession=PF00881.14; Description =Nitroreductase family
MALRKRQVASAQALYSALGVAREDRAGRDAQFGRNYRFFDAPVALVVSIDARFGAGGYMDLGMTLYGLQMAAAAQGLGSCAIGALASYPDTVRRVLDLPPGEHIVCGLALGWPDEAAPVNRTQTTRAPLTEYFKLCELAPTSTGHGDGTTKAQPGDTEEGPTPAAPPRTEGVVPLPREAGREGEGASALPGVSSSERRNHRPLELHIDELAHFIGG

SEQ ID NO: 152335 - protein, 127 aa, Glycine max
  Coding DNA Sequence Number=SeqID_35557
MIMRSQDIYSSQDKATTSPSSSESEEAKEEESSEEIYPQEAGKPLMVKKECKETLVSIVTPLRLEFIPQVKELLDEGLVRKSLNPCALLVPKIGVPMNPKRIKVIPEWPAPPSVLREKAQSFKNLGI

SEQ ID NO: 152336 - protein, 46 aa, Glycine max
  Coding DNA Sequence Number=SeqID_35558
MDTLEPYTGAMRGIVHKPQVPSYKVMSKDDNWYLKASHWGNEGHRA

SEQ ID NO: 152337 - protein, 103 aa, Glycine max
  Coding DNA Sequence Number=SeqID_35559
GKDGRANGFNPCGIEKSLKISEKNCFLEKNPRRGASIMLSRRFCRRSRGDSSPFLIVHHHSSFILHRSSVFNRSDFLITIEDTWKQKPRFCRPPQEIVNGPTP

SEQ ID NO: 152338 - protein, 77 aa, Glycine max
  Coding DNA Sequence Number=SeqID_35560
MYPKSSNIYITCRINYFGSKECIKYSSGCPVRKDMQSLLMFGREGMTADVVIENDDDEAKSKKDRTPKKQGKDESKK

SEQ ID NO: 152339 - protein, 128 aa, Glycine max
  Coding DNA Sequence Number=SeqID_35561
  Subcellular localization annotation: CTP_CleavageSite=25; ConfidenceScore=5.39e-01
MRAKILENVLIMSRLLRSFSRISFRSNSSSSSSSRNTNLLSDQDNQTQEVAPKHNLFDEEVRFEDINQNMDDWNIPEIPQDQLYVPETIKDKHNFDYIIKTVENNIPLGQDIGEEFHLLSKSSIYEHS

SEQ ID NO: 152340 - protein, 473 aa, Glycine max
  Coding DNA Sequence Number=SeqID_35562
  Gene Ontology: Mol. function=[ribulose-bisphosphate carboxylase] -lysine N-methyltransferase activity; Cellular component=nucleus; Biological process=nucleotide-excision repair
  Homolog annotation: Hit_ID=Q1SNG5; Match level="QueryCoverage=99%, HitCoverage=100%, E-value=0.0, Identity=72%"; Hit description =Nuclear protein SET
  Pfam annotation: Domain name=Rubis-subs-bind; Domain location=318 -442; Score=93.7; E_value=5.6e-25; Accession=PF09273.1; Description =Rubisco LSMT substrate-binding
  Pfam annotation: Domain name=SET; Domain location=69-324; Score =101.8; E_value=2e-27; Accession=PF00856.18; Description=SET domain
  Pfam module annotation: Pfam domain module=Rubis-subs-bind::SET; Domain location=318-442::69-324
  Subcellular localization annotation: CTP_CleavageSite=60; ConfidenceScore=5.64e-01
MELSRLFVSDTCFFSPPIRCSPSPALSTFFAVKNRRSRRRSSFCSASNPDTLVAGGAAVVAGAGEKHEEDLKSWMHKHGLPPCKVVLKDKPCPNDSHKPIHYVAASQDLQVGDVAFSVPNSLVVTLERVLGNETVAELLTTNKLSELACLALYLMYEKKQGKKSFWYPYIRELDRQRGRGQLSVESPLLWLKSELDYLSGSPIKDEVIQREEAIRKEYNELDTVWFMAGSLFQQYPYDIPTEAFSFEIFKQAFAAIQSCVVHLQKVSLARRFALVPLGPPLLSYQSNCKAMLTAVDGAVELAVDRPYKAGDPIVVWCGPQPNSKLLINYGFVDENNSNDRLIVEVYAGKEREAVLDMLRYMRLGYVSDPSEMESVISSQGPVCPVSPCMERAALDQLADYFKARLAGYPTTLAEDESMLTDDNLNPKKRVATQYVRLEKKMLHACLQATTDFINQLPDHTISPCPAPYAPLLK

SEQ ID NO: 152341 - protein, 87 aa, Glycine max
  Coding DNA Sequence Number=SeqID_35563
MFILVWGLAVSNNSSWWPPVVMGGGEEESLYNLQTSLSEFILLRGSPLFALSTTICTECNSLCAKCNNSRSAQFPLKLELRLARFLH

SEQ ID NO: 152342 - protein, 107 aa, Glycine max
  Coding DNA Sequence Number=SeqID_35564
MEDWGNFLHRILEEDSEDSALIKINGGSWRPPVVVGGGEGGVRIWVAFGEKERVKIIFFTLKNRNFLCTRSHSAGQLSLSAIPSQVGIAPSVPLLAQRNSFSGWNCA

SEQ ID NO: 152343 - protein, 353 aa, Glycine max
  Coding DNA Sequence Number=SeqID_35565
  Gene Ontology: Mol. function=hydrolase activity, hydrolyzing O -glycosyl compounds; Cellular component=vacuole; Biological process =carbohydrate metabolic process
  Homolog annotation: Hit_ID=Q1SNG7; Match level="QueryCoverage=79%, HitCoverage=94%, E-value=2e-92, Identity=60%"; Hit description =Glycoside hydrolase, family 18
  Pfam annotation: Domain name=Glyco_hydro_18; Domain location=26-284; Score=129.4; E_value=1e-35; Accession=PF00704.18; Description =Glycosyl hydrolases family 18
MRNKLPHPLCLFLLISLALFAKSDAGSLVVYWGQNAGEGQLTKTCKTGLFHIVNIAFLSTFGNGSQPQINLAGHCSPASKGCKRLGKDIKNCQRRGIKVMLSIGGGTNTYSLSSPDDARQVADYIWANFLGGKSNSRPFGNAILDGVDFNIESGELHYAALAYRLHDHYAGSKKKFYLTASPQCSFQNNLLHGALTAGLFDHVWIQFYNNPQCEFTSKDPTGFKSAWNQWTTSINAGKFFVGLPSSHAAARTGFVSSHALINHLLPIVRSPKYGGVMLWDSLQVVNINTSLALNNLNGTMLHFFLIIKKGAEQIKGRVDLRKQQVRILALPPSSAFITITVVTIRLVATISSF

SEQ ID NO: 152344 - protein, 48 aa, Glycine max
  Coding DNA Sequence Number=SeqID_35566
MIGLIGRWLDNEERVKTLISGTPVCDGASQEQLSEQLFRDVFTSFFSW

SEQ ID NO: 152345 - protein, 56 aa, Glycine max
  Coding DNA Sequence Number=SeqID_35567
MGGVIWFPGSGGYGFPLPGDWALSETGSLSVPYKNNSTPLVRKVRLAQQRKNIDSG

SEQ ID NO: 152346 - protein, 162 aa, Glycine max
  Coding DNA Sequence Number=SeqID_35568
ALLLLLKHYTKQIVYIVIPLFIAIPVFLNVYWFVACTLGASCSNVFPLAYRVLVLVFLFLVIGIICVDLGGELASHGAHGEHNWGHFPCTFEDMALFGVRPCLSVGLVMYFVPIVVFMVFARFNGKIIAKNLKSGYDCEWKEDSWVPAYYALAVLTMLWSGA

SEQ ID NO: 152347 - protein, 201 aa, Glycine max
  Coding DNA Sequence Number=SeqID_35569
VGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 152348 - protein, 47 aa, Glycine max
  Coding DNA Sequence Number=SeqID_35570
MMNPEELASPRTGDSKDYSNDKNFRETWPPEKLLGLIDVYMEPLMVL

SEQ ID NO: 152349 - protein, 247 aa, Glycine max
  Coding DNA Sequence Number=SeqID_35571
MGYVGVRELSWRWATGDGGFMRALWMWKNLLCTIARPPPSTTCDGVVPGDMSRGSGDLGDVRRAPGSQQIKGKQDHKARRLVVAGQLCILCNMWIVALVIDYQGLENEVRKLREPLIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEESCRHLRQTLRED

SEQ ID NO: 152350 - protein, 91 aa, Glycine max
  Coding DNA Sequence Number=SeqID_35572
MENVLKDEQAKVSALQVEREAREEVIESLHEEGIKWMDKFFVTLNGSQELPRLLAKAKTVVGTSSAPDEVHSLFNYCQHMVELMTHIIRNH

SEQ ID NO: 152351 - protein, 65 aa, Glycine max
  Coding DNA Sequence Number=SeqID_35573
MNEAVLLSRAGASPASGGFEAMAVTIDFVPRHAKIKNFILIERMDENDNVLGGFKLFDPVKVTRA

SEQ ID NO: 152352 - protein, 62 aa, Glycine max
  Coding DNA Sequence Number=SeqID_35574
MFMTPRLCISAILGEKMCFHEENPSRGAAVTLPRRFHEHFREDFPPFFTVLCPFFVHSSVFN

SEQ ID NO: 152353 - protein, 138 aa, Glycine max
  Coding DNA Sequence Number=SeqID_35575
  Gene Ontology: Cellular component=chloroplast
  Homolog annotation: Hit_ID=P03938; Match level="QueryCoverage=43%, HitCoverage=45%, E-value=6e-11, Identity=86%"; Hit description =Hypothetical 14 kDa protein ycf68
MSPHGGDMDGGEKKKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 152354 - protein, 306 aa, Glycine max
  Coding DNA Sequence Number=SeqID_35576
  Homolog annotation: Hit_ID=Q1RUD8; Match level="QueryCoverage=69%, HitCoverage=43%, E-value=8e-10, Identity=26%"; Hit description=IMP dehydrogenase/GMP reductase
VDWDQYLAGIGGSTINWFPRWKEGKEGVLFSSGDYPNVPLIGTRGCINYNPTLAIRQLGYPMRGAPTEESLSPFLVRDFGAQSFKIVHRVHKAWESPLRKDKELRGIRNGIISGYHECLRVHTRGLDWLSKLKIINEENFEASEEDEEVQALKLELGKARLAKEKFKARKEEHGRDKFRGALWGSNNELKLRREERDQSRVHGMVLKEELAACSRSKRSLAQHLEATEQSMLAIIGQYKEELNQSLTHEQKLVEDFTQAYAEKEARGRVIDALHQEATMWMDRFALTLNGSQDLPRLLAKAKAIAE

SEQ ID NO: 152355 - protein, 155 aa, Glycine max
  Coding DNA Sequence Number=SeqID_35577
MKQKEETTESTQRAIKSAKIQVGKLAEEVTQFVARREEDFVEVEAQEESPAKEHDSRGKHEEKGEEKVQQWEKYPTIENQQESILQVNTFPHQLIIKEERQGEHEKALSVILSLITNTSSAMSWKVLPKYMKFMEFLAKRQNYKEDVLYVTFMPP

SEQ ID NO: 152356 - protein, 123 aa, Glycine max
  Coding DNA Sequence Number=SeqID_35578
MVYIPPNELWPCVRMEEEHLGAQRCIVDIGIWKVHRHMSRHIGQFNDITRRFVLAHDFDDYKGNVRKKGMNPLGLILQEETNATIYALFAIVSNQSVSCYSMPRCETMVISRKREQIPQRIIH

SEQ ID NO: 152357 - protein, 87 aa, Glycine max
  Coding DNA Sequence Number=SeqID_35579
  Homolog annotation: Hit_ID=Q9LTU4; Match level="QueryCoverage=97%, HitCoverage=8%, E-value=6e-10, Identity=36%"; Hit description =Helicase-like protein
MAHKFCFEALDHSLRDIIKHNSKDNKIFGGKILRLTKNMRLQNNMQATDQEETAAFAQWIIDIGDGIIGHENDGYATIEIPQELLIT

SEQ ID NO: 152358 - protein, 481 aa, Glycine max
  Coding DNA Sequence Number=SeqID_35580
  Gene Ontology: Mol. function=transporter activity; Cellular component= membrane; Biological process=oligopeptide transport
  Homolog annotation: Hit_ID=Q5Z6P7; Match level="QueryCoverage=98%, HitCoverage=82%, E-value=1e-155, Identity=55%"; Hit description =Putative nitrite transporter
  Pfam annotation: Domain name=PTR2; Domain location=1-393; Score =420.5; E_value=2.3e-123; Accession=PF00854.12; Description=POT family
GMISLTLSAVLPQFRPPPCKGEEVCRQASAGQLAVLYISLLLGALGSGGIRPCIVAFGADQFHESDPKQNTKTWSYFNWYYFVMGVAMLVAVTVLVYIQDNIGWGIGLGIPTIAMFFSIAAFIVGYPLYRNLNPDGSPYTRLVQVIVAAFHKRNVPYLSNPSLLYQNDELDASISLEGKLLHTEQMKFLDKAAIVTEEDDNKISNLWRLNTVHRVEELKTIIRMGPIGASGIFLITAVAQQHTFFLQQAKTMDRHLTKTFQIPAGSMFVFNILTMLITTAFYDRVFIKVARRFTGLDRGISLLQRMGIGFVISTLATLVAGFVEMMRKKAASAHGLLDHPHAIIPISVFWLLPQYSLNGMAEAFMSIGHLEFFYDQAPESMRSTAMALFWASISAGNYVSTLLVTLVHKFSARPNGSNWLPDNNLNKGKLEYFYWLITILQIFNLIYYLICAKLYTYKPIEFQDKGDSSSKGNQIELSSTV

SEQ ID NO: 152359 - protein, 200 aa, Glycine max
  Coding DNA Sequence Number=SeqID_35581
  Gene Ontology: Mol. function=nucleic acid binding; Cellular component= cytoplasm; Biological process=DNA integration
  Homolog annotation: Hit_ID=Q0PEL6; Match level="QueryCoverage=81%, HitCoverage=11%, E-value=8e-42, Identity=50%"; Hit description =Putative integrase
MDMTRMAGEEAKEKKSRGLVLKSSKPYLMMRVIKKMQKNEVVERKNRSLEELARTMLNENHLPKYFWTDAVSTTCYVLNRVIIRPLLKLTPYEIYKGRKPNISHLKVSGCKSFVLNNGKESLGKFDAKADEDLFLGYSSTSKAYRVFSKNSLKIEEFFHVVFDESNPQKEGKVSIFYDDVGSPREAYLRSEEVVSNKPQE

SEQ ID NO: 152360 - protein, 75 aa, Glycine max
  Coding DNA Sequence Number=SeqID_35582
MKKEFGRTPESKQRAKREISLLSESSVSCHAQRSIGKEEEEQQERNYNAFAQHLHTLRGRSNNKEPFESDLRVFE

SEQ ID NO: 152361 - protein, 64 aa, Glycine max
  Coding DNA Sequence Number=SeqID_35583
MALHSNTRDGKTSWPDPPKIGQGGLACSDLKGWTCWPTPPEGWRANPPRPVSSPEGWQVRRGRP

SEQ ID NO: 152362 - protein, 191 aa, Glycine max
  Coding DNA Sequence Number=SeqID_35584
  Homolog annotation: Hit_ID=Q1RUD8; Match level="QueryCoverage=82%, HitCoverage=40%, E-value=2e-14, Identity=31%"; Hit description=IMP dehydrogenase/GMP reductase
MDGLVDLAAINAFLAYHHGKESPVVAVLADAYDTFDRRCEKSSMRIVCCTPALYVWLVSNIFLHERFPNVPLMGTRGCINYNPILAIRKLGYPMRGVPLEEIITPFIARGFYEGNSNVLQRVQKAWNAVERKDKELRVSNNDVIGGYHKWLKARMQGITWLPKLKISSGEEAEVPEESEKVQALKAELERT

SEQ ID NO: 152363 - protein, 66 aa, Glycine max
  Coding DNA Sequence Number=SeqID_35585
MKLTLLDLPKLLLSLPIASLPSSCAKILTILTIHAMEGYNPENRYKFLPPSKHPNIPSNSSTVGTN

SEQ ID NO: 152364 - protein, 135 aa, Glycine max
  Coding DNA Sequence Number=SeqID_35586
LSKAAKEEHARDLPIMNGIKEIIKSVEVLDSRSLNYKETLYNLSNRLKSLQGLCKQHFMEEDSELLPIMEAVGLSKEEEEDALEHCFVVMQGTHGRLLKFLLEGLPPNDSMKYLDLISMCRDKERMESMLRVVVE

SEQ ID NO: 152365 - protein, 317 aa, Glycine max
  Coding DNA Sequence Number=SeqID_35587
  Gene Ontology: Mol. function=helicase activity; Biological process =viral genome replication
  Homolog annotation: Hit_ID=Q1SN45; Match level="QueryCoverage=97%, HitCoverage=19%, E-value=1e-73, Identity=47%"; Hit description=AAA ATPase
MGFLQDDKEFIKAIKEAKDWGSAHYIRKLFVLLLLTATMNKPEQVWDQTWHWMADDIVYNYKKSSASPALQLDDRTLQNLFLLEIEQLLQANQRSLRDYPSMSYLEDANCPTYLDNSFILAELNDNNQELRSEFKHLFSQMTDEGGMCFLYGYGGTGKTYIWKTLASSLRVDNKIVIMVASSGIASLLLPGGRTAHSKFKILVPVFEDSTGNIHQGTQLATLLNQTSLIIWDEAPMTHKFYFEALDHSLRDIIKHNLKDCKIFGGKVMVFGGDVWQISPVIPRGSRSDIVNATINSSYLWDHCQILRLTKTCATKLH

SEQ ID NO: 152366 - protein, 274 aa, Glycine max
  Coding DNA Sequence Number=SeqID_35588
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=99%, E-value=5e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSKSCGFGMTGPLDESISCFLIRVDPWVLVPITFRGLHVLALRGLHVLTFVGLHALTFRGPHVLNFRGLHALAIRGPHVLTFVGLHALIFRGPHVLTFRGLHALAIRGPHVLTFRGLHALAIRGLHVLTFRGLHALAIRGLHVLTFRGLHALAIKGLHVLTFVGLHVLTFRGLHVLANRGLHALAIRGLHVLAIVGLHALAIRGLHVLTNRGLHALTFRGLHILAIRGLHTLTLRGLHILALRGLHVLTIRGLHALTFRGLHVLANREAARPHL

SEQ ID NO: 152367 - protein, 149 aa, Glycine max
  Coding DNA Sequence Number=SeqID_35589
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=82%, HitCoverage=25%, E-value=3e-38, Identity=66%"; Hit description=NADH -plastoquinone oxidoreductase subunit 2
MAITEFLLFILTATLGGMFLCGANDLITIFVALECFSLCSYLLSGYTKKDVRSNEATTKYLLMGGASSSILVHGFLLAIWFIRGRDRASRNSERSYQYTNELGSSFPQPLSHQWTPDVYEGVRCYIVGSHPSETTSIIGASVNKRITLR

SEQ ID NO: 152368 - protein, 207 aa, Glycine max
  Coding DNA Sequence Number=SeqID_35590
  Gene Ontology: Mol. function=peptide deformylase activity; Cellular component=chloroplast; Biological process=translation
  Homolog annotation: Hit_ID=Q9FV54; Match level="QueryCoverage=93%, HitCoverage=60%, E-value=3e-39, Identity=50%"; Hit description =Peptide deformylase, chloroplast precursor
  Pfam annotation: Domain name=Pep_deformylase; Domain location=74-206; Score=-14.8; E_value=5.5e-07; Accession=PF01327.11; Description =Polypeptide deformylase
  Subcellular localization annotation: CTP_CleavageSite=49; ConfidenceScore=5.50e-01
MASLRCLHSTHPHLHRGSALLAISNRCFNHSSLLNRTLSVNPPRTAPPRAMAKPSFSTAQDLVASPGDFEFAQPLKIVEYPDPRLRARNKRIVAFDDSLKKLVHEMFDVMYKASPGAAVKLCLGDLLVMGSNPETASLHMQGTDGIGLSAPQLGINVQLMVFNPVGERGEGEEIVLVNPRVSQYSKKLTLFNEGCLSFPGINADVKV

SEQ ID NO: 152369 - protein, 150 aa, Glycine max
  Coding DNA Sequence Number=SeqID_35591
MSGLTCDSPQILASPHQLNLAPYASGPYNAQWNALGLLHDKHTLRSSRILGEMGVDEPWLGLWLPLNYHRIPNGVANCRNRPFLRASEARLTGASSKGGKCAESPPTFICGKHRKNRRKPVMKNIPDSGVVFTFEEGISTSHVCPKGQQP

SEQ ID NO: 152370 - protein, 79 aa, Glycine max
  Coding DNA Sequence Number=SeqID_35592
MDKFDIFVPHPLTNASLLIQLSPKYGCKPLVCLLKRPALLSLDFQDRSIRNYSCYTFERNELSRIGCGTNGLSYLKKGG

SEQ ID NO: 152371 - protein, 90 aa, Glycine max
  Coding DNA Sequence Number=SeqID_35593
MVGRNDRAIIDALQALAQAMGNQNRGEATGAIEYQGLDRFQRNNPLALNGGYNPNEELKVAFGTYTFIEEAGYWWENTRVRDRGSNMKKL

SEQ ID NO: 152372 - protein, 456 aa, Glycine max
  Coding DNA Sequence Number=SeqID_35594
  Gene Ontology: Mol. function=nucleotide binding; Cellular component =cytosol; Biological process=meiosis
  Homolog annotation: Hit_ID=Q6K987; Match level="QueryCoverage=95%, HitCoverage=64%, E-value=1e-134, Identity=56%"; Hit description =Endoribonuclease L-PSP family protein-like
  Pfam annotation: Domain name=ATP_bind_4; Domain location=1-186; Score= 94.8; E_value=2.6e-25; Accession=PF01902.7; Description=ATP-binding region
  Pfam annotation: Domain name=Ribonuc_L-PSP; Domain location=192-308; Score=-18.6; E_value=0.002; Accession=PF01042.11; Description =Endoribonuclease L-PSP
  Pfam module annotation: Pfam domain module=ATP_bind_4::Ribonuc_L-PSP; Domain location=1-186::192-308
MAVIFKDSCYSSCYMKVICYKHQELGYKETQGDEVEDLCILLREVKRQIPSVSAVSSGAIASDYQRLRVESVCSRLGLVSLAYLWKQDQSLLLQEMITNGIVAVTVKVAAMGLDPAKHLGKELAFLNAYLHKLKELYGINVCGEGGEYETLTLDCPLFSNARIVLDEYQVVMHSSDSIAPVGILHPLAFHLENKADVQYLKSQDKIHESFTQKLGSVFEVQDSVEGCLQEDLKIVLGKIESQLLGLGFGWENVLYIHLYIDDMNNFSEANETYVKFITQEKCPFGVPSRSTVEMPLIEMGFSRAYIEVLVANNKDKKVLHVQSISSWAPSCIGPYSQATLHEGILHMAGQLGLDPPTMNLCKGGPGVELEQALKNSEAVAKCFNCSITTSAIAFVIYCSKHISLLERLDIQEKQETILRQMKISHLQERTTYKALDPLFLYVLVPDLPKRYCRVYP

SEQ ID NO: 152373 - protein, 135 aa, Glycine max
  Coding DNA Sequence Number=SeqID_35595
MEESNRENNKDCICQSRGFALDGEEYNADGGFNQQNNKDNISQSRGSALDGSALDDEEHVGEWRNPIGIKLIDTVYLKGGPVGKPVVPAALMNRPTRGERRFAYCALEECILTYYVGTDEGVSEVLHVGGEKRLH

SEQ ID NO: 152374 - protein, 95 aa, Glycine max
  Coding DNA Sequence Number=SeqID_35596
  Homolog annotation: Hit_ID=Q1SM20; Match level="QueryCoverage=91%, HitCoverage=22%, E-value=8e-15, Identity=42%"; Hit description =Nucleic acid-binding, OB-fold
MARIPNKIRSIDGSKETLKLAVRITDLWFVGTPNKSEQAKMVFVDFEGDQIHAICKSDHLKSWKADLKENCTYVMHNFKVVKNDGQFRVCEHEYK

SEQ ID NO: 152375 - protein, 86 aa, Glycine max
  Coding DNA Sequence Number=SeqID_35597
  Gene Ontology: Mol. function=DNA binding; Biological process=DNA integration
  Homolog annotation: Hit_ID=Q1RVN6; Match level="QueryCoverage=94%, HitCoverage=10%, E-value=8e-11, Identity=48%"; Hit description =Integrase, catalytic region
MSKGTNYVGPKKIWIPKSQIVPTADILGSKRPIKGKVNVPGKIAFGGISIGNVFGMGKIGIPSQASINNVLYAEGLKYNLLSISQF

SEQ ID NO: 152376 - protein, 338 aa, Glycine max
  Coding DNA Sequence Number=SeqID_35598
MEDLLEDHAKIPYPKLVPQRGLGVAQLEKFRLEQEQKEKAAIIATSASSSNSDIPYDKHLQFLKFHNSNQPSPNSFPLSTASIANNGGSDAGRHEALVLGHVSGPQLRAPHDFKFVKKKIGMNTGMTFASTLPCASNTIMPFPNCVQKTQQHQQQHPSSSMVSVSSRTSSTIVPHSSLEPYSTETYVSKRLEKMIGIKRPNPFSLKITPVSSSNFKPFESNPIRPSPNWMHRTQQHPSSSMLGVNPRTSSTIVPQSLLEPPSNQNYIGSYVSKRKEEKMIWTKQPKPFSMDIPPVSSSNSKPLTFPNPPMSSSNFKPLTFPNPPMSSSNFNLSLSLLL

SEQ ID NO: 152377 - protein, 201 aa, Glycine max
  Coding DNA Sequence Number=SeqID_35599
  Subcellular localization annotation: CTP_CleavageSite=56; ConfidenceScore=5.69e-01
MSSSPFSTLSFRRLVVSNAMVSPCMSYAMKPLTALPSVGRRQFLFFLTATTAFTVREATSVAQDIPLFGIRKSLKKAEEEVEEIVKEGFEAADKGRSGNGEQEGQGARHKQHQRLRRARKPQEDEGLAGPSKPNDKKDVFWAPVPLTSKSWADVDDEDDDDYYATIAPPESVWAAPIITQNDITATKISFFYLPYFFPPSL

SEQ ID NO: 152378 - protein, 130 aa, Glycine max
  Coding DNA Sequence Number=SeqID_35600
MTLPDIIIIIQSSIRDDDVSSVITSLWIHDVGYNVQDILPENTGIAKSIEAAGSTMSDTMSRTSCPKILELLKALKLQDPRCRIRCPGHLARKYWTHESVISLTDYCAIFRKNDRSHPAQEVAAQIHTLL

SEQ ID NO: 152379 - protein, 187 aa, Glycine max
  Coding DNA Sequence Number=SeqID_35601
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=3e-18, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTDVLTFRRLHALTFRGLYVLSLRGPHVLAIRGLHALTFRGLYVLPFRGLHALAFRRLLALIFRGEHVVSFRGLHVLAIRGLHALTIRGLHILAIRGLHILTIRGLHVLAFRGLHVLAFRGLQVFAFRGLHVLTIRMLHALAFRGLYVLAFRWLYAFTFRGLDILPLRGLCVLIFRGPHVLAIRGLL

SEQ ID NO: 152380 - protein, 76 aa, Glycine max
  Coding DNA Sequence Number=SeqID_35602
  Subcellular localization annotation: CTP_CleavageSite=61; ConfidenceScore=5.24e-01
MGLCSQDTQLDPKKSNRVLGFLALITSLCQFYGVPVTPSRVIRPLLTGLSSRSTAPPGRRRARHHSSGQQAHCHHL

SEQ ID NO: 152381 - protein, 851 aa, Glycine max
  Coding DNA Sequence Number=SeqID_35603
  Gene Ontology: Mol. function=catalytic activity; Cellular component =Golgi transport complex; Biological process=metabolic process
  Homolog annotation: Hit_ID=Q9FFF3; Match level="QueryCoverage=99%, HitCoverage=77%, E-value=0.0, Identity=57%"; Hit description=Low density lipoprotein B-like protein
MVLSLFLESRKSWISQILGNAGPGDASSLVVLVLCDVLGIIQVLNDMPLFYKVILGSPPASQLFGGIPNPDEEVRLWKSFRDKLESIMAMLDKSYIADTCFAWLRECVSKISGRNLIDAVGSGQDLASAEKSIRETMESKQVLQGSLEWLKNVFGSEVELPWSRIRELVLEDESDLWDEIFEDAFVGRMKAIIDLRFRELTGAVDVVNSISAIGDLCTKLDDVQGYLNRPSTAGGVWFLESNAKKTGVASGFKVQPEESEFQYCLNAYFGPEVSRIRDAVDVSFQSILEDLLSFLESPKASRRLKDLAPYLQSKCYECVSSILMTLKKELDSLYAPTENGEVPTAVTVEKSLFIGRLLFAFQNHSKHIPLILGSPRFWVNGNASAVGKLPALVKQSRFGSDSAICDSPGRQTSLGSKRQNSSVVSALLGMREGASHELEELNKTIGDLCIRAYNLWILRISNELSAIVSQDLKQDDALSLSSPWRGWEDIIVKQDQSDENPPEMKISLPSMPSLYIISFLFRACEEVHRVGGHVLDKKILHKLASRLLEKDLRVTKIIILSPNPPPVKSNCNQVIETLNGLLVTGIFEDFLSTAESGVHQVSEKGVLQVLLDVKFATDVLSGGDSNMVGELSSNPKAKLPGRKKHDQSLTNSAIRERSNQLLNRLSQKLDPIDWLTYEPYLWENERQSYLRHAVLFGFFVQLNRMYTDTVQKLPTNSESNILRCSTVPRFKYLPISAPALSSRGTKKAFTPSSNEIALRSSWNSITNGDLSQKINLDDSSSLGVAAPLLKSFMQVGSRFGESTFKLGSILTDGQVGIFKDRSAAAMSSFGDILPAHAAGLLSSFTAPRSDS

SEQ ID NO: 152382 - protein, 231 aa, Glycine max
  Coding DNA Sequence Number=SeqID_35604
  Gene Ontology: Mol. function=protein transporter activity; Cellular component=Golgi transport complex; Biological process=intra-Golgi vesicle-mediated transport
  Homolog annotation: Hit_ID=Q9FFF3; Match level="QueryCoverage=97%, HitCoverage=22%, E-value=2e-64, Identity=58%"; Hit description=Low density lipoprotein B-like protein
MNKPKYLLRLELIDDGDGGERIGVSGNGEAAFEQAIAAALGDLRPEALDDLPLVLEHCEIGKELLLLVIGIDEQVVVHVLGTHVARRGLEKHPFVEATPNVLGRVDDVLDAAGRAVGPGSGLGMELGLGLGLGLGEGADAVVYDGDVAGDAVAGALHADDGIGGVDQVAVPVADELPELLLLVLDLLPRRRLRLPDLGDGLRAEEGLGVAAADGGDTVVIGARQRRRRVWG

SEQ ID NO: 152383 - protein, 154 aa, Glycine max
  Coding DNA Sequence Number=SeqID_35605
  Gene Ontology: Mol. function=dihydrodipicolinate reductase activity; Cellular component=cytoplasm; Biological process=lysine biosynthetic process via diaminopimelate
  Homolog annotation: Hit_ID=Q1S0J3; Match level="QueryCoverage=60%, HitCoverage=31%, E-value=8e-43, Identity=90%"; Hit description =Dihydrodipicolinate reductase
  Pfam annotation: Domain name=DapB_C; Domain location=2-106; Score =15.7; E_value=5.9e-08; Accession=PF05173.4; Description =Dihydrodipicolinate reductase, C-terminus
MDLPSADANQIANNLSNLGQIYNREDPSTDVLARGQVLGDGIRVHSMVLPGIPSSTTVHFSGPGEVYSIKHDITDVKCLMPGLLLAIRKVVRLKSTSFISLPRTLTWLSSRDLLLQHLDKIHIERFARTKEKQMLTKLLFSGPIIQSHHAAPEL

SEQ ID NO: 152384 - protein, 316 aa, Glycine max
  Coding DNA Sequence Number=SeqID_35606
  Homolog annotation: Hit_ID=Q6Z3T8; Match level="QueryCoverage=51%, HitCoverage=43%, E-value=1e-19, Identity=39%"; Hit description=Auxin- regulated protein-like
  Pfam annotation: Domain name=OTU; Domain location=160-308; Score= -2.6; E_value=0.091; Accession=PF02338.9; Description=OTU-like cysteine protease
  Subcellular localization annotation: CTP_CleavageSite=53; ConfidenceScore=5.31e-01
MLGVLCATRPKPWLLSLVHVHASLPRLPHSPLSPSASPPPRRRHSTACKLFLSGGAAASIWHAIMPRGDDGLRRGVVAVHDLKGEGSWNVAWDARPARWLHRPDSAWLLFGVCACLAPPPGCVDADTNSAGIAVDESCGLLDKEREEDEVSADYRVTGVPADGRCLFRAIAHGACLRNGEKAPDENRQRELADELRAKVYRRGFRYISAENSTALCMGWRTRAIDGFSCFELSLSFVERHKMFAITSTKCVWGCSYKLWSSVVYMTPISVFMRDTGSVELVNIAKYGEEYRNDKDISINVLFHGYGHYDILETLRP

SEQ ID NO: 152385 - protein, 132 aa, Glycine max
  Coding DNA Sequence Number=SeqID_35607
MTQSKRFLAPVSITKQEQGAKFPDKFPNFKQHLNAQKLQFGAVNGCVMEYKYYILKNTHLVQDIEMVEEEEPRIGAYCSSATSNKFEIYKEEAGNAAQKHKTKRWKVSMLMQKPLVITGKVHIALCILKLKH

SEQ ID NO: 152386 - protein, 100 aa, Glycine max
  Coding DNA Sequence Number=SeqID_35608
  Gene Ontology: Mol. function=transition metal ion binding; Biological process=cytoskeleton organization and biogenesis
  Pfam annotation: Domain name=Transposase_21; Domain location=1-100; Score=-37.6; E_value=2.1e-11; Accession=PF02992.5; Description =Transposase family tnp2
MMLPMVISGPRQPGNEIDVYLNPLIEDLTKLWDEGVVVFDGYRTETFKLLFCTINDFLAYRNMSGYNVKGHCACLIYEEDISYVQLKHGRKIVYTQEHDT

SEQ ID NO: 152387 - protein, 237 aa, Glycine max
  Coding DNA Sequence Number=SeqID_35609
  Gene Ontology: Mol. function=nucleic acid binding; Biological process= DNA integration
  Pfam annotation: Domain name=zf-CCHC; Domain location=146-163; Score =19.0; E_value=0.00071; Accession=PF00098.13; Description=Zinc knuckle
MAIVNKMRIHGDKKEDITVVEKILRSMTPKFNFVVCSIEEAHDIKELSIDEFQSSLLIHEKKINQQDIEEQALKVSIENRSTSKGERGRGKGKGKGIRGRGWGSNEHGNQQEYQQHHDNQFHRRGRGRGGHHFTTHKSKSADKSDVECYQCHRYGHYQSECQTNLNKDNGEKTNFVEKEEEVSLLMSEKKESHQDSTSGGLNPFSVSLTFGNSIGAVRGKKNLEESQETARNVVIAV

SEQ ID NO: 152388 - protein, 494 aa, Glycine max
  Coding DNA Sequence Number=SeqID_35610
  Gene Ontology: Mol. function=nucleic acid binding; Cellular component= chromatin; Biological process=DNA integration
  Pfam annotation: Domain name=rve; Domain location=35-198; Score =183.0; E_value=7.1e-52; Accession=PF00665.16; Description=Integrase core domain
  Pfam module annotation: Pfam domain module=RVT_2::rve; Domain location=264-408::35-198
MVIGLPQITSPSEVCEERVVSKQHRNQFPQGKSWRARKALELVHSDICGPINPYSNSGKRYLITFIDDFSHKTWVYFLQKKSEAFTAFKNFNVLVEKEANSPIKVLHNDRGGEYNSHEFVNFCEAHGIKRQLTAAYTPQQNGVCERKNRTIMNVVRSLLTRSGVPKTFWSEAVNWSIHILNRSPTLAVQNMTPEEAWSGQRPVVDHFRIFGCVAYAHIPNQRRTKLDDKGEKCIFLGERQQPAENHQQIPPENVADTSGSPTIASDDERPQCVRKRPAWMINYEGHKTIGVKWVYKTKLKKNGDVEKYKARLVAKGYKQEFGVDYKEVFAPVARHDTVSDAAMFEKFKKSMMIEFDMTDLGMLHYFLGIEVMQSAAGTFISQKKYVLEILDRFQMKNGNSVSTPTEVGLKLVRDPDERKIDNTLCKKIVGSLMYLTATIPDITYVLIVTLSTTEVEFVAATSCACEAIWVRKILEELCFKQQGPTPIYCEQFNN

SEQ ID NO: 152389 - protein, 93 aa, Glycine max
  Coding DNA Sequence Number=SeqID_35611
MTTGGHHEPSLLVVEPPHQVERFNRSRILRIHLKDSVENNPSILSCVASLRDDAIAAAPTVDKGSSRCFDDAKRSHASQSFIQDKAIKDIQDG

SEQ ID NO: 152390 - protein, 76 aa, Glycine max
  Coding DNA Sequence Number=SeqID_35612
MDEMRYQYMELSRLLDVSDSEGPLSEIDSLSETRWESTSLIDSLLGFPSTLCELYASLSGCHSLSAYASLSETPAA

SEQ ID NO: 152391 - protein, 109 aa, Glycine max
  Coding DNA Sequence Number=SeqID_35613
  Homolog annotation: Hit_ID=Q1T6P5; Match level="QueryCoverage=48%, HitCoverage=6%, E-value=5e-10, Identity=60%"; Hit description=EGF -like, subtype 2; S-locus glycoprotein; Curculin-like (Mannose- binding) lectin; ...
  Homolog annotation: Hit description=Apple-like; Serine/threonine protein kinase, active site
MEGSHGLSMKAPKMIVAVLLAGFEGQHLLEKKKWLHACEYAARGHFSIKLDVFSYGVILLEINGDKLMPKPKVPGFYPETEVTSVANCSLENHRLCSVNELSIRMLDAR

SEQ ID NO: 152392 - protein, 64 aa, Glycine max
  Coding DNA Sequence Number=SeqID_35614
MGWFMMSQKNQLGTTVDMGVRCEGTIGGLKERNDELVEGGRALEKARMEREERSERSATRDVAK

SEQ ID NO: 152393 - protein, 126 aa, Glycine max
  Coding DNA Sequence Number=SeqID_35615
  Gene Ontology: Mol. function=zinc ion binding; Cellular component =integral to membrane; Biological process=ubiquitin cycle
  Homolog annotation: Hit_ID=Q1SZN2; Match level="QueryCoverage=60%, HitCoverage=36%, E-value=2e-27, Identity=71%"; Hit description=Zinc finger, RING-type; RINGv
  Pfam annotation: Domain name=FYVE; Domain location=48-99; Score= -16.3; E_value=0.058; Accession=PF01363.12; Description=FYVE zinc finger
  Pfam annotation: Domain name=PHD; Domain location=18-63; Score=-2.1; E_value=0.092; Accession=PF00628.19; Description=PHD-finger
  Pfam annotation: Domain name=zf-C3HC4; Domain location=19-60; Score =32.6; E_value=1.4e-06; Accession=PF00097.15; Description=Zinc finger, C3HC4 type (RING finger)
  Pfam module annotation: Pfam domain module=FYVE::PHD::zf-C3HC4; Domain location=48-99::18-63::19-60
SLPKFTYADDGDRRKWSECAICLTEFGAGDEVRVLPQCGHGFHVACVDTWLASHSSCPSCRAPFAVVARCQKCGHFPAVASASAASESKAVGCDNAAVSAANANRNNIKIKSFIRHSASYLLGIYG

SEQ ID NO: 152394 - protein, 739 aa, Glycine max
  Coding DNA Sequence Number=SeqID_35616
  Gene Ontology: Mol. function=RNA-directed DNA polymerase activity; Cellular component=chromatin; Biological process=chromatin assembly or disassembly
  Pfam annotation: Domain name=Chromo; Domain location=640-688; Score =17.3; E_value=0.0088; Accession=PF00385.14; Description='chromo' (CHRromatin Organisation MOdifier
  Pfam annotation: Domain name=rve; Domain location=380-493; Score= -10.9; E_value=0.049; Accession=PF00665.16; Description=Integrase core domain
  Pfam annotation: Domain name=zf-H2C2; Domain location=321-362; Score =17.3; E_value=0.0018; Accession=PF09337.1; Description=His(2)-Cys(2) zinc finger
  Pfam module annotation: Pfam domain module=Chromo::rve::zf-H2C2; Domain location=640-688::380-493::321-362
MNHFLAPFLRHFAAVFFDDILVYSNSLSSHVQHLDLIFQALLRSEFYLKRTKCLFTQRELEYLGHVVSNKGVTLEPSKIRAIEQWPTPATAKELRAFLGLTGFYRKFVRQYAAIASPLMSLLCKDAFEWSLESQEAFDKLKSAMTNTLVLALPNFSEPFLVETDASGTAMGAVLTQRGHPLAQYLLGSLFTILIDHKSLRELMTQVIQTPEQHYYLSKLLGFDYTIQYKAGATNVVTDALSCRPPEPGQLLVLSVPQLDFLCDIQQTLVNDLDYQALMANFQENPSAYPQYRVHNGYLLFNDRIWLNKTNPYIPSLLSEFHATPLGGHFGVTKTLHRIEASFFWQGLKHDVQKYIRECKVCQQNKSSTKRSAGLLQPLPSPIGVWEDISMDFVTHLALSNGFTIIMVVVDRYSKGVHLGALPTGFLAFKVAMLFIEITQWHPPSVKHGVLEQYLRCFVSSQPSSWFRYLSLAEWCYNTSLHSSSRLTPFEVIYGKPPPTIPQYIPGLMKNEVVESLVESRQNMHTKLQKRLKKAQDSMKKHTDARRDDVTFAVNQWVYVKLRPTHQRSVTGTHHPKLSKRYFGPFKILAKVGEVAYRLDLPIEARIHPVFHFSLLRLHHGPPPSSTEPWTLEIVGQKPMQRPLCILDSKLDTSTSPPTQLVLTQWVGQPPEDTSWEPWLELRDTYHLEDKVVSKDRGIASIQASIDANEEAHSATMTDDAPARPARAVTRLGYLRDYIS

SEQ ID NO: 152395 - protein, 76 aa, Glycine max
  Coding DNA Sequence Number=SeqID_35617
MALEYWMNCLGEQCTAGEVIRCVQIENGGKKTWLYVSIEAFDDANEEAHYATMTDDAPARPAHAVTRPGYLRDYVS

SEQ ID NO: 152396 - protein, 400 aa, Glycine max
  Coding DNA Sequence Number=SeqID_35618
  Gene Ontology: Mol. function=GTP binding
  Homolog annotation: Hit_ID=Q9FKY6; Match level="QueryCoverage=98%, HitCoverage=93%, E-value=1e-99, Identity=50%"; Hit description =Arabidopsis thaliana genomic DNA, chromosome 5, TAC clone:K2A18
MSSVGLTSVDVEGAAFDSASQVNVHGWTINNKYYTADVSIWMAHLNDDFSAANVPVFRRMTALPSSLAALREWVSHTDIQNFEILLCIGNKVDLVTGHPAHAEYRRRLLKLEDSAADLYSEEYGISELEGTSLLGDEEPSWDIRRSCLEWCTDHNIEFIEACGSNADFDKCLSIDGDLQGVERLYGALSAHMWPGMVLKSGDRINQPSFPEKEGILPLQFSFFGACSCCFCQHRISASTDFGLSFPLSPSELSSEESDYEQEYEVLSAGSADWDESEQGWVSASSLGAGGSAPQNNPGTDGQHEDEIKSDKESHPTTSSPTIQDESDKDVVHNIMDSKGDGKENEAKCLELEDLEQLMSEIGNMRAGLRLMPDFQRRDMAAKLAMKMASIFGGESDEEEI

SEQ ID NO: 152397 - protein, 200 aa, Glycine max
  Coding DNA Sequence Number=SeqID_35619
  Gene Ontology: Mol. function=RNA-directed DNA polymerase activity; Cellular component=chromatin; Biological process=chromatin assembly or disassembly
MADHGTRKTTTNRLEDAIARLTNSQANLNERYTDLSGKVDSILDHLRLCGTHQNQPSVSNTNCHRNTVKLDIPWFDGRDPLGWIFKMNQLFQYQNTPEVERITVASLYLDGAALSWYQWMFTNDFITSWQGFLQALESRFAPTFYDDRKGALFKSSSTIPIKLLYLGIEPRASTRGVSYPTNLPPLSHCPRETAGGQVTR

SEQ ID NO: 152398 - protein, 152 aa, Glycine max
  Coding DNA Sequence Number=SeqID_35620
YGKGDWAKIAEEFVCNKTPQQVQSYAIIFFKNLQQSVNPPPPTYSYGYSSKNPTYFAPYPMSRNLNPMVDPSASNSMSMIVNQSQQLFTPVPMNVPFPLVPQYGEASTSTNTNTIAYGFQTHTSGATAGTSMHAIANDNKEIDLELRLGRNN

SEQ ID NO: 152399 - protein, 132 aa, Glycine max
  Coding DNA Sequence Number=SeqID_35621
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=87%, HitCoverage=22%, E-value=1e-59, Identity=91%"; Hit description =Isoflavone conjugate-specific beta-glucosidase
MRFMEPLTKGEYPRNMRALVGSRLPKFSKWQAKLVNGSFDFIGLNYYSSGYINGVPPSNAKPSFLTDSRTNTTFERNGRPLGLRAASNWIYFYPKGLRDLLLYTKDKYNNPLIYITENGKYALIHYVYFYFT

SEQ ID NO: 152400 - protein, 165 aa, Glycine max
  Coding DNA Sequence Number=SeqID_35622
  Gene Ontology: Mol. function=cysteine-type peptidase activity; Biological process=proteolysis
  Homolog annotation: Hit_ID=Q1S6A6; Match level="QueryCoverage=85%, HitCoverage=24%, E-value=2e-30, Identity=46%"; Hit description=FAR1
  Pfam annotation: Domain name=FAR1; Domain location=13-164; Score= -53.3; E_value=0.0092; Accession=PF03101.5; Description=FAR1 family
MGMKFAGEEAAYKFYYAYAKFTSFAIRKDEVRYSSNGEVKRRQFVCNKVKFRNIKHFIRDDRKKTHRPLTCTGFLARLCLKVDPITSRFQVVSFWEGHKHVLCEPNYVPLFKLYYGLSDGEKAQVDSLHAYGIRSCQIMGYMMGQKGGPVGMGFNKKDLFNYIEQ

SEQ ID NO: 152401 - protein, 148 aa, Glycine max
  Coding DNA Sequence Number=SeqID_35623
MATARWALKHPVYGIVILRLGIYTNRSNVSKLCSSISSMNSSILISVIPETKLLATTFLNEKKILRDSGLSTNTIDNNETSTDVTTQTIYKRGNIKREYGSRDLPIMWLRMPPDSWVTVTKSGVVDKSRAFAPTYPQFVMRNSDLRSS

SEQ ID NO: 152402 - protein, 107 aa, Glycine max
  Coding DNA Sequence Number=SeqID_35624
  Subcellular localization annotation: CTP_CleavageSite=41; ConfidenceScore=5.48e-01
IMATDPTSPPQSDGQSEATSKRSRTTTRLRTLTLRTVDQPRPAVYVDPATGRASGPMREKFHSYLGVVAREKVPIIHNNWKDVPETLKEIVWNDILVSPSYQLQYLN

SEQ ID NO: 152403 - protein, 129 aa, Glycine max
  Coding DNA Sequence Number=SeqID_35625
  Gene Ontology: Mol. function=DNA binding; Biological process=DNA integration
  Homolog annotation: Hit_ID=Q1S3H4; Match level="QueryCoverage=99%, HitCoverage=27%, E-value=8e-40, Identity=50%"; Hit description =Integrase, catalytic region
MANYKVAGITPSDFNWNQQKKFLHDARFYVWDDPHLFKIRADNLLKICVTMEETRSILWHCHNSPCGGHYSGDRTAAKRTEEISWRNEIPLQNIMEVEIFDCWGIDFVGPLPSSYGNQYILVAIDYVSK

SEQ ID NO: 152404 - protein, 45 aa, Glycine max
  Coding DNA Sequence Number=SeqID_35626
MVASLVLSRAPPLGLDLNQEGEALMNSSECRPWGSPGLSAPLSLC

SEQ ID NO: 152405 - protein, 55 aa, Glycine max
  Coding DNA Sequence Number=SeqID_35627
MWYHFPVKNLVGRLGVHDKTCLTMGLQEHSNRMTPKAYTPKSPLGPLPPDSVRLK

SEQ ID NO: 152406 - protein, 65 aa, Glycine max
  Coding DNA Sequence Number=SeqID_35628
  Gene Ontology: Mol. function=protein serine/threonine kinase activity; Biological process=protein amino acid phosphorylation
  Homolog annotation: Hit_ID=Q70I28; Match level="QueryCoverage=93%, HitCoverage=7%, E-value=2e-18, Identity=75%"; Hit description=S -receptor kinase-like protein 3
MARTFGLDQDEANTNRVMGTCAYMPPQYAVHGSFSVKSDVFSFGVIVLEIISGRKNRGFCDPTIT

SEQ ID NO: 152407 - protein, 208 aa, Glycine max
  Coding DNA Sequence Number=SeqID_35629
  Gene Ontology: Mol. function=protein serine/threonine kinase activity; Cellular component=membrane; Biological process=protein amino acid phosphorylation
  Homolog annotation: Hit_ID=Q1STT5; Match level="QueryCoverage=99%, HitCoverage=26%, E-value=3e-45, Identity=46%"; Hit description =Protein kinase; S-locus glycoprotein; Curculin-like (Mannose -binding) lectin; Apple-like
  Pfam annotation: Domain name=PAN_2; Domain location=1-55; Score=52.0; E_value=2e-12; Accession=PF08276.2; Description=PAN-like domain
MKLSDTSSSWYDKTISLQECEKYTLSNCSCTAYAQLNISGNGSGCLHWFYDIVDIRTLPMGGQDFYLRMAIVSNLDLQLQDHHFNWKKLAGIVVGCTIFIIGITIFGFFCIRRKKLKQSDKSKKDDIDLPIFHFLTISNATNHFSKSNNLGQGGFGPMYKGILPDGQEIVVKRLSKTYGQGLDEFKNEVMLVAKLQHRNLVKLLGCSI

SEQ ID NO: 152408 - protein, 51 aa, Glycine max
  Coding DNA Sequence Number=SeqID_35630
  Homolog annotation: Hit_ID=P14655; Match level="QueryCoverage=65%, HitCoverage=7%, E-value=2e-10, Identity=88%"; Hit description =Glutamine synthetase, chloroplast precursor
MTNYFLFPAFEGGCKDWGTGIDVRSKSRTMSKPVEDPSELPKWNYDESRTG

SEQ ID NO: 152409 - protein, 153 aa, Glycine max
  Coding DNA Sequence Number=SeqID_35631
  Gene Ontology: Mol. function=protein serine/threonine kinase activity; Cellular component=membrane; Biological process=protein amino acid phosphorylation
  Homolog annotation: Hit_ID=Q70I28; Match level="QueryCoverage=95%, HitCoverage=17%, E-value=9e-33, Identity=48%"; Hit description=S -receptor kinase-like protein 3
  Pfam annotation: Domain name=B_lectin; Domain location=38-149; Score =103.5; E_value=6.1e-28; Accession=PF01453.15; Description=D-mannose binding lectin
MSSTLDMVTPTHPIRDGFFNLANSNNRYLGVWYKNIFPRTTVWVANKETPLKDNTGILEVGTNQGILSIKDGGGAKIWSSSASHTPNKSIVVKLLESGNMVMKDGHNNLLWQSFDYPSDTLLPGMKIGVNFKTGQHRALRSWKSLSDLTLGNF

SEQ ID NO: 152410 - protein, 139 aa, Glycine max
  Coding DNA Sequence Number=SeqID_35632
  Subcellular localization annotation: CTP_CleavageSite=67; ConfidenceScore=5.37e-01
MNVYTCSRRSRSPPKVARVSVSFNPAAASGTRCHTFLNTIIQVPRKCHCRWSRLPPFSNSSSAIRLVGFERGALGLDHCHSGCRTTSDSVPVGCRHSGHRFSPSMQRVVVCSLVGTAETRIGAGLDAEPLLLILHGIGA

SEQ ID NO: 152411 - protein, 55 aa, Glycine max
  Coding DNA Sequence Number=SeqID_35633
  Subcellular localization annotation: CTP_CleavageSite=16; ConfidenceScore=5.14e-01
VTCAVLIAAASVSAVVAATEVPAPAPGPSSGASASLPLIGSLVGASVLSFFALFH

SEQ ID NO: 152412 - protein, 292 aa, Glycine max
  Coding DNA Sequence Number=SeqID_35634
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-36, Identity=31%"; Hit description= UPI00006A17C9 related cluster
GLHVFAIRGIHVLTIRRLYAFTLRGLHALTFRGLQVLAIRGSHALIFRGLHILTIRGSHGLIFRGLHVLTFRELQFFTIRGLHVLPFRGLHVLTIRGLHALTCRGLHALPIRGLHALTFRGLHVLTIRGLHALTCRGLHVLTIRGLHALTFRGLHVLAIKGLQALIFRGLHVLAIRGELQFFTIRGLHVLAIRGLHALTFRGLHVLTIRGLHALTCRGMHVLTIRGLHALTFRGPYVLDIRGLDALTFRGLHVLAIRGLHALTCRGLHVLTIRGLHALAIRGLHALSFGGLH

SEQ ID NO: 152413 - protein, 87 aa, Glycine max
  Coding DNA Sequence Number=SeqID_35635
  Homolog annotation: Hit_ID=Q6ESI7; Match level="QueryCoverage=70%, HitCoverage=6%, E-value=1e-12, Identity=47%"; Hit description =Putative tripeptidyl peptidase II
MTEYPKYIPLLAKILEGLVSRSSIKDKFHHDEEKIKKKMESTHDQLVEALYQKGLALAEIESLKLQYPFMQNREIKHHVDDIEKAQT

SEQ ID NO: 152414 - protein, 132 aa, Glycine max
  Coding DNA Sequence Number=SeqID_35636
MPTGDVFVFRGCFFTFQCSLCFSPEIVNNLFLNWPFVKFLWRWLASNLHCSFNLGSFTSFLAACDHFSGKQLLDVALASWDSKCYLENLDVRNQGAILVIETTWQKGWIRFWLNTDSSAMVVQSSSKPSLLP

SEQ ID NO: 152415 - protein, 229 aa, Glycine max
  Coding DNA Sequence Number=SeqID_35637
  Homolog annotation: Hit_ID=Q9LK64; Match level="QueryCoverage=40%, HitCoverage=6%, E-value=1e-13, Identity=49%"; Hit description =Multidrug resistance-associated protein 3
MVKLAPLEEPLLNGDSNVSNNYVPIKARGNETLTRYSNAGFSSILTFSWMSPLVTLRNEKTLEREDLPHLATNDSVDGILPTLTNKLESECGSVITTLRKYEVTAQMNNTMLGEPHSNDDNLRVAMRDSASRVKDNDSDDDGLRAKKVFNQDLYFRRTVKYVGDAMTHLEYIASSAARQSLIVRGLLPMLADPQHPNMYAQLLPLALPTPPMGGLGMPLMPPFWYATHG

SEQ ID NO: 152416 - protein, 73 aa, Glycine max
  Coding DNA Sequence Number=SeqID_35638
MYALENWFRHFNKHLIGNKNIFNPSTQEWRARRFDNEGWVTDVWADDCGGPDGTINLNYGLVFGGVGGGRLRH

SEQ ID NO: 152417 - protein, 185 aa, Glycine max
  Coding DNA Sequence Number=SeqID_35639
  Homolog annotation: Hit_ID=Q1S8P7; Match level="QueryCoverage=97%, HitCoverage=44%, E-value=2e-11, Identity=34%"; Hit description=HMG-I and HMG-Y, DNA-binding
  Pfam annotation: Domain name=DUF296; Domain location=1-66; Score= -19.9; E_value=0.024; Accession=PF03479.5; Description=Domain of unknown function (DUF296)
  Subcellular localization annotation: CTP_CleavageSite=58; ConfidenceScore=5.40e-01
GTFEILSLSGACTYTSSPSGLVRKTGSLSVSLARTDGRVFGGVLESALVAACPIQLVMASFKQNISSQQIKRKQLSESSNAPLMLCNSDSERDQLKLPKLTGGEKSCPSPPPTTLEPTATANGVADNVFVATSNGMVDNAITPDHNVHSPSVNGVVDLDSQAPQPASDDSDQRTYADVSASVMVL

SEQ ID NO: 152418 - protein, 272 aa, Glycine max
  Coding DNA Sequence Number=SeqID_35640
  Homolog annotation: Hit_ID=Q1SZM6; Match level="QueryCoverage=38%, HitCoverage=34%, E-value=4e-19, Identity=43%"; Hit description =Ribonuclease H
MTEKQPLNSMGIVNMGVDIDAVTNANIMRNNDTISQQITEESTDKRQTWCPTQTTLAASGTVNAKSGPTTSGAIIYDVGFGKNSTIPMKTIVSHNRFTILHENDNEAHTMDVGNKEFHVEVDDMILETPLELQIATDCLEGQECNYFSRQPWNLWKKLDKPTGYVGWKPPIAPSIKLNIDESSFGDPGISGFGGVLRDQTSKCLSSFSGNYGNTTCLKAALFAVYHGLKTAWQRGFRHVVCESDSKIALGLIQDHVDPFHPYFSLALFIRDR

SEQ ID NO: 152419 - protein, 144 aa, Glycine max
  Coding DNA Sequence Number=SeqID_35641
  Gene Ontology: Mol. function=DNA binding; Biological process=DNA integration
  Homolog annotation: Hit_ID=Q1SS72; Match level="QueryCoverage=91%, HitCoverage=12%, E-value=1e-25, Identity=32%"; Hit description =Integrase, catalytic region
MSGGSEQTPSMDNFLYLHPNENPAVTLVSLVLDSTNYHSWSRSIEFVDGSAPEPPKTDRMHGDLLQILNLQQEASSMKQGDLSVTEYFTKLRIIWDEIENFIPNPICSCTVRCSCSVLVTIAQHKLEDRAMQFLSGLNEQYSNV

SEQ ID NO: 152420 - protein, 97 aa, Glycine max
  Coding DNA Sequence Number=SeqID_35642
KHEFPLGHKFYNAKTIANSIVTVDSKVTDDQTQHHKSQEVRLSPEQYKALLALIQQPFPGNSASTPSHVNQIASVSSCSTNPTPTSGYEHSSKDWYS

SEQ ID NO: 152421 - protein, 224 aa, Glycine max
  Coding DNA Sequence Number=SeqID_35643
  Gene Ontology: Mol. function=DNA binding; Cellular component=beta -galactosidase complex; Biological process=DNA integration
  Homolog annotation: Hit_ID=Q1SDN3; Match level="QueryCoverage=94%, HitCoverage=25%, E-value=2e-40, Identity=57%"; Hit description =Polynucleotidyl transferase, Ribonuclease H fold
MSISASTESTSYVEASHHDCWIKATQAELHAFQMNHTWTLTTLPPHKIAIGCRGVYKIKYNVDGSIERHKARLVAKGYTQMEGLDFLDTFSPVAKLTTVRLLLALAALNDWHLKQLDVNNAFLHNELNEERKYTLDILSDSGMLGSHPTSTPMDYSTCLNATSGTLLSASYSSSYRRLVGYLIYLTNTRPDITHVVQQLSQYMANPTTAHSQATYVFSVILRAP

SEQ ID NO: 152422 - protein, 40 aa, Glycine max
  Coding DNA Sequence Number=SeqID_35644
MASIIVAICSFKASVSAFIFSCTSSTSPITLALTRVWTWG

SEQ ID NO: 152423 - protein, 240 aa, Glycine max
  Coding DNA Sequence Number=SeqID_35645
  Gene Ontology: Mol. function=geranyltranstransferase activity; Cellular component=chloroplast; Biological process=isoprenoid biosynthetic process
  Homolog annotation: Hit_ID=Q6D843; Match level="QueryCoverage=100%, HitCoverage=79%, E-value=1e-88, Identity=70%"; Hit description =Geranyltranstransferase
  Pfam annotation: Domain name=polyprenyl_synt; Domain location=1-240; Score=351.5; E_value=1.4e-102; Accession=PF00348.8; Description =Polyprenyl synthetase
MQYGALLGGKRLRPFLVYATGEMLRAEAASLDAPAAAVECIHAYSLIHDDLPAMDDDALRRGQPTCHIKYGEDTAILAGDALQTLAFTILADQPMPGVSPQDRIAMISELAQASGVAGMCGGQALDLAAEGQSVDLNQLEQIHRHKTGALIRAAVRLGALTAGAAGREALPQLDIYANAIGLAFQVQDDILDVVGDTAVLGKTQGADQALGKSTYPALLGLDNARAKAQDLYREALGALE

SEQ ID NO: 152424 - protein, 53 aa, Glycine max
  Coding DNA Sequence Number=SeqID_35646
MYKQEKVTRGLILTLVSWSSTGFLVNFDSLPWNVSVKMLLLEFTRVFGIELLE

SEQ ID NO: 152425 - protein, 129 aa, Glycine max
  Coding DNA Sequence Number=SeqID_35647
  Gene Ontology: Mol. function=methyltransferase activity; Biological process=metabolic process
  Homolog annotation: Hit_ID=Q6X0N8; Match level="QueryCoverage=96%, HitCoverage=16%, E-value=2e-59, Identity=85%"; Hit description =Putative spermine/spermidine synthase
MNLSFGLHQSIQSTYVNNRTEALILELHGSHVHDVPSHEGTVTDVAAEHVGDDDLGEVDVGDGSVAGVVEVLREARVATAGDEELKRERNGFGEGEEWAPEVGPFNIPLEGIAAKGEELVPVLFACEVS

SEQ ID NO: 152426 - protein, 147 aa, Glycine max
  Coding DNA Sequence Number=SeqID_35648
MSGHYCVVVGVLPRRAMNTDLVLTPSVTSSQWDGHFWIVASISCAGKSCANKERGWGQGKACVEIRHRRSGTRDCGSRSPWWWRSEGPPWIDTGGDIEHAGVVEGDNKDEEVVAEDEREGEDFLFKKIEMCFISLKKEMRSVLKDEG

SEQ ID NO: 152427 - protein, 78 aa, Glycine max
  Coding DNA Sequence Number=SeqID_35649
MLQKSNILVLVQQSQEVAEEASILLSPLQQDSSSKSTQSRVRSLVDIYESCNTAMVEPKCYEKSSKKQRQLIKQIKLE

SEQ ID NO: 152428 - protein, 119 aa, Glycine max
  Coding DNA Sequence Number=SeqID_35650
MRLGTQTGYVKEMHNVSQNPGTNDGRAYVTKGKVAGAMHKKQPKPSYDAKSEAAQVVNGCNGYSVYSGPAPVSGYSEMQRYHAGSCTSAVNNSAVTVVHVIKLVLQSLIASSFFSYNND

SEQ ID NO: 152429 - protein, 107 aa, Glycine max
  Coding DNA Sequence Number=SeqID_35651
MHVITLHRHWHAHPHLIERLKVLVAAYLGNLVVDLMMPLNLMLHSTTGNSSAELTSWASFSLRVSPETRSWVRWAIGSLVLSRIGKVSWRTSCRNKETELTRRGGGE

SEQ ID NO: 152430 - protein, 62 aa, Glycine max
  Coding DNA Sequence Number=SeqID_35652
MGEQEIEGEKEGEKLNCEVCLIRLSFIKVVTSVTHVSIYSLGIFQGYAKGILEYFKNMPKES

SEQ ID NO: 152431 - protein, 85 aa, Glycine max
  Coding DNA Sequence Number=SeqID_35653
MTSFFPTELDENKDDFMVLENPIFPTLSSGIRLYCYRRIHVFKVRMLVDKRRHRLCLRVWVPLGRKNMDWPSIRVPMLRYLAKVL

SEQ ID NO: 152432 - protein, 165 aa, Glycine max
  Coding DNA Sequence Number=SeqID_35654
  Gene Ontology: Mol. function=signal transducer activity; Biological process=G-protein coupled receptor protein signaling pathway
  Homolog annotation: Hit_ID=Q9C516; Match level="QueryCoverage=88%, HitCoverage=13%, E-value=1e-13, Identity=38%"; Hit description=G -protein alpha subunit, putative
MALEGISEEDAPPGASIPDDASNLDYSIAIQYVGPPVSYEVPRVEPFDANSRAIPTAQPLSRSQRSNTHGGHMVIEPIPLLVSHIASVTSSPNQSPRVSGSSDSMVSVLHNPDLYSASPSASPSSIHNLLSNPHKPGNEVKRASVATFNTIDRPQRKEVEVVKPV

SEQ ID NO: 152433 - protein, 138 aa, Glycine max
  Coding DNA Sequence Number=SeqID_35655
EGRRGRLEFFSEKENQETQQPHPGKGNAPEKNPHCVAVVLPEKKHTGGRQFLLSLCELYIKASSKGRPSTIREVNVEAKLHGESKNNSSESRTIQEFKIRIKKNSRLKKKVKSQESRFKVQDLKNQDQDSRFKNQEKA

SEQ ID NO: 152434 - protein, 184 aa, Glycine max
  Coding DNA Sequence Number=SeqID_35656
MGKRGCISYNLILTIRQLGYPMRGAPLEEELAPVISRGFSETNVETYRKARKAWEVVQKKDKELRGSNNGPIGGYRKWLKAHVQGLDWLPSLRTAKREEVEAPEEDEEVQALRTGLKQAQTVKESKYQEELSLAMTHEHRVADKYAQVYAEKEARGRVIDSLHQVATMWMDRFALTLNGSQELP

SEQ ID NO: 152435 - protein, 268 aa, Glycine max
  Coding DNA Sequence Number=SeqID_35657
  Gene Ontology: Mol. function=nucleic acid binding; Biological process= transport
  Homolog annotation: Hit_ID=Q8H6Q8; Match level="QueryCoverage=66%, HitCoverage=5%, E-value=2e-31, Identity=39%"; Hit description=CTV.20
  Pfam annotation: Domain name=MP; Domain location=6-180; Score=37.0; E_ value=6.4e-08; Accession=PF01107.9; Description=Viral movement protein (MP)
MDDWNIPEIPQDQLYVPETIKDKHNFDYIIKIVENNIPLGQDIGEEFHLLSKNSIYEHSRKYKYLHIGYVQVAIKPLIDMGIDATVLMCLRDIRHNKFEDSLIGTVETSLGQAPVYFNCYPNKTVSLMDKNILDSLFLNINFHGLDMKEGSIPAALIYRIQYKVMNTCASRVLLQPQKGETTLFITDITKANVSLKRIIKQDDVTLPEKWDMEKATPSDPRPTPIIEKIKQDNSGKVEITFNRRNSHEWNIDAQMEYNIVNAHQHMIM

SEQ ID NO: 152436 - protein, 195 aa, Glycine max
  Coding DNA Sequence Number=SeqID_35658
  Gene Ontology: Mol. function=calpain activity; Cellular component =intracellular; Biological process=proteolysis
  Homolog annotation: Hit_ID=Q1SI76; Match level="QueryCoverage=74%, HitCoverage=44%, E-value=8e-20, Identity=39%"; Hit description =Cyclin-like F-box; F-box protein interaction domain
  Pfam annotation: Domain name=F-box; Domain location=28-75; Score =31.8; E_value=2.4e-06; Accession=PF00646.23; Description=F-box domain
MLNPSNIGTYICGLFTENHRNMRSEKKSCSPLLYDELIKEILSRLPVKTLIQFKCVYKGWNSLMSDPYFIKLHLNKSATKDDLEHLQLMKNFIIPFPTIKTSLFNFANIPSYHLVGSCNGLHCGVSEIPEGYRVCFWNKETRVISRQLPTLSFSPGIGRRTMLGFGYDPSSDKYKVVAIALTMLSLDVSQKTEMK

SEQ ID NO: 152437 - protein, 131 aa, Glycine max
  Coding DNA Sequence Number=SeqID_35659
MSFVLNSTLGMGGNDFEGSIQQPLVESVVIPIGDSSIEEPHHEASDNRSSSFERLLDLRHIREGSSRACERVPPSASFLEEEPIPVITILPFSPPTVRGMGDGGIIRVSPQSRHSHSAGTFSPPPFVVGYE

SEQ ID NO: 152438 - protein, 78 aa, Glycine max
  Coding DNA Sequence Number=SeqID_35660
MTQELVARRDTLWLSAPRHSVTPSVIDEQRPMWSYAPFPEMSAFSGGDFFKSHKIRRSKSLAFVGHPHKFCHAGTGVT

SEQ ID NO: 152439 - protein, 642 aa, Glycine max
  Coding DNA Sequence Number=SeqID_35661
  Gene Ontology: Mol. function=pyridoxal phosphate binding; Cellular component=cytoplasm; Biological process=gamma-aminobutyric acid metabolic process
  Homolog annotation: Hit_ID=Q0X7A2; Match level="QueryCoverage=68%, HitCoverage=96%, E-value=0.0, Identity=71%"; Hit description =Aminotransferase class-III
  Pfam annotation: Domain name=Hep_Hag; Domain location=8-35; Score =17.7; E_value=0.041; Accession=PF05658.4; Description=Hep_Hag
  Subcellular localization annotation: CTP_CleavageSite=12; ConfidenceScore=5.20e-01
SNPSGGWARKPSSSAAGSSAVLDARDVISIGTGTGSASTSALGLGQRLVEQDDRQVDFFVADVQRRRKGDHVLVPATHVEHEAHALAVVQQVTGQADVDHAVQQFLVRGVAVGLADFRAQGQAQAVDVADFRVALLQATQAVEEVRALLRHGALVVHFLAQLQHFQAQAGAQRVGVEGGMGGARREHGRVDQLFASPQARQRVQAVGQRLAEHQHVRCDTEVLDRPQLAGAPEAHLDFIDDHQDAVLVQHALEAGEEVARRNDVAAGALDRLNVERGVLGLADLGIPHAVVLAFEQALELPHAVVGILVRGHALRATEGVRERDEHRTLAEVAVAAAVAVAGGDRRRTQGAAVVAAFEGEHQALAAARVAHDLQRVFNGLRAADVEVHAAVEVELLVHVHGNGLGQLHAGRVQVLAGDLRQGVDLVLQRVVQALVAVAEVAGRVPHLQVEVGHARTVEHVAAFAALEDLRRVDVVDGVAEGAVAGFVGQQLRVGGSGVGVLVKNVHAVRFREGRSKEVAGACSGGGQQQGQCGGLRAGVDAAWLQQAAIEQTRQQRDCIVEGSDGGMPDAGIGAMGDQAALGEHEVGIFGYAEIRAAVTDHQHARCFVGARLRGAGAFAGATAAAFGLVGRFQFPVVPAPAQ

SEQ ID NO: 152440 - protein, 73 aa, Glycine max
  Coding DNA Sequence Number=SeqID_35662
MGVWPLKSICSAPFISFSLRIHSFDFRWLDRGSRGWMVITLADNERADVSIFAQPASSASRCFWLATISNCDR

SEQ ID NO: 152441 - protein, 111 aa, Glycine max
  Coding DNA Sequence Number=SeqID_35663
LLLCKKTLVSTVTPLGLEVIPQVKKLLDEGVPTDPKRIKVIPDWSILPTPLTELVRNHVPSWEDAQERGVKGRSPEYQEPWDFRSNSFQGGRDDSILPPKGIGLKTPIGLG

SEQ ID NO: 152442 - protein, 131 aa, Glycine max
  Coding DNA Sequence Number=SeqID_35664
MTDRLLVGSLTFDCCIMHYIIVRILLPRSSNLAQASEEDLILMWAFQTSRQIDWAHLVRYRMHKALRANAPLPYLHLVTLFLHHFNFPLDYEPFVKDLPPPILDERTLSTPPQRADSTSLLTEVLTKLCDL

SEQ ID NO: 152443 - protein, 612 aa, Glycine max
  Coding DNA Sequence Number=SeqID_35665
  Pfam annotation: Domain name=Transposase_23; Domain location=326-396; Score=9.7; E_value=9.8e-05; Accession=PF03017.5; Description =TNP1ENSPM transposase
  Subcellular localization annotation: CTP_CleavageSite=32; ConfidenceScore=5.72e-01
MASPPASPPPPPPPPSHPLPPSAPSDASASPSAVKRTRKASRGRHLRELEGGPYCLEGPNLGGYSADQDGVEDTICEKYDISKEKWAQFCQTRRDPSWEDVRKKAQVIQKQNTAPHVLSRGGYDYLEQKLLDEKTKKKLEEATQSGSADGVIDPPSPIRRHVKWKMARTKKTGEMATEAAKEIAEKIDSFEEQATQGSFVPHGRQDVLTTAIGRPEHPGCVRVVGAGVTIKQYFGSAPRTSHSSSSLPPEELQQLTQQIRDQLEESITEKVTRQLMASFSQMQSQIQSQMQSQGLALPPEPLVGSSGPRVSTKGRCVDPSGNDPETGDSDRCGLYINAYPARLVALGRVYEGSTVVHNTPLLPGQVKVSVEEVTDADAPVPVPTDEVSLVGQALHTFLAWPTHLVVVSPVKPPPKPDPEVDDPLYLMTLTILELFLRPYQVSWDDTMFGVFNPDFPLYIKHEDLSEIAHGGQCLSISVLQLWILHLTDTSMRAGNSDIYGFLEPQSIQRSGQSQFESESQKTTIRGLLTGLDDAPQPKSKAPARWIVVKCNKQKGSTECGYYVMHWMSTIILGTFRNNWEAYFNDPRPLEPERLKALQIQWAQHYLRVRDQT

SEQ ID NO: 152444 - protein, 50 aa, Glycine max
  Coding DNA Sequence Number=SeqID_35666
MVVAGKMQNVFNELLTANTLFTGLQNGSVLSYMNECKVSGKWPKREKASH

SEQ ID NO: 152445 - protein, 133 aa, Glycine max
  Coding DNA Sequence Number=SeqID_35667
  Gene Ontology: Mol. function=RNA-directed DNA polymerase activity; Biological process=RNA-dependent DNA replication
MQPDLVVSGRVCIFGARHVQISIIDAYSPFGVGLFYHDDVGELGKIFDFSDEVGIEEFVHFFSDSFAVVATYPLVRGRRGDHGCVFQERKMGGVATNVYSRKTSEKLERCGLRTLIVKGSGVVFMHGEGEKMA

SEQ ID NO: 152446 - protein, 113 aa, Glycine max
  Coding DNA Sequence Number=SeqID_35668
SLRAIRLFVLQTAKKNVYTDNHSGISARQRVSNVSMTDLVSAEDDTAKKNVYTDNHSGISARQRVSNVSMTDLVSAEDDTAKKNVYTDNHSGIYARQRDSNVSMTDLVSAEDD

SEQ ID NO: 152447 - protein, 88 aa, Glycine max
  Coding DNA Sequence Number=SeqID_35669
  Subcellular localization annotation: CTP_CleavageSite=17; ConfidenceScore=5.02e-01
MVQQSSCYTKPNTFYITCSKLKYSNQKWRNTVGLGWKRMKERLRDRKMQRVQRQTKHEQVFGCWKLERAKCKVRNKHIRLHDAKTRVK

SEQ ID NO: 152448 - protein, 105 aa, Glycine max
  Coding DNA Sequence Number=SeqID_35670
  Subcellular localization annotation: CTP_CleavageSite=51; ConfidenceScore=5.05e-01
MGIAPTKTPSGPEEVQQGPGVSSSGSVCRPQQGHQVPPTNRAFIKKFCVSRQAQGETPQQPGDGWQRATDAPPSPLEFTSAHPQKGLSIAYTTWPTNRRPSPKPK

SEQ ID NO: 152449 - protein, 63 aa, Glycine max
  Coding DNA Sequence Number=SeqID_35671
  Gene Ontology: Mol. function=amino acid binding; Biological process =metabolic process
  Homolog annotation: Hit_ID=Q9ZPQ8; Match level="QueryCoverage=98%, HitCoverage=14%, E-value=1e-20, Identity=72%"; Hit description =Putative uridylyl transferase
MKYVVFHANIDAEGPEAYQEYYIKHIDGSPVKSDAKRQRVIQCLAATIKRRGLKLELCTTDKL

SEQ ID NO: 152450 - protein, 92 aa, Glycine max
  Coding DNA Sequence Number=SeqID_35672
MAEKVHTRGLDWLSKLKIINKENFEAPEEDEEVRALKTELGKTRLAKEKFKLVTTEIRKECAELREENAATARALEQETKRAHKEEHGRDKF

SEQ ID NO: 152451 - protein, 306 aa, Glycine max
  Coding DNA Sequence Number=SeqID_35673
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=8e-42, Identity=31%"; Hit description= UPI00006A17C9 related cluster
TLDTLTLRGLHVLAFRGLHVPTFRGLHVLPFRGLHALAFRGVHVLAFRGLHVHTFRGVHVLALRWLHALAFRGQHVLTFRLLHVLAFRGLYTLLFIGLHALPFKGLHVLAFRGLHILLFRGLHALTFRGLHALAFRGLHILVFRGLHSITFRGLHVVAFRGLHALSFRGLHALSFRGLHVLAFRGLHVHALRGLHALAFKELHGYTPSPSEGCTPSLSDDYTSSPSEDYTFSPSEDYTCSPSEDYTSKPFEGYTPSPSKGYRSSPSEGCTPSPLKDYMSSPSEGYTSPPLEDYTSSPLEGYTLSPS

SEQ ID NO: 152452 - protein, 574 aa, Glycine max
  Coding DNA Sequence Number=SeqID_35674
  Gene Ontology: Mol. function=transporter activity; Cellular component= membrane; Biological process=oligopeptide transport
  Homolog annotation: Hit_ID=Q9CAS0; Match level="QueryCoverage=95%, HitCoverage=88%, E-value=1e-159, Identity=47%"; Hit description =Putative peptide transporter; 37139-33250
  Pfam annotation: Domain name=MFS_1; Domain location=34-517; Score= -13.6; E_value=0.0013; Accession=PF07690.6; Description=Major Facilitator Superfamily
  Pfam annotation: Domain name=PTR2; Domain location=96-505; Score =187.2; E_value=4.1e-53; Accession=PF00854.12; Description=POT family
  Pfam module annotation: Pfam domain module=MFS_1::PTR2; Domain location=34-517::96-505
MPSLQKKLLDEESLAESVPQAHSRKPGWKAMPYILGNDTIERLATFGMQANFVVYLMKVYNMDQVLSANILNAWLAVSNITPLIGAFIADAYLGKFLTITLASFASLVGMAIVMLTAWVPKFHPAPCSIQQQQFGECTGQTNFQMGVLMFGLFWLSIGTGGIRPCSVPFAVDQFDLTTAEGRHGSSIFYTLYYTTQTLIMLINQTLLVYIQDSVSWTLGFALPTVFILISIILLFAGTKVYAYVKPEGSNFSSMFEVLVAAQHKRHFHVPAAEDTEGAFYDPPLHDDSETKLPLTNEFRCLNKAAIVEENELNNDGSSKDPWRLCSVQQIEELKCLLKIMPIFITSIIVNIPIGQQAIFGVSQALKMDRNLGHNFEIHAGSVNVIMMLSIGVFLPIYDQIIAPALEKITKQEGGLTTLQRIGLGHAFGVLSMVVSGLVEIKRRELAISKGASDGVAPMSVMWLAPQFMLLACCHVFGTVGHTEFFNKEFPDGMKSIGNSLLCLNVSAASNLSSFIVNIVHSYTRKLGQPDWLDGDINKGRLEYFYFFIAALGVLNMCYFIFCSRRYHYKITRLL

SEQ ID NO: 152453 - protein, 65 aa, Glycine max
  Coding DNA Sequence Number=SeqID_35675
MAYGMSGKSEISEGGANDSVASVGDVIFVKLRDSSWWPAQVVDENSVNKSVKPSKLTKQLPRDIL

SEQ ID NO: 152454 - protein, 57 aa, Glycine max
  Coding DNA Sequence Number=SeqID_35676
  Subcellular localization annotation: CTP_CleavageSite=49; ConfidenceScore=5.06e-01
MSPSAMRSATHPRARNDYVAVQLAPNFLKGLCRNRLTITGVVLSSESIACRHKRGVL

SEQ ID NO: 152455 - protein, 102 aa, Glycine max
  Coding DNA Sequence Number=SeqID_35677
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9SP38; Match level="QueryCoverage=77%, HitCoverage=42%, E-value=2e-25, Identity=65%"; Hit description=NADH ubiquinone oxidoreductase PSST subunit
MNVEAVAKKSKNPRKGIEGILAKSGSHLVGESADDDQTDEAVKIVVGGTDVHHFDGAGCETEGHGPDGAMTSPVHQIVNLQHHKLCRLRHVGRRGSTREREM

SEQ ID NO: 152456 - protein, 88 aa, Glycine max
  Coding DNA Sequence Number=SeqID_35678
MEYTPLVHSWHFPFPSLSVPPKGDPTEDIAAPNGIVIVEDEEAPNDIVAAPKIEESVAPNASAGEEEEAREKKGIEEEEKREKERGDG

SEQ ID NO: 152457 - protein, 106 aa, Glycine max
  Coding DNA Sequence Number=SeqID_35679
MESYDTIMLEKYGEDSSKHPLVDSTTWVELLGSKKRRVFGTMATSSSKVIGHPSHTSISTQEVIKEVVNVAMTSFVDDSLMPMLEPIICFFGGSQAKAAEEDHEDS

SEQ ID NO: 152458 - protein, 68 aa, Glycine max
  Coding DNA Sequence Number=SeqID_35680
MCKSYQLDKAPLKYVCHQSKQWFLYQYPFGLSRWLPYPLVDLILEGLLELLENKECAHWKAKYVSGWI

SEQ ID NO: 152459 - protein, 88 aa, Glycine max
  Coding DNA Sequence Number=SeqID_35681
MEQAWGRVRLVRMHGPKFSTVTVTASLKGQYPGEMRFSFSCKHYYKKAFPRHQNNIGAMPTLLNMYRWHFCKYPDINDNVFGAARCRI

SEQ ID NO: 152460 - protein, 306 aa, Glycine max
  Coding DNA Sequence Number=SeqID_35682
  Gene Ontology: Mol. function=hydrolase activity, acting on ester bonds; Biological process=lipid metabolic process
  Homolog annotation: Hit_ID=Q7X9E8; Match level="QueryCoverage=25%, HitCoverage=76%, E-value=3e-13, Identity=46%"; Hit description=Lipase
MQMFQKGSPVARDVSKAILHLSEKAELKRLEEKWLITSPASCSNVTSDDTDSLKLRSLWILYVISGATSTICVLLSAIQSLVKSCHQCQAVAPEGNDTPSDHKVWEKEQVVTDCSSRWDRVNMTVSPEHQQEMASPLPGILMLPSPPPEDLPGFMESLVKQMSVNLKRLHSLGIKKVAVGLLQPIGCFPGLNVIFCRTNCIGLLNVISKDHNKMLLKAVQELNKEAAVKSVFITLDLYNSFLSAIETMQKKRAEKSTLMNPLQPCCEGNKLEDSCGSVDDEGSKKYSLCENPKLSFFWDTLHPSQN

SEQ ID NO: 152461 - protein, 113 aa, Glycine max
  Coding DNA Sequence Number=SeqID_35683
MVVMCENEFRRWCPNFRIIKWFRCMLEKVRVLGKESGGTNLRGRKNVETYGPTYELLEGPTKELFEGHTKESHKADLNLSHLCSHGNFLGSSVEVYLDSVNMDLFFLLSITRC

SEQ ID NO: 152462 - protein, 37 aa, Glycine max
  Coding DNA Sequence Number=SeqID_35684
MWLYSPEFEGIICAGEYGKSTIFKQARNCIFSTACEL

SEQ ID NO: 152463 - protein, 339 aa, Glycine max
  Coding DNA Sequence Number=SeqID_35685
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6PP98; Match level="QueryCoverage=98%, HitCoverage=77%, E-value=1e-158, Identity=85%"; Hit description =Mitochondrial pyruvate dehydrogenase kinase isoform 2
  Pfam annotation: Domain name=HATPase_c; Domain location=152-299; Score=57.6; E_value=4.2e-14; Accession=PF02518.16; Description =Histidine kinase-, DNA gyrase B-, and HSP90-like ATPase
MKNIVRDWYVDSFRDLRAFPNIKNVNDEQDFTEMIKAIKVRHNNVVPTMALGVQQLKKRMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYVFNRMDTNSYASFVRRESLEFLVQHPFGGLPTEKQICTKLDITHYTLELCTDAYLHLSRLGDSQEPLP

SEQ ID NO: 152464 - protein, 324 aa, Glycine max
  Coding DNA Sequence Number=SeqID_35686
  Gene Ontology: Mol. function=sequence-specific DNA binding; Cellular component=nucleus; Biological process=regulation of transcription, DNA-dependent
  Homolog annotation: Hit_ID=Q93XA4; Match level="QueryCoverage=99%, HitCoverage=100%, E-value=1e-117, Identity=68%"; Hit description =Homeodomain leucine zipper protein HDZ2
  Pfam annotation: Domain name=HALZ; Domain location=136-180; Score =57.0; E_value=6.3e-14; Accession=PF02183.8; Description=Homeobox associated leucine zipper
  Pfam annotation: Domain name=Homeobox; Domain location=81-135; Score =63.6; E_value=6.2e-16; Accession=PF00046.19; Description=Homeobox domain
  Pfam module annotation: Pfam domain module=HALZ::Homeobox; Domain location=136-180::81-135
MAGQKLHGGSSMTLLLQKERLPCSPELIQSFCFQNSEPSFQGSKSMANVVNVTHRPFFQGPEKEENGNDADFEVCLHQPGKTRRLTSEQVQFLQSNFEVENKLEPERKVQLAKELGMQPRQVAIWFQNRRARFKTKQLETDYGMLKASYHVLKRDYDNLLQENDKLKEEVNSLNRLIPREQEEQNSDDTSCDTVNSRHKEHKEHKDLIINTGSENGSEVPLPVKVINKHEDANSAKSDVLDSESRHFTDGNQSSYMEPADSSHALEPDHSDFSQDEEDILSQNILTMPFLPKVEDVCYEYDEPNENSCSFRFPLEDQAFCFWSY

SEQ ID NO: 152465 - protein, 89 aa, Glycine max
  Coding DNA Sequence Number=SeqID_35687
MAYGKTTARDLHKNYNIGVNEGMDEKGKGLDEKDMGLQLIHMDFGVEEEEHENFGNSRIYIKIFHSYYCNAYFNKFEVGITNGRKWRVL

SEQ ID NO: 152466 - protein, 420 aa, Glycine max
  Coding DNA Sequence Number=SeqID_35688
  Gene Ontology: Mol. function=transferase activity; Cellular component= nucleus; Biological process=regulation of transcription
  Homolog annotation: Hit_ID=Q9FND7; Match level="QueryCoverage=47%, HitCoverage=36%, E-value=3e-47, Identity=44%"; Hit description =Selenium-binding protein-like
  Pfam annotation: Domain name=PPR; Domain location=223-257; Score =15.6; E_value=0.11; Accession=PF01535.11; Description=PPR repeat
  Pfam annotation: Domain name=PPR; Domain location=258-291; Score=5.3; E_value=1.8; Accession=PF01535.11; Description=PPR repeat
  Pfam annotation: Domain name=PPR; Domain location=294-328; Score =14.9; E_value=0.13; Accession=PF01535.11; Description=PPR repeat
  Pfam module annotation: Pfam domain module=PPR::PPR::PPR; Domain location=223-257::258-291::294-328
MGQWVFMYAELGCSVQMPILHACANCGNIDFARKMVCTIWEVKGGVGYVPFDVDGGWVHAYVERYKIRMMVTLGVALGDMYVEAKLHDESKLIQRCFDDSKDDDKGDDKKLKGQSKNEFKMFKIESITLQDSRGKLISRIKIQGSSFQESRSKFKTQDSRIKRRLNQDKGYIYLGLTENKIGYISCGSVLVEGTSTRFKENKGGYIPRGSLLVKGFLQGKKCLYLESAIGGLAMNGFGQESLDLFYDIKREGVQPNGVTFISVLKGCNVVGLMEKGRKHFDSMMNVYGIDPRLKHYGLMVDMYSRAGHLEEALNFINSMPMKPMLVHGVLCFMLVECIKTKNSGELSKRNIVELEDKNDCAYVLKSMLPGCSVIEVDGEVHEFIVGDKSHPRYGEIELKLEEISKCLRLDGNVVNTNTAF

SEQ ID NO: 152467 - protein, 333 aa, Glycine max
  Coding DNA Sequence Number=SeqID_35689
  Gene Ontology: Mol. function=ribonuclease H activity; Biological process=RNA-dependent DNA replication
  Homolog annotation: Hit_ID=Q1SZM6; Match level="QueryCoverage=52%, HitCoverage=60%, E-value=1e-28, Identity=33%"; Hit description =Ribonuclease H
  Pfam annotation: Domain name=RnaseH; Domain location=209-323; Score= -29.5; E_value=0.033; Accession=PF00075.14; Description=RNase H
MDNMGVVRNEGKLKRKGKGWGGKREGQFCPFTYIQKGVIAPTLLNLLMASSPELISPMVPLQVTDPGCGNSSYPKILNFSCGSLAISPCQLILFYFTAPFVFRFFLSQVWIGAQEESILQLDIIKQIDANDDSSTWIRHYAGSTHGGLFVVTCLILWKHRNARIFNNVVWENWFIISQIWNLQSIIRKFFVPKPSHVHDISARWIPPTSNFIKLNTDGSSLGNPDNVVFGCLLCDSLGQWISSYLGSCEIATCLFAELIAIYHGINIAWNKGIRNLYCESDSKNFIQGLKVKTQKITHFIQFARPQFVTHTHVQKKSLSQGIFVERLPLCIAK

SEQ ID NO: 152468 - protein, 135 aa, Glycine max
  Coding DNA Sequence Number=SeqID_35690
MVTNYEKLRENTKPLNELVTTTFKRPDEASSSNSSEVFHSLMIKPKVKEDNKMPIFAVKADGRVIYSYNVNEHFIWDVAPEMCDSNCSWMTVMETEDETDDEDECEGRWKPEPRPCKPPPPPQEEVTQKMDHGRE

SEQ ID NO: 152469 - protein, 92 aa, Glycine max
  Coding DNA Sequence Number=SeqID_35691
MARTARVVLSFLFYFFCRRIICSYSVENNDQRRKGARDNVYGSISKAAKDMSPIPVFEDALHFLFLPLNKNLCVAVAVFQAFEYFLTLMCFH

SEQ ID NO: 152470 - protein, 58 aa, Glycine max
  Coding DNA Sequence Number=SeqID_35692
MEAFGLLAGNVKEKEEGNVSASGYWVASNRSCPAAQPCPAMADEPDTVLHASHVHLRV

SEQ ID NO: 152471 - protein, 51 aa, Glycine max
  Coding DNA Sequence Number=SeqID_35693
MVKSHKVKKDSWQGKQTQDGAPPKVSGPLEKDFNLQGGDGLDAKIVRMFFS

SEQ ID NO: 152472 - protein, 77 aa, Glycine max
  Coding DNA Sequence Number=SeqID_35694
MAKTKRCRRLIRDKGDGSMREMDLQRWRFCDRDRSTMVERSKVEMVEVKALLVIGGVGGGVVGHQRQHVRIWEREGR

SEQ ID NO: 152473 - protein, 142 aa, Glycine max
  Coding DNA Sequence Number=SeqID_35695
  Gene Ontology: Mol. function=protein dimerization activity
  Homolog annotation: Hit_ID=Q2R1C3; Match level="QueryCoverage=71%, HitCoverage=14%, E-value=9e-25, Identity=50%"; Hit description=HAT family dimerisation domain containing protein
  Pfam annotation: Domain name=hATC; Domain location=51-127; Score =31.0; E_value=4.2e-06; Accession=PF05699.5; Description=hAT family dimerisation domain
MVISLEWSTYEDDDVRKAKKVKETLLNDIWWDKTNQFGVCNFFGKREGFHDVDSLRDRIELDAKFWWLVHGAYAPTLQKIVLKLLGQPSSSCCCKRNWSTYDFIHSSKRNKMTPKRVEDLVYVHSNLHLISRNSSNYNEEET

SEQ ID NO: 152474 - protein, 206 aa, Glycine max
  Coding DNA Sequence Number=SeqID_35696
  Pfam annotation: Domain name=zf-CCHC; Domain location=178-195; Score =9.8; E_value=0.023; Accession=PF00098.13; Description=Zinc knuckle
VLSYDESSKIIPLRHELSPTGFCEQVRPSSKNHYSFLCIYYPSHCSELKPDFNIGESFASTLALEKSHSKLWRTNRSKEPLSWKKKCLTTIWQEHFGAYNAVMNVYDNNSSARTTISSSRRSTSRRSNQLVIRGRTTARSLRHASTPRPTHEEVTIFAKGQKKKKGKGGKKRKFDPKDICNYSKELGHWKQDCPKKAKKYFVVTLV

SEQ ID NO: 152475 - protein, 47 aa, Glycine max
  Coding DNA Sequence Number=SeqID_35697
MGEEEKGKWLNPFLSTFKVGLSTARHNFLKSKIGVTESGSILQEHFK

SEQ ID NO: 152476 - protein, 113 aa, Glycine max
  Coding DNA Sequence Number=SeqID_35698
  Gene Ontology: Mol. function=transporter activity; Cellular component= membrane; Biological process=oligopeptide transport
  Homolog annotation: Hit_ID=Q9CAR8; Match level="QueryCoverage=92%, HitCoverage=17%, E-value=9e-30, Identity=63%"; Hit description =Nitrate transporter (NTL1); 53025-56402
MELEQNQRWEGYVNWRNKPALSGCNGGMLAASFVLVVEILENLAFLANASNLVLYLRQYMHMSPSKSANNVTNFMGTAFLLALLGGFLSDAFFTTYQIYLISAVIEFLKESNL

SEQ ID NO: 152477 - protein, 188 aa, Glycine max
  Coding DNA Sequence Number=SeqID_35699
  Gene Ontology: Cellular component=cytoplasm; Biological process =multicellular organismal development
  Homolog annotation: Hit_ID=Q2LFC4; Match level="QueryCoverage=50%, HitCoverage=12%, E-value=1e-37, Identity=65%"; Hit description=AGO1-1
MGVANLITNINQTQINGFGMILGKISNITNINQVVTLVEQSQEFPQKQGGRENYDQYGRTIWKLHCCASSAGDLKRICETDLGLASQCCLTKHVFKMSKQYLANVALKINVKVGGRNTVLVDALSRRIPLVVASQDYPEITKQELIQDLFKQWQDPVRGRVTGGMIKYSPSLFLICEMVNAHWDIGVA

SEQ ID NO: 152478 - protein, 508 aa, Glycine max
  Coding DNA Sequence Number=SeqID_35700
  Gene Ontology: Mol. function=transporter activity; Cellular component= membrane; Biological process=oligopeptide transport
  Homolog annotation: Hit_ID=Q9CAR8; Match level="QueryCoverage=93%, HitCoverage=79%, E-value=1e-168, Identity=62%"; Hit description =Nitrate transporter (NTL1); 53025-56402
  Pfam annotation: Domain name=MFS_1; Domain location=1-448; Score= -35.9; E_value=0.014; Accession=PF07690.6; Description=Major Facilitator Superfamily
  Pfam annotation: Domain name=PTR2; Domain location=17-436; Score =371.5; E_value=1.3e-108; Accession=PF00854.12; Description=POT family
  Pfam module annotation: Pfam domain module=MFS_1::PTR2; Domain location=1-448::17-436
MYNILIVHTYHVAQLLFMTKGIGTCVCSMLQGLIVLTVQARVPSLKPPACDASTPCNEVSGGKAAMLFAGLYLVALGVGGIKGSLPSHGAEQFDDNTPSGRKKRSTFFNYFVFCLSFGALIAVTFVVWVEDNKGWEWGFGISTITIFVSIPVFLAGSTTYRSKIPSRSPLTTILKVLVAASLNSCFNSRNSSSAVVNMTSSPSNLNSGRKQVGKEASNIANKEPEAPITNTLKFLNKAVENNPIYSSIKCTVEQVEDVKIVLKVLPIFACTIMLNCCLAQLSTFSVEQAATMDTKLGTLKVPPASLPIFPVLFIMVLAPIYDHIITPFARRVTKTEMGITHLQRIGIGLVLSVVAMAVAAVVEVKRKRVAIMATHSNSLLDDATKPLPITFFWIAFQYLFLGSADLFTLAGLLEFFFTEAPSSMRSLATSLSWASLAVGYYLSSAIVSIVNSVTGNTSHRPWLSGTNLNHYHLERFYWLMCVLSALNFLHYLFWAIRYKYRGTGTTNN

SEQ ID NO: 152479 - protein, 126 aa, Glycine max
  Coding DNA Sequence Number=SeqID_35701
MEGYRALGLLVVILFGVPTLRGLRQAIDEIKKRRTAAARTILTAIAFFKPSEGSCSNLSLRRAFFCVFCAEVKIGMFKSRIEELFDEVSLNGELYAIMSVADMLLWRNKKISAGALGRATAVWVLF

SEQ ID NO: 152480 - protein, 45 aa, Glycine max
  Coding DNA Sequence Number=SeqID_35702
MTIKVSVCQRARLPLDDKTRLPLVDERWQMTMICLRVSSDLLIFG

SEQ ID NO: 152481 - protein, 92 aa, Glycine max
  Coding DNA Sequence Number=SeqID_35703
MLEYRVQAVLLTSIVIQHLASVLTSPLMLNAHFLPRFLNNTDLECLISTSVVRIVPMWKTLSFYNDGLGTDAEIFNFQHRLTTDVECGFPLM

SEQ ID NO: 152482 - protein, 142 aa, Glycine max
  Coding DNA Sequence Number=SeqID_35704
MGTSMTTHTQIWMTLLVSNILPSDHNSDLPLPKCQLVYAILTQVSVHVAQLISDAIYQFVGTGPTRHPMDPERYNRALGFPALITGLCQFYGVPIAPSKASVGRGTTAAWRRSAAGRRCTTVTPGVHLGLLAEVRVLHTTCG

SEQ ID NO: 152483 - protein, 545 aa, Glycine max
  Coding DNA Sequence Number=SeqID_35705
  Gene Ontology: Mol. function=DNA binding
  Homolog annotation: Hit_ID=Q1RTB4; Match level="QueryCoverage=55%, HitCoverage=70%, E-value=1e-30, Identity=31%"; Hit description=IMP dehydrogenase/GMP reductase
MGSNQTPLLKKRFYQVKIKSLEVTSLRELGQLMGQLQRKAFHKAYGKIWDLAMVEVSMEAIASLTQYYDQPLRCFTFEDFQLVLTMEEFEEILGCPLGGRKRYLFSGFYPSMARVAKAKAMANQSEWASFIDILALLIFGVILFPNVEGLVDLAAIDAFLAFHHSKEIPVVTILADMYDMPVCPLQGHCSCTGKGKANWDKLLASMEGASVNWFPHWKEGRTRILSSCEGFPNVPMMGTRGCINYNLVLAVRQLGYPMRGAPSEESITPFIARGFSDPNTRVLQGVHKAWDAVRRKDKELRGSSNGIIDGYRKWLRVRIQGLDWLQKLRAVRDKEAEAPEENEEVRTLKVELEGARATKEKFKSMAIKVQREYDELRDVNMATTEALERETKRAGKEEHGQNKFQGTLWGSNSELKLRRDEKDQSRVEGMIMKDDETEGHMWAIIDEYKEKLNLAATHEQRLEDEYTKISAEREARERVIDSLHREAMMWKDRFAFTLNGSQELPRLLAKAKGMADVYSAPKEIHGLLNYCQHMIDLMAHIVRSR

SEQ ID NO: 152484 - protein, 160 aa, Glycine max
  Coding DNA Sequence Number=SeqID_35706
  Gene Ontology: Mol. function=RNA-directed DNA polymerase activity; Cellular component=intracellular; Biological process=RNA-dependent DNA replication
MALEDMEKTTFVTLWGTLCYKVMSFGLKNARATYQQAMVALFHDMMHKEIEVYVDDMIAKSRTEEEHLINLLGKLLGFVVSQKGIEVDPDKVKAILDMPEPRMEKIKQCLMNPPMLMPLILYMTVLDESMRCMLGQHDDSGKRERVVYYLSKKFTAWNNS

SEQ ID NO: 152485 - protein, 85 aa, Glycine max
  Coding DNA Sequence Number=SeqID_35707
MVGYAPSSFADLVFADKRMETGLKIGKFDHPALMNEKTRANEKDENEEGTRVVAVIPTWPNFPPAQQCHRSANIGPSPYPPPNHP

SEQ ID NO: 152486 - protein, 205 aa, Glycine max
  Coding DNA Sequence Number=SeqID_35708
MHLHGGKSPLKDLIEAQRSSLHRSSTSKLPSKGGKSSEEIYPQEEGQPLMVKEECKEVSVSSKRLAKKERHFEIKKNIKEISPLRQPPHFLLCKNTLVSIVTPLGLKYIPQVKELLDEGLVRKSLNPCALLVAKIGVPMNPKRIKLIPEWPTPPSIKKIWGFHDLTNFYKSVEEKSPEFQEPQDLRSNPFQGGGNDAILSRKGIG

SEQ ID NO: 152487 - protein, 318 aa, Glycine max
  Coding DNA Sequence Number=SeqID_35709
  Homolog annotation: Hit_ID=Q9AVH2; Match level="QueryCoverage=77%, HitCoverage=99%, E-value=1e-78, Identity=56%"; Hit description =Putative senescence-associated protein
AESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPKRDDQLCESTGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 152488 - protein, 315 aa, Glycine max
  Coding DNA Sequence Number=SeqID_35710
  Gene Ontology: Mol. function=transcription factor activity; Biological process=regulation of transcription, DNA-dependent
  Homolog annotation: Hit_ID=Q0S6F4; Match level="QueryCoverage=65%, HitCoverage=89%, E-value=4e-52, Identity=50%"; Hit description =Probable transcriptional regulator, TetR family protein
  Pfam annotation: Domain name=TetR_N; Domain location=117-163; Score =62.8; E_value=1.1e-15; Accession=PF00440.13; Description=Bacterial regulatory proteins, tetR family
RDHERGEDQLGAGRDDHGTDHHHRERPPQREHDRRDEDDREQDLAQEELPERGGPVLRQRRLAAPDRDALGPPGAVPPAQSAAPPGLEPAGCNPAFPHALIMTAFAMHESAELRTGVVTAALELFSAQGFDQTSVEQIAKAAGVSRSTFFRQFGGKEDVVFEDHEVLLEQLREFLDEGHEDPWGAVCAASESVFVHFAHDPELARRRYQIVRQVPVLREREIITVFRYERLFDEYLRGALPGVDPLDAVGFAALVTAVHNHVLRQLLRGRKKIPLSTLQTALADVRRRYGVAGEAATEPDDVVVAVFPRSKPIAE

SEQ ID NO: 152489 - protein, 263 aa, Glycine max
  Coding DNA Sequence Number=SeqID_35711
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q1SVV0; Match level="QueryCoverage=99%, HitCoverage=31%, E-value=1e-108, Identity=57%"; Hit description =Heavy metal transport/detoxification protein
  Pfam annotation: Domain name=HMA; Domain location=32-96; Score=34.4; E_value=3.9e-07; Accession=PF00403.16; Description=Heavy-metal -associated domain
MEQRIREAIEDAGFEAKVMEEDSKDTSTQICRIHVRGMTCTSCSSTIESALQSLHGVHKARVALTTEEAEVCYDPKIVTHNHFMSAIEETGFEAVLISTGEHITKIELQIDGIKNEQSLNVIERSLHELPGVETIDIYPDINKISITYKPYMTGPRTFIEVIESTGSGCFKAIIFPNDGGREAQRQEEINRFFKLFIWSLAFTIPVFLTSMVLMYIPGVKRVLDIKVVNMLNIGLLLRCEFATPVQFIIGRRFYVGAYKALRK

SEQ ID NO: 152490 - protein, 686 aa, Glycine max
  Coding DNA Sequence Number=SeqID_35712
  Gene Ontology: Mol. function=transferase activity; Cellular component= integral to membrane; Biological process=response to oxidative stress
  Homolog annotation: Hit_ID=Q8H2Q5; Match level="QueryCoverage=100%, HitCoverage=68%, E-value=0.0, Identity=53%"; Hit description =Putative anthranilate phosphoribosyltransferase
  Pfam annotation: Domain name=C2; Domain location=272-352; Score=90.6; E_value=4.8e-24; Accession=PF00168.20; Description=C2 domain
  Pfam annotation: Domain name=C2; Domain location=436-518; Score=87.4; E_value=4.5e-23; Accession=PF00168.20; Description=C2 domain
  Pfam annotation: Domain name=C2; Domain location=598-678; Score=63.2; E_value=8.6e-16; Accession=PF00168.20; Description=C2 domain
  Pfam annotation: Domain name=C2; Domain location=6-91; Score=89.2; E _value=1.2e-23; Accession=PF00168.20; Description=C2 domain
  Pfam module annotation: Pfam domain module=C2::C2::C2::C2; Domain location=272-352::436-518::598-678::6-91
MNNFKLGVDVVSAHNLLPKDGQGSSNAFVELYFDGQKYRTAIKERDLNPVWNESFYFNISDPSNLHYLTLDAYVHCHTKATNSTSFLGKVSLTGTSFVPYSDAIVLHYPLEKRGIFSRVRGEIGLKVYITNDPNIKSSIPTPAVESMPTNNSSSTHAEVRAPASTMTNNFPNEKVDSRHTFHHLPNTSHHQHQQHSSGFADTHYVTKYEADAMKSEPQPMKLVRTATSVQPVDFALKETSPYLGGGRVVGGRVVHKDKTASTYDLVERMYFLYVRVVKARELPAMDVTGSLDPFVEVRIGNYKGITRHFDKNQSPEWNQVFAFSKDRMQASVLDVVIKDKDLIKDDFVGIVRFDINEVPLRVPPDSPLAPEWYRLEDKKGEKIKGELMLAVWIGTQADEAFSDAWHSDAATPVDSTHAISAVMRSKVYHAPRLWYVRVNVVEAQDLVPTEKNRFPDVYAKVQIGNQVLKTKTVPARTLSALWNEDLLFVAAEPFEDHLTISVEDRVSPGKDEVIGRIIIPLNSVERRADDRIIHSRWFNLEKLVAIDVDQLKKEKFSSRIQLRLCLDGGYHVLDESTHYSSDLRPTAKQLWKPPIGVLELGVLNAVGLHPMKTRDGRGTSDTYCVAKYGHKWVRTRTIADNLCPKYNEQYTWEVFDHATVLTVGVFDNSQLGEKGNGSSKDLKIGK

SEQ ID NO: 152491 - protein, 563 aa, Glycine max
  Coding DNA Sequence Number=SeqID_35713
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q1SVV0; Match level="QueryCoverage=99%, HitCoverage=55%, E-value=0.0, Identity=75%"; Hit description=Heavy metal transport/detoxification protein
  Pfam annotation: Domain name=E1-E2_ATPase; Domain location=1-214; Score=238.8; E_value=1.2e-68; Accession=PF00122.10; Description=E1 -E2 ATPase
  Pfam annotation: Domain name=Hydrolase; Domain location=218-457; Score=125.7; E_value=1.3e-34; Accession=PF00702.16; Description =haloacid dehalogenase-like hydrolase
  Pfam module annotation: Pfam domain module=E1-E2_ATPase::Hydrolase; Domain location=1-214::218-457
MNLTPETATLLTQDDEGNVVSERQIDSRLIQKEDVIKVVPGAKVASDGFVIWGQSHVNESMITGEAKPVAKRKGDMVIGGTLNENGVLHVKVTRVGSESALSQIVRLVESAQMAKAPVQKIADHISKYFVPMVIALSLSTWLSWFLAGKFHAYPKSWIPSSTNSFELALQFGISVMVIACPCALGLATPTAVMVGTGVGATQGVLIKGGQALENAHKVNCIVFDKTGTLTVGKPVVVTTKLLKKTSLSNFYEFAAAAEASLLPFTVNSEHPIAKAIVEHAKKIIEEEQNHPWPEARDFASVSGHGVKAIVLNKEIMVGNKKMMLDHNIAISAEAEETLAEAESLAQTGILVSLDGEVAGVLAVSDPLKPGAKEVISILNLMKIKSIMVTGDNWGTANSIARQAGIETVMAEALPETKATKIKELKSSGYTVAMVGDGINDSPALVAADVGMAIGAGTDIAIEAADIVLMKSNLEDTIIAIDLAKKTFSRIRLNYIWALGYNLLAIPIAAGVLYSSTRFRLPPWIAGAAMAASSLSVVCSSLLLKNYRRPSLLNNLDMNAIKIE

SEQ ID NO: 152492 - protein, 72 aa, Glycine max
  Coding DNA Sequence Number=SeqID_35714
MTRRKQQKNKRVGLCLSGGGVGKRSGWCSLLSAQVNANNTDRHCLQCKVQKTKATRASASDSDSVTFISLIW

SEQ ID NO: 152493 - protein, 106 aa, Glycine max
  Coding DNA Sequence Number=SeqID_35715
MTLLLSNISSSDRNTDLPLRKYQGRAHKTPSGPREVQQGPGVFSSGYGPLGRVHKTPSGPKEVQQGLGASGSDYGPLSVLRSARHPQQGHQAPINRGFIEKYCAPR

SEQ ID NO: 152494 - protein, 84 aa, Glycine max
  Coding DNA Sequence Number=SeqID_35716
ATCTQQNCWGTRKKGMGNLCPSGKGYFSKDTFFGSLSEDPFFGKLPEEEGGLPEELQKTFRKKCLPKVFRKKGLPEYFLLLPEE

SEQ ID NO: 152495 - protein, 107 aa, Glycine max
  Coding DNA Sequence Number=SeqID_35717
MVEPSKKCKGTSSRSQRHSGSQEAPIPPSIPYGSLFSSEEQRIWYTNLFSSRSIVDPKFIDMEFFSNENFECFQAFENSNLIPFMSLKLPVYSELVKAFYSNLEIHE

SEQ ID NO: 152496 - protein, 57 aa, Glycine max
  Coding DNA Sequence Number=SeqID_35718
MKNDEERWKIFTKSPMETSQKREKREVVAAQLAQASWVASTRRHRLLLEHSGRPRWA

SEQ ID NO: 152497 - protein, 577 aa, Glycine max
  Coding DNA Sequence Number=SeqID_35719
  Gene Ontology: Mol. function=transferase activity, transferring glycosyl groups; Cellular component=membrane
  Homolog annotation: Hit_ID=Q9LXU2; Match level="QueryCoverage=37%, HitCoverage=27%, E-value=7e-99, Identity=77%"; Hit description =Anthranilate phosphoribosyltransferase-like protein
  Pfam annotation: Domain name=Exostosin; Domain location=289-533; Score=157.8; E_value=2.8e-44; Accession=PF03016.6; Description =Exostosin family
  Pfam annotation: Domain name=PRT_C; Domain location=95-234; Score =297.7; E_value=2.2e-86; Accession=PF08372.1; Description=Plant phosphoribosyltransferase C-terminal
  Pfam module annotation: Pfam domain module=Exostosin::PRT_C; Domain location=289-533::95-234
LDMLRHQAMNIVAARLGRAEPPLRKEVVEYMSDVDSHLWSMRRSKANFFRVMSVFSGVFAVGKWFGDICMWRNPITTALVHVLFLMLVCFPELILPTVFLYMFLIGVWNFRYRPRYPPHMNTRISQAEAVHPDELDEEFDTFPTNRSPDLVRMRYDRLRSVAGRIQTVVGDLASQGERIQALLSWRDPRATSIFITLCLLSALVLYVTPFQAVAGTHPSFEMPTSANNNSSTITPGIDEGNATTEPVDINDRDEKVANAVKVVEEQLQLHRSWRSKSSKNYATCDGQGIYVYDLPSKFNKDSGLGEPIAKLGKGWYKTHQYSLELVFHSRVSKHPCRVYDENVAKLFYVPFYGGLDILRWHFKNVSNDVKESLALELVSSDSPWGTRLLELDKMQKPIKLLIERQPWHVNDNGIPHPTNFHPHSDNDIISWQLKIIRSNRKNLVSFAGAARADSEDNIRSTLIDQCTSLGNGCIPVLFDPFTAYYQYPWHLSHDHDKYSVLMDKKEVVQKNVNVVERLTNISSRERENMRRFITYELLPGLVYGDYNSELDRFQDAFAITMNNLFERVSRLDEAHKD

SEQ ID NO: 152498 - protein, 73 aa, Glycine max
  Coding DNA Sequence Number=SeqID_35720
  Homolog annotation: Hit_ID=Q1RY58; Match level="QueryCoverage=41%, HitCoverage=18%, E-value=5e-09, Identity=87%"; Hit description =Glutathione peroxidase
MTTKVPKSVYDFVVKAWRFWHFHVTNLWNFSKFVVDKNGQVVGRYYPTTSPLSLERDIHSFWEFPEGKKIISS

SEQ ID NO: 152499 - protein, 96 aa, Glycine max
  Coding DNA Sequence Number=SeqID_35721
MVLDKRKQIHVQEFSWVIISCYRQTLREGKPMINSESTPEQKKLLAKGERSNSLSLIAIRRTIFEHLLCGLPEKPIAKKFLDALEKRYQVFDNAEP

SEQ ID NO: 152500 - protein, 92 aa, Glycine max
  Coding DNA Sequence Number=SeqID_35722
  Homolog annotation: Hit_ID=Q9FHD6; Match level="QueryCoverage=55%, HitCoverage=17%, E-value=2e-08, Identity=53%"; Hit description =Arabidopsis thaliana genomic DNA, chromosome 5, TAC clone:K1O13
MGKKGGAKKLESASHTPISLREEATGKIQTKAASNTKSKLRFEHLKNLAVWATTIPSLGAFYGHQFATFGEATGIPPDPSLITCQRSFNMIP

SEQ ID NO: 152501 - protein, 262 aa, Glycine max
  Coding DNA Sequence Number=SeqID_35723
  Gene Ontology: Mol. function=translation elongation factor activity; Cellular component=nucleus; Biological process=transcription
  Homolog annotation: Hit_ID=Q1RY71; Match level="QueryCoverage=73%, HitCoverage=33%, E-value=2e-73, Identity=68%"; Hit description=Bromo adjacent region; Transcription elongation factor S-II, central region
  Pfam annotation: Domain name=BAH; Domain location=87-206; Score=77.6; E_value=3.8e-20; Accession=PF01426.8; Description=BAH domain
MMNHRRRTQVVTSDDEEETPNPQYTQKRTRLSEQDNSNENKEEQKKEAVSKLPRPVEDAKPIGEPIKSSGKGKKEKRHYESFEFNGIKYTLEDHVLFKPEEKGQKPYAGIIKDITQGNNGNVVVTGQWFYRPEEAEKKSGGNWKSCDTRELFYSFHRDDVHAEAVMHKCVVHYVPQHKQLPKRKDHPGFIVQKVYDNVEKKLWRLGDKGFEDIKQQEIDVLLEKTLQRIGELFDIEADETLNDGEDQMKIKKKLKEKKCFTS

SEQ ID NO: 152502 - protein, 169 aa, Glycine max
  Coding DNA Sequence Number=SeqID_35724
MCHLTAYVCVYYDDQICNTNEGTTFVSNNTKTFMVDKVITFTQLLELVHQKLSIDPEQHIQHLHFRCPIFESGQRYMYTSFILRDDADVRQMFNNFYNNPSLPFVELFAIICHNNNPPRNQHGSTSNFEDLSDEYETCWVKNHDSDIDSSSGPEGSNLSPSHEPIFKRD

SEQ ID NO: 152503 - protein, 657 aa, Glycine max
  Coding DNA Sequence Number=SeqID_35725
  Gene Ontology: Mol. function=translation elongation factor activity; Biological process=transcription
  Homolog annotation: Hit_ID=Q1RY74; Match level="QueryCoverage=92%, HitCoverage=46%, E-value=0.0, Identity=60%"; Hit description=Bromo adjacent region; Transcription elongation factor S-II, central region
MRQGSVYQSSEQVINIKKIGTIRGRKKIEISSRSSDASFSGSVVDSLCGSDDESLDERPSVISQDSNLGSTSPSVSVSWVSMENSTSNGYIEFCLNSDVWDEKYGAAEGVGSINTEIRSDKVAGSPIDGNFHLQKETVRGLQKPLSAMVEISLMPSPSESDCSPRSSSKISLTSIRNRLNSYTKSKSLKSPVSCVLETTEVKLSGTRNRAYQRSLLNDFSNTAKHSDIISEFINRDIQFSGLSCSPVHLHGNLKLKNKQGLPFFEFKVKCPEDVFVVKTWKSGNAFNWAYTFHSMDNRKKSTATDLGSHCCDKDSSMVAQMLVSSNSCSKLEGGMFDNSMVSEFVLYDLTHSSKSVSPEKKRYSDQHCSKTLKASRVGMKGETFRPDEETLFTKNKLLSGNADFDKSNSYPLSSTELHSNPEMAAIVLQIPFRKRESLKYKRRDRINAEEHSKLSDLSLAVDQSRKSLHDRKVLEQVKVVLPTGSHGLPSAESQGPSSLLDRWKHGGGCDCGGWDMACPLILLGNPTIQFAEGRTHMEGYQTLELFTQGAKERTPTFGMTMVEEGQYAVDFHANLSPLQAFSICVAILHGNSSFSGTGKAKNQQISRCNSLKMLLEEEVELFINSVTKEENKNVSKIQKGISRPYVLNPPLSPIARV

SEQ ID NO: 152504 - protein, 123 aa, Glycine max
  Coding DNA Sequence Number=SeqID_35726
  Gene Ontology: Mol. function=translation elongation factor activity; Biological process=transcription
  Homolog annotation: Hit_ID=Q1RY71; Match level="QueryCoverage=97%, HitCoverage=18%, E-value=8e-37, Identity=64%"; Hit description=Bromo adjacent region; Transcription elongation factor S-II, central region
KNAVLARRLLSGELEPSKILNMTPNELKESSLLTKGIGVEGLVAEEKTKEEPDKIQHLQMTDARCSKCMDCKVALREIIQAGNNERYQLECVSCGHSWYASRDEVSMLTIDASDSKGNIGTAL

SEQ ID NO: 152505 - protein, 188 aa, Glycine max
  Coding DNA Sequence Number=SeqID_35727
  Gene Ontology: Mol. function=D-alanyl-D-alanine endopeptidase activity; Cellular component=integral to membrane; Biological process=cytochrome complex assembly
  Homolog annotation: Hit_ID=Q945B8; Match level="QueryCoverage=74%, HitCoverage=26%, E-value=6e-53, Identity=72%"; Hit description =Growth-on protein GRO10
  Pfam annotation: Domain name=PA; Domain location=78-174; Score=50.1; E_value=7.6e-12; Accession=PF02225.12; Description=PA domain
MASEKICSILLFCAVILLLRDAPSAIAGDIVHDDDSTPKKPGCENQFVLVKVQTWVNGVEDVEFVGVGARFGRAIVSKEKNAKHTRLILSDPRDCCIPPKNKIVGDVIMVDRGNCTFTKKANIAQNANASAILIINNQKELYKMVCEPDETDLNIHIPAVMLPLDAANLVMVAISLMLMTYQQILIAM

SEQ ID NO: 152506 - protein, 54 aa, Glycine max
  Coding DNA Sequence Number=SeqID_35728
MRHPLGNKPWKKKLHHQESVLDKKLRDEAKLTPMPKYMKEESFLGEQVSHPSNS

SEQ ID NO: 152507 - protein, 164 aa, Glycine max
  Coding DNA Sequence Number=SeqID_35729
  Gene Ontology: Mol. function=cation transporter activity; Cellular component=membrane; Biological process=cation transport
  Homolog annotation: Hit_ID=Q84ND4; Match level="QueryCoverage=100%, HitCoverage=44%, E-value=1e-42, Identity=56%"; Hit description =Cation diffusion facilitator 10
MAESGGGHRRREPPPVSPEEEGANASWRLNVEEFCLSNQTHDHRQHHRFYTFRSLLRKLSKQLKVAEYSKKQESLLEGLNEMETMTETCGLPGTLTEDEMKQLAKSERMAVYASVGSRSLAVIASTMDSLLDLLSGFILWFTAHAMKNRNQYHYPIGKKLMQPV

SEQ ID NO: 152508 - protein, 375 aa, Glycine max
  Coding DNA Sequence Number=SeqID_35730
  Gene Ontology: Mol. function=cation transporter activity; Cellular component=membrane; Biological process=cation transport
  Homolog annotation: Hit_ID=Q84ND4; Match level="QueryCoverage=99%, HitCoverage=96%, E-value=1e-170, Identity=76%"; Hit description =Cation diffusion facilitator 10
  Pfam annotation: Domain name=Cation_efflux; Domain location=110-368; Score=205.2; E_value=1.5e-58; Accession=PF01545.11; Description =Cation efflux family
MAESGGGNRRREPLLVSPEEEAAKASWRLNVKEFRLPSQTNDHQNQRSFTFHGLLRKPRKQRKVAEYYKNQERLLEGFNEMETMTEEGGFPGSLTEDEMKQLAKSERMAVHVSNMCNLVLFAAKVYASVASRSLAVIASTMDSLLDLLSGFILWFTSNAMKNPNQYHYPIGKKRMQPVGIIVFASVMATLGLQILIESARELISKAMKFILMVYCRRFKNEIVRAYAQDHFFDVITNSVGLAAAVLAVKFCWWIDPTGAIIIALYTINTWAKTVIENVWSLIGRTAPPDFLAKLTFLIWNHHEQIKHIDTVRAYTFGAHYFVEVDIVLPEDMLLHQAHNIGETLQEKLEQLPEVERAFVHVDFESTHRPEHKTMV

SEQ ID NO: 152509 - protein, 105 aa, Glycine max
  Coding DNA Sequence Number=SeqID_35731
MTLEKKKKEEVVLVGHRMCRGGVGLQRWGWRMIIFSSLKVFPFELVSANSDQWGVLMITMMITKDDDKGDDKKLKDQSKNNSSESRTIQEFKIRIKKNSRLKKKV

SEQ ID NO: 152510 - protein, 272 aa, Glycine max
  Coding DNA Sequence Number=SeqID_35732
  Homolog annotation: Hit_ID=O82347; Match level="QueryCoverage=64%, HitCoverage=70%, E-value=4e-52, Identity=51%"; Hit description =Expressed protein
  Subcellular localization annotation: CTP_CleavageSite=55; ConfidenceScore=5.66e-01
MAFLLPNVQPSLLAQSKSKKDKANLHQTLSPQKPTSQFPISSTTCSSSLQTSTAQVAKVSTPHDKQQQQPKDEFYLNLGLDVRTIREDLPLIFIKDLNYDIYRFSLEFGYFRDDITFMDPLNTFTGIEKYKLIFWALRFHGKILFREIALDVYRVWQPSENVILVRWNLRGVPRVPWEAKGEFQGTSRYKLDRNGKIYEHKVDNLAFNFPQNIKPVSVLDLVTACPASPNPTFLWGPVDAYSSSWITFYKAIRETLDQERSLLPQDGLATCS

SEQ ID NO: 152511 - protein, 239 aa, Glycine max
  Coding DNA Sequence Number=SeqID_35733
  Subcellular localization annotation: CTP_CleavageSite=51; ConfidenceScore=5.44e-01
MVEQSKKRKGVATSSTTIGTRSHGTSKAQTSQIPPSISSPTLFSSEEQRIRYNSLFTSHSIIDPKFVDLAFFDDEVFDYFQAFQNSGLIQFISMKLPFYPELVKAFYSNLEIQEDSLISEVYGIKMVIDQSLFFELTQLSSDGVPFKGTLDDEWKFDFSVSDARQMVCTNQADMIGRLLAGSLAFECRIMHYLIVRILLPRSSNLAQVSEEDLIIMWVFLTGRQIDWAHLVRYRMHKGL

SEQ ID NO: 152512 - protein, 102 aa, Glycine max
  Coding DNA Sequence Number=SeqID_35734
MGITTKTVIKTVLKIMTKLGLCLSSGPPPLDDKRVRITIRMTKLGLCLSSGPPPLDDKRVRITIRYLRVSWVQNDQTWSLRAIGHDCHDQTWSLRAIGHDCV

SEQ ID NO: 152513 - protein, 215 aa, Glycine max
  Coding DNA Sequence Number=SeqID_35735
MASITSPTWLMGLLMFLCSEDPSPKQARVRGHLVKIDADSLNTFLETPIVLEEGETLPTYSRHCRLSIDHREIEAALCIPERGFILNAEGHPRRILRKDLTTLAQVWSVLSYSNLDPTSHASDLTMDRARLLPYAELEGVVSDNLTFERLSPAINLAYIRKNCWNIDDLTVAFRRARRARARPADIPSTSTAPASTSAALSVPAHVDSQSFEAML

SEQ ID NO: 152514 - protein, 335 aa, Glycine max
  Coding DNA Sequence Number=SeqID_35736
  Gene Ontology: Cellular component=endoplasmic reticulum
  Homolog annotation: Hit_ID=Q2HRE1; Match level="QueryCoverage=71%, HitCoverage=53%, E-value=6e-85, Identity=56%"; Hit description =Lipopolysaccharide-modifying protein
  Pfam annotation: Domain name=DUF821; Domain location=10-325; Score =468.8; E_value=6.9e-138; Accession=PF05686.3; Description =Arabidopsis thaliana protein of unknown function (DUF821)
MPHSILIALHQRAVNTTEHRTELGGFAPCEKRQTENDSFQKSNFLALSPRIQLARAEINIRPWEHVLKEMEKGNRRIKWNDREPYAYWKGNPFVAETRQDLLKCNVSTTQDWNARLYVQDWIQESQQGFNNSNLASQCTHRYKIYIEGYAWSVSEKYILACDSVTLMVKPRFYDFFIRSLQPMQHYWPIRDKGKCKSIKHAVDWGNNHKEEAQKIGKAASKFIQEELKMDYVYDYMFHLLNEYAKLLKFEPRVPEGAEELCVEAMACTRSGLERKFMTESMVREPSTKAPCSLPPPLEPTSRRVFYANKLNSIRRVERWEDNYWKNSTQQLHTRI

SEQ ID NO: 152515 - protein, 315 aa, Glycine max
  Coding DNA Sequence Number=SeqID_35737
  Gene Ontology: Mol. function=L-isoleucine transporter activity; Cellular component=integral to membrane; Biological process=amino acid transport
  Homolog annotation: Hit_ID=Q1SAP1; Match level="QueryCoverage=83%, HitCoverage=71%, E-value=1e-124, Identity=79%"; Hit description =Amino acid/polyamine transporter II
  Pfam annotation: Domain name=Aa_trans; Domain location=1-311; Score =9.7; E_value=1.1e-07; Accession=PF01490.8; Description=Transmembrane amino acid transporter protein
  Pfam annotation: Domain name=Trp_Tyr_perm; Domain location=1-297; Score=-259.5; E_value=0.0091; Accession=PF03222.4; Description =Tryptophantyrosine permease family
  Pfam module annotation: Pfam domain module=Aa_trans::Trp_Tyr_perm; Domain location=1-311::1-297
MAGVGILSTPYTLKEAGWMSMVLMVLFAVICCYTATLMRYCFESREGITSYPDIGEAAFGKYGRIIVSIILYTELYSCCVEFITLEGDNLTGLFPGTSLDLGSFRLDSVHLFGILAALIIIPTVWLKDLRIISILSAGGVFATLLIVVCVFCVGTINGVGFHHTGQLVNWSGIPLAIGIHGFCFAGHSVFPNIYQSMADKRQFTKALIICFVLSITIYGGVAIMGFLMFGGETLSQITLNMPRDAFASKVALWTTVINPFTKYPFYHKLVFYECHQNEHDLIKFRNNFSLLFLNYTQICFVDEPIGEKSRRVATR

SEQ ID NO: 152516 - protein, 82 aa, Glycine max
  Coding DNA Sequence Number=SeqID_35738
MASNTNTNNSNKKEKDLEFFFEEDINELGAQQMDAETAKLESESSSSDDEGNDTTRRHSFTSQQWPQSYKYTLHHLFNFFAI

SEQ ID NO: 152517 - protein, 384 aa, Glycine max
  Coding DNA Sequence Number=SeqID_35739
  Gene Ontology: Mol. function=protein-tyrosine kinase activity; Cellular component=integral to membrane; Biological process=protein amino acid phosphorylation
  Homolog annotation: Hit_ID=Q8GY10; Match level="QueryCoverage=94%, HitCoverage=54%, E-value=1e-122, Identity=61%"; Hit description =Putative receptor protein kinase
  Pfam annotation: Domain name=LRRNT_2; Domain location=25-66; Score =39.7; E_value=9.9e-09; Accession=PF08263.3; Description=Leucine rich repeat N-terminal domain
  Pfam annotation: Domain name=LRR_1; Domain location=119-141; Score =14.9; E_value=0.3; Accession=PF00560.23; Description=Leucine Rich Repeat
  Pfam annotation: Domain name=LRR_1; Domain location=143-165; Score =11.5; E_value=2; Accession=PF00560.23; Description=Leucine Rich Repeat
  Pfam annotation: Domain name=LRR_1; Domain location=167-190; Score =14.2; E_value=0.48; Accession=PF00560.23; Description=Leucine Rich Repeat
  Pfam annotation: Domain name=LRR_1; Domain location=212-234; Score =5.0; E_value=33; Accession=PF00560.23; Description=Leucine Rich Repeat
  Pfam annotation: Domain name=LRR_1; Domain location=71-93; Score=5.2; E_value=31; Accession=PF00560.23; Description=Leucine Rich Repeat
  Pfam annotation: Domain name=LRR_1; Domain location=95-117; Score =11.5; E_value=2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=25-66::119-141::143-165::167 -190::212-234::71-93::95-117
MKPCTLLLFLSFISTLSFVVSDTVPSNEVWALRSFKEAVYEDPYQVLSNWDTVESDPCNWFGVLCTMVRDHVIKLNISGSSLKGFLAPELGQITYLQALILHGNNFIGTIPRELGVLESLKVLDLGMNQLTGPIPPEIGNLTQAVKINLQSNGLTGRLPPELGNLRYLQELRLDRNRLQGPIPAGGSSNFASNMHGMYASKENVTGFCRSSQLKVADFSFNFLVGRIPKCLEYLPRLSFQGNCLQGQELKQRSSIQCAGASPASAKSQPVVNPNHQPAEYVSKHHRASKPVWLLALEIVTGTMVGSLFLVAVLAAFQRCNKKSSIIIPWKKSGSQKDHTAVYIDPEFLKDVRRYSRQELEVACEDFSNIIGSSPDSVVYKGTMK

SEQ ID NO: 152518 - protein, 557 aa, Glycine max
  Coding DNA Sequence Number=SeqID_35740
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q9SH30; Match level="QueryCoverage=98%, HitCoverage=57%, E-value=0.0, Identity=67%"; Hit description =Putative copper-transporting ATPase 3
  Pfam annotation: Domain name=E1-E2_ATPase; Domain location=392-557; Score=109.0; E_value=1.4e-29; Accession=PF00122.10; Description=E1 -E2 ATPase
  Pfam annotation: Domain name=HMA; Domain location=119-183; Score =33.7; E_value=6.2e-07; Accession=PF00403.16; Description=Heavy-metal- associated domain
  Pfam annotation: Domain name=HMA; Domain location=194-255; Score=7.9; E_value=0.25; Accession=PF00403.16; Description=Heavy-metal -associated domain
  Pfam annotation: Domain name=HMA; Domain location=43-107; Score=56.9; E_value=6.8e-14; Accession=PF00403.16; Description=Heavy-metal -associated domain
  Pfam module annotation: Pfam domain module=E1-E2_ATPase::HMA::HMA::HMA ; Domain location=392-557::119-183::194-255::43-107
MAKLLALSCWRSLSPRPHYPSMPKYPKGESVATVQELSESTAVLSVVGMSCAACAGSVEKAVKRLPGIREAIVDVLNNRAHVIFYPSFVNVETIREAIEDAGFEAALLTDDKKSVQVCRIQIKGMSCTSCSSTLESVLQALDGVLEARVGLATEEAQVHYNPILLTTNHILQAIQDSGFEAQLISSSQDLSKIDLLVEGDITMKLIEDSLQTLPGVLAVDITTELNKISVSYKPDVTGPRNFINVIHETGNGNFKAKIYPTEEGQRDSHRRQETKQYYRSFLWSLVFTIPVFLTSMVLMYVPGVKDSLDAKIVNMLTVGEVARWVLSTPVQFVLGWRFYYGSYKALRRGSANMDVLIALGTNAAYFYSVYSVLRAATSPHFEGNDFFETSAMLISFILLGKYLEILAKGKTSDAIAKLMNLTPDTAVLLTLDGDGSVVGEEEIDSRLVQKNDVIKVVPGAKVASDGFVVWGQSHVNESMITGEARPVAKRKGDTVIGGTVNENGVLHVKATRVGSESALSQIVRLVESAQMAKAPVQKFADRISKYFVPLVIMNCVM

SEQ ID NO: 152519 - protein, 227 aa, Glycine max
  Coding DNA Sequence Number=SeqID_35741
  Gene Ontology: Mol. function=protein-tyrosine kinase activity; Cellular component=integral to membrane; Biological process=protein amino acid phosphorylation
  Homolog annotation: Hit_ID=Q8GY10; Match level="QueryCoverage=79%, HitCoverage=29%, E-value=7e-64, Identity=61%"; Hit description =Putative receptor protein kinase
MTADEEGCQFSWTRRMKIAIGIARGLKYLHTEVEPPFTISELNSSAVYLTEEFSPKTILERSEKNSGSIGSQGAICVLPNSLEARHLDTKGNIFAFGVLLLEIISGRPPYCKDKGYLVDWAKDYLEMPDEMSCVVDPEMKFFRYEDLKVICEVITLCVNPDTTVRPSMRELCSMLESRIDTSVSVELKSSSLAWAELALLSVSVRLKHDKVSLYSTSGLVEVQKLLK

SEQ ID NO: 152520 - protein, 139 aa, Glycine max
  Coding DNA Sequence Number=SeqID_35742
  Gene Ontology: Mol. function=actin binding; Cellular component =intracellular; Biological process=cell division
  Homolog annotation: Hit_ID=Q1RY49; Match level="QueryCoverage=96%, HitCoverage=98%, E-value=1e-64, Identity=85%"; Hit description=Actin- binding, cofilin/tropomyosin type
  Pfam annotation: Domain name=Cofilin_ADF; Domain location=14-139; Score=197.9; E_value=2.4e-56; Accession=PF00241.10; Description =Cofilintropomyosin-type actin-binding pr
MGQANAASGMAVHDDCKLRFQELKARRIYRFITFKIEHQQVVVDKIGEPTESYDDFQASLPVDECRYAVYDFDFTTDENCQKSKIFFIAWSPDTSKVRMKMVYASSKDRFKRELDGIQVDMQATDPSEMSLDLVKARAF

SEQ ID NO: 152521 - protein, 50 aa, Glycine max
  Coding DNA Sequence Number=SeqID_35743
MTEFDPAVSAVLSGAHASSSLSPEPSALDDTAPLDDVRGVEAPQNDPTNH

SEQ ID NO: 152522 - protein, 145 aa, Glycine max
  Coding DNA Sequence Number=SeqID_35744
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q1SVV0; Match level="QueryCoverage=61%, HitCoverage=10%, E-value=3e-23, Identity=58%"; Hit description=Heavy metal transport/detoxification protein
  Pfam annotation: Domain name=HMA; Domain location=42-108; Score=28.1; E_value=3e-05; Accession=PF00403.16; Description=Heavy-metal -associated domain
MGKKFEGWECSLQCSGNLSPQAHYPMRRLEEEGRDSEGKKVVLSVMGMSCAACAGSIEKAIKRLPGIREAVVDVLNHKAQVLYYPQMLHTNSTILYKSLYNGGRREDGRGERKGNKKESPTLEHAHTFSKCLLRPRSISSSLNSS

SEQ ID NO: 152523 - protein, 176 aa, Glycine max
  Coding DNA Sequence Number=SeqID_35745
  Gene Ontology: Mol. function=transferase activity, transferring glycosyl groups; Cellular component=cytoplasm; Biological process =nucleoside metabolic process
  Homolog annotation: Hit_ID=Q9FKS0; Match level="QueryCoverage=98%, HitCoverage=41%, E-value=2e-42, Identity=50%"; Hit description =Uridine kinase-like protein
  Pfam annotation: Domain name=PRK; Domain location=56-176; Score= -66.7; E_value=0.021; Accession=PF00485.8; Description=Phosphoribuloki nase  Uridine kinase family
MMLKETTSIDYVMEAASRPHFSTLRLDGRVLSSATVASSTLDSSLTLNSLPNQPIIIRVSGGTALDKTTVCDMIIQQLHDHCVVLVNQDLFYRGLNPEELECAHEYNFDHPDAFDSKQLLECTRKLISGQGVHVNASDLIILEGIIVFHDQHMQDLMNTKIFVDAGLISQLTLQIT

SEQ ID NO: 152524 - protein, 76 aa, Glycine max
  Coding DNA Sequence Number=SeqID_35746
MQCMNMINARMLRPLRCHEEMYDAIKEHASGLSVTMHHQKRKTLDEASLLSSESETQHDHRSTSTPYGSHRPGYRA

SEQ ID NO: 152525 - protein, 452 aa, Glycine max
  Coding DNA Sequence Number=SeqID_35747
  Gene Ontology: Mol. function=zinc ion binding
  Homolog annotation: Hit_ID=Q5SMM0; Match level="QueryCoverage=97%, HitCoverage=74%, E-value=1e-129, Identity=54%"; Hit description=LIM domain containing protein-like
  Pfam annotation: Domain name=LIM; Domain location=203-260; Score =31.3; E_value=1.2e-06; Accession=PF00412.12; Description=LIM domain
  Pfam annotation: Domain name=UIM; Domain location=161-178; Score =11.8; E_value=0.73; Accession=PF02809.10; Description=Ubiquitin interaction motif
  Pfam annotation: Domain name=UIM; Domain location=80-94; Score=5.0; E_ value=6.7; Accession=PF02809.10; Description=Ubiquitin interaction motif
  Pfam module annotation: Pfam domain module=LIM::UIM::UIM; Domain location=203-260::161-178::80-94
MGWFTKLLKGSNRKSSGGRYHGKYEDDRISDNLDCSAFGTWIPNQGLGFDSRLGHGVTRGGITLPQKWANPVGGGLHLLKEEIGRAIALSLSEADKKGKKVIGLKFLPHKTQEDDSESEDDELCPLSDEEAESVGEVQQDEDDHHATIQQDEDKHLDEVQLEEDEQLARAIQESLSISSPPRSETDSLFQPLAHLFPPVYRICAGCNAEISHGRFLSCMGGYWHPECFCCHACKLPITDYEFSMSGNRRYHKSCYKELRHPRCDVCKNFIPPNSAGLIEYRAHPFWLQKYCPSHERDGTPRCCSCQRLESVDTKYLLLDDGRKLCLECLDLAIMDTHECQPLYVEIQEFYEGLHMKMEQQVLMLLVERQALNEAMEGEKNGHHHLPETRGLCLSEEQNVPTILRRPRIGAGYQLIDMITEPFRLVRRCEVTAILVLYGLPRYPSDIIYFQNL

SEQ ID NO: 152526 - protein, 160 aa, Glycine max
  Coding DNA Sequence Number=SeqID_35748
MASVEVAQQTPTTKVSKTQETTPVTKAPATEQPAAEIPATEQPPAEAPAPELTTQAPKEETIEAPTETVEKTTTEVAPEEPKEVPVETEEVVAKETEEEKPAEEKSEEKTEEVKEEAEEPKETTETESAAVAPPATTEEENKPAKSVETPVEVRVEKTEA

SEQ ID NO: 152527 - protein, 406 aa, Glycine max
  Coding DNA Sequence Number=SeqID_35749
  Gene Ontology: Mol. function=ATP-dependent helicase activity; Cellular component=cytoplasm; Biological process=RNA metabolic process
  Homolog annotation: Hit_ID=Q1SNS2; Match level="QueryCoverage=78%, HitCoverage=62%, E-value=1e-121, Identity=71%"; Hit description =Helicase, C-terminal
  Pfam annotation: Domain name=Helicase_C; Domain location=161-237; Score=115.6; E_value=1.4e-31; Accession=PF00271.21; Description =Helicase conserved C-terminal domain
MKQLSNQSDLYCLWIRTPPRKRKTSYYVSKMELNYPLIRVYLPILFLVLDEADRVLDVGFQEELRFIFQCLPENRQNLFFSATTTSNLQKLRERYQDKMYVYEAYEGFKTVETLKQQAIFIPKKVKDVYLMHILAKMEDMGIRSAIVFISTCRDCHRLSLMLEVLDQEAAALYSFKSQAQRLEALHQFKSGKVSILLATDVASRGLDIPTVDLVINYDVPRFPRDYIHRVGRTARAGRGGLALSLVTQNDVDLIHEIEALIEKQLEMIEYKENEVLSLMKKVFSAKNVAEMKMIDDGFEEKAKERKKQKLKMLADKGLLNKRSKKRKRNKEFAEEGEEQKNEVFTVRNVTEMKRMDEDGIEEKAEEGGIQKLKMRTQKDEGKKQKKEKVEALADIETPKKRSKKRQ

SEQ ID NO: 152528 - protein, 75 aa, Glycine max
  Coding DNA Sequence Number=SeqID_35750
MDGGENPKKEKLRKRERKRESAFLRASFSGRRVVDDESSDIQRAFSGPRGEKIVVAAAFVWTTATFLGVDSSACA

SEQ ID NO: 152529 - protein, 1275 aa, Glycine max
  Coding DNA Sequence Number=SeqID_35751
  Gene Ontology: Mol. function=protein-tyrosine kinase activity; Biological process=protein amino acid phosphorylation
  Homolog annotation: Hit_ID=Q67W58; Match level="QueryCoverage=85%, HitCoverage=98%, E-value=1e-141, Identity=34%"; Hit description =Putative ethylene-inducible CTR1-like protein kinase
  Pfam annotation: Domain name=PB1; Domain location=189-276; Score =104.1; E_value=4.2e-28; Accession=PF00564.15; Description=PB1 domain
  Pfam annotation: Domain name=Pkinase; Domain location=973-1258; Score= 185.8; E_value=1e-52; Accession=PF00069.15; Description=Protein kinase domain
  Pfam annotation: Domain name=Pkinase_Tyr; Domain location=973-1258; Score=248.3; E_value=1.6e-71; Accession=PF07714.7; Description =Protein tyrosine kinase
  Pfam module annotation: Pfam domain module=PB1::Pkinase::Pkinase_Tyr; Domain location=189-276::973-1258::973-1258
MEQSRFQNTVLYNNMEPRHDEYHHPGSQSVMQDHMDGTHAGRRPADLNTSEVKPVLNYSIQTGEEFALEFMRDRVNIRKPVLSNVSDSNYTPGYMELKGILGISHAGSESGSDISMLSMVDKYPKEFDRMNTSLPGDRSNYGSIRSMPRTSLNQDNRQFVPGYGSFGVYDRSMMMKFLCSFGGRILPRPCDGKLRYVGGQTRILRIRKDISWQELMQKALQIYNQVHAIKYQLPGEDLDALVSVSSDEDLQNMMEECNHLLDREGSQKLRMFLFSMSDLEDAQFGLSSIGDDSEIQYVVAVNGMDLESRKNTTMFGVSFSANDINELDRQISIDRETSRVGVESIAQGAPLTNNFNSSLATQSSPPVLPTSSNSYDAYPQFYGDQMIRRGEPSDQYIINHGLIPSHKPVIGETPIIMPPHMLVNQQGILSEGLPPHGIQVQNSEIAGTFASNLVDSSIQQGSDPGKIFASELPSTAPAQLLNNGYMKNNFPEASVVVTAPEGHSLHPTKMDKLPDYEETSSTSSSAFGPAYVDSHYNAADLSSLHPPPLPKRVYYSERISREQLELLNRSSKSDDTNSSQFHVSDLLSDVNPPDSVTESGDKLHGGNLPNLSEELGITGKPLHADGYAIDNGAVNHQIYKQLPDASSQMKSKLTEHVSPELKQVSLDNGGRKDLLNKDNVVGLETEIYSINNYNKPLIDETKTSKPDLPILHQVSSDKHLDDPASILPEVDWGDTSVKESNEDINVQALPVSINGNTTTDEDSEEFPSNVVSKQAQGDILIDINDRFPREFFTDMFSKAVLEEDPSSLHPLTSDGVGLSVNMENREPKRWSYFQKLAQEGIDNVSLMDQDHLDFSPGKVVGENRAQHVKPLTTDEVSLNHAESHLDFVEENIRDLHGRIGAETTVLKSNYDHSQVNDTESMQFDVMMENIRAQESEYEVGKFEKRNSNLPPPDPSLVGEFDPSTFQVIMNDDLEELKELGSGTFGTVYHGKWRGTDVAIKRIKKICFTGRSSEQERLTVEFWREAEILSKLHHPNVVAFYGVVQDGPGGTMATVAEYMVDGSLRHVLLRKDRCSVRNCKFLKKSLNPEDIRKVMYLDRRKRLIIAMDAAFGMEYLHSKNIVHFDLKCDNLLVNLKDPMRPICKVGDFGLSKIKRNTLVSGGVRGTLPWMAPELLNGSSNKVSEKVDVFSFGIVLWEILTGEEPYANMHYGAIIGGIVNNTLRPTIPDHCDSEWRTLMEQCWAPNPAARPSFTEIASRLRIMTAAASQTKTQKASK

SEQ ID NO: 152530 - protein, 1256 aa, Glycine max
  Coding DNA Sequence Number=SeqID_35752
  Gene Ontology: Mol. function=protein-tyrosine kinase activity; Biological process=protein amino acid phosphorylation
  Homolog annotation: Hit_ID=Q5XTZ4; Match level="QueryCoverage=25%, HitCoverage=99%, E-value=1e-130, Identity=72%"; Hit description=Salt- inducible protein kinase
  Pfam annotation: Domain name=PB1; Domain location=182-269; Score =92.1; E_value=1.7e-24; Accession=PF00564.15; Description=PB1 domain
  Pfam annotation: Domain name=Pkinase; Domain location=963-1237; Score= 185.1; E_value=1.7e-52; Accession=PF00069.15; Description=Protein kinase domain
  Pfam annotation: Domain name=Pkinase_Tyr; Domain location=963-1237; Score=237.3; E_value=3.2e-68; Accession=PF07714.7; Description =Protein tyrosine kinase
  Pfam module annotation: Pfam domain module=PB1::Pkinase::Pkinase_Tyr; Domain location=182-269::963-1237::963-1237
MQKHQYNSMEPRNEEFHSAPQLVPQDLRDGMHINARPPPFNMSENKPVLNYSIQTGEEFALEFMRDRVNLRKPAFPNVVGDPNYSTGYMELKGILGHPGSESGSDISVLTKVEKGPKEFDRRNSSQHQDRSNYGSAQSIPRSSSNQDSYRVLHGTSSSSVSESASMKMKVLCSFGGKILPRPSDGKLRYVGGETRIISIRRDIRFHELMLKTSSIYNETHVIKYQLPGEDLDALVSVSSDEDLRNMMEECHDLQGGRESNKLRIFLLSMNDLDDTQFGIGSMDGDSEIQYVVAVNGMGMGSRNNSILRGESGSTNNLHELNGHNNERETNRVLMDTFGVSSSSLTDNVKPSLAIQSSQPVLPISSNAYETHPLFYDEQIIHHGEASHYPLQHGLGPSNNSAHNLEEIPVSMPTHGLVNQGIMNDGQASSQLQVQISAMPETLVKRKGDNFIHTGNDPGKVFPLEAPYPIPLQPFEGNLHANISDASATAAISEGLHPALPSKNKGKHQQSEDASSLISSMNPTQTPKSVEDDFFTTATDAFSHAHVDAESNVIDFSYLEPPPLPNRVYYSERIPREQADLLNRSTKSDDAHGSHLLMSDLLSDFSQKNSITESTDMLHNGNTSNLNMMSSSAGKPLQADGHTIDDGFAPPQTYKQLPDTTIKVNPKLSQHVNSESKQVLEDNKVSRNEDQVLSSENETKGTEHLAFHQVPSVEQNQNLASKLPDLNLAEVSTRESDNDTKVQSQTFPLTGNTGQDVSQDFPPEAKSRPTQGDILIDIEDRFPRDFLYDMFSKAIISEDSSSIGPLPTDRAGLSLNMDNHEPKRWSYFQNLALEGFDNVSLIDQDNLGFSSAVRKVQEGDSKSQPSAPQPAGGVLAGRTDSHLNIGEENQKNVPVATKTEASIFHQKYEHSQLKGNENKNMDAIMENIRPQESEYQDDKNEPRNVVVAGEFDTSTVQFIKNEDLEELRELGSGTFGTVYHGKWRGSDVAIKRIKKSCFAGRSSEQERLTIEFWREADILSKLHHPNVVAFYGVVQDGPGATLATVTEFMVDGSLRNVLLRKDRYLDRRKRLIIAMDAAFGMEYLHSKNIVHFDLKCDNLLVNLKDPIRPICKCDKATKLAFHQVGDFGLSKIKRNTLVSGGVRGTLPWMAPELLNGSSNKVSEKVDVFSFGIVLWEILTGDEPYANMHYGAIIGGIVNNTLRPTIPSYCDLEWKTLMEQCWAPNPAVRPSFAEIARRLRVMSAAASQIKGQGHKASK

SEQ ID NO: 152531 - protein, 89 aa, Glycine max
  Coding DNA Sequence Number=SeqID_35753
MSERNCSQSEVEEEYPNILSHSACFHDHDPPLAILVTAILPQDIKKKRLLLIIMAPLLHSNASALKDSKVEQYVSMKECQKCRKKCPQM

SEQ ID NO: 152532 - protein, 155 aa, Glycine max
  Coding DNA Sequence Number=SeqID_35754
  Gene Ontology: Mol. function=catalytic activity; Cellular component =membrane; Biological process=carbohydrate metabolic process
  Homolog annotation: Hit_ID=Q7G3M2; Match level="QueryCoverage=50%, HitCoverage=22%, E-value=6e-22, Identity=59%"; Hit description =Expressed protein
  Pfam annotation: Domain name=X8; Domain location=66-146; Score=156.2; E_value=8.8e-44; Accession=PF07983.3; Description=X8 domain
  Subcellular localization annotation: CTP_CleavageSite=81; ConfidenceScore=5.57e-01
MGPPYFEPTPPFIIPSPTGGITPGPPSTVPSPTEGTVPSPSVFQPPVVYPPPSVPPPPNYAPRTTLWCVAKPSVPDPIIQEAMNYACWSGADCTSIQPNGPCYEPNTVYAHASYAFNSYWQRTKGAGGNCEFGGTAMLVAVDPSESHNHKMGLDS

SEQ ID NO: 152533 - protein, 149 aa, Glycine max
  Coding DNA Sequence Number=SeqID_35755
  Subcellular localization annotation: CTP_CleavageSite=77; ConfidenceScore=5.53e-01
MTKEVIHSHNSTASAPLFLFYFFFYIFSLFFRKQPLSARKFSQASCNLPKRVACLMVQRKAVLTSSCSNSMSRIATRASKTRMKVALDGFDSSSQSLQLVLNFDVEGLGSSSSMDFFASWKMNRSGMEKQGREEMPLQGEDESRRSSPP

SEQ ID NO: 152534 - protein, 95 aa, Glycine max
  Coding DNA Sequence Number=SeqID_35756
MSCALTRSSDSYYAIDLDEKTIIFYNILSAICLAKDQVYHERTKHIDIGYHFICTKKRDEVQIVYIKKNVIEPRWRLLDDRDKADNNIVRMVQYF

SEQ ID NO: 152535 - protein, 66 aa, Glycine max
  Coding DNA Sequence Number=SeqID_35757
MNLLDNKTLAKVLFVLHFLLAVLLFPLYMQPEPPAEVALCLGVIPCFVFVYATIAWRATLFYMQVG

SEQ ID NO: 152536 - protein, 276 aa, Glycine max
  Coding DNA Sequence Number=SeqID_35758
  Homolog annotation: Hit_ID=Q9FHJ0; Match level="QueryCoverage=36%, HitCoverage=14%, E-value=7e-12, Identity=37%"; Hit description =Arabidopsis thaliana genomic DNA, chromosome 5, P1 clone:MFC19
MLVRRWSESISGFNLVSYCLHKRKLRLVDNKVIEYIGFKEPLEQWLCEKKQPLLQKLWIFIFTELERKSSDADDVETIQRICSSRGEWVLQEGELPRKDLNKLMSYVERNEVTFDQCLILWHIATDLLFYADKDEEDERKKKQHDDAKKNDALDLKKGPISGDGQNHNENDDAQDLEKGIIDKRQKNNEIAPDDHVKKESSEGQKKNEIAPDDVNKGSAEGKKKNENAGHKDDLVKNDFGDVDELRDFSKLLSDYLLYLVIMQPNMMSAVRGIAQI

SEQ ID NO: 152537 - protein, 71 aa, Glycine max
  Coding DNA Sequence Number=SeqID_35759
MREFEMRGGHDQRRRGCATTGHNRGRLRGRGIAKEGEGEKDGDNIEQRCLGMVGAPSDGDNLVKGTRGVGG

SEQ ID NO: 152538 - protein, 460 aa, Glycine max
  Coding DNA Sequence Number=SeqID_35760
MTSNNRKSKTVSEDITSKSEATKGSVGDNSYKLEHAVEENRSIPEGELRCPNCSHNEDISNSTENLKIHQKPKSTSADEERETQQPMMKKKEVWRRQWEVEVAKKQGKERVFHQDCTKHAFSVKQDATMQQTEEIYADQEDQAKITRPDKLPIRGGKKVAWKNTQKELIECLGRAAPMKTTEGTEKEAFKNTTLECSGSDALKHLFDLEKRMQNQLASLNAFIKGQNAQSSPHMECNNLQASSTSNPSSNLQMVLASGSTSRPESIGTEGPRKPIPRLGIPPFHVGVGNEEGLNLGRFIPSSSCAFRPYHQGSSSRGFNSVQPSAIAHREVINANSNTMAPQLHGLYFNERPNLLAQNFMPMSVQTLQTPPFSLSATRISPLANVETEARPQLLLGGRFLLSNDNVILKNNIHGYYENFPDFSNNYPSVVLVLEHHPNNLKGGTVLWYKLAMISLGQTHS

SEQ ID NO: 152539 - protein, 426 aa, Glycine max
  Coding DNA Sequence Number=SeqID_35761
  Homolog annotation: Hit_ID=Q00M75; Match level="QueryCoverage=17%, HitCoverage=14%, E-value=4e-09, Identity=43%"; Hit description=PPR -repeat containing protein
MAISFSYWDDCVDPQNFEAMWNVPEVSAEWIKAGEQRCQKVHLSRDPDGQPYLTQTEMRAVADIIITKHFHSEIDPDMICAIAELESDRQLLVMNSRHKSKEPTVGLMQLLPKTTEWLMRLTTACSELGYCSYEADENREFLFKPFVNVYFGAAYIKWLSNFENKKASPGAAVKLCLGDLLVMGSNPETASLHMQGKRSEEFIVRAYKGGTKKATHKSTLRYWNCYLSVKESFRSRKSVDDNVSPPAHSHPLPSLENSKDASVDTYWDSRVAPEDMEAMWNHLEVRKEWNKSKQKQGKVRFAHDEKKRPYLSRVEMKAIADIILYKYLSTVKIKSTVICAIGEVLSKRFLHGVGEQPGIMGIDYSTAYWLYLELGYRAYRLESVDDLNNPFVSMYFGAAYVAWLSEYEGSLDFGIGDFVVKNLEGN

SEQ ID NO: 152540 - protein, 45 aa, Glycine max
  Coding DNA Sequence Number=SeqID_35762
MTLHVAPSERRHAIFSFRSQKDFVFSASAIGDDNSDKEPPNGDGG

SEQ ID NO: 152541 - protein, 55 aa, Glycine max
  Coding DNA Sequence Number=SeqID_35763
MSNVFVTAGHLHQSKLLEILVWISYWHRSSITIAPVGAVSTLLFVNATPLTVSCE

SEQ ID NO: 152542 - protein, 381 aa, Glycine max
  Coding DNA Sequence Number=SeqID_35764
  Gene Ontology: Mol. function=oxidoreductase activity; Cellular component=cytoplasm; Biological process=retinoid metabolic process
  Homolog annotation: Hit_ID=Q9M6B5; Match level="QueryCoverage=98%, HitCoverage=99%, E-value=0.0, Identity=84%"; Hit description=Alcohol dehydrogenase 6
  Pfam annotation: Domain name=ADH_N; Domain location=36-165; Score =126.6; E_value=6.9e-35; Accession=PF08240.2; Description=Alcohol dehydrogenase GroES-like domain
  Pfam annotation: Domain name=ADH_zinc_N; Domain location=196-338; Score=140.6; E_value=4.4e-39; Accession=PF00107.16; Description=Zinc- binding dehydrogenase
  Pfam module annotation: Pfam domain module=ADH_N::ADH_zinc_N; Domain location=36-165::196-338
MASTTAGKVIRCKAAVAWEAGKPLVIEEVEVAPPQANEVRIKILFTSLCHTDVYFWEAKGQTPLFPRIFGHEAGGIVESVGEGVTDLKPGDHVLPVFTGECKECDHCKSEESNMCDLLRINTDRGVMLNDGKARFSINGQPIYHFVGTSTFSEYTVVHVGCVAKINPAAPLDKVCVLSCGISTGLGATLNVAKPNKGSSVAVFGLGAVGLAAAEGARLAGASRIIGVDLNSKRFTEAKKFGVTEFVNPKDYDKPVQEVIAEMTGGGVDRSVECTGSINAMISAFECVHDGWGVAVLVGVPNKDDAFKTHPINVLNEKTLKGTFFGNYKPRSDLPSVVEMYMNKELELEKFITHEVPFEEINKAFEYMLKGESLRCIIRMTE

SEQ ID NO: 152543 - protein, 393 aa, Glycine max
  Coding DNA Sequence Number=SeqID_35765
  Gene Ontology: Mol. function=oxidoreductase activity; Cellular component=mitochondrial outer membrane translocase complex; Biological process=aromatic compound metabolic process
  Homolog annotation: Hit_ID=Q9FVQ0; Match level="QueryCoverage=98%, HitCoverage=98%, E-value=1e-121, Identity=54%"; Hit description =Flavin-containing monooxygenase, putative
  Pfam annotation: Domain name=FMO-like; Domain location=6-393; Score= -462.0; E_value=0.021; Accession=PF00743.9; Description=Flavin -binding monooxygenase-like
MEEVSVIIVGAGPSGLAISACLSQNFISHIILEKEDCSASLWRKNAYDRLKLHLASEFCVLPLMPHPPSAPTYLSKDEFVQYIDSYIACFNINPLYCRMVEFAAYDEVENKWRVEAKKTLEGTSETYVAKFLVIATGENSEGYIPDVPGLESFEGEIVHSKYYKSGSKYETKEVLVVGCGNSGMEIAYDLNDWGANTSILIRNPLLEETCRHVFNWVHVFTKELINEGMRMLKHLPVHVVDNIITSLANMEYGDLSKYGIYQPKKGPFHLKFITGRAPVIDVGTIEKIKEGAIKVIPSHIVRIENKKVIFENDAEKEFDVIVFATGYRSVANKWLKDYKYVLNDEGMPNNDFPNHWKGDRGLYCAGLSNRGLFGVKMDVEAIADDINQTLKLH

SEQ ID NO: 152544 - protein, 1073 aa, Glycine max
  Coding DNA Sequence Number=SeqID_35766
  Gene Ontology: Mol. function=nucleoside-triphosphatase activity; Cellular component=integral to membrane; Biological process=protein catabolic process
  Homolog annotation: Hit_ID=Q9FLG0; Match level="QueryCoverage=69%, HitCoverage=89%, E-value=0.0, Identity=76%"; Hit description =Similarity to FtsH
  Pfam annotation: Domain name=AAA; Domain location=589-762; Score =224.0; E_value=3.2e-64; Accession=PF00004.19; Description=ATPase family associated with various cellular activities (AAA)
  Pfam annotation: Domain name=AAA_2; Domain location=586-700; Score= -23.0; E_value=0.00051; Accession=PF07724.4; Description=ATPase family associated with various
  Pfam annotation: Domain name=AAA_5; Domain location=589-706; Score= -20.9; E_value=0.07; Accession=PF07728.4; Description=ATPase family associated with various
  Pfam annotation: Domain name=DUF246; Domain location=1-205; Score =156.6; E_value=6.6e-44; Accession=PF03138.5; Description=Plant protein family
  Pfam annotation: Domain name=FtsH_ext; Domain location=385-563; Score= 86.8; E_value=6.7e-23; Accession=PF06480.5; Description=FtsH Extracellular
  Pfam annotation: Domain name=Sigma54_activat; Domain location=556 -735; Score=-188.2; E_value=0.07; Accession=PF00158.16; Description =Sigma-54 interaction domain
  Pfam module annotation: Pfam domain module=AAA::AAA_2::AAA _5::DUF246::FtsH_ext::Sigma54_activat; Domain location=589-762::586 -700::589-706::1-205::385-563::556-735
MTVTKQRLVDRLRSHGGRYIALHLRYEKDMLSFTGCAYGLTDAESEELRILRENTNYWKVKKINSTEQRVGGFCPLTPKEVGIFLHALGYPPSTPIYIAAGEIYGGNTHLSELSSRYPNLIFKESLATPEELKDFANHASQTAALDYIICVESDVFVPSYSGNMARAVEGHRRFLGHRKTINPDRKGLVGIFYMLETGELEEGRELSNMVQRMHKNRQGAPRKRHGSLPGIKGRARFRTEEPFYENPYPECSNSQNPSSLAKSLSPYFLTLHLAFSPPHSPLATSQIDANSESPLPILFPTQPIPTKSKTPNPLNYSSCELLREVNCVQKLKEAERKRMNELEEFDKKANVQLERQLVMASSWSRALLTLRGKLKGTEWDPENSHRIDYSDFLRLLDSNNVQFMEYSNYGQTISVILPYYKNGKPTGTEGNTQGIIFRRHPVNIMPIDSWNDVWRKLHQQIVNVDVINVDAVPAEIYSTIAVAVIWSMRLALAVGFYVWIDNLMRPIYAKLIPCDLGTPSQKTTQPLRSRALGSLGQSRAKFISAEERTGVTFDDFAGQEYIKNELQEIVRILKNDEEFQDKGIYCPKGVLLHGPPGTGKTLLAKAIAGVAASRVKDLFANARAFSPSIIFIDEIDAIGSKRGGPDIGGGGAEREQGLLQILTEMDGFKVSTAQVLVIGATNRLDILDPALLRKGRFDKIIRVGLPSEDGRFAILKVHARNKFFRSEEEKETLLKEIAELTEDFTGAELQNILNEAGILTARKDLDYIGRDELLEALKRQKGTFETGQEDSTEIPEELKLRLAYREAAVAVLACFFPEPHRPFVETDINSIRSQPNMHYAEISGQVFARKSDYINSIVRACAPRVIEEEMFGIDNLCWISAKATLEASKHAEFLILQTGMTAFGKAYYKNYSDLVPNLAMKLEALRDEYMRYATEKCSSVLKEYHLAVETITDILLEKGQIKAEEIWDIYKSAPHVAQPPVSPVDEFGALIYAGRWGIHGISLPGRVTFAPGNVGFATFGAPRPTETQIVSDETWKLVDDIWDKKVQNIKDEASMVIEEEKEKPQLLMASHFL

SEQ ID NO: 152545 - protein, 358 aa, Glycine max
  Coding DNA Sequence Number=SeqID_35767
  Gene Ontology: Mol. function=protein serine/threonine kinase activity; Cellular component=spindle pole body; Biological process =protein amino acid phosphorylation
  Homolog annotation: Hit_ID=Q39893; Match level="QueryCoverage=99%, HitCoverage=100%, E-value=1e-163, Identity=78%"; Hit description =Protein kinase
  Pfam annotation: Domain name=Pkinase; Domain location=4-269; Score =179.8; E_value=6.7e-51; Accession=PF00069.15; Description=Protein kinase domain
  Pfam annotation: Domain name=Pkinase_Tyr; Domain location=4-273; Score=-71.4; E_value=4.3e-08; Accession=PF07714.7; Description =Protein tyrosine kinase
  Pfam module annotation: Pfam domain module=Pkinase::Pkinase_Tyr; Domain location=4-269::4-273
MDKYEAVKDLGAGNFGVARLMRNKVTKELVAMKYIERGPKVVLTPTHLAIVMEYAAGGELFERICSAGRFSEDEARYFFQQLISGVHFCHTMQICHRDLKLENTLLDGSPAPRLKICDFGYSKSSLLHSRPKSTVGTPAYIAPEVLSRREYDGKLADVWSCAVTLYVMLVGAYPFEDQDDPRNFRKTIQRIMAVQYKIPDYVHISQDCRHLLSRIFVANPLRCQDIIRFENWDTYGTRLLKFRCHVQNVLNSSWLLRITIKEIKNHPWFLRNLPRELTESAQAIYYQRDSPNFHLQSVDEIMKIVGEARNPPPVSRPVKGFGWEGEEDLDEEVEEEEDEDEYDKRVKEVHASGEFQIS

SEQ ID NO: 152546 - protein, 135 aa, Glycine max
  Coding DNA Sequence Number=SeqID_35768
  Gene Ontology: Mol. function=magnesium ion binding; Cellular component=membrane; Biological process=metabolic process
  Homolog annotation: Hit_ID=Q5DMX2; Match level="QueryCoverage=97%, HitCoverage=38%, E-value=2e-57, Identity=78%"; Hit description=EXO
  Pfam annotation: Domain name=Exostosin; Domain location=3-97; Score= -64.1; E_value=4.4e-05; Accession=PF03016.6; Description=Exostosin family
MQIYEELPEGISYYTKLRSSKFCLCPSGYEVASPRVVKAIFAECVPVLISDGYVPPFSDVLNWNSFSVQVDVKDIPNIKKILMGISERQYLRMYKRVKQVQRHFVPNEPPKRYDMFHMTVHSIWLRRLNIHIQDQ

SEQ ID NO: 152547 - protein, 511 aa, Glycine max
  Coding DNA Sequence Number=SeqID_35769
  Gene Ontology: Mol. function=nucleotidyltransferase activity
  Homolog annotation: Hit_ID=Q9SKH2; Match level="QueryCoverage=96%, HitCoverage=95%, E-value=1e-152, Identity=53%"; Hit description =Expressed protein
  Subcellular localization annotation: CTP_CleavageSite=16; ConfidenceScore=5.12e-01
MDPHRRHRHRRRTWCCSFAVPPSSPDNLTNSSKPLPRNSEPHSKPAFSLPNSPKSRIPVKIDPRRILSPGRVSPIDSDPVAGEPLPFPPPSPEPPRPPSPAAATGERDVRMSLRGKNGGCMVLEVNSGVLCANSEVFAGLIEDYKKGSSSGSNKMCRIEVPEVDNLGVFRETIELMFENDDGVTKRLLNIGVFRSIDVLEVSAGIMFTKGVLSCLQYLEAMPWTEEEEEKLRSLFTRFEFDEATTRDILGRLYLHDSVDSSSQPNVARQLVWSITTCVDANARNEMKSLVKGLLCKSSVYEKNHLDLSKEDLYSVCHLCLDSLISLFEEASDTERLAKKDKNRPLIERVARQVDNINWLLEILLDGQIAEDFVNIWADQHQLIKMHENASPMVRYELSRVSAMLFVAMATRKLQCRSEARLGLLQAWFRPMLLDFGWLQRCRRGLDIKLLQEAMGQTLLTLPLNQQYMLFMEWFRHFSSHGTECPNLSKAFQIWWRRSFLRGFETDAIESR

SEQ ID NO: 152548 - protein, 471 aa, Glycine max
  Coding DNA Sequence Number=SeqID_35770
  Gene Ontology: Mol. function=DNA binding; Biological process =regulation of transcription
  Homolog annotation: Hit_ID=Q1RT19; Match level="QueryCoverage=99%, HitCoverage=98%, E-value=7e-84, Identity=40%"; Hit description=No apical meristem (NAM) protein
  Pfam annotation: Domain name=NAM; Domain location=1-128; Score=251.5; E_value=1.7e-72; Accession=PF02365.6; Description=No apical meristem (NAM) protein
MPGFRFQPTDVELIEYFLKRKVRGKKFPSEIIAELDLYKFAPWDLPDMSLLKNGDLNWYFFCPRGKKYSTGGRLNRATEAGYWKTTGKDRAIEHNNRVVGMIKTLVFHTGRAPKGDRTDWVMHEFRLDDKVLADEGVLQKGILQASNFVEVYVSVVGFVTVRMVYQKEGPGPRNGAQYGKPYEEKEWETDEEIDSVQSAPVAAVCAPVPIQPSESHISVANYIHPSTSGCAGLTSVSCVSELMPSCSTHPSAPSNPVGTVSCVSELIPSCSEPHHLPSNNQVGSVSCVSEFMPSCSAHPSAPNSQVGSVSRVSEFMPSCSDHPSAPSNQVGSVSCVPELMTSCSAHPSAPNNQVDNDILSLLDCFFEDDDTLAVKENNRIENIDDPDQANNADGALCSDPNAIFEELGDLNSLVGLGEGSFSCGQKNEYTTSEMLYTVDIFGSCDHDFLELLDLETPQLWLNKHGSGSQDK

SEQ ID NO: 152549 - protein, 1079 aa, Glycine max
  Coding DNA Sequence Number=SeqID_35771
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=100%, E-value=0.0, Identity=85%"; Hit description =Glycosyl transferase, family 48
  Pfam annotation: Domain name=Glucan_synthase; Domain location=210 -957; Score=841.2; E_value=5.5e-250; Accession=PF02364.6; Description= 1,3-beta-glucan synthase component
MDLLMVPYSSDPSLKIIQWPPFLLASKIPIALDMAAQFRGKDSDLWRRICADEYMKCAVIECYESFKNVLNALVVGEAEKRTISVIIKEVENSISKNTLVANFRMGFLPSLCKKFVELVEILKDADSSKQGTVVVLLQDMLEVFTRDMVVNEISELAELNHSSKDTGRQLFAGTDAKPAVLFPPLVTAQWEEQIRRLHLLLTVKESAIEVPTNLEARRRIAFFTNSLFMDMPRAPRVRKMLSFSVLTPYYSEETVYSKNDLEVENEDVILPDEWTNFMERLECKKDSEIWEKDEHILQLRHWASLRGQTLSRTVRGMMYYRRAIKLQAFLDMANEQEILDGYKAVTVPSEEDKKSHRSLYASLEAVADMKFTYVATCQNYGNQKRSGDRRATDILNLMVNNPSLRVAYIDEIEEREGGKVQKVYYSVLVKAVDNLDQEIFRIKLPGPAKIGEGKPENQNHAIIFTRGEALQTIDMNQDNYLEEAFKMRNLLEEFNEDHGVRRPTILGVREHIFTGSVSSLAWFMSNQETSFVTIGQRVLARPLKVRFHYGHPDVFDRIFHITRGGISKASCGINLSEDIFAGFNSTLRRGNITHHEYIQCGKGRDVGLNQISLFEAKVACGNGEQTLSRDIYRLGHRFDFFRMLSCYFTTIGFYISSVIVVLTCYAFLYGKLYLSLSGFEAAIVKLARRKGDDALKAALTSQSLVQLGLIMTLPMFMEIGLERGFRTAIGELIIMQLQLAPVFFTFSLGTKLHYFGRTLLHGGAKYRATGRGFVVRHEKFAENYRMYSRSHFVKGIELTILLLCYKIYGSATPDSTSYGFLSWSMWFMVCSFLFSPFLFNPSGFEWQKIVEDWDDWQKWISIRGGIGVPSNKSWESWWNEEQEHLQHTGFLGRICEIILDLRFFVYQYGIVYHLNVARGDKSILVYALSWIVIVAVMVILKIVSMGRKQFSADFQLMFRLLKLFLFIGAIVALGLMFTLLSLTVGDIFASLLAFLPTAWAVIQIGQACRPFVKGIGMWGSVKALARGYEYLMGVVIFAPVAILAWFPFVSEFQTRLLFNQAFSRGLQIQRILAGGKKNK

SEQ ID NO: 152550 - protein, 192 aa, Glycine max
  Coding DNA Sequence Number=SeqID_35772
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q93XQ3; Match level="QueryCoverage=95%, HitCoverage=9%, E-value=2e-77, Identity=72%"; Hit description =Putative beta-1,3-glucan synthase
MDNESPRIYVGRGMHENQFALLKYTLFWVILLAAKFSFSFFVQIKPLVQPTKDIMSIRHVDFGWHEFFPKARHNYGAVVALWAPVLMVYFMDTQIWYSIFSTICGGVIGAFDRLGEIRTLTMLRSRFQSLPGAFNTYLVPTDKKREKRFTFSKRFAEISASRRSEAAKFAQLWNEVICSFREEDIISDRKGF

SEQ ID NO: 152551 - protein, 91 aa, Glycine max
  Coding DNA Sequence Number=SeqID_35773
  Gene Ontology: Mol. function=RNA-directed DNA polymerase activity; Biological process=RNA-dependent DNA replication
MLSSSLNVIIHPVLANLLKKVIGERISGAISFIEGRSILHNALIANEIVHHMKCKGGKHGEVALKIDISKAYDRVDWHECILCCVIRHECI

SEQ ID NO: 152552 - protein, 87 aa, Glycine max
  Coding DNA Sequence Number=SeqID_35774
  Gene Ontology: Mol. function=RNA-directed DNA polymerase activity; Biological process=RNA-dependent DNA replication
MERRDNFHGIKVARGAPIISHLLFADDCFMFFRASSQEADHMKFILNMYETTSGQTLNLQKSEAYFSGNVDQSTRQDILSHIRVREG

SEQ ID NO: 152553 - protein, 218 aa, Glycine max
  Coding DNA Sequence Number=SeqID_35775
  Gene Ontology: Cellular component=membrane
  Homolog annotation: Hit_ID=Q6Z4E5; Match level="QueryCoverage=52%, HitCoverage=27%, E-value=2e-31, Identity=60%"; Hit description =Limonene cyclase like protein
MALFFITSLVLVSCRSLLAPNFSSSPWRGEPTSSLDTENKSASILHDDHEGEAPSPTAFDSDHHGPHREIFNKGDENDSKFKHKGTDKGYLTDHKYTKLGRIEARLAKARYSIREASKIRNLTSNLQDPDYVPQGSIYRNVNAFQRSYLEMEKVFKIFVYEEGEPPLFHNGLSKDIYATEGRFIHEMEKGRYYRTYDPDEAFVYYLPFSGVYVGRICV

SEQ ID NO: 152554 - protein, 120 aa, Glycine max
  Coding DNA Sequence Number=SeqID_35776
  Gene Ontology: Mol. function=transferase activity
  Homolog annotation: Hit_ID=Q1T4N4; Match level="QueryCoverage=56%, HitCoverage=12%, E-value=2e-09, Identity=41%"; Hit description =Polynucleotidyl transferase, Ribonuclease H fold
MSGLEKTVLTVPRCQSTKEAIFELIASLQQPKKALFAAGAILTAWGSSRKDDSGAFAIARTGWETPCMNIIEGEAMGVLKALTWLTELSLTHVIVESDCKVVLDKINNFDTDVTEIGCHC

SEQ ID NO: 152555 - protein, 158 aa, Glycine max
  Coding DNA Sequence Number=SeqID_35777
  Gene Ontology: Mol. function=ferrochelatase activity; Cellular component=chloroplast; Biological process=heme biosynthetic process
  Homolog annotation: Hit_ID=O64391; Match level="QueryCoverage=96%, HitCoverage=27%, E-value=5e-41, Identity=60%"; Hit description =Ferrochelatase
  Subcellular localization annotation: CTP_CleavageSite=60; ConfidenceScore=5.03e-01
LLPQAICTSQKKYWCFRAHVEASFNTNPLKNYTSVSCSTWWSEAQSLVSYKTHNKQLFTVGSLATSTAQDVSDTTLIGGDKIGVLLLNLGGPETLEDVQPFLFNLFADPDIIRLPRIFSFLQKPLAQFVSVARAPKSKEGYASIGGGSPLRRMTDEQA

SEQ ID NO: 152556 - protein, 561 aa, Glycine max
  Coding DNA Sequence Number=SeqID_35778
  Gene Ontology: Mol. function=molecular_function; Cellular component =tight junction; Biological process=biological_process
  Homolog annotation: Hit_ID=Q69R94; Match level="QueryCoverage=89%, HitCoverage=37%, E-value=1e-171, Identity=64%"; Hit description =Putative symplekin
MAEALRDSFPPSDKSLSKLLGESPYLPKSVLKILENMCSPGNGDKGEKELHSLNADRVTQGLSTVWSLILLRPPIRDTCLQIALQSAVHHLEEVRMKAIRLVANKLYPLSSISKQIEDFSKEMLFSVMSGDATEATDVEGSFADSQKGPDVEKVPNEQSSLSGSTKDVPSDNRQSCTSESVSPDSVSEAQRCMSLYFALCTKKHSLFRQIFVIYRSTSKAVKQAVRCQIPILVRTMGSSSDLLEIISDPPNGSENLLMQVLQTLTDGTVPSKDLICTVKRLHDSKLKDAEVLIPILPFLSHDEVMPIFPHIVNLPLEKFQAALGRILQGSSQSGPVLTPAEVLIAIHGIDPEKDGIPLKKVTDACNACFEQWQTFTQEVLARVLNQLVEQIPPPLLFMRTVLQAIGAFPTLVDFIMGILSRLVMKQIWKYPKLWVGFLKCVQLTKPQSFGILLQLPPAQLENTLNRIAALKAPLIAHASQPDIQSKLPRAMLVVLGLASDSQVLSQAQTTQTQTSQTQTSQTQTTQTQTSQTQTSQTQTGETSNSDKDTATEKSKESSTAS

SEQ ID NO: 152557 - protein, 241 aa, Glycine max
  Coding DNA Sequence Number=SeqID_35779
  Homolog annotation: Hit_ID=Q9STI6; Match level="QueryCoverage=17%, HitCoverage=9%, E-value=5e-07, Identity=60%"; Hit description =Nucleotide sugar epimerase-like protein
MVLTSPLWSKFFDVYDEIIDFTKASSEITERHLKKLGMRFVNHEWIMAREPAAIGNVDQMEEEAKAEALHWKHFLLGLHFKKLLHNFHKLTHMYKGSEIPCQSSPIRRLEYRNMLPLENVLRGCWHNRGGIGGFIVAVEVVEVEDIIAIMLEGEGDIGVDKASGTGDEDEEARGGNLGDEGRGQRVIGRQRRGVEVWVRHEKKMTEREEMSRSGLESFVKIDVVKHYTTLIFIKPMLTSIK

SEQ ID NO: 152558 - protein, 246 aa, Glycine max
  Coding DNA Sequence Number=SeqID_35780
  Gene Ontology: Mol. function=ferrochelatase activity; Cellular component=chloroplast; Biological process=heme biosynthetic process
  Homolog annotation: Hit_ID=Q9FEK8; Match level="QueryCoverage=93%, HitCoverage=44%, E-value=1e-116, Identity=89%"; Hit description =Ferrochelatase
  Pfam annotation: Domain name=Ferrochelatase; Domain location=1-228; Score=275.0; E_value=1.5e-79; Accession=PF00762.10; Description =Ferrochelatase
MITKIRNAENKSLKIKRDGITKLVILPLYPQFSISTSGSSLRLLESIFREDEYLVNMQHTVIPSWYKREGYIKAMANLIEKELKSFDCPEEVMIFFSAHGVPLAYVEEAGDPYKAEMEECVDLIMEELETRKITNACTLAYQSRVGPVEWLRPYTDETIVELGKKGVKSLLAVPISFVSEHIETLEEIDVEYKELALESGIEKWGRVPALGCEPTFISDLADAVIESLPYVGAMTASDLEAQQVLF

SEQ ID NO: 152559 - protein, 415 aa, Glycine max
  Coding DNA Sequence Number=SeqID_35781
  Homolog annotation: Hit_ID=Q69R94; Match level="QueryCoverage=86%, HitCoverage=26%, E-value=5e-22, Identity=31%"; Hit description =Putative symplekin
MKRKALSVIFIYNETVQLQEEEEEPATNSGDSVQNTLARKRSGSQIGGDLSEDEETPGKRVRTTIVALEEPKKELDVCTTAYSQDEAPSKGVVDNGPVRQLVATFGALIAQGEKAVGHLEILISSISADLLAEVVMANMQNLPTYYPNAEGNDEQLQDISMIGSDDKAKYPASFVAAVMSLSSTFPPIASLLDAHQSVSKEVVKSQVEEEIAETATNIGPVHSGMNIESENIPSPPDFPSSDASIPGVENGCTTVPPDPDIHDVGNSESGIPGLDSFGRSDAVSQTFAPSLLVSTEICQEDGSQEQDTSLDQRSPLNLAPSISTDRSEELSPKAAVRDANSLVSSTATSVVPPRLVLPKMIAPVVDLEDEQKDRLQQSCFMRIIDAYKQIAVAGGSNVRFSILAYLGVEVKIPAS

SEQ ID NO: 152560 - protein, 75 aa, Glycine max
  Coding DNA Sequence Number=SeqID_35782
MVGSGKVSTFGGFGKWVCSRRVIGDRRRSGSEKWEMVLMRVCVDVCEKEAEEKKKKRKRVRRRRHLISQICGSNS

SEQ ID NO: 152561 - protein, 254 aa, Glycine max
  Coding DNA Sequence Number=SeqID_35783
  Gene Ontology: Mol. function=transcription regulator activity
  Homolog annotation: Hit_ID=Q9ZV88; Match level="QueryCoverage=99%, HitCoverage=77%, E-value=2e-64, Identity=52%"; Hit description =BES1/BZR1 homolog protein 4
  Pfam annotation: Domain name=DUF822; Domain location=1-75; Score= -26.3; E_value=0.023; Accession=PF05687.4; Description=Plant protein of unknown function (DUF822)
  Subcellular localization annotation: CTP_CleavageSite=29; ConfidenceScore=5.26e-01
MGCKPLERMDIVGGSSAASPCSSYHPSPCASYNPSPGSSSFPSPSSSPYTQIPNADGNSLIPWLKNLSTASSSASSPKLPHLYLHSGSISAPVTPPLSSPTSRTPRINVEWDEQSARPGWTRQQHYSFLPSSSPPSPGRQVVDPEWFAGIKLPHVSPTSPTFSLVSSNPFAFKEDGLPGSGSRMWTPAQSGTCSPAIPPGSDQNADIPMSEAVSDEFAFGSNTLGLVKPWEGERIHEEFGSDDLELTLGNSKTR

SEQ ID NO: 152562 - protein, 83 aa, Glycine max
  Coding DNA Sequence Number=SeqID_35784
MSEMSLQCFVVRINLIREKLLRIKLIRVTQADQKRIKLISPPPWINLIRSFKIYMRIKLIRKAPPPHRQTPVEENVRGRSRAA

SEQ ID NO: 152563 - protein, 166 aa, Glycine max
  Coding DNA Sequence Number=SeqID_35785
  Gene Ontology: Cellular component=intracellular; Biological process =intracellular protein transport
  Homolog annotation: Hit_ID=Q1S1S0; Match level="QueryCoverage=71%, HitCoverage=28%, E-value=1e-16, Identity=52%"; Hit description=GAT; ENTH/VHS
MSVGCTTIVLNAHRVGVELPLDEEPPHSVSAVEVEIGYGGITTGRERVSTSRDGDSIESGRISGRFCLSPRKPKRGMSVSVIGKELDIQRLKTGKAPSDQLFRLLFLLCFFMVKSSGGHCSSASKKVIMSCKNFLKLLIQFNCWRNYPFISTEDQCITNLRNKLTI

SEQ ID NO: 152564 - protein, 45 aa, Glycine max
  Coding DNA Sequence Number=SeqID_35786
MSRVLDKKQEGGREEYAGLFLHIITRLRPNKEQQKSAASFFGYRT

SEQ ID NO: 152565 - protein, 330 aa, Glycine max
  Coding DNA Sequence Number=SeqID_35787
  Gene Ontology: Mol. function=phosphotransferase activity, alcohol group as acceptor
  Homolog annotation: Hit_ID=Q69R94; Match level="QueryCoverage=85%, HitCoverage=22%, E-value=1e-46, Identity=40%"; Hit description =Putative symplekin
  Pfam annotation: Domain name=HEAT; Domain location=43-79; Score=0.8; E_value=34; Accession=PF02985.12; Description=HEAT repeat
  Pfam annotation: Domain name=HEAT; Domain location=80-116; Score =20.4; E_value=0.0067; Accession=PF02985.12; Description=HEAT repeat
  Pfam module annotation: Pfam domain module=HEAT::HEAT; Domain location=43-79::80-116
MCMAATSREKLTSLVNAAKLAIDIPSKLESLRQLRHELPPEDPVLLTEFLPSLFLFHSDRFGPVRKFLTEMLGEIGLKNTEFLSDIVPVLIDLLDDDTPAVVRQALLCGIDLFRATLEKIAVQGLYSSDLDGALESAWAWMLKFKDKVYSIAFQHGSGGAKLLALKFVEAVICLYTHDPNGSSEPTSHQGRPVEFNISWLGRGHPVLNIGDLSIEASHRLGLLLDLLRFPTVKSLGNSVIIVLIKSLSAIAIDRPAFYGRILPVLLSLEPSSSVVNGVSVSATHFALKNAFLTCSKCTHPSAAPLRTTNTSDTCLVYPQMLRRLVWSSLF

SEQ ID NO: 152566 - protein, 503 aa, Glycine max
  Coding DNA Sequence Number=SeqID_35788
  Gene Ontology: Mol. function=protein serine/threonine kinase activity; Cellular component=cell cortex; Biological process=protein amino acid phosphorylation
  Homolog annotation: Hit_ID=Q75PK5; Match level="QueryCoverage=94%, HitCoverage=73%, E-value=0.0, Identity=70%"; Hit description=Mitogen- activated kinase kinase kinase alpha
  Pfam annotation: Domain name=Pkinase; Domain location=80-360; Score =293.6; E_value=3.7e-85; Accession=PF00069.15; Description=Protein kinase domain
  Pfam annotation: Domain name=Pkinase_Tyr; Domain location=80-360; Score=112.3; E_value=1.4e-30; Accession=PF07714.7; Description =Protein tyrosine kinase
  Pfam module annotation: Pfam domain module=Pkinase::Pkinase_Tyr; Domain location=80-360::80-360
  Subcellular localization annotation: CTP_CleavageSite=65; ConfidenceScore=5.41e-01
MKFLVRSKSPGPGSRGPTSPTSPLHPKLLGLSLDSPTGRQEGECHPLPLPPGSPTSPSSSLPSMRANGMTEHTTSNLSKWKKGKLLGRGTFGHVYLGFNSDSGQLSAIKEVRVVCDDQSSKECLKQLNQEIHLLSQLSHPNIVQYYGSDLGEETLSVYLEYVSGGSIHKLLQEYGAFKEPVIQNYTRQIVSGLSYLHGRNTVHRDIKGANILVDPNGEIKLADFGMAKHRMRARMHLAHTELSDLCSVVYNLKINSSSSMLSFKGSPYWMAPEVVMNTNGYSLPVDIWSLGCTILEMATSKPPWNQYEGVAAIFKIGNSRDMPEIPDHLSSEAKKFIQLCLQRDPSARPTAQMLLEHPFIRDQSLTKATNVRITRDAFPCMFDGSRTPPPVLDHSNRTSLTSLDGDYATKPVPVTSRAERSPRDNTRMITSLPVSPCSSPLRQYEPAHKSCFLSPPHPTYTLMGQNTLPSYPVRSNATFTLDPFQETSFYKAHTPGGSPRRLI

SEQ ID NO: 152567 - protein, 147 aa, Glycine max
  Coding DNA Sequence Number=SeqID_35789
  Gene Ontology: Mol. function=ligase activity
  Homolog annotation: Hit_ID=Q8RZQ7; Match level="QueryCoverage=75%, HitCoverage=12%, E-value=9e-18, Identity=54%"; Hit description=DNA ligase-like
MWARRKTPKLDASLFLDIEVGQSLIIDDPAAGAFTVSAFDANHCPASAFVKFFYNEFYYYLAVRIKTSKHKSHQENSVIFCTREIAGSFLSVCSTYWTSMLGGKGKSLAALLIGMPGKHSAIQQMEMHALDALLGCSKLLVLYSLWR

SEQ ID NO: 152568 - protein, 192 aa, Glycine max
  Coding DNA Sequence Number=SeqID_35790
  Subcellular localization annotation: CTP_CleavageSite=36; ConfidenceScore=5.17e-01
MAFLGETSSQTVVNSTLGFIFPNGSIVHNDSGVSFQASTPVPIRVPNGCDFQTLKTRIHNTLKLTDKQFLDEIYYRQPFTYAGKNPKNFDIPTGCTMDELKDLIKQVAPCGIPPYGVDETQMVRRLFFRKPSHHKYSEKVIKFEIIELKTNEDVMKVLIESNYWKKIGPIEILAVFSKPVPQMEDELSLSQN

SEQ ID NO: 152569 - protein, 92 aa, Glycine max
  Coding DNA Sequence Number=SeqID_35791
MVEMCLGYRFRFAIEASVLLSSSPSLFTLPYPSRGHDLAIEAEDERKPRPDGLHAIAASLARAGIFPGRCYSILAREIRPEELITVTDFYVS

SEQ ID NO: 152570 - protein, 170 aa, Glycine max
  Coding DNA Sequence Number=SeqID_35792
MDIVSTQGKREGEADGGKDAGHGKVDVAWKMLRVMNGVRGVMLDASDFDAENAERGIYAGKGVVELGTGQACCDEANLENPNQQMLPAFQTIYYMPSRVGKTNEMRKVNGEAYMLSLKIPPGFWSRSRFSFNSNCDALLNMSETFNSVIVGPKGKPIISFVTVLEEITFL

SEQ ID NO: 152571 - protein, 239 aa, Glycine max
  Coding DNA Sequence Number=SeqID_35793
  Gene Ontology: Mol. function=sugar porter activity; Cellular component=integral to membrane; Biological process=transport
  Homolog annotation: Hit_ID=Q941R4; Match level="QueryCoverage=95%, HitCoverage=59%, E-value=4e-49, Identity=58%"; Hit description=GDP -mannose transporter
MKPSSPNEEHHDLENAKSDKDKVRTPRNGRGVKVYNQALLSGLAYCFSSCGMILVNKLVLSSYDFNAGISLMLYQNLISVAIVSVLSLLGLVSTEPLTWRLIKVWLPVNFIFVGMLVTSMFSLKYINVAMVTVLKNVTNVITALGEMYLFKKHHDGKVWASLFLMAAYNIPLPYLRIAKSLRAMGYEDEVLSPWACCYHGHSVSLVPRILHLSVLRTGLDLVERQIDAPKGHGYSKASY

SEQ ID NO: 152572 - protein, 41 aa, Glycine max
  Coding DNA Sequence Number=SeqID_35794
MASHKFLKRINGLQQVTLLYFVQWVWSHVLNYCTGPNALDH

SEQ ID NO: 152573 - protein, 50 aa, Glycine max
  Coding DNA Sequence Number=SeqID_35795
MEQSNESGKTNCGHICDVECAPLLQNGAHGYAEYAGDLVAYVMHFCLQEC

SEQ ID NO: 152574 - protein, 95 aa, Glycine max
  Coding DNA Sequence Number=SeqID_35796
  Gene Ontology: Mol. function=transcription regulator activity; Cellular component=nucleus; Biological process=regulation of transcription, DNA-dependent
  Homolog annotation: Hit_ID=Q9ZV88; Match level="QueryCoverage=75%, HitCoverage=22%, E-value=3e-19, Identity=62%"; Hit description =BES1/BZR1 homolog protein 4
  Pfam annotation: Domain name=DUF822; Domain location=2-93; Score =101.3; E_value=2.8e-27; Accession=PF05687.4; Description=Plant protein of unknown function (DUF822)
MTSVARQPTWKERENNKRRERRRRAIAAKIFSGLRMYGNYKLPKHCDNNEVLKALCNEAGWTVEADGTTYRKWHGTCYWWWESEGRERRRELRKG

SEQ ID NO: 152575 - protein, 134 aa, Glycine max
  Coding DNA Sequence Number=SeqID_35797
MLERNTAHSASKRIIEETTSFLLFLYKIWDCDLSRSRRGRLGGGGGGAWWPEKPPEKRGSGFVLGVNCAQWGEEKVEGAKEKEKWTKYVEERELGLVLGVFTDVPLDLERESGILGRFCLGQLKPEKDERLCFK

SEQ ID NO: 152576 - protein, 347 aa, Glycine max
  Coding DNA Sequence Number=SeqID_35798
  Gene Ontology: Mol. function=protein transporter activity; Cellular component=membrane; Biological process=protein secretion
  Homolog annotation: Hit_ID=Q13MQ4; Match level="QueryCoverage=96%, HitCoverage=84%, E-value=2e-83, Identity=49%"; Hit description=MFS efflux pump, membrane fusion protein, EmrA subfamily
  Pfam annotation: Domain name=HlyD; Domain location=73-347; Score =99.1; E_value=1.4e-26; Accession=PF00529.10; Description=HlyD family secretion protein
MSENHNPPSADEQKDNNTSDSSQDNEQSPRKRPGKKPLIILAIVVVIMLLVGFWFWFSTRNIETTDDAFTEGDAVTIAPKASGYVVQLLVKDNQRVKKGDLLVLIDPRDNAAQRDQAKAQLGLAQAQLHQAQAQLALARVQYPAQRDQALADQARAQANLLNAQADYRRQRGVDPRATSQRNIDTAAAQLRSAEAQLQSAKAQVEVASQVQLQIRQQETNVEARQQQVEQARAQLNTAELNLSYTEVRAPYDGFVTKRNVQPGTLVQAGSALFSLVSPDIWITANFKESQLARMNPGDKVEIGVDAWPDMKLEGHVDSVQMGSGSRFSTFPAENATGNYVKIVQRVP

SEQ ID NO: 152577 - protein, 61 aa, Glycine max
  Coding DNA Sequence Number=SeqID_35799
MTRTQHVHIVGEPWGIPLSTDFQVQAIGQFAQATCAPEFGLPRPFNQRLLVLHVGGGAVKQ

SEQ ID NO: 152578 - protein, 49 aa, Glycine max
  Coding DNA Sequence Number=SeqID_35800
MATIALSSRYGSKLAYDTGIWGESYRLFAAKFISWLVFFLCGRQALWLI

SEQ ID NO: 152579 - protein, 607 aa, Glycine max
  Coding DNA Sequence Number=SeqID_35801
  Gene Ontology: Mol. function=catechol oxidase activity; Cellular component=chloroplast; Biological process=metabolic process
  Homolog annotation: Hit_ID=P43309; Match level="QueryCoverage=89%, HitCoverage=90%, E-value=0.0, Identity=58%"; Hit description =Polyphenol oxidase, chloroplast precursor
  Pfam annotation: Domain name=Tyrosinase; Domain location=123-442; Score=546.8; E_value=2.2e-161; Accession=PF00264.10; Description =Common central domain of tyrosinase
  Subcellular localization annotation: CTP_CleavageSite=52; ConfidenceScore=5.67e-01
MASLYPPPFSIATNNNTSTPAATGTHVSTSCSIPLIRNHNSNAPKVAKSRVSCKATKGGDQENQSIKNINKDTQEEAFMFDRRNILIGLGGFYGTLSNDSLSLAAPISPPEITKCGPPDLPSGAKQTNCCPPISSNIIDFTLPITPQVKVRPAAHLVDATYLQNYKEALRRMKALPPNDPRSFTQQANIHCAYCDGAYHQVGFPSLDFQVHNSWLFFPFHRWYLYFYEKILGSLIKDLDPNFALPFWNWDFPNGMPMPAMYTDPKSPLYDSLRNANHKPPKLVDLDYNGVEDQSSTQEQISTNLNTMYRQLVSSSKTPTLFFGSPYRAGEDSDPGGGTVENIPHGPVHIWTGDNTQPNFEDMGTLYSAARDPIFYSHHANVDRMWSIWKTLGGKRSDIKDPDWLESGFLFYDENKNLVRVKVKDCLDTRKLGYVYQDVDVPWLEAKPTPRFRRVVARSFGAGAALAAETTNKTTNKFPLVLDSSVSALVKRPKKGRSEKEKEEEEEVLVIEGIEFERDLGVKFDVYINDEDDVPGGPSKTEFAGSFVSVPHKHKHKHGKMKTNLRLGITELLEDLGAEDDEHVVVTLVPKFGKGHVIVGGIKIEFHK

SEQ ID NO: 152580 - protein, 623 aa, Glycine max
  Coding DNA Sequence Number=SeqID_35802
  Gene Ontology: Mol. function=transporter activity; Cellular component= integral to membrane; Biological process=transport
  Homolog annotation: Hit_ID=Q2Q0V7; Match level="QueryCoverage=86%, HitCoverage=97%, E-value=1e-136, Identity=60%"; Hit description =Patellin 1
  Pfam annotation: Domain name=CRAL_TRIO; Domain location=316-500; Score=82.7; E_value=1.2e-21; Accession=PF00650.10; Description =CRALTRIO domain
  Pfam annotation: Domain name=CRAL_TRIO_N; Domain location=128-303; Score=40.8; E_value=4.6e-09; Accession=PF03765.5; Description =CRALTRIO, N-terminus
  Pfam annotation: Domain name=EMP24_GP25L; Domain location=505-586; Score=48.7; E_value=1.9e-11; Accession=PF01105.14; Description =emp24gp25Lp24 family
  Pfam module annotation: Pfam domain module=CRAL_TRIO::CRAL_TRIO _N::EMP24_GP25L; Domain location=316-500::128-303::505-586
GPGNYVRTVMVVTGLGDKVAHDGKEVKESVTVVTMAEEVPKTSTTPEEVVVSDVAPADEKPDTTTDVVVPVEKDAQQEQETSPEKEKENVPETAETESEVVSKPSGDDNVPESGSFKEESTIVSDLPETEKKALQELKQLIQEALNNHELSEVPTTNPPKDEKPEHKEEQKPVEEEKKEHAADVAEETEKEAAEVTVTETEVVEEKVAVSASADEDGAKTVEAIEESVVSVTVTVSEEPKVEAVSLSASPEEVCIWGVPLLADDRSDVILLKFLRARDFKVKEALAMIKSTIRWRKEFKMEELLEEDLGGDGLEKAVYMHGFDKEGHPVCYNIYGEFQNKELYKKSFSDEEKRYRFLRWRIQFLEKSIRKLDFNPGGICTIVQVNDLRNSPGPSKWELRQATKQALQLLQDNYPEFVAKQVFINVPWWYLAVNRMISPFLTQRTKSKFVFAGPSKSAETLLRYIAAEQLPVKYGGLSKDGEFGISDAVTEITVRSAAKHTVEFPVTENSLLSWELRVIGWDVSYGAEFVPTSEGSYTVIIQKARKVASSEEPVLCNNYKIGEPGKVVLTIDNQSSKKKKLLYRLKGDGEEQCLHGLLDYILAFTSISQDVQSFKDVDFAARRG

SEQ ID NO: 152581 - protein, 214 aa, Glycine max
  Coding DNA Sequence Number=SeqID_35803
MANVRLCGLKPLLFGRKSCVSESMKSSTTPKKSSMAQNEGKGGSIEWSFVGADQLISMMKVHKKIFVFRDIMDLAPLNSSASLHEMVIATLEEVYRSGETMSGTLDCLINFASEKFDIMEEDPKKEFSPPSSSFGKVMSNSNSFSESSYSPTTPLWSLRIQGVAKQNPIDLKRLSYHMSPPHTEIHKIEKKPTINMEIIDHKAENHGKSISQEI

SEQ ID NO: 152582 - protein, 123 aa, Glycine max
  Coding DNA Sequence Number=SeqID_35804
  Gene Ontology: Mol. function=protein serine/threonine kinase activity; Cellular component=cytoplasm; Biological process=protein amino acid phosphorylation
  Homolog annotation: Hit_ID=Q39893; Match level="QueryCoverage=100%, HitCoverage=42%, E-value=5e-62, Identity=82%"; Hit description =Protein kinase
  Pfam annotation: Domain name=Pkinase; Domain location=4-123; Score= -46.8; E_value=8.9e-06; Accession=PF00069.15; Description=Protein kinase domain
MDKYETVKDLGAGNFGVARLMRNKVTKELVAMKYIERGPKVVLTPTHLAIVMEYAAGGELFERICSAGRFSEDEARYFFQQLISGVHFCHTMQICHRDLKLENTLLDGSPAPRLKICDFGYSK

SEQ ID NO: 152583 - protein, 813 aa, Glycine max
  Coding DNA Sequence Number=SeqID_35805
  Gene Ontology: Mol. function=transmembrane receptor activity; Cellular component=membrane
  Homolog annotation: Hit_ID=O80386; Match level="QueryCoverage=95%, HitCoverage=64%, E-value=2e-71, Identity=31%"; Hit description=COP1 -Interacting Protein 7
MYLKELTIKRKTQSNFLFPLQWLLLVVDEMVSLHRLLESRIALLRKEQAMAYTRGLVAGFEIDSIDDLIYFANAFGAARLSEACMNFKELWKKKHADDLWIKEVAAMQSSLPPALSLSGSSGIILANDITTHNSSRDSIASGDENVSLETLNSALNKKEGMPCADVNLPTADHKLSHTANVNMPMPWPYNVPPYMYNLQNPQMPSYQGYPMTNMQSVPPYLVPNMQWSPDLGVNQKPSETKRDKSHKKRAEEYQDQQTESSDPDSGSESDSDKQNHSSHSSKDDLKRKKHRRKSSRTVVIRNINYITPKRRNNEGGVSDESLEDDDGIDEETIKQKVGVALESLQKVHKVEKRAKGKKAAAWHNVTKSSDATEEDLTYNLSDASEGGKKNDNWDAFQNLLKIDEGTGTDGPERMQSIDIQDEHFVLRSSELRMPNGASSSPNLDFKEVLKNPKVPNDCFIVSQRDGGNEGGSKLDEYVDNCGPVTKSRDNIGEEMLLSHRSKEPGRNELGDPLSTFAADSLQTKGRAADDWFIVDNLEKMRSPDPTIVPAVFDGDYTSSVNDRSQSEKRSERTLIDDSFMIQGQLVDNDLSDSQWKTDLSMVADLTAANKLESDAAASNEKHALSKNQEPSDLFVVLQRDSGLDSVEASRTMDYEIDFSFSETNRRSSMDDSHAKVNDNLPVSPVKTNVRKSQVSGTRSSGKDEKSKVLRDYSGKSKPEIMSRARKPALPKKPIVQKSKREQEDEIRQKMEELRNERQRRIAERTASSGIARAATRKDQIEGKTARISAKSDKNKAQPVKETSRISSVKVRGI

SEQ ID NO: 152584 - protein, 568 aa, Glycine max
  Coding DNA Sequence Number=SeqID_35806
  Gene Ontology: Mol. function=ferrochelatase activity; Cellular component=chloroplast; Biological process=heme biosynthetic process
  Homolog annotation: Hit_ID=Q9FEK8; Match level="QueryCoverage=95%, HitCoverage=95%, E-value=0.0, Identity=67%"; Hit description =Ferrochelatase
  Pfam annotation: Domain name=Ferrochelatase; Domain location=117-441; Score=618.1; E_value=7.6e-183; Accession=PF00762.10; Description =Ferrochelatase
  Subcellular localization annotation: CTP_CleavageSite=9; ConfidenceScore=5.46e-01
MNSPIHAPSSSASSSSYMLRPSPCLTHASRNLKCPMLLPQAICTSQKKYHCFGANVEASFNTNPLKNYTSVRCSPWWSETQSLVSNKTLNKQLFTVESLATSTAQDVSDTTLIGDDKIGVLLLNLGGPETLEDVQPFLFNLFADPDIIRLPRIFSFFQKPLAQFVSVARAPKSKEGYASIGGGSPLRRMTDEQAEELKKSLWEKNVPAEVYVGMRYWHPFTEEAIEQIKRDGITKLVILPLYPQFSISTSGSSLRLLESIFREDEYLVNMQHTVIPSWYQREGYIKAMANLIEKELKSFDCPEEVMIFFSAHGVPLAYVEEAGDPYKAEMEECVELIMEELETRKITNACTLAYQSRVGPVEWLRPYTDETIIELGRKGVKSLLAVPISFVSEHIETLEEIDVEYKELALESGIENWGRVPALGCEPTFISDLADAVIDSLPYVGAMAASDLEARQTSLEALVRSVGHVIFRYVKRGKGRSERTLEDIIKRDLMSLVPLGSVEELLAAYDSQRRELPPPVIVWEWGWTKSAETWNGRVAMLAVLLLLFFEFTADKGLLHQMGIWPSLR

SEQ ID NO: 152585 - protein, 152 aa, Glycine max
  Coding DNA Sequence Number=SeqID_35807
  Homolog annotation: Hit_ID=O80386; Match level="QueryCoverage=82%, HitCoverage=10%, E-value=2e-28, Identity=59%"; Hit description=COP1 -Interacting Protein 7
MDSNSKAILDYALFQLTPTRTRCELLVFRGGVHQKIASGLFEPFVSHLKFLKDEISKGGYSIKLLPPNHGGFWFTRATFERSLLLLLILNLPLWPLNDLCALSAHRLFWRGLLALKMKFFRSEVHFKLMLFQCPLQLQMKDLCHQPMASQGG

SEQ ID NO: 152586 - protein, 245 aa, Glycine max
  Coding DNA Sequence Number=SeqID_35808
  Gene Ontology: Cellular component=intracellular; Biological process =intracellular protein transport
  Homolog annotation: Hit_ID=Q1S1S0; Match level="QueryCoverage=91%, HitCoverage=51%, E-value=9e-63, Identity=58%"; Hit description=GAT; ENTH/VHS
  Pfam annotation: Domain name=GAT; Domain location=3-95; Score=23.4; E_ value=9.1e-06; Accession=PF03127.5; Description=GAT domain
MILLCIIQKASNALEVLKEVLDAVDAQNPQGASDEFTLDLVEQCSFQKQRVMHLVMASRDERIISRAIELNEQLQKVLARHDDLLAGRVTMTTTRFDHEEAEEEEEPEQLVRRLRKGKACARPEDEETETNIPRLGLLGERLNRPLSIESPSREVDTRSPPVVIPPSREANTRSPPVVIPPPRPKQNGEVPHPVEIPPPPAKHIERERFFQENKDGSNLSGHMRGITLHSRNGSSSRSGSFDFSD

SEQ ID NO: 152587 - protein, 207 aa, Glycine max
  Coding DNA Sequence Number=SeqID_35809
  Gene Ontology: Mol. function=nucleic acid binding; Biological process= DNA integration
  Homolog annotation: Hit_ID=Q1S7C5; Match level="QueryCoverage=75%, HitCoverage=16%, E-value=1e-19, Identity=29%"; Hit description =Integrase, catalytic region
MATPVTSGGGGGDPNPPHSGAAPPVHPAPVNTNLNHIITEKLDSTNYLFWKSQVEPIIHGYNLLHFIHEVQIPQRFDTIKDGNAGRVTEDKINNHFHTHMNVECNHLHTQLHQLTLEGRTVSKFLSAVQDLVDSFNAIGDPISVHEHIAVIVEGLPETYESYISFINNHAEPLTVDEIETLLIGHEARIERYRKKAALVFFCTAKIR

SEQ ID NO: 152588 - protein, 225 aa, Glycine max
  Coding DNA Sequence Number=SeqID_35810
  Gene Ontology: Mol. function=nucleic acid binding; Cellular component= mitochondrion; Biological process=DNA integration
MQQPPGFEASSKSMACKLNKAIYGLKQAPRAWFDRLKETLLKFGFSSSKCDPSLFVYSKGSTTVYMWIYVDDIIITGGNPTLLQSLVCKLNSVFSLKDLGSLDYLLESLSDPFLYRSVVGALQYATITRPEISFSVNKGCQFTTHPCEEHWVAVKRILRYLKGTLTWGLHIQSVPKPFFITAYCDADWAANPDDRRSTSEAGVFFGSNLISWWSKKQTVVARSST

SEQ ID NO: 152589 - protein, 382 aa, Glycine max
  Coding DNA Sequence Number=SeqID_35811
  Gene Ontology: Mol. function=protein binding; Cellular component =membrane; Biological process=steroid metabolic process
  Homolog annotation: Hit_ID=Q8LN57; Match level="QueryCoverage=89%, HitCoverage=44%, E-value=1e-110, Identity=60%"; Hit description =Putative oxysterol binding protein
MVGLVCSVRENRSDERRFSVCTGTKKRLHLRAESKEDRATWVKAMMAVKDLFPRLSNAEAMSPVASVLVSTERLRDRLLMEGVSETAIRESEEIMKSEFSQLQKHIVALKQQQSLLMDTLRHLEAEKVDLENTLIEDRRQSKDETDPYLSTQKKYSEGSGDDSSEEHYRNNHSEDEDDAFYDTCDDILSTGSDHPRSCHDSECEEIIPNGDEKSPTGSVGFNHPHIKRRKNLPDPVEKESSVSLWSIIKDNIGKDLTKVCLPVYFNEPLSSLQKCFEDLEYSYLLDQAYEWGKMGDNLKRVLHVAAFAVSGYASTNGRSCKPFNPLLGETYEAEYQDKGIRFISEKKECIGKDHPPMHLLGSTSLKTPIRQFLFQKGNSWSG

SEQ ID NO: 152590 - protein, 201 aa, Glycine max
  Coding DNA Sequence Number=SeqID_35812
  Gene Ontology: Mol. function=nucleic acid binding; Biological process= DNA integration
  Homolog annotation: Hit_ID=Q1SRN1; Match level="QueryCoverage=61%, HitCoverage=8%, E-value=6e-13, Identity=36%"; Hit description =Integrase, catalytic region
  Pfam annotation: Domain name=zf-CCHC; Domain location=75-92; Score =27.1; E_value=3.4e-05; Accession=PF00098.13; Description=Zinc knuckle
  Subcellular localization annotation: CTP_CleavageSite=38; ConfidenceScore=5.66e-01
MIVSGKAALVNVTSSSVMPSSAQYKTNTSASATANYVQQNSNTSQTDSGQNQNAGHNSGKSGGRGRGGRAGHSSLQCYICQKFGHVAADCWHKPSTTASPYCMMAFMQQPVMQQMVPTQMAMVSSQQMTNFTTKQNHSPQAMTVGSTSDPSNIWYPNLGAFHHVTANVENVQQCSSLEGPDQVIVGNGQGLPIKSIGSSSL

SEQ ID NO: 152591 - protein, 566 aa, Glycine max
  Coding DNA Sequence Number=SeqID_35813
  Homolog annotation: Hit_ID=Q1S1S0; Match level="QueryCoverage=20%, HitCoverage=29%, E-value=2e-33, Identity=65%"; Hit description=GAT; ENTH/VHS
MEEAQIWAKKVELPAFMGTDPIGWIARAEKFLSQNNPDLDWASFSTALIKRFRDRYEFLKERTNISELKHMLHKILNEEVDSHASQQDKNSMEGSGLEFSEAKASSWARKVELPSFDRSIEGGTDLKGNSFECDSDPLQFFKSENRSKEDSVIKNHTLCGGEETKNDEAKLAREKKTEKIMEEEVDPSIKREKHKENGVTNVGCVDDFLDNPITNLIKKEVEAGDATKPHCFQDSDFHKKIVMVKQKSFMKVVGTSMVLESWNANLLGEPLALNFVVSMDDSSTLEPRQKGATETVMMIQIIRSPPSSPPPLKLPDLSLHEVASGFTVDPPWRDTKEAHPVSVNDSVLKDEKEEGGVLEFCKGGPTFYIVGHAQMGYRNGIHKRGAETWNSNWVAGFILLKLDVCVPDDMLKEQRWKEIEASHMELQGVQMSSSNRRKLEELLEMLMNNIGEHIHEQVIDTGIITILVKIVKKKSDLPVRERIFLLLDATQTSLRGASGKFPQYYNAYYDLVRAGVQFAQRDQVVQPNIPISQPSRTSNVPNREQASPRHEAVAQPAESQTVPESR

SEQ ID NO: 152592 - protein, 91 aa, Glycine max
  Coding DNA Sequence Number=SeqID_35814
MAVAVDAAEGLFANDHGLGLDLVHDLVARGGVLSREPHGGGSLHGCGGEGGGQGGGAEEEVEVGWSEIRAGTGFVRCWEPQKEFMDRVRLG

SEQ ID NO: 152593 - protein, 175 aa, Glycine max
  Coding DNA Sequence Number=SeqID_35815
  Gene Ontology: Mol. function=oxysterol binding; Cellular component =cytoplasm; Biological process=steroid metabolic process
  Homolog annotation: Hit_ID=Q8LN57; Match level="QueryCoverage=94%, HitCoverage=20%, E-value=2e-65, Identity=68%"; Hit description =Putative oxysterol binding protein
MIHGVVEDKKGRTVATLFGTWDESLHYVIGGNSGKGKGSSYVSSKPHVLWKRSPTPEYQTRYNLTQFAITLNEITPGLKEKLPPTDSRLRPDQRCLENGQHEMANSEKLRLEQSQRQARKVQEKGWKPRWFAKEKGSNSYRYVGGYWEAREKGNWESCPDIFGQVSTDTDFNPTS

SEQ ID NO: 152594 - protein, 602 aa, Glycine max
  Coding DNA Sequence Number=SeqID_35816
  Gene Ontology: Mol. function=phosphatidylinositol phosphate kinase activity; Cellular component=membrane; Biological process =phosphatidylinositol metabolic process
  Homolog annotation: Hit_ID=Q1S1T3; Match level="QueryCoverage=90%, HitCoverage=81%, E-value=0.0, Identity=69%"; Hit description =Phosphatidylinositol-4-phosphate 5-kinase
  Pfam annotation: Domain name=MORN; Domain location=101-123; Score =35.1; E_value=2.5e-07; Accession=PF02493.10; Description=MORN repeat
  Pfam annotation: Domain name=MORN; Domain location=124-146; Score =28.6; E_value=2.3e-05; Accession=PF02493.10; Description=MORN repeat
  Pfam annotation: Domain name=MORN; Domain location=147-169; Score =28.2; E_value=2.8e-05; Accession=PF02493.10; Description=MORN repeat
  Pfam annotation: Domain name=MORN; Domain location=170-192; Score =37.2; E_value=5.6e-08; Accession=PF02493.10; Description=MORN repeat
  Pfam annotation: Domain name=MORN; Domain location=193-215; Score =35.4; E_value=2e-07; Accession=PF02493.10; Description=MORN repeat
  Pfam annotation: Domain name=MORN; Domain location=55-77; Score=27.6; E_value=4.5e-05; Accession=PF02493.10; Description=MORN repeat
  Pfam annotation: Domain name=MORN; Domain location=78-100; Score =36.2; E_value=1.1e-07; Accession=PF02493.10; Description=MORN repeat
  Pfam annotation: Domain name=PIP5K; Domain location=392-599; Score =251.4; E_value=1.9e-72; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=101-123::124-146::147-169::170 -192::193-215::55-77::78-100::392-599
MQETLLTLSEHQQDDNNKDIELLVVPPPPCRRPPRMARRVSPGAVEKALPNGDIYSGSLSGNVPHGTGKYLWSDGCMYEGDWKKGKACGKGRFSWPSGATYEGEFAAGRMHGRGTFVGVDGDTYRGAWLSDRKHGFGEKRYANGDVYEGFWRCNLQEGEGRYTWRNGNNYVGEWKGGAISGKGVLVWKNGNRYEGCWENGVPKGRGVFTWRDGSTSSGNWGKEFVNEKRVSVDVCSNHNNNKSVSFPRICIWELDGEAGDITCDIVEASMIYGGGGGVCESDVQLQKSPCGSVDGDVKKPGHTVSKGHKNYDLMLNLQLGIRYSVGKHASVLRDLRPGDFDPKEKFWTRFPPEGSKFTPPHQSVDFRWKDYCPVVFRHLRELFGIDPADYMLAICGNDTLREMSSPGKSGSFFYLTQDDWFIIKTLKKSEVKVLIRMLPSYYQHVSQYKNSLVTKFLGVHCVKPIGGQKTRFIVMGNVFCSEYRIHKRFDLKGSSHGRTTDKPREEIDETTTLKDLDLCFVFRLEHSWFQELKWQLDRDCEFLEAEGIMDYSFLIGLHFRDDSSVDEVKSLPDELCSGKRDMQNDDIQDMKWIPIDRNDCPP

SEQ ID NO: 152595 - protein, 76 aa, Glycine max
  Coding DNA Sequence Number=SeqID_35817
  Subcellular localization annotation: CTP_CleavageSite=53; ConfidenceScore=5.05e-01
MLKVHEPSLIGIDRGRTHNFNQKKTPGMPELCSRNRNRPRARKRCDAMRFARRAKTASYGEREGTRVREFGARVGV

SEQ ID NO: 152596 - protein, 42 aa, Glycine max
  Coding DNA Sequence Number=SeqID_35818
  Homolog annotation: Hit_ID=Q6ZD71; Match level="QueryCoverage=96%, HitCoverage=8%, E-value=2e-07, Identity=73%"; Hit description =Putative exo-poly-alpha-D-galacturonosidase
MDPKEWPIIEALPSYGRGRERGYEEDILALYMEMALAMLSLQ

SEQ ID NO: 152597 - protein, 417 aa, Glycine max
  Coding DNA Sequence Number=SeqID_35819
  Gene Ontology: Mol. function=GTPase activity; Cellular component =intracellular; Biological process=translational initiation
  Homolog annotation: Hit_ID=Q8RWP3; Match level="QueryCoverage=80%, HitCoverage=49%, E-value=1e-168, Identity=85%"; Hit description=GTP -binding protein LepA homolog
  Pfam annotation: Domain name=ATP_bind_1; Domain location=106-271; Score=-71.6; E_value=0.08; Accession=PF03029.7; Description =Conserved hypothetical ATP binding prot
  Pfam annotation: Domain name=GTP_EFTU; Domain location=92-273; Score =255.5; E_value=1.1e-73; Accession=PF00009.17; Description=Elongation factor Tu GTP binding domain
  Pfam annotation: Domain name=GTP_EFTU_D2; Domain location=294-364; Score=48.4; E_value=2.3e-11; Accession=PF03144.15; Description =Elongation factor Tu domain 2
  Pfam annotation: Domain name=MMR_HSR1; Domain location=95-223; Score =1.0; E_value=0.0008; Accession=PF01926.13; Description=GTPase of unknown function
  Pfam annotation: Domain name=Ras; Domain location=126-271; Score= -96.3; E_value=0.047; Accession=PF00071.12; Description=Ras family
  Pfam module annotation: Pfam domain module=ATP_bind_1::GTP_EFTU::GTP _EFTU_D2::MMR_HSR1::Ras; Domain location=106-271::92-273::294-364::95- 223::126-271
  Subcellular localization annotation: CTP_CleavageSite=76; ConfidenceScore=5.63e-01
MAAEICGGSLFLSVKTQLQLQQRNQQNVFFHAQRSRTRRSTTRFHSSKRCFSSSAFPNASAFRRGAVCQVASIDFESAAKAGEDRLSKVPVRNIRNFCIIAHIDHGKSTLADKLLQVTGTVHQREMKDQFLDNMDLERERGITIKLQAARMRYVFENEPYCLNLIDTPGHVDFSYEVSRSLAACEGALLVVDASQGVEAQTLANVYLALENNLEIIPVLNKIDLPGAEPDRVIKEIEEIVGLDCSNAILCSAKEGIGIIEILNAIVARIPPPEDTSKKPLRTLIFDSYYDPYRGVIVYFRVVDGTIKKGDRVYFMASGKDYFADEIGVLSPSQLQVEELYAGEVGYLSASIRTVADARVGDTVTHYGRKADNSLPGYEEATPMVFCGLFPVDADQFPDLRDALEKLQLNDAALKLYF

SEQ ID NO: 152598 - protein, 92 aa, Glycine max
  Coding DNA Sequence Number=SeqID_35820
  Gene Ontology: Mol. function=metalloendopeptidase activity; Cellular component=membrane; Biological process=proteolysis
  Homolog annotation: Hit_ID=Q6EPN8; Match level="QueryCoverage=51%, HitCoverage=10%, E-value=1e-09, Identity=66%"; Hit description =Putative Ste24p
MVTPGTATTLNLQALAEEIKARYDKAAVKVVDLILTLLQFGGYTLVQNSVDLYRSFGFDTQPVLIGLIIFQAGIVASPVGHWSKGHFIVTHF

SEQ ID NO: 152599 - protein, 54 aa, Glycine max
  Coding DNA Sequence Number=SeqID_35821
  Gene Ontology: Mol. function=nucleotide binding; Cellular component =membrane; Biological process=small GTPase mediated signal transduction
  Homolog annotation: Hit_ID=Q40207; Match level="QueryCoverage=80%, HitCoverage=20%, E-value=9e-12, Identity=84%"; Hit description=RAB1Y
MEGKKLKLAIWDTAGQERFRTLTSSYYRGAQGIIMAITSIVETRDTNVLMFKDK

SEQ ID NO: 152600 - protein, 249 aa, Glycine max
  Coding DNA Sequence Number=SeqID_35822
  Subcellular localization annotation: CTP_CleavageSite=21; ConfidenceScore=5.25e-01
MALAVGSFMRMPLLRTSKYSRAQKPTTMTIRISLLNLDIRSCTCHNNSTKGAERRRSVLQTKRRHDGGKGRDPQTNSLGQLKSTTTTERGIVLKKKRRHNAGNGHDPQTNSMGLLKRKTTERRGIVLRKNRRRHDGGRGRDSQTNSMGLLKSTTTRRRGIVLRKNRRRHNGGRGRDPQTNSIGLLKSTITRRRGIVLRKNRRRHDGGRGRDPQTNSKGLLKSTTTRRRGIVLQTKRKHHGGKGSDHQTN

SEQ ID NO: 152601 - protein, 262 aa, Glycine max
  Coding DNA Sequence Number=SeqID_35823
  Gene Ontology: Mol. function=GTPase activity; Cellular component =intracellular; Biological process=translational initiation
  Homolog annotation: Hit_ID=Q8RWP3; Match level="QueryCoverage=98%, HitCoverage=43%, E-value=1e-105, Identity=68%"; Hit description=GTP -binding protein LepA homolog
  Pfam annotation: Domain name=EFG_C; Domain location=147-236; Score =128.7; E_value=1.6e-35; Accession=PF00679.14; Description=Elongation factor G C-terminus
MKKGDRVYFMASGKVGYLSASIRTVVDARVGDTVTHYGRKADNSLLGYEEATPMVFCGLFPVDADYLRDALEKLQLNDVALKFEPETSSAKGFGFICGFLGLLHMEIVQERLEREYNLSLITTAPSVVYRVECSNPSLLPEPGKRKSIEEPFVKIEMLTPKDYIGSLMELAQERRGQFREMKFIAENRASITYELPLAEMVGDFFDQLKSRSKGYASMEYTFVGYTESNLIKLDIRINGDCVEPLATIVHNDKAFGLKRNDP

SEQ ID NO: 152602 - protein, 86 aa, Glycine max
  Coding DNA Sequence Number=SeqID_35824
MAFFREKGLCYNCDNKWSSTHCCKGRVLLFIADTDPLPDHLEPSLPRPPSPDTQPIFDATPVSPPISLHALSNLPTLETFHLFGFI

SEQ ID NO: 152603 - protein, 300 aa, Glycine max
  Coding DNA Sequence Number=SeqID_35825
  Gene Ontology: Mol. function=sequence-specific DNA binding; Cellular component=nucleus; Biological process=regulation of transcription
  Homolog annotation: Hit_ID=Q1RY84; Match level="QueryCoverage=95%, HitCoverage=97%, E-value=9e-37, Identity=36%"; Hit description=DNA -binding WRKY
  Pfam annotation: Domain name=WRKY; Domain location=137-199; Score =86.3; E_value=9.4e-23; Accession=PF03106.6; Description=WRKY DNA -binding domain
MENQLPNGKKAMEEELIKGHGMANQLLEVLVQDKLNTHLEEEGSSKSVLPFVEDLVRKVLCSFTNTLLILNSNNDVSNEVAASITLRDVSSSINCPKLQSVDETCKSPNILNPKSGSGCYKRKSIAPTWKKDSSILIEDGYTWRKYGQKMTSQSKYLRSYYRCTHKNDQGCQAIKQVQRIQDNPPLYRTTYYSHHTCKSPMNPEIIVEPFSPSASSILLSFDNNLQSKQENPFSSSILASTKHEPQEVIHNEHSAQNKLSTFENLLFYDYDIPFDYSRNATLLSSTEAVQFENVYEQYGF

SEQ ID NO: 152604 - protein, 296 aa, Glycine max
  Coding DNA Sequence Number=SeqID_35826
  Gene Ontology: Mol. function=sequence-specific DNA binding; Cellular component=nucleus; Biological process=regulation of transcription
  Homolog annotation: Hit_ID=Q9M6E0; Match level="QueryCoverage=74%, HitCoverage=89%, E-value=9e-32, Identity=37%"; Hit description=DNA -binding protein 4
  Pfam annotation: Domain name=WRKY; Domain location=133-195; Score =93.5; E_value=6.5e-25; Accession=PF03106.6; Description=WRKY DNA -binding domain
MENQNQLPNGKNAMEEELIRGRDMANQILEVLAHDKDEGSTNSKSVLPFVEDLVRKVLCSFTNTLLLLNSNNDVSYEVVASIAPKHVSSSTSSPKLESSDETCKSLMNTKTRRRGYKRKSIAPAWEKDSSILIEDGYVWRKYGQKMTLNAKYLRSYYRCSHKNDQGCQAMKQVQRIQDNPPLYRTTYYGHHTCRSPLNPEIILEPISPSASSTLLSFNNSFQRQQESPFPSSLLASTKQEPVEVIQDYHSAQNQLSSPEDLLLYDYDFFFDYSKRVASLSSTETVEFENVYEQFGF

SEQ ID NO: 152605 - protein, 294 aa, Glycine max
  Coding DNA Sequence Number=SeqID_35827
  Gene Ontology: Mol. function=sequence-specific DNA binding; Cellular component=nucleus; Biological process=regulation of transcription
  Homolog annotation: Hit_ID=Q9M6E0; Match level="QueryCoverage=65%, HitCoverage=77%, E-value=6e-25, Identity=36%"; Hit description=DNA -binding protein 4
  Pfam annotation: Domain name=WRKY; Domain location=132-194; Score =99.2; E_value=1.2e-26; Accession=PF03106.6; Description=WRKY DNA -binding domain
MENQPSNGRKAIEEELIKGRDIANQLLEILAPKSNTTQHKGVEVEALVLPFAEDLVRKVLRSLTNTLLLLNTHSDHVSDEVVLPVTIKGVSSSVKCQKPEYKDESFNAKRRSGSYKRKSSAPTWEKNSSILMEDGYAWRKYGQKMTMNAKYLRNYYRCTHKYDQGCLATKQVQRIQEDPPLYHTTYYGHHNCKSSLMLEPASSSDSSMFLSFSNTFPNKAEYPFSSSLYSSMKQEPMEVIHEDHIVHNQLPSSDYHMLCDYDLDFNYSRYGTMLSSTESVQFDEVCRSDQEFDG

SEQ ID NO: 152606 - protein, 104 aa, Glycine max
  Coding DNA Sequence Number=SeqID_35828
  Gene Ontology: Mol. function=translation initiation factor activity; Cellular component=intracellular; Biological process=translational initiation
  Homolog annotation: Hit_ID=Q6ET52; Match level="QueryCoverage=91%, HitCoverage=13%, E-value=9e-38, Identity=84%"; Hit description =Putative LepA protein
  Pfam annotation: Domain name=LepA_C; Domain location=3-102; Score =215.3; E_value=1.4e-61; Accession=PF06421.3; Description=GTP-binding protein LepA C-terminus
MKINIGLYFQAYSVGRALTLKLKELIPRQMFKVPIQACIGSKVIASEAISAIRKDVLAKCYGGDISRKKKLLKKQAEGKKRMKSIGKVDVPQEAFMAVLKLEKE

SEQ ID NO: 152607 - protein, 373 aa, Glycine max
  Coding DNA Sequence Number=SeqID_35829
  Gene Ontology: Mol. function=ubiquitin-protein ligase activity; Cellular component=ubiquitin ligase complex; Biological process =protein ubiquitination
  Homolog annotation: Hit_ID=Q5N9E5; Match level="QueryCoverage=99%, HitCoverage=92%, E-value=3e-23, Identity=28%"; Hit description =Putative immediate-early fungal elicitor protein CMPG1
  Pfam annotation: Domain name=U-box; Domain location=1-64; Score=25.0; E_value=9.7e-07; Accession=PF04564.6; Description=U-box domain
LDLFEDPVTLCTGQTYDRSSIEKWFSTGNLTCPVTMQKLHDPSIVPNHTLRHLIDQWLQLGPQFGNSATIDYLAALKHTLESPQLENKLQALEKIRVLSDEYCSFRKSYFHQLSFLPLLLELVFGSRLSKSHNREFTELALSCILKLLPLVSLEPLNMIKDESKLATFLLLFEKGTSSVKTSLCHIIDSIASPQTEEVCHMLGHSHKLVHEIVVLVRQNCEVSKVAIKAMLALCSLQSNRENLVREGAIDGVITYISGCETRQKNAAPLAMAIIKKLLVLESAKEALVNHPNGVETLVKMVFRVCNQECSESAVGILAIICCDFGRAREEAIEAGVLTQLLFLLQSQCGTKTKTKARMLLKLLRSKWIEEPKQ

SEQ ID NO: 152608 - protein, 126 aa, Glycine max
  Coding DNA Sequence Number=SeqID_35830
MALSKVDLTPQPLFTIKLFPQHHHHPLHVVMQIGLVIARGGCRPREPLVLHKKNVTLWSIECVEHVYIPFAPTALVDVTENFTVAMVSSPIAFLSLTIWKGLTMAAVVTVKDKGELQSSDPYCDRG

SEQ ID NO: 152609 - protein, 55 aa, Glycine max
  Coding DNA Sequence Number=SeqID_35831
MGDEQLNSDGRWLCMEKIWKKNNNECKIPQWLPTQCCGGGHHGRCPLTRGGIVES

SEQ ID NO: 152610 - protein, 154 aa, Glycine max
  Coding DNA Sequence Number=SeqID_35832
  Gene Ontology: Mol. function=motor activity; Cellular component =myosin complex; Biological process=signal transduction
  Homolog annotation: Hit_ID=Q1SXC2; Match level="QueryCoverage=97%, HitCoverage=10%, E-value=5e-58, Identity=78%"; Hit description=IQ calmodulin-binding region; Myosin head, motor region; Dilute; AAA ATPase; Myosin, N-terminal, SH3-like
AARETGALQAAKNKLEKQVEDLTLRLQLEKRLRINIEESKTQENEKLQSALQAMQLQFKETKLLVQKEREAAKREAERAPVIQEVPVVDHALLEKLTSENEKLKTLVSSLEKKIDETEKRYEEANKISEERLKQALDAESKIIQLKTTMQRFCL

SEQ ID NO: 152611 - protein, 67 aa, Glycine max
  Coding DNA Sequence Number=SeqID_35833
MLIQHQQLNFHPHLSTILQIRSLLARNWSVRLQHCYREGNAPADWLAKHGASNALFLSVQPHLAAFG

SEQ ID NO: 152612 - protein, 118 aa, Glycine max
  Coding DNA Sequence Number=SeqID_35834
  Homolog annotation: Hit_ID=Q7XJ40; Match level="QueryCoverage=29%, HitCoverage=4%, E-value=5e-08, Identity=77%"; Hit description =Receptor-like protein kinase ARK1
MVESNEENVKEDLELPLVDLAVIFKATDGFSINNKLGEGGFGTVYMAAGNNTGHDEVKKNALGIETLGVPNHDGACSTLSRSRSLWNCAGLAEKAHTYVQQGVVLSFESENTIEIKIA

SEQ ID NO: 152613 - protein, 139 aa, Glycine max
  Coding DNA Sequence Number=SeqID_35835
  Gene Ontology: Mol. function=binding
  Homolog annotation: Hit_ID=Q1SUU4; Match level="QueryCoverage=77%, HitCoverage=20%, E-value=7e-15, Identity=38%"; Hit description =Tetratricopeptide-like helical
  Pfam annotation: Domain name=PPR; Domain location=75-109; Score=36.6; E_value=8.6e-08; Accession=PF01535.11; Description=PPR repeat
MGRYGFVQKVVGDLCSLDSSPIAKLLDSCDGRNVFDRMPQRNIFSYNAILSVLTKFGKLDEALNVLKSMSEPDQCSWNAMVSSFAQHDRFEEALKFFDAMHSEDFVLSEHLFGSALSACSGLTDLNMVVQIHALISKSR

SEQ ID NO: 152614 - protein, 631 aa, Glycine max
  Coding DNA Sequence Number=SeqID_35836
  Gene Ontology: Mol. function=nucleoside-triphosphatase activity; Cellular component=integral to membrane; Biological process=transport
  Homolog annotation: Hit_ID=Q9SIT6; Match level="QueryCoverage=97%, HitCoverage=95%, E-value=0.0, Identity=67%"; Hit description=White -brown complex homolog protein 5
  Pfam annotation: Domain name=ABC2_membrane; Domain location=363-573; Score=211.0; E_value=2.8e-60; Accession=PF01061.14; Description=ABC -2 type transporter
  Pfam annotation: Domain name=ABC_tran; Domain location=68-254; Score =165.8; E_value=1.1e-46; Accession=PF00005.17; Description=ABC transporter
  Pfam module annotation: Pfam domain module=ABC2_membrane::ABC_tran; Domain location=363-573::68-254
MKKEGCEVEAIGINYKIRTKTTEQPFKIFTKPPQSNREDVHEAKEEERPCSGVRHVLKDVNCMAKPWEISAIVGPSGAGKSSLLEILAGKASPQSGSILVNQEPVDKAKFRKFSGYVTQKDTLFPLLTVEETIMFIAKLRLNLPQEQLRYRVKSLILELGLSHVARTRIGDERVRGISGGERRRVSIGVEVIHDPKVLILDEPTSGLDSTSALQIIEMLKVMADSRGRTIILSIHQPGYRIVKLFNSLLLLANGNVLHHGTVDLLGVNLRLMGLELPLHVNVVEFAIDSIETIQQQQKSEHVQLEVPRRLPGTMQQKKGGDLGESRSGKFTLQQLFQQSKIIDIEIISSGMDITRDFANSGLRETMILTHRFSKNILRTTELFACRTIQMLVSGLVLGSVFCNLKDGLVGAEERVGLFAFILTFLLSSTTEALPIFLQEREILMKETSSGSYRVSSYAIANGLVYLPFLLILAILFAMPLYWLIGLNRNFTAVLYFLMLIWLVLCTANSIVVCFSALVPNFIVGNSMIAGVIGSFLLFSGYFISKHEIPNYWIFMHYISPFKYPFEGFLINEFSNSNNCLEYLFGECVVRGEDVLKEAKLGGETSRWKNVGVMVQMLARSHPKSMMDSLSV

SEQ ID NO: 152615 - protein, 827 aa, Glycine max
  Coding DNA Sequence Number=SeqID_35837
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=97%, HitCoverage=97%, E-value=0.0, Identity=66%"; Hit description =Putative Na/H antiporter
  Pfam annotation: Domain name=Na_H_Exchanger; Domain location=44-431; Score=268.1; E_value=1.7e-77; Accession=PF00999.11; Description =Sodiumhydrogen exchanger family
MADVATNKTDDYIVCYAPSMITTNGVWQGDNPLEYSLPLFILQLTLVVVATRIFVFILKPFRQPRVIAEILGGVMLGPSVLGQNEAFANAVFPLRSVMVIETMANIGLLYFLFLVGVEMDLTVMRSVGRKAVASAIAGMILPFIVGIAFSYLLAKKTDSDINQGTYILFLGVALSVTAFPVLARILAELKLVNTELGRLALSAALINDVCAWVMLALAIALAETEITTLASLWVLISSVVFVAICAYGVRPAAKCLVKKTPEGESFSEFYISLILAGVMVSGFITDAIGTHAVFGAFVFGLSIPNGPLSFTLVEKLEDFVSGLLLPLFFAISGLKTNLGLIHGSYTWVILIIVIFLACLGKVVGTILVALFYEMPIHEGAALGLLMNTKGLVEMVVLNVGKDQKVFDEESFAIMVVITVIMTGIIVPAISVIYKPSRNSICYKRRTIEISKLDAEFRVLFCVHTPRNVPTMINLLEASNPTKNSPICVYVLHLVELSGRTSAMLIVHNTAKQDAPALNRTEAQSDHIIKAFENYEQHASFVSVQPLTAISPYSTMHEDICNLALDKRVSLIIVPFHKQQTVDGGMEATNMAYRSINQNVLANAPCSVGILVDKGLSGSNRLAGNQVSHHVAVLFFGGPDDREALCYGWRMVEHHGISLTVMRFVQSDQVQVEPLRQQHGGIDLDEPRVLTVQTDRDIQKQHDEKLIHEFRMRCGDDDAVDYVEKVVSNGEDTVAAIRTMDDIHDLFIVGRGQGVISPLTAGLTDWSECPEIGAIGDMLASSDFAATASVLVLQQYVGDGSQYEGLETPYGEESTPLPPGHKMFGSEH

SEQ ID NO: 152616 - protein, 187 aa, Glycine max
  Coding DNA Sequence Number=SeqID_35838
  Gene Ontology: Mol. function=binding; Cellular component=nucleus; Biological process=protein kinase C activation
  Homolog annotation: Hit_ID=Q1SLC5; Match level="QueryCoverage=90%, HitCoverage=57%, E-value=2e-18, Identity=30%"; Hit description =Tetratricopeptide-like helical
  Pfam annotation: Domain name=PPR; Domain location=75-109; Score=48.8; E_value=1.8e-11; Accession=PF01535.11; Description=PPR repeat
MDVVVKLLMFIRPSAPTFVSVIDACAQEALIGRGDKSGNLFNVYVGNALIDMYAKCGDMKSAENLFEIAPMRDVVTWNILISGFAQNGHGEESLAVFRRMIEAKVEPNHVTFLGCYLVVAMQCWGLVEFMGTWTLLERLQSNCLSWNQKIRVDMLYWQIYAASGKWGGAKRIRKVMKERSLEKEPAL

SEQ ID NO: 152617 - protein, 245 aa, Glycine max
  Coding DNA Sequence Number=SeqID_35839
  Homolog annotation: Hit_ID=Q8H7Q9; Match level="QueryCoverage=99%, HitCoverage=20%, E-value=2e-19, Identity=27%"; Hit description =Putative kinesin-related protein
MQNLELHCQCTVLDSKLGESQIVFSGMLKLVEELECKFTSMLEDSALKEKTIDVDLDALLEESRKLDERFTMEENFLTHMYLEKTAEAAILESALQEEQEKARLYDTELDNLGAEYEVMVQNYAEELAASRANQETLMVNHEKVVVLLEKVKLNEDLKGRVRGLEPELKASELKRLKATEEIFELQVQLQKIEMLQDEIFILKRSLYEAEFEFRRLEASYLMLSLECDELKAKNVSYNRRISTTE

SEQ ID NO: 152618 - protein, 480 aa, Glycine max
  Coding DNA Sequence Number=SeqID_35840
  Gene Ontology: Mol. function=methyltransferase activity; Cellular component=cellulose and pectin-containing cell wall
  Homolog annotation: Hit_ID=Q9FMJ2; Match level="QueryCoverage=86%, HitCoverage=53%, E-value=0.0, Identity=77%"; Hit description=Ankyrin- like protein
  Pfam annotation: Domain name=DUF248; Domain location=16-464; Score =801.8; E_value=3.9e-238; Accession=PF03141.7; Description=Putative methyltransferase
  Pfam annotation: Domain name=Methyltransf_11; Domain location=78-173; Score=32.5; E_value=1.4e-06; Accession=PF08241.2; Description =Methyltransferase domain
  Pfam module annotation: Pfam domain module=DUF248::Methyltransf_11; Domain location=16-464::78-173
MAILYKSCRSKDYGRHLIDNCMEIRFELVGIAHWVLTRKETNSKHDKKWQYGCMTMGFGDTLQTEPDIAWGKRTRVILDVGCGVASFGGFLFDRDVLAMSLAPKDEHEAQVQFALERGIPAISAVMGTKRLPFPGKVFDVVHCARCRVPWHIEGGKLLLELNRVLRPGGFFVWSATPIYQKLPEDVEIWKAMKTLTKAMCWEVVSISKDQVNGVGVAVYKKPTSNECYEQRSKNEPPLCPDSDDPNAAWNIKLQACMHKVPASSKERGSKLPELWPARLTKVPYWLLSSQVGVYGKPAPEDFTADYEHWKRVVSQSYLDGMGIKWSNVRNVMDMRSIYGGFAAALRDLNVWVMNVVTIDSPDTLPIIFERGLFGIYHDWCESFSTYPRTYDLLHADHLFSKLKKRCNLAAVVAEADRILRPEGKLIVRDTVEIVEELESMARSMQWKVRMTYSKDKEGLLCVEKSKWRPKEQEKLEYAIV

SEQ ID NO: 152619 - protein, 237 aa, Glycine max
  Coding DNA Sequence Number=SeqID_35841
MSTIHQTHESDGEKEFSFWGSSNTIPSENNCDQPQGNESRLNKEAYSGETHQRKSLKYEYSRFCSTVSDPSRSEAILEGQRELMEMMQDMPEFGYELSFQDMVVHEKQALEPEQQPHQNETSLENTLMQSSGHKAQLKRVSKKKKNKGNSRPGQILRVESMDSETFLLKLFFPISLDWMKKDRAKNGSKVSSRPSLQESIKQVGKEWRIKRLFLSGDNREDGICQKNGGRSISDINE

SEQ ID NO: 152620 - protein, 58 aa, Glycine max
  Coding DNA Sequence Number=SeqID_35842
MTTTTTEGKGKAREISNELNTEVVDTFLNTVVEEYGSQIDVDSNTRVSNNTTVMNGPR

SEQ ID NO: 152621 - protein, 159 aa, Glycine max
  Coding DNA Sequence Number=SeqID_35843
  Gene Ontology: Mol. function=protein kinase activity; Cellular component=integral to membrane; Biological process=protein amino acid phosphorylation
  Homolog annotation: Hit_ID=Q1T5L7; Match level="QueryCoverage=94%, HitCoverage=17%, E-value=9e-53, Identity=67%"; Hit description =Protein kinase
  Pfam annotation: Domain name=LRR_1; Domain location=102-124; Score =9.8; E_value=4.2; Accession=PF00560.23; Description=Leucine Rich Repeat
  Pfam annotation: Domain name=LRR_1; Domain location=126-148; Score =9.4; E_value=4.9; Accession=PF00560.23; Description=Leucine Rich Repeat
  Pfam annotation: Domain name=LRR_1; Domain location=30-53; Score=2.0; E_value=1.2e+02; Accession=PF00560.23; Description=Leucine Rich Repeat
  Pfam annotation: Domain name=LRR_1; Domain location=55-76; Score =20.1; E_value=0.0082; Accession=PF00560.23; Description=Leucine Rich Repeat
  Pfam annotation: Domain name=LRR_1; Domain location=78-100; Score =12.8; E_value=1.1; Accession=PF00560.23; Description=Leucine Rich Repeat
  Pfam module annotation: Pfam domain module=LRR_1::LRR_1::LRR_1::LRR _1::LRR_1; Domain location=102-124::126-148::30-53::55-76::78-100
MMGLASSQGYNFSASVCSWRGVSCDADREHVVDLVFSGMDLSATIPDNTIGKLGKLQFLDLSHNKITDLPLDFWSLSTVKSLNLSSNQISGSLTNNIGNFGLLESIDLSSNNFSEEIPEAVSSLLSLRVLKLDQNRFAHNIPSGILKCQSMICATSYFN

SEQ ID NO: 152622 - protein, 62 aa, Glycine max
  Coding DNA Sequence Number=SeqID_35844
  Gene Ontology: Mol. function=structural constituent of ribosome; Cellular component=intracellular; Biological process=translation
  Homolog annotation: Hit_ID=A0A3A0; Match level="QueryCoverage=87%, HitCoverage=53%, E-value=2e-17, Identity=72%"; Hit description =Putative ribosomal protein
  Pfam annotation: Domain name=Ribosomal_S24e; Domain location=1-58; Score=17.6; E_value=0.00039; Accession=PF01282.9; Description =Ribosomal protein S24e
MKEKLGRMYDMKDTKIVFVFKFQPHFGGGKSIGFGLIYDSVENAKKYEPKYRFIKFDDCLSS

SEQ ID NO: 152623 - protein, 66 aa, Glycine max
  Coding DNA Sequence Number=SeqID_35845
MVVNECVIDICSDITCHVRPKRILQSLGLGGKDTRFECSFKPMLIPCGWGILAKQSNPDWSPYDVT

SEQ ID NO: 152624 - protein, 72 aa, Glycine max
  Coding DNA Sequence Number=SeqID_35846
MDEVEDINVLEHCDKDGDADDNKLKDDVLKHYIEEESVNDEDEVQDNVLIFDAQKLIETLLAMCLSSEELRG

SEQ ID NO: 152625 - protein, 94 aa, Glycine max
  Coding DNA Sequence Number=SeqID_35847
MSMHMTVNFLFYYNSPSGKIIRGMEERYRYLMLYSVLDSKTHGPGRNARIVYIDGAFDLFHADHVEPEVSKEIISASNSLWWNIYLLYPTDQDE

SEQ ID NO: 152626 - protein, 549 aa, Glycine max
  Coding DNA Sequence Number=SeqID_35848
  Homolog annotation: Hit_ID=Q1S853; Match level="QueryCoverage=32%, HitCoverage=49%, E-value=1e-08, Identity=26%"; Hit description=RNA -binding region RNP-1
  Pfam annotation: Domain name=RRM_1; Domain location=66-131; Score =27.4; E_value=5e-05; Accession=PF00076.12; Description=RNA recognition motif. (a.k.a. RRM, R
MNKFRERNNGWERDRFRGKTVERGRASFRKVTQWDYASNKTRGQQLHKVSNWRDHNDITTFYFTCFGEEITEEKLWQHFKKWGDVRKVFIPNRRNYSGRRYGFVRLKGVRDIPHLARQLDRIVIGGLKLYVNIPKHGRDKPRKADAGIKIQRHEGGTQTETDHARQARQTNPASYRDRLASNIQNHSRQTSPSSIHIDIELEDTKWLKDAWVGRLRNPATFERVEDELWWEIGLKIAPKYIGDDSVLLLGLNDEDPEQIMNKGQDRGSSMFYSMERWSPSLRTGNRLVWVHCWGIPLQAWDKKHIQQIMSVMGDLVDMDDEVEEKRRLDRARVLIKTPWRPTIQHTIHVHIGDETFAVDVIEESDSVFHDYLRGRRSFVGLSDEIFSDKSYYRDHNSQTHNQTHFGAIPSTSAANVVREDDMQLSTVPETQNEQRYLACRPDGGVEDHGTTLLSSGQPGCKYPVGNSSIPRTFGRQQRSTAAQQLFHQNGNIERREIDDMAEIHNVLKAETRDHSVTCDPTEAKDHSCNHGKLKNLEGDEDRGVKAARE

SEQ ID NO: 152627 - protein, 125 aa, Glycine max
  Coding DNA Sequence Number=SeqID_35849
  Gene Ontology: Mol. function=metal ion binding; Cellular component =integral to membrane; Biological process=ubiquitin cycle
  Homolog annotation: Hit_ID=Q6EPF2; Match level="QueryCoverage=66%, HitCoverage=21%, E-value=4e-14, Identity=43%"; Hit description=Ring zinc finger protein-like
MGGKVLEGVRERGFELWNDFGIENGWAWNDFGIERFCDACDVKNARKSVAYNPQLERHVGILVAIENQDGGNKGKVPENVQDDEGLGKGLITLPLFELLRCRLPHHHGRLCLSFLAFIVLKLKKK

SEQ ID NO: 152628 - protein, 592 aa, Glycine max
  Coding DNA Sequence Number=SeqID_35850
  Gene Ontology: Mol. function=motor activity; Cellular component =myosin complex; Biological process=signal transduction
  Homolog annotation: Hit_ID=Q1SXC2; Match level="QueryCoverage=100%, HitCoverage=42%, E-value=0.0, Identity=75%"; Hit description=IQ calmodulin-binding region; Myosin head, motor region; Dilute; AAA ATPase; Myosin, N-terminal, SH3-like
  Pfam annotation: Domain name=IQ; Domain location=489-509; Score=21.0; E_value=0.0044; Accession=PF00612.17; Description=IQ calmodulin -binding motif
  Pfam annotation: Domain name=IQ; Domain location=512-532; Score=22.5; E_value=0.0015; Accession=PF00612.17; Description=IQ calmodulin -binding motif
  Pfam annotation: Domain name=IQ; Domain location=537-557; Score=28.2; E_value=2.9e-05; Accession=PF00612.17; Description=IQ calmodulin -binding motif
  Pfam annotation: Domain name=IQ; Domain location=560-580; Score=14.6; E_value=0.36; Accession=PF00612.17; Description=IQ calmodulin-binding motif
  Pfam annotation: Domain name=Myosin_head; Domain location=1-473; Score=471.9; E_value=7.8e-139; Accession=PF00063.11; Description =Myosin head (motor domain)
  Pfam module annotation: Pfam domain module=IQ::IQ::IQ::IQ::Myosin _head; Domain location=489-509::512-532::537-557::560-580::1-473
SNPVLEAFGNAKTVRNNNSSRFGKFVEIQFDQRGRISGAAIRTYLLERSRVCQLSDPERNYHCFYMLCGAPPEDIQKYKLGNPRTFHYLNQTNCFELEGVDELKEYRDTRRAMDVVGISSEEQEAIFRVVAAILHLGNIEFTKGQEMDSSVPKDEKSWFHLRTAAELFMCDAKALEDSLCKRVIVTRDETITKWLDPEAAALSRDALAKIVYTRLFDWLVDKINNSIGQDPDSKSLIGVLDIYGFESFKTNSFEQFCINLTNEKLQQHFNQHVFKMEQEEYKKEEIDWSYIEFVDNKDVLDLIEKVLKPTVICVAVDKSSSLQAEHQALLYVSKCPFVSGLFPPSPEESSKQSKFSSIGSRFKQQLQALLETLSATEPHYIRCVKPNNLLKPAIFENKNVLQQLRCGGVMEAIRISCAGYPTRKTFDEFADRFGLLAPEALDGSSDEVTTCKKILEKVGLKGYQIGKTKVFLRAGQMADLDTRRSEVLGKSASIIQRKVRTYLARRSFFLIRLSAIQIQAACRGQLAQQVYEGLRREASSLMIQRYFRMHVARKAYKELYSSAVSIQTGMRGMAARSELRFRKQTRAAIVIQ

SEQ ID NO: 152629 - protein, 100 aa, Glycine max
  Coding DNA Sequence Number=SeqID_35851
MEKALSANDEVPELFEAFGRTEILVYVGLTMFTVVALRVGESQSQSQDYFGECGYYVMHWMSTIILGTFRNNWEATIGAKEIKSIADPVGTVYLRVRDQA

SEQ ID NO: 152630 - protein, 226 aa, Glycine max
  Coding DNA Sequence Number=SeqID_35852
  Gene Ontology: Mol. function=nucleic acid binding; Cellular component= mitochondrion; Biological process=DNA integration
  Homolog annotation: Hit_ID=Q1SIY6; Match level="QueryCoverage=51%, HitCoverage=10%, E-value=5e-41, Identity=64%"; Hit description =Integrase, catalytic region; Zinc finger, CCHC-type
  Pfam annotation: Domain name=rve; Domain location=10-173; Score=79.4; E_value=1.1e-20; Accession=PF00665.16; Description=Integrase core domain
MENSLEIWTSHKYPNSELAMGFKVFFENKQCMIKDPYENEEEQAAYTAAMTNTKTWHKRLGVFFKFKNWIENQSGFRIHVLRLDNSKEYALNEFDKLCEEAGIEHQLTEPYTPQQNGVNKQKNRTIMEMARCLLHKKELPKEYWVEVANIVVFLLNRLPTKAVDGKTPFEAWYSMMQAPLELVGLGSSSSMDSFASWKINGSRMEKEEREETPLQGEDEFRRSSPP

SEQ ID NO: 152631 - protein, 103 aa, Glycine max
  Coding DNA Sequence Number=SeqID_35853
MDMQKEVEYKQQQEKLECEELFNNLHAHLGPQVDVIETLMVEVSSQPIPDDALTTINTSSIPRKINHLTIVAYNGVFKERIQEMNVRIYDDGSQKVILEKLQF

SEQ ID NO: 152632 - protein, 135 aa, Glycine max
  Coding DNA Sequence Number=SeqID_35854
MNESLVKLIIIFLPQEAHFPIIESIDLCWMQDLHHMHVVATYPSAGGRRVTRGIRVPRKEYARSRHQRLFEENVGKTGKDAIYELLSERFGSCIYARGRRETLRCWTINDLSGWSTKAGLLLLRILNCDEEIRPT

SEQ ID NO: 152633 - protein, 347 aa, Glycine max
  Coding DNA Sequence Number=SeqID_35855
  Gene Ontology: Mol. function=receptor activity; Cellular component =mitochondrion; Biological process=protein amino acid phosphorylation
  Homolog annotation: Hit_ID=Q1S1U3; Match level="QueryCoverage=87%, HitCoverage=47%, E-value=1e-114, Identity=70%"; Hit description=Trp repressor/replication initiator
  Pfam annotation: Domain name=DUF668; Domain location=284-347; Score= -32.4; E_value=0.052; Accession=PF05003.3; Description=Protein of unknown function (DUF668)
MKISAELILFQVSEVSLRLGKAGTTGIAIGLEKAVEVLDTLGSSMTNLNASSGFVSGAAIKGNEISILAFEVANTIVKGFNLLQSLSAKSIRHLKEEVLLSHAVQDLVSKDMDELLRIVAADKRQELKVFSDEVIRFGNRSKNPQWHNLERYFEKVSKELNGQRLSRDEAEAIMQQLMTLVQFTAELYHELHALDRFEQDIQRKGEEEEGDQRGDGLAFLRAEIKSQKKQIRHLKKKSLWSRSLEEVMEKLVDIVHFLYLEISNAFGNADDPKPFIGRMSNRQRLGPAGLALHYANIVLQIDTLLPLTSDGAISGRKFHVLKFLILIAFQVAIPSVTWNWKWMNLLV

SEQ ID NO: 152634 - protein, 241 aa, Glycine max
  Coding DNA Sequence Number=SeqID_35856
  Gene Ontology: Mol. function=protein binding; Cellular component =integral to membrane
  Homolog annotation: Hit_ID=Q5N731; Match level="QueryCoverage=91%, HitCoverage=60%, E-value=9e-87, Identity=69%"; Hit description =Putative NTS2 protein
  Pfam annotation: Domain name=DUF803; Domain location=1-213; Score =281.3; E_value=1.8e-81; Accession=PF05653.4; Description=Protein of unknown function (DUF803)
MVSAVLAHFMLNEKLQKMGMLGCLLCIVGSTVIVLHAPQEKSLSSVEEIWQLALQPAFLSYTASAIAVVFFLILYCAPRHGQTNILVYIGICSIIGSLTVMSIKAIGIAIRLTIEGADQFVQFQTWIFTMVAISCIVTQLNYLNMALDTFNTAVVSPIYYALFTSFTILASAIMFKDYYGQSISSIASELCGFVTVLSGTTVLHSTREPDPPVNTEFFISLQKTHGDSRKVKLENVWVEGT

SEQ ID NO: 152635 - protein, 141 aa, Glycine max
  Coding DNA Sequence Number=SeqID_35857
MKIENIVKSAAATSQDEFVSNCHTLISSGDLCLMTCDHSLVLVRCLAPIIKRFVKFQDMPKNQKNIDAESHPGPLGPSRIFLQKAVASGGSNLARLGELGGNHLPYFAINRGGSEEEKGSAPLALLSLSNLLGKIVSVKKI

SEQ ID NO: 152636 - protein, 381 aa, Glycine max
  Coding DNA Sequence Number=SeqID_35858
  Gene Ontology: Mol. function=nucleic acid binding; Biological process= DNA integration
  Homolog annotation: Hit_ID=Q1SG63; Match level="QueryCoverage=98%, HitCoverage=26%, E-value=1e-26, Identity=28%"; Hit description =Integrase, catalytic region; Zinc finger, CCHC-type
MTLEELIRILEVYEQELAQDEGTKKGKSLALMVQRPKFNSTSKESSSKAFPVNDALEEESDDDDSNKEDDELSLIIRKIRKMWRNKNPSRFNGSSKRSFHKKEKIPIICYKCKKLRHFKKHEDLIKAHQVHLVDFVPVTTSPCSEQDTFVCEEVKAPLSKKVSSGRKNLLKDFQDLEEREKSLTITLKDSEEWCKEMIKPKLLLQKECTLAKNELDKLKKKNSDLWMECQHYKKMSSDLNYKLKECEVLRALPLEVVKIYEIETLRDKLGNFVGGHEALNKILKISLIARKKHQSWYLDSICSRHMTGEKSMLQSLSPISSGVIIFRGNKKGLITGVGLKHNLLSISQLCDSGYNVTFYKDICIFHNKDNSSLFSAKRQGD

SEQ ID NO: 152637 - protein, 166 aa, Glycine max
  Coding DNA Sequence Number=SeqID_35859
  Gene Ontology: Mol. function=RNA-directed DNA polymerase activity; Biological process=RNA-dependent DNA replication
  Homolog annotation: Hit_ID=Q1RXD8; Match level="QueryCoverage=62%, HitCoverage=12%, E-value=3e-11, Identity=35%"; Hit description=RNA -directed DNA polymerase
GLLSENVDVKESLWWRNLKRVCGGLDQSKTKWFEKGMEWKLGDGDHIKFWVDEWLGEHCLAYLYPRLFLNSLKKSELECDMGREIPDSWIWKSSLEDSYKVSERAWKILYSWGSFSTFLPYSADTSWKVIYNQMQFMEDNVERIGMGSQDFDHEYQGLFGMMVMLV

SEQ ID NO: 152638 - protein, 736 aa, Glycine max
  Coding DNA Sequence Number=SeqID_35860
  Homolog annotation: Hit_ID=Q1S1T0; Match level="QueryCoverage=60%, HitCoverage=95%, E-value=1e-127, Identity=53%"; Hit description=DDT
  Pfam annotation: Domain name=DDT; Domain location=336-396; Score =36.1; E_value=1.2e-07; Accession=PF02791.7; Description=DDT domain
TNHEMDFADRLTVARGAMAVAVDATERLLADDHGPSLNLAVEDELIRAVDLVFTHLYRIPDTPFPTMLFSMTSLRVVVCCRVNLAEADRLTADEEEDARERRLCAQLEKERKRNAGGMEDGGGGGSGFAGDSGWAGFGAVLGADKRNSWIGLDCAENGYDENEVAKNGTEGFIPMPLLKRKPFVLPEPPDDLEPHENYRQRVWTCKITGKSGLTYEEALVSEKHAAEKVQQIPEELVAPALRIIHYSMLPLKDLADSIAEKLQEQLFVGAQLYGKKNDRVRPCKVLKVMQEDAENVRYVEESIKYPIDDLLVKPSPDDPVFSSRPSPSRDFNVPIYCVGDLLMVWDFFMSFGKLLRLSPYSLKDFENAISHKESNVVLLVESHAVLLRVLIKGDYEYSAAVLEKIQKKITLISWKDYLSDFLEMINIPKLRQHEATIKRGDYGYVDVNAKLEIFRELVNRALGTAFVREKLDEFIEQRTVLGAAKREEAIEAAGKRRKVKEQLKADFERNCGENGHHLGTVLGAAKREEAIEAAGKRRKVKEQLKADFERNCGENGHHLGHDASVSTNNNHRIQNGVAGKNRNGEIESSRQRDALDSGIKHSNIDSKIKAKKFNLELNRTAEIVEVSRKESKKQPGGDKDQSEKSAEQRSEYFDREMEKWRIRTSPLGKDRYYNRYWWFHRDGRIFVESSDSKEWGFYSSKEEDDSMVRRSTRVRAPPRENPSKAFLKYANVWKEE

SEQ ID NO: 152639 - protein, 182 aa, Glycine max
  Coding DNA Sequence Number=SeqID_35861
  Gene Ontology: Mol. function=transmembrane receptor activity; Cellular component=membrane; Biological process=regulation of transcription, DNA-dependent
  Homolog annotation: Hit_ID=Q7XIJ6; Match level="QueryCoverage=72%, HitCoverage=69%, E-value=6e-39, Identity=56%"; Hit description=TIR/P- loop/LRR disease resistance protein-like protein
  Pfam annotation: Domain name=TIR; Domain location=19-158; Score=43.5; E_value=7.4e-10; Accession=PF01582.10; Description=TIR domain
MQRLPAKTISKIARTACDVFINHRGIDTKKNVAGLLYDNLTRNGVRAFLDSMNMKPGDRLFDHIDRAILGCKVGVAVFSPRYCDSYFCLHELALLMESNKRVVPIFYDVKPSQLVVKDNGTRPHKDLQRFCLALEEAKNTVGLTFDSLNGDWSELLRNASDAVIMNLLEVEEERKHARKQQR

SEQ ID NO: 152640 - protein, 441 aa, Glycine max
  Coding DNA Sequence Number=SeqID_35862
  Gene Ontology: Mol. function=protein binding; Cellular component =cytoplasm; Biological process=steroid metabolic process
  Homolog annotation: Hit_ID=Q8LN57; Match level="QueryCoverage=97%, HitCoverage=62%, E-value=1e-155, Identity=56%"; Hit description =Putative oxysterol binding protein
  Pfam annotation: Domain name=Oxysterol_BP; Domain location=77-418; Score=103.5; E_value=6.1e-28; Accession=PF01237.9; Description =Oxysterol-binding protein
AEKVDLENTLIDDQRQSKDETESYLSTQEKYSEGSGDDSFEEHDGDDHSDDGDDAFYDTCDDILSTTSSEHLRSCHDSEYEETSPNGDEKSAIGSFGFNYPQIKRRKKFPDPVEKESSVSLWSIIKDNVGKDLTKVCLPVYFNEPLSSLQKCFEDLEYSFLLDQAYEWGKMGDSLKRMLHVAAFAVSGYASTNGRSCKPFNPLLGETYEAEYQDKGIRFISEKLDPVGLLTVEFDDGEVFHWSKGNREYSCKIKFKEQSIIDRNPHQIHGIVEDKKGRTVATIFGKWDESLHFIIGGNSGKGKRSSNVSSKPHLLWKRNPTPEYQTRYNLTQFAITLNEITPGLKEKLPPTDSRLRPDQRCLENGQHEMANSEKLRLEQRQRQAQKMQEKGWKPRWFAKEKGNNSYRYVGGYWETREKGNWESCPDIFGQFSTDTDFNSTP

SEQ ID NO: 152641 - protein, 180 aa, Glycine max
  Coding DNA Sequence Number=SeqID_35863
  Homolog annotation: Hit_ID=O04892; Match level="QueryCoverage=45%, HitCoverage=15%, E-value=5e-22, Identity=77%"; Hit description =Cytochrome P450 like_TBP
MSRRARRSLQNPGREPGGSVVGADLGGSSKYSNENFEGRRGEKPAHPWKRLSRKVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRTVNSELVRTRGIRLFN

SEQ ID NO: 152642 - protein, 259 aa, Glycine max
  Coding DNA Sequence Number=SeqID_35864
  Homolog annotation: Hit_ID=Q84UU3; Match level="QueryCoverage=41%, HitCoverage=13%, E-value=2e-24, Identity=52%"; Hit description =Terpene synthase
MVGFGLAYGGVVWDSKGLSGHSQVIFQVLNNLVSEASTKYLQQVGIYDDITNSMRDISYKKEKDQGKINSVLVNMVEDLESSIEDSIALVTEMIHKKEKELLEHALIEGHNDLPKASNHLHLSCLKVFHMFFNCSNRYDSETAMLQDISKAIYLALSKNSKPFEVVPLQLEPKEKTPTPVSYSNSYFKHHKRTTFTAHQVSQPALRKGHTSSTIRTSGSDGGDFPRRKEEKNANELLRLKQGTAWPAPRNVANVSPSYS

SEQ ID NO: 152643 - protein, 33 aa, Glycine max
  Coding DNA Sequence Number=SeqID_35865
MIMVRTRGLDRVLGRIIGRTLGREDHHDSDDVP

SEQ ID NO: 152644 - protein, 109 aa, Glycine max
  Coding DNA Sequence Number=SeqID_35866
  Homolog annotation: Hit_ID=Q8H6Q8; Match level="QueryCoverage=87%, HitCoverage=2%, E-value=1e-12, Identity=38%"; Hit description=CTV.20
MDRNILDSLFLNIYFHGLDMKEGSIPTALIYSIQYKVVNTCASRVLLQAQKGETTLFITDMTKTNVSLKRIIKWDEVTLPEKWVMEKATLSNPRTGPIIEKIKRDKLRK

SEQ ID NO: 152645 - protein, 449 aa, Glycine max
  Coding DNA Sequence Number=SeqID_35867
  Gene Ontology: Mol. function=serine carboxypeptidase activity; Cellular component=cellulose and pectin-containing cell wall; Biological process=proteolysis
  Homolog annotation: Hit_ID=UPI000034F551; Match level="QueryCoverage =84%, HitCoverage=79%, E-value=1e-167, Identity=71%"; Hit description= SCPL31; catalytic/ serine carboxypeptidase
  Pfam annotation: Domain name=Peptidase_S10; Domain location=75-449; Score=547.1; E_value=1.8e-161; Accession=PF00450.12; Description =Serine carboxypeptidase
  Subcellular localization annotation: CTP_CleavageSite=57; ConfidenceScore=5.19e-01
MAKVISSQAVNKRGIKILPGWTLIDLIRFSKISTHPQSASSSVSSRDRQWGGVRRILSSGDNNNNNNGDLVTNLPGQPPVDFQHYAGYVTVNETNGRTLFYWFYEAMTKPEDKALVLWLNGGPGCSSVGYGATQEIGPFLVDTDGRGLKFNNFSWNKEANMLFLESPVGVGFSYSNTTSEYAQLGDDFTANDAYTFLHNWFLKFPSYRTRTFYIAGESYAGKYVPELAELIHDRNKDPSLHINLKGILLGNPETSDAEDWSGMVDYAWSHAVISDETYKTIKASCDFNSSDPWSNNDCTQGVDETLKQYNEIDIYSLYTSVCFASTARSNDQSMQMVMSRSSKMMPRIMGGYDPCLDDYAKTFYNRPDVQKALHVSDGYNLKNWSICNENIFKGWAQSKPSVIPIYKKLISAGLRIWVYSGDTDGRVPVLSTRYSLSILGLPITKRWRP

SEQ ID NO: 152646 - protein, 324 aa, Glycine max
  Coding DNA Sequence Number=SeqID_35868
  Homolog annotation: Hit_ID=Q94BQ7; Match level="QueryCoverage=18%, HitCoverage=5%, E-value=3e-07, Identity=45%"; Hit description =Putative RB-binding protein
MAVLRGVALPAQGAGTLPRCESGWVHCKDKGEHEGYAFVAFNRNRVVNDIHGFSTKKNKEYQEKLPLVVLRAVEIIYSKANFENVVVTRRIVAFTIHQPSIDIFEAFDELTTCTLLRERDSGHNPSIGVESLYPCSADLSLPSMLHSVPPIVAPMVYDHRAESGASLGMLSSSSLYGGYGSFSGVGHCRASDVSSCLATAQATEFPFSELSCPTTCLQGPFECDDEVADTLSQLWHLRYPLNVKVSLVAVMVLQSSAILQNVFLHDAFVTALRKAEQFLWAGSKMDSVRDMVKNLIEAQKWAEGIREKLSYGCVIGTLMSRKLI

SEQ ID NO: 152647 - protein, 183 aa, Glycine max
  Coding DNA Sequence Number=SeqID_35869
  Gene Ontology: Mol. function=helicase activity
  Homolog annotation: Hit_ID=Q9ZQ61; Match level="QueryCoverage=98%, HitCoverage=15%, E-value=2e-47, Identity=45%"; Hit description =Putative helicase
MLSDLTKNHLLRNVVAYNKYPTSDEIDQIISAEIPSKEDYPELYTLVQNHMVHGPCGIIRSESPCMKEGKCSRFYPKMFQPRTLLDANGYPVYHRRNDGRIISKNSVIIDNRHNVPYNPKLLKKYQAHVNIEWCNQSASIKYLFKYINKGYDRVIAVMLYDGNDEIQNATNQKDEIKEYIDGK

SEQ ID NO: 152648 - protein, 262 aa, Glycine max
  Coding DNA Sequence Number=SeqID_35870
  Gene Ontology: Mol. function=cysteine-type peptidase activity; Biological process=proteolysis
  Homolog annotation: Hit_ID=Q1S6A6; Match level="QueryCoverage=66%, HitCoverage=36%, E-value=4e-24, Identity=33%"; Hit description=FAR1
MEEHSISDCSNDGTFEDVHMEDDGVALRMMSLVSKVKNMCFWNEDGLDDNECFENNVSDDNELKDEEDYDNEVLNDEGYQFYKCGGHKHKLLNEQDCGLLSGHRKITASDAMQIENYRKVVIRPPHIYASLAQTSGGYNKVGYVRKDIYNYFARQGRKQSSDVNRALNYFHHLCPKDPMMVVAYIVDDENRLQHLFCVNHHNNTIVFATALVTNETEETYVWLLEQFLKEMKGKHPSSVITDGDLPMRAIRIVFPRTHHQFA

SEQ ID NO: 152649 - protein, 144 aa, Glycine max
  Coding DNA Sequence Number=SeqID_35871
  Subcellular localization annotation: CTP_CleavageSite=32; ConfidenceScore=5.35e-01
MTATKLTFTVTKQPTKNLNYPTCKPSPTHLFRTMIATKLTSTKLNPQPSIMNKHLKPHYAKKIYKEGQLPLRGYLKCQSWDNVSATSSSHSNGPLFELSELMSQLPIKRGLSMFYQGKAQSFSSLASVESIGDLPKNLVKNQTN

SEQ ID NO: 152650 - protein, 140 aa, Glycine max
  Coding DNA Sequence Number=SeqID_35872
  Homolog annotation: Hit_ID=Q10MC3; Match level="QueryCoverage=75%, HitCoverage=14%, E-value=5e-12, Identity=37%"; Hit description=WD40 -like Beta Propeller Repeat family protein, expressed
MATTTWKHSVLRTGFKCNDVVIYNFKDGAYTRWGDSLDDDRVKRNGSIGGENCSVNTPPLVLASTVEVESAIVDPGWPAIEFGNLDTVSSIAGEEDIDVSGEIFNFFGPTVGGAVGSNSGPKTRGREGWAEISEAVQHNS

SEQ ID NO: 152651 - protein, 64 aa, Glycine max
  Coding DNA Sequence Number=SeqID_35873
MGVKLAQNDRYIIIARSAPYLIFQVECGMTIEQCISTSWVRKLAILARKGVHACAMDKARIEPR

SEQ ID NO: 152652 - protein, 67 aa, Glycine max
  Coding DNA Sequence Number=SeqID_35874
MRRGAKRKTKQGQEAIHDAPEDNKPKAQPRAKRAKTSKPQSEPKYFQDKRNLCTLYLRLFWFGALTQ

SEQ ID NO: 152653 - protein, 137 aa, Glycine max
  Coding DNA Sequence Number=SeqID_35875
MVDCNVITTRSGLATKELVKKDMEVDNEVKEDIQEEDSRLTKEAKQAITHEKLYLSKPAKQDKEWRYRRLIDLIKQFDVTIPFINVIDMMLEYSKLLKDLITKNKCLKDYGIVTLEEDCSVILENHKKHNHKGDLTR

SEQ ID NO: 152654 - protein, 790 aa, Glycine max
  Coding DNA Sequence Number=SeqID_35876
  Gene Ontology: Mol. function=nucleic acid binding; Cellular component= nucleus; Biological process=RNA processing
  Homolog annotation: Hit_ID=Q5ZCG4; Match level="QueryCoverage=94%, HitCoverage=59%, E-value=0.0, Identity=59%"; Hit description =Putative ATPase
  Pfam annotation: Domain name=DEAD; Domain location=51-313; Score= -27.3; E_value=0.0011; Accession=PF00270.19; Description=DEADDEAH box helicase
  Pfam annotation: Domain name=Helicase_C; Domain location=656-734; Score=77.5; E_value=4.3e-20; Accession=PF00271.21; Description =Helicase conserved C-terminal domain
  Pfam annotation: Domain name=SNF2_N; Domain location=44-439; Score =155.6; E_value=1.3e-43; Accession=PF00176.13; Description=SNF2 family N-terminal domain
  Pfam annotation: Domain name=zf-C3HC4; Domain location=477-517; Score= 17.8; E_value=0.0023; Accession=PF00097.15; Description=Zinc finger, C3HC4 type (RING finger)
  Pfam module annotation: Pfam domain module=DEAD::Helicase_C::SNF2 _N::zf-C3HC4; Domain location=51-313::656-734::44-439::477-517
MVGSMGPKARDEQYILRVALQDLSQPKSEVSPPDGLLAVPLLRHQRIALSWMVQKETSSLYCSGGILADDQGLGKTVSTIGLILKERPPLLNKCNNAQKSELETLNLDADDDQLPENGIVKNESNMCQVSSRNPNQNMNLLLHAKGRPSAGTLIVCPTSVLRQWAEELHNKVTCKAKLSVLVYHGSNRTKNPHELAKYDVVLTTYSIVSMEVPKQPLVDKDDEEKGTYDDHAVSSKKRKCPPSSKSGKKGLDSAMLEAVARPLAKVAWFRVVLDEAQSIKNHRTQVARACWGLRAKRRWCLSGTPIQNAIDDLYSYFRFLRYDPYAVYTSFCSTIKIPISRSPSKGYRKLQAVLKTIMLRRTKATLLDGEPIISLPPKSVELKKVEFSPEERDFYSRLEADSRAQFQEYADAGTVKQNYVNILLMLLRLRQACDHPLLVKRYNSNSLWKSSVEMAKKLPQEKRLCLLKCLEASLALCGICNDPPEDAVVSVCGHVFCNQCICEYLTGDDNQCPAPNCKTRLSTPSVFSKVTLNSSFSDQPCDNLPDYSGCEVEESEFCSQAQPYDSSKIKAALEVLQSLSKPQCFASQNNSVQSTSGESTDGLGSSSSADRMKSLNEIPESQNVLEERSSNNSVGVGEKAIVFSQWTRMLDILEACLKNSSIQYRRLDGTMSVTARDKAVKDFNTLPEVSVMIMSLKAASLGLNMVAACHVLMLDLWWNPTTEDQAIDRAHRIGQTRPVTVLRLTVRDTVEDRILALQVSVGCSFWWKQKKQGAENFVAWPLLTLDMKII

SEQ ID NO: 152655 - protein, 356 aa, Glycine max
  Coding DNA Sequence Number=SeqID_35877
MCSCAFTVDPCLLTSASGNSVLECEHENQGPSSQTFSSPNALAGGFRDSSMLESDEFCFTEMTGVSNCETPAYIADRRFPVPEANSSSVAVCGDNLNLPLWKCENDSQIKHIGYDAQSEHASHGSIIENIDLNFGDYETYMEDIIGLSGKQENDSCTSFEMSFVDADRSSRVATSTDSSICQGSNVPNDFSDYYPSLNCYQGMDDRPVVANSSGCLPNGVYPHVRKNEEMVRNMKVAKMELFADTSSGMHSSINGGISFQDSQFRFADSKYASSFPGNVLFEDNASVELSTCGSYISREGQSLTVKAERDELIMPYQNSVHSNDAEFNVGQEMKQLPGIFPAVGCQGNDFFKCRDK

SEQ ID NO: 152656 - protein, 49 aa, Glycine max
  Coding DNA Sequence Number=SeqID_35878
MVEAEIVEKDCRIECWYGMVGLQCNGQRASKSNKLGPFSITIQNVVVTV

SEQ ID NO: 152657 - protein, 147 aa, Glycine max
  Coding DNA Sequence Number=SeqID_35879
MAYPVGQLDKPYIILSLRLSDLSSHWHLLKMILGLRDLTRQSHLAMNITYRSETEILHPSKINIARKGVGPKAKPPVASLEIEERGGFQSHSKKEGRKRREARDREESARFLRRFVMRLFFVTPCCVRKKREKVGERKDKAVPELWM

SEQ ID NO: 152658 - protein, 106 aa, Glycine max
  Coding DNA Sequence Number=SeqID_35880
MGLLERLEWVNAYGKKRCRSLFWRVRAALKKALKNGGKQRLKFQYDPSSYALNFDDGCCAAKKFIGDARLMELTDIHNNTLELVLFPCASAYYLIFLTSVLSYNTR

SEQ ID NO: 152659 - protein, 64 aa, Glycine max
  Coding DNA Sequence Number=SeqID_35881
MGLKSSSLFDFETRHRRFLAMMSNEEFDYSYLSDDDGDVADDDKLCIDLDTVMSVLDEDADPSE

SEQ ID NO: 152660 - protein, 51 aa, Glycine max
  Coding DNA Sequence Number=SeqID_35882
MKRKHMHQHVRLTCGTDEDCAANSAQLLLMEKDSDEIIVIDAVLIGIVLPW

SEQ ID NO: 152661 - protein, 54 aa, Glycine max
  Coding DNA Sequence Number=SeqID_35883
MVMLGGLDFLLMKPYTEQLSYVGEGDDVAMERGREGGDWWRVKSHRGPVENLQN

SEQ ID NO: 152662 - protein, 226 aa, Glycine max
  Coding DNA Sequence Number=SeqID_35884
  Gene Ontology: Mol. function=ribokinase activity; Biological process =D-ribose metabolic process
  Homolog annotation: Hit_ID=Q1SXC4; Match level="QueryCoverage=96%, HitCoverage=64%, E-value=2e-65, Identity=55%"; Hit description =Carbohydrate kinase, PfkB
MIPDELSKSSLLSALDGAKFAYFDGRLPDTALVVAQEAVRKNIPILIDAERPREGLDDLLKLADYVVCSAKFPASFIYCAFLAAGPSTEEVDVDSLLESLEIKRDKSVSIPTCISSVMSAKPKILFLLSVAKLKAEGIGTVSGKLYVGTAESIPPSELVDTTGAGDAFIGAVIYAICAKFTPETMLSFAANVAGAKCRDLGARSGLPYRADPRIASFVLEKLSSSA

SEQ ID NO: 152663 - protein, 90 aa, Glycine max
  Coding DNA Sequence Number=SeqID_35885
  Subcellular localization annotation: CTP_CleavageSite=51; ConfidenceScore=5.48e-01
MLSTALPSPSKPETAFRFSSPNMENSDFGRLRGPKPFFARRVLREALVLTVCGLKAFSRQFYGGFVLPESKPPQRFLTAGMKKTEANIRD

SEQ ID NO: 152664 - protein, 150 aa, Glycine max
  Coding DNA Sequence Number=SeqID_35886
  Gene Ontology: Mol. function=ribokinase activity; Biological process =D-ribose metabolic process
  Homolog annotation: Hit_ID=Q1SXC4; Match level="QueryCoverage=68%, HitCoverage=29%, E-value=7e-43, Identity=80%"; Hit description =Carbohydrate kinase, PfkB
  Subcellular localization annotation: CTP_CleavageSite=38; ConfidenceScore=5.75e-01
MPNLCTVSSNASSNFIFGVQPHNFYNVFGSRRTRPRCRVSMSSSDPQNAVVVGCGSVTMDFLATVAAYPKPDDKIRSTSLKVQGGGNVGNALTCLARLGLNPRLISKIADDSQGRSILDELRDDGVDTSFIVVSKEGTSPFTYIIVDNQT

SEQ ID NO: 152665 - protein, 162 aa, Glycine max
  Coding DNA Sequence Number=SeqID_35887
MAIKVDLVDLFSVERKALLQSLRLTMFGFHCLLRLTPSVAVASGSKHHCKLCEDLLFHGGVDTGIGGGILSGGADKNDVRLGVAGEVHGAKVVGGTVGGLKECGDELAGGGRVGGRTKRGTRGGHSSEGRRRGRTRRGGCRRRGRRWRQQEWKGKSSLRDLR

SEQ ID NO: 152666 - protein, 440 aa, Glycine max
  Coding DNA Sequence Number=SeqID_35888
  Gene Ontology: Mol. function=metal ion binding; Cellular component =cytoplasm; Biological process=vesicle-mediated transport
  Homolog annotation: Hit_ID=Q5JMT9; Match level="QueryCoverage=85%, HitCoverage=88%, E-value=1e-115, Identity=58%"; Hit description =Copine I-like
  Pfam annotation: Domain name=Copine; Domain location=125-308; Score =251.8; E_value=1.4e-72; Accession=PF07002.6; Description=Copine
MGNSESMYESQDNFYQHPPSYYNSYHQPSPYAENSENTTYHEPSSYAWNSSNTTYYQSSTYAGSSENTRHQHTRQPTYIADNFSSLDQVVSSLREAGLESSNLILGIDFTKSNEWTGKHSFHRKSLHHIGNTPNPYEQAISIVGHTLSSFDEDNLIPCFGFGDASTHDQNVFCFYQDNRFCHGFEEVLARYREIVPYIKLSVVLREFKQKDYIDFSVGASSLSTVPPVRNPAFVPFRPTSFAPVIDAAIDIVERNNGQYHVLVIIADGQVTRNPDVPYGKLSPQEQATINSIIAASHYPLSIILVGVGDGPWDEMKYYDDNITERLFDNFQFVNFTKIMSENTEASKKEATFALAALMEIPLQYRAAQNIQLNDRESVLHQHKRPLPPPNEVIHHDNARMAIPHMPNLESAESTAPAAAEPVCPICLTNPKDMAFGCGHT

SEQ ID NO: 152667 - protein, 309 aa, Glycine max
  Coding DNA Sequence Number=SeqID_35889
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=Q9LRE6; Match level="QueryCoverage=97%, HitCoverage=29%, E-value=1e-137, Identity=73%"; Hit description=DNA polymerase delta catalytic subunit
  Pfam annotation: Domain name=DNA_pol_B; Domain location=1-214; Score=- 48.2; E_value=1.4e-07; Accession=PF00136.12; Description=DNA polymerase family B
MVQFGVSAVEEAMNLGREAAEYISGTFTKPIKLEFEKVYYPYLLISKKRYAGLFWTKPDNFDKMDTKVQYVKNAISDLLMNRMDLSLLVITKGLTKTGDDYEVKAAHVELAERMRKRDAATAPNVGDRVPYVIIKAAKGAKAYEKSEDPIYVLENNIPIDPQYYLENQISKPIMRIFEPILKNASKELLHGSHTRSISISTPANSGILKFAKKQLTCIGCKALLGNGHHTLCSHCKGREAELYCKTVSQVSELEMLFGRLWTQCQECQGSLHQDVLCTRHQTLNGPLEPLAHEMKKGSRELLVYSRRKK

SEQ ID NO: 152668 - protein, 391 aa, Glycine max
  Coding DNA Sequence Number=SeqID_35890
  Gene Ontology: Cellular component=integral to membrane
  Homolog annotation: Hit_ID=Q1SQ50; Match level="QueryCoverage=86%, HitCoverage=73%, E-value=7e-44, Identity=43%"; Hit description =Sodium/calcium exchanger membrane region
  Pfam annotation: Domain name=CD20; Domain location=58-157; Score= -49.1; E_value=0.062; Accession=PF04103.5; Description=CD20IgE Fc receptor beta subunit family
  Pfam annotation: Domain name=Na_Ca_ex; Domain location=20-150; Score =41.2; E_value=3.7e-09; Accession=PF01699.14; Description =Sodiumcalcium exchanger protein
  Pfam annotation: Domain name=Na_Ca_ex; Domain location=238-391; Score= 1.1; E_value=0.011; Accession=PF01699.14; Description=Sodiumcalcium exchanger protein
  Pfam module annotation: Pfam domain module=CD20::Na_Ca_ex::Na_Ca_ex; Domain location=58-157::20-150::238-391
MAITVFVSKRMGYTLFLNTCFLVICSFMIVHFHTPDVMVVTKISAFDSSNGQELSPTIAGVTLLSLGNGAPDVFSSLVSFQESGTRDMGFNTVLGGVSFVSCVVVGSVSIAIRQSGVQVAKSAFVRDVYFLLFVVLALFVIVYASFTRWKEGGDDDERGGIGISDCDNDLSLGVPLLNGAQEYDLNIEKDYCCMRYSIYTSKSEAADVGLGYFLTMSLYLPRRLTIPVVCEERWSKNLIVYGIGILVGTILGVIAFFTTKMSGSPEKCLFPWLAGGFVMSVTWSYIIAQELFLAWGNSLGDLMTNLTMALNGGPEGAQVAMSCCYAGSIFDTLTENPQPVVIPRDPYLWETMVFLVAGLVWALVVLRKTDMKLDGLLGGGLLFVYFLSLFI

SEQ ID NO: 152669 - protein, 138 aa, Glycine max
  Coding DNA Sequence Number=SeqID_35891
  Gene Ontology: Mol. function=actin binding
  Homolog annotation: Hit_ID=Q2HV31; Match level="QueryCoverage=86%, HitCoverage=19%, E-value=1e-37, Identity=69%"; Hit description =Prefoldin
  Pfam annotation: Domain name=DUF827; Domain location=2-135; Score= -110.8; E_value=0.035; Accession=PF05701.2; Description=Plant protein of unknown function (DUF827)
MLIQQQQQQRLIPLGGKVLEKETQLLLAQTELNNIKKQLQCAENTKSKTLSELDKAKVTLQELRTKLNSVRESKQSAIEVAKAMNNKAKQLEQALSQKAIGYEAWKQKLEHERKEYTTTVKEESRCFEATTQQNNAIF

SEQ ID NO: 152670 - protein, 195 aa, Glycine max
  Coding DNA Sequence Number=SeqID_35892
  Gene Ontology: Mol. function=ubiquitin-protein ligase activity; Cellular component=intracellular; Biological process=protein modification process
  Homolog annotation: Hit_ID=Q1SJF0; Match level="QueryCoverage=77%, HitCoverage=73%, E-value=4e-22, Identity=35%"; Hit description =Regulator of chromosome condensation/beta-lactamase-inhibitor protein II
  Pfam annotation: Domain name=RCC1; Domain location=135-186; Score =13.2; E_value=0.026; Accession=PF00415.9; Description=Regulator of chromosome condensation (RCC1)
  Pfam annotation: Domain name=RCC1; Domain location=29-80; Score=8.5; E_value=0.084; Accession=PF00415.9; Description=Regulator of chromosome condensation (RCC1)
  Pfam annotation: Domain name=RCC1; Domain location=83-132; Score =25.5; E_value=0.00019; Accession=PF00415.9; Description=Regulator of chromosome condensation (RCC1)
  Pfam module annotation: Pfam domain module=RCC1::RCC1::RCC1; Domain location=135-186::29-80::83-132
MLRRSFSKLHLSLRAPGLGFPTRSFSRDAGKRFAALWGNGDYGRLGLGNLDSQWKPVVCPAFRNKTLNAIACGGAHTLFLTEDGCVYATGLNDFGQLGVSESKHYSVEPLCVFGEEKKVVQISAGYNHSCAITVDGELYMWGKNTSGQLGLGKRAPNIVPLPTKVEYLKGINIKMAALGSEHSVAISGMQKINNH

SEQ ID NO: 152671 - protein, 213 aa, Glycine max
  Coding DNA Sequence Number=SeqID_35893
  Gene Ontology: Mol. function=cobyrinic acid a,c-diamide synthase activity; Cellular component=chloroplast; Biological process =selection of site for barrier septum formation
  Homolog annotation: Hit_ID=Q45RR8; Match level="QueryCoverage=71%, HitCoverage=52%, E-value=7e-45, Identity=57%"; Hit description =Plastid division regulator MinD
MLRRSLIFILHLLLLSFGYEVGLVGWRDGSDEAGVSASRAVDEDEGLAVESEGKFGVGFGDAEEFEVGPALVTDGGLVEATVAIEDLNHGVVDAILKAEEEVEVAKVNISVDGDHGEAETGEEEANVGDGGGLAHATLAGGDDDNARGGVGELGLVIPLESSWSRGFRKRREKFKRKERRGSKRENLKFNLLKIEFKILFFQLTKIPLKILKF

SEQ ID NO: 152672 - protein, 254 aa, Glycine max
  Coding DNA Sequence Number=SeqID_35894
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=57%, HitCoverage=20%, E-value=7e-40, Identity=54%"; Hit description =Receptor kinase-like protein
MDTEMVESIVENLVAIRSSNATEADLGSSPSPAHAFASAVDIRTVAAPLFTPAELKVATNNFSFVDHANVFVKIIILSVYIWDIKYSNILTDVTWTAKVSDFGKAAGTIGYIDPEYLTRRVLTEKSDVYRFRVVVLELLTGKTPIFESMYGEDGGTRLHVIPYAVPAILAGELVKILDPRVGPPDIDEAEAVELVAYTTIHCVKREGKDIPTMADNVVNLERVLIICGMLVGHTCNADPKKSPCSIAAAVTAIC

SEQ ID NO: 152673 - protein, 142 aa, Glycine max
  Coding DNA Sequence Number=SeqID_35895
  Homolog annotation: Hit_ID=P57681; Match level="QueryCoverage=37%, HitCoverage=10%, E-value=4e-20, Identity=85%"; Hit description =Probable prenylcysteine oxidase precursor
METEKRKRQKYEILKHVAVVSTICLKYKERQEILKMEKTNSVVGPRGLAGKHGKLQKAIYDLKQTPQACVRKETIRINWAAYPLYHAPEVFAPFILDGRHLYYVNAFENAASTMETSAVAAENINCPTHTVKIFWPSNCAFI

SEQ ID NO: 152674 - protein, 140 aa, Glycine max
  Coding DNA Sequence Number=SeqID_35896
  Gene Ontology: Mol. function=zinc ion binding; Cellular component =intracellular; Biological process=protein modification process
  Homolog annotation: Hit_ID=Q2R2X5; Match level="QueryCoverage=91%, HitCoverage=31%, E-value=3e-19, Identity=38%"; Hit description=Uvb -resistance protein uvr8, possible, putative, expressed
  Pfam annotation: Domain name=RCC1; Domain location=33-80; Score=15.3; E_value=0.016; Accession=PF00415.9; Description=Regulator of chromosome condensation (RCC1)
  Pfam annotation: Domain name=RCC1; Domain location=83-128; Score =19.7; E_value=0.0053; Accession=PF00415.9; Description=Regulator of chromosome condensation (RCC1)
  Pfam module annotation: Pfam domain module=RCC1::RCC1; Domain location=33-80::83-128
MAEYTPRLIKDLEGIKVKYVAAGLLNSACTDENGCVFVFGERGIEKLRLKEMSDATKPSLISELPSSKEVACGGYHTCVLTNSGELYTWGSNENGCLDVIHLPEKVQGPFLKSSVSQVSCGWKHTAAISGSGQMLEVAMG

SEQ ID NO: 152675 - protein, 447 aa, Glycine max
  Coding DNA Sequence Number=SeqID_35897
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=67%, HitCoverage=39%, E-value=1e-83, Identity=54%"; Hit description =Receptor kinase-like protein
  Pfam annotation: Domain name=Pkinase; Domain location=90-364; Score =57.1; E_value=5.9e-14; Accession=PF00069.15; Description=Protein kinase domain
  Pfam annotation: Domain name=Pkinase_Tyr; Domain location=90-364; Score=-19.0; E_value=2.6e-11; Accession=PF07714.7; Description =Protein tyrosine kinase
  Pfam module annotation: Pfam domain module=Pkinase::Pkinase_Tyr; Domain location=90-364::90-364
MDTETVERIDVRDNTDDARSFSMAVDSDIRSDTGSIFGESRVRSFASLVDSAIRSSSASEADLGSSPSPVHAFAAPLFTLAELKAATNNFSFDNKIGTGGFVVEYRGKLVDGREVAIKRGKTWSNSFGKSKFALFSRLHHKNLVGLVGFCEEKYERLLVYEYMKNGTLYHHLHSKKGSSVLNSWKMRIKIAVAVSEGIQYLHNYASIIHKNIMSSNILFDATWTARVSGFDLWLVNPEPDRDYRTMWTVGTFGYIDPEYYGLNVLTAKSDVYGLGVVLLELLTGKRAKFKYEGKDFVCTPIKSVVDFAVPVILTGELVKILDPRVGPPDVNEAEAVELVAYTAIHCVNLKGKDRPTMADIVANLGRALAIFGGEGTFTIFHLLCPIRTRKLLRIYSVNKKLTFRALDGHVEKGGEVRARQAKRSFTLKSTVNLSLVLAFTPVFFFVL

SEQ ID NO: 152676 - protein, 304 aa, Glycine max
  Coding DNA Sequence Number=SeqID_35898
  Gene Ontology: Mol. function=DNA binding; Cellular component =chromatin silencing complex; Biological process=regulation of transcription, DNA-dependent
  Homolog annotation: Hit_ID=Q1SJF6; Match level="QueryCoverage=94%, HitCoverage=75%, E-value=1e-105, Identity=65%"; Hit description =Silent information regulator protein Sir2
  Pfam annotation: Domain name=SIR2; Domain location=110-304; Score =57.8; E_value=1e-15; Accession=PF02146.8; Description=Sir2 family
  Subcellular localization annotation: CTP_CleavageSite=72; ConfidenceScore=5.17e-01
MAMSLPLRFYSSSSFSLTHCVSANYCIFTDIVQPRSGNWHLAKRGGRLISFKGRARLVHTTCRISVPGTLPRTDEKASSNISRDKKTVPEADPPSIKDVQLFTKLTVLTGAGISTECGIPDYRSPNGAYSSGFKPITHQEFLRSSRARRRYWARSYAGWRRFTTAQPSAAHTALATLDKAGRINFMITQNVDRLHHRAGSNPLEIHGTVYTVICIDCGYSFCRSLFQDQLKTLNPKKNADEWAEAIDNLDHGNPGSDKSFGMKQRPDGDIEIDERFWEEDFTIPTCHKCNGALKPDVGRLVSFS

SEQ ID NO: 152677 - protein, 574 aa, Glycine max
  Coding DNA Sequence Number=SeqID_35899
  Gene Ontology: Mol. function=RNA-directed DNA polymerase activity; Cellular component=chromatin; Biological process=chromatin assembly or disassembly
  Pfam annotation: Domain name=rve; Domain location=52-208; Score=90.8; E_value=4.1e-24; Accession=PF00665.16; Description=Integrase core domain
MRVAKTLARVSENFSWPGLRRDVTKFVAQCVDCQLTKYETKKSAGLLCPLPVPQRPWEDLSLDFIMGLPPFQGHSVILVVVDRFSKGIHLGTLPASHTAHMVAVLFMEIVGKIHGIPRSLVSDRDPLFLSNFWRELFQLSGTQLRMSYAYHPQTDGQTEVMNRIIEQYLRAFVHRRPRGWGKLLLWVEWSHNTSWNTATGTTPYEITFGRKPFNFPDYITGTSKLDAVEEMLRDRDETFQCIRRKLIKAQIKMKKFADVKRREMSYQPGDWVLLKLRPRRQSSMKENSAVHSKLAKRFYGPFKVLERVGPVAYRLQLPENARIHSVFHCSVLKQFQGTPGSDIPVPLPDQFIQNQPLISPLSILDYRRPTPADPWQDYHLEDKVILQGPPGDNTTIHKVQIADKDKGAEQAKHCEGEVRLASDTKRRTSKPNAKKTHKKAQKCTLGGVRAKRIIAAVTAKPRPRSVRDYTNISAKPRSTRSVSNRVDFKLLRPMKGVGNNTERYQVSELSIEYMFSLSISNQGNISSFSSHSFLLFSIYPFFYSHQFSLKCKVSHDNEMLNLIVGSLDKPTLVI

SEQ ID NO: 152678 - protein, 514 aa, Glycine max
  Coding DNA Sequence Number=SeqID_35900
  Gene Ontology: Mol. function=triacylglycerol lipase activity; Biological process=lipid metabolic process
  Homolog annotation: Hit_ID=Q2TNK2; Match level="QueryCoverage=94%, HitCoverage=78%, E-value=1e-128, Identity=50%"; Hit description =Phytoalexin-deficient 4-2 protein
  Pfam annotation: Domain name=Lipase_3; Domain location=2-95; Score =2.3; E_value=0.00034; Accession=PF01764.16; Description=Lipase (class 3)
MQMLALMGNSKTKSIVLTGHSIGGATASLCALWLLSYLHQTYSSISVSVLCITFGSPMLGNGSFSRAILRERWGGNFCHVVSKHDIMPRLLFAPITPYTAQINFLLQFWQLSMTAPGFGKLAVPISDQQKELFNFVMSHLDAATQDEEGSAPVLFHPFGSYLFVSSDGAVCVDCATSVIKMLHLMFASVSPACSIEDHLKYGDYVKNLSLQFLNQNNSVQGNIPDSSYEAGLELSVQSSGLGNQESAIEPAKECLKMTRRMGPSPTKNAANLSITLSKFVPYRTEIEWYKAWCHQQVDQMGYYDLFKRRRSTSKMAMKVNMNRHKLARFWNNVIEMWERNELPHDVAVRAKWVNASHFYKLLVEPLDIAEYYGKGMHTTKGHYIQHGREKRYEIFDRWWKDAMGNTEENNERRSKFASLTQDSCFWARVEEARDWLNSVRSESDTTKLAVLWDNIEKFEKYAMELIDNKEVSEDVLAKNSSYSIWMEDLRGLRELKAKLDSVICNMPMNYLFAK

SEQ ID NO: 152679 - protein, 370 aa, Glycine max
  Coding DNA Sequence Number=SeqID_35901
  Gene Ontology: Mol. function=phosphoinositide phospholipase C activity; Cellular component=cellular_component; Biological process =intracellular signaling cascade
  Homolog annotation: Hit_ID=Q1SDI4; Match level="QueryCoverage=99%, HitCoverage=62%, E-value=1e-136, Identity=65%"; Hit description =Phosphoinositide-specific phospholipase C
  Pfam annotation: Domain name=C2; Domain location=241-332; Score=87.8; E_value=3.2e-23; Accession=PF00168.20; Description=C2 domain
  Pfam annotation: Domain name=PI-PLC-Y; Domain location=103-220; Score= 81.9; E_value=2e-21; Accession=PF00387.9; Description=Phosphatidylinos itol-specific phospholipase C, Y domain
  Pfam module annotation: Pfam domain module=C2::PI-PLC-Y; Domain location=241-332::103-220
MATGIFGEMLYCPETDYLTEFPSPESLKKRIIISTVPPKEYRQSDSISKPMPNGSEPSEEESWGPELPDSVAKLKTEDRNSSDEDQEDINTSDNKSNQQGVRQYKHLIAIHGGKSKGSMKNRLKDDVKVRRLSLSEKKLKSASESHGADLIRFTQRNILRVFPKGERVKSTNFRPYIGWLYGVQMVAFNMQGHGKSLRLMQGMFRANGGCGYVKKPEFLIRTLPHEEVFDPKKPPSRKQILKVKVYKGDGWRLDFSPTHFDRFSPPDFYTKVSIVGVPADCAKNKTRVKTDTWYPVWDEEFEFKLRVPELALLRIEVKDKDKGKDDFAGQTCLPLSELRHGFRSVPLYDRKGKKYKSVTLLMRFKLETLN

SEQ ID NO: 152680 - protein, 178 aa, Glycine max
  Coding DNA Sequence Number=SeqID_35902
  Gene Ontology: Mol. function=transcription factor activity; Cellular component=nucleus; Biological process=regulation of transcription, DNA-dependent
  Homolog annotation: Hit_ID=UPI000034F24B; Match level="QueryCoverage =75%, HitCoverage=16%, E-value=2e-34, Identity=58%"; Hit description =electron transporter/ transcription factor
MVAANCASTVFHIPRRKKAEIGFGNVRFGVFGSAFGAVPEGGGGGSGGGNRKARGGAGGGKVGGLASPALDAEEVEDGEAEGGAGPGGVGGFDAFEADEAGESAGGGGGQEGLDLREVGTGVAGEFEVGLEDGVGEIRVAEGGGGGGIAAAVVGVGVGKWRWRGRGRVRVVNVNLIPR

SEQ ID NO: 152681 - protein, 523 aa, Glycine max
  Coding DNA Sequence Number=SeqID_35903
  Gene Ontology: Mol. function=phosphoinositide phospholipase C activity; Cellular component=intracellular; Biological process =intracellular signaling cascade
  Homolog annotation: Hit_ID=P93620; Match level="QueryCoverage=99%, HitCoverage=100%, E-value=0.0, Identity=77%"; Hit description =Phosphoinositide-specific phospholipase C
  Pfam annotation: Domain name=C2; Domain location=396-488; Score=90.4; E_value=5.4e-24; Accession=PF00168.20; Description=C2 domain
  Pfam annotation: Domain name=PI-PLC-X; Domain location=105-249; Score= 150.7; E_value=3.8e-42; Accession=PF00388.9; Description =Phosphatidylinositol-specific phospholipase C, X domain
  Pfam annotation: Domain name=PI-PLC-Y; Domain location=273-375; Score= 73.9; E_value=5.1e-19; Accession=PF00387.9; Description =Phosphatidylinositol-specific phospholipase C, Y domain
  Pfam annotation: Domain name=efhand_like; Domain location=26-103; Score=14.3; E_value=0.00049; Accession=PF09279.1; Description =Phosphoinositide-specific phospholipas
  Pfam module annotation: Pfam domain module=C2::PI-PLC-X::PI-PLC -Y::efhand_like; Domain location=396-488::105-249::273-375::26-103
MASHNYKVFSCFNRKFTVTEPGPPPDVERAFSEFAAGASSLSGDHILRFLAEHQGDVDCTAADSERMLQQSRKEDRESGMDLHDFFRFLLHDDFNSPIKSQVHHDMNAPLSHYFIYTGHNSYLTGNQLSSDCSDVPIIKALQGGVRVIELDLWPNSDKDDIEVVHGRTLTTPVSLIQCLKSIKEYAFVKSHYPLIITLEDHLTPDLQAKAAEMATQVFGELLYYPQTDSLMEFPSPESLKGRILISTKPPKEFLESKECDDKDNEKESADEGDIQDELKAAGAVRRLSLSEQALEKASESYGADIVRFTQNNILRVYPKGTRLNSSNYKPHIGWTYGAQMVAFNMQGYGKSLRYMQGMFRANGGCGYVKKPEFLIEKGPYNEVFDPKRTLPVKKTLKVKVYMGTGWSLDFSQTDFDTYSPPDFYVKVCIVGVPADMAKKKTCVISNNWFPVWDEQFDFPLTVPELALLRIEVRENDKSQKDDFGGQTCLPVSELKSGFRSVPLYDEKGDKLKSVKLLMRFQFR

SEQ ID NO: 152682 - protein, 470 aa, Glycine max
  Coding DNA Sequence Number=SeqID_35904
  Gene Ontology: Mol. function=protein transporter activity; Cellular component=nuclear pore; Biological process=intracellular protein transport
  Homolog annotation: Hit_ID=Q94KB0; Match level="QueryCoverage=91%, HitCoverage=81%, E-value=1e-115, Identity=52%"; Hit description =Importin alpha 1
  Pfam annotation: Domain name=Arm; Domain location=107-149; Score =52.6; E_value=1.3e-12; Accession=PF00514.13; Description =Armadillobeta-catenin-like repeat
  Pfam annotation: Domain name=Arm; Domain location=151-193; Score =20.4; E_value=0.0063; Accession=PF00514.13; Description =Armadillobeta-catenin-like repeat
  Pfam annotation: Domain name=Arm; Domain location=194-229; Score =18.4; E_value=0.025; Accession=PF00514.13; Description=Armadillobeta- catenin-like repeat
  Pfam annotation: Domain name=Arm; Domain location=231-271; Score =25.1; E_value=0.00025; Accession=PF00514.13; Description =Armadillobeta-catenin-like repeat
  Pfam annotation: Domain name=Arm; Domain location=273-315; Score =25.4; E_value=0.00021; Accession=PF00514.13; Description =Armadillobeta-catenin-like repeat
  Pfam annotation: Domain name=Arm; Domain location=317-360; Score =24.4; E_value=0.00042; Accession=PF00514.13; Description =Armadillobeta-catenin-like repeat
  Pfam annotation: Domain name=Arm; Domain location=362-402; Score =29.4; E_value=1.3e-05; Accession=PF00514.13; Description =Armadillobeta-catenin-like repeat
  Pfam annotation: Domain name=Arm; Domain location=64-105; Score=35.7; E_value=1.6e-07; Accession=PF00514.13; Description=Armadillobeta -catenin-like repeat
  Pfam annotation: Domain name=HEAT; Domain location=113-151; Score =14.5; E_value=0.38; Accession=PF02985.12; Description=HEAT repeat
  Pfam annotation: Domain name=HEAT; Domain location=195-231; Score =14.1; E_value=0.52; Accession=PF02985.12; Description=HEAT repeat
  Pfam annotation: Domain name=HEAT; Domain location=368-404; Score =9.7; E_value=2.8; Accession=PF02985.12; Description=HEAT repeat
  Pfam annotation: Domain name=HEAT; Domain location=70-107; Score=4.5; E_value=12; Accession=PF02985.12; Description=HEAT repeat
  Pfam annotation: Domain name=HEAT_PBS; Domain location=136-173; Score= 13.5; E_value=0.78; Accession=PF03130.6; Description=PBS lyase HEAT -like repeat
  Pfam annotation: Domain name=HEAT_PBS; Domain location=347-384; Score= 3.5; E_value=33; Accession=PF03130.6; Description=PBS lyase HEAT-like repeat
  Pfam annotation: Domain name=HEAT_PBS; Domain location=92-129; Score =2.4; E_value=47; Accession=PF03130.6; Description=PBS lyase HEAT -like repeat
  Pfam module annotation: Pfam domain module=Arm::Arm::Arm::Arm::Arm::Ar m::Arm::Arm::HEAT::HEAT::HEAT::HEAT::HEAT_PBS::HEAT_PBS::HEAT_PBS; Domain location=107-149::151-193::194-229::231-271::273-315::317 -360::362-402::...
  Pfam module annotation: Domain location=64-105::113-151::195-231::368- 404::70-107::136-173::347-384::92-129
MSLQPGSSLLQRRGREAIIVELTPTKTPSSLLEAIPVMKQRLWSESAAEQFEGTIHFRKLLANGHPPIDEVIKADVVPRIVEFLESDGLHQLQFEALWVLTNIASGTSQHKRAVIDHGAVPKLVKLLSPTNNYDDVREQAVWVLGNIAFDSPCYSDLILNEHALLPLLSLLNPPSPILSMLRITTWTLSNLVRGKPPVKTLMPVLKTLIHNSDEEVVSDACWALFYISDVSSDTTKTIVEAEFCVKLVDLLTNSSLTVIVPVLRTLGNIVAGDDAQTQLTIDKGLIPGLSKQLLISRDKEQIYKETCWTISNITAGNGAQIQAIIDAHIIPVLVAIVIYRKDCEIDLKKEVAWAISNATRGSHDQIRYLVDQSCIQALCDLLAYPNSEIVSNCLEGLENILVVGEVDKDIDRGNSFAERVDKCDGWGMIENLKSHDKKEIKERAARIFKTFWAEDDLVEDTDLQDDLGRG

SEQ ID NO: 152683 - protein, 148 aa, Glycine max
  Coding DNA Sequence Number=SeqID_35905
  Gene Ontology: Mol. function=DNA binding; Cellular component =intracellular; Biological process=DNA integration
  Homolog annotation: Hit_ID=Q8LLX4; Match level="QueryCoverage=98%, HitCoverage=15%, E-value=7e-21, Identity=44%"; Hit description =Putative retroelement
MMKEEVRKGVLKLLEAGMIYAISESSWVSLVQVDPKKGSWPVGECVLITSFLTMQQGNSTFLFPSWIKCLRGPVLGQKRNERIHVIYYANKVLNRAQINCATTEKEMLLVVYALEKCRSYLGSKDHCAHQPFNYKISTRQSGFLAKIN

SEQ ID NO: 152684 - protein, 119 aa, Glycine max
  Coding DNA Sequence Number=SeqID_35906
MVREHNINSGWPPIGAPLNVQRDEYDQHWSNFDSSVNAVSFGFVATAILISMFLVMAIFERFLKPTSPALLPSGGWNRRRSSQMDFNGKLAHPSPKVSVQNLIFSWGVLCEYSLFIAVP

SEQ ID NO: 152685 - protein, 373 aa, Glycine max
  Coding DNA Sequence Number=SeqID_35907
  Gene Ontology: Mol. function=protein binding; Cellular component =actin cytoskeleton; Biological process=cytoskeleton organization and biogenesis
  Homolog annotation: Hit_ID=Q6PFL3; Match level="QueryCoverage=54%, HitCoverage=49%, E-value=2e-15, Identity=28%"; Hit description=Kelch- like 20
  Pfam annotation: Domain name=Kelch_1; Domain location=133-184; Score =51.8; E_value=2.2e-12; Accession=PF01344.15; Description=Kelch motif
  Pfam annotation: Domain name=Kelch_1; Domain location=186-241; Score =25.5; E_value=0.00018; Accession=PF01344.15; Description=Kelch motif
  Pfam annotation: Domain name=Kelch_1; Domain location=305-356; Score =9.4; E_value=0.33; Accession=PF01344.15; Description=Kelch motif
  Pfam annotation: Domain name=Kelch_1; Domain location=68-131; Score =25.7; E_value=0.00017; Accession=PF01344.15; Description=Kelch motif
  Pfam annotation: Domain name=Kelch_2; Domain location=133-184; Score =24.4; E_value=0.0004; Accession=PF07646.5; Description=Kelch motif
  Pfam annotation: Domain name=Kelch_2; Domain location=186-241; Score =8.9; E_value=2.6; Accession=PF07646.5; Description=Kelch motif
  Pfam annotation: Domain name=Kelch_2; Domain location=68-131; Score =8.9; E_value=2.5; Accession=PF07646.5; Description=Kelch motif
  Pfam module annotation: Pfam domain module=Kelch_1::Kelch_1::Kelch _1::Kelch_1::Kelch_2::Kelch_2::Kelch_2; Domain location=133-184::186 -241::305-356::68-131::133-184::186-241::68-131
  Subcellular localization annotation: CTP_CleavageSite=20; ConfidenceScore=5.04e-01
MGSLPSPPRPTAPPSPENLLSNHVVVAVFCPREPAPGVSLPNSIELYYPSMNTWTYVGSIPGLSDHQILKGFAIVSLGDFIYIIGGQICHKEMVHVSDECADYVDQGIKVVATVLRYNIRTNQWFDCAPLGVARYDFACTVCENKIYVAGGKSTLACAGPAHGISSAEVYDPDHDRWTPLPNLRILRYKCIGVTWQGKVYIVGGFAEREDSDKTMASIVERSSAEVYDTQARKWDLIAGMWQLDVPPNQIVAVNGTLFSSGDCLNAWKGHIEAYDGKLWNEVDGSHKRNLSTLEDNYENWPQNDQRLYLTMAPIGTRLFFLAGYRIGGELPRTMSVVHMFDTSATRDAWRSFEPMELEGEKELCSHCCVVQLS

SEQ ID NO: 152686 - protein, 175 aa, Glycine max
  Coding DNA Sequence Number=SeqID_35908
  Gene Ontology: Mol. function=DNA binding; Cellular component =intracellular; Biological process=DNA integration
  Homolog annotation: Hit_ID=Q1S3H4; Match level="QueryCoverage=97%, HitCoverage=34%, E-value=8e-30, Identity=39%"; Hit description =Integrase, catalytic region
MEKEILAVLYALKNGFQAKLIRWVLLLQEFDLDIRDKKGCDNLVSHQQSKLVKEEVTKKEKEIEEEFPDKTLMEVSFKDEDYPWFTDTANCKAIGQPSKVMKFHERKRFFREATRYVWDDPILFRIDADNLLRQCVTKGEQASILWHCQNLPYGGLKNICKDPSCQILFGYTLHI

SEQ ID NO: 152687 - protein, 306 aa, Glycine max
  Coding DNA Sequence Number=SeqID_35909
  Gene Ontology: Mol. function=RNA-directed DNA polymerase activity; Cellular component=chromatin; Biological process=chromatin assembly or disassembly
  Pfam annotation: Domain name=zf-H2C2; Domain location=182-220; Score =5.4; E_value=0.069; Accession=PF09337.1; Description=His(2)-Cys(2) zinc finger
MLMQDKKPIAYFSKALSTNLNKSAYEKEWITLVLAVQHWRPYLLGRRFVVYSDQQSLRHLPQQCITTADQQNWIAKPLGYQFNVVYKPEPANKVVDSLLRLFKEGELKSVTSFPMWMQEQQVQQEVHHDPFLKKMIVRLQENLASHPGFSMIQGSLFFKDRLVISPKSSCIPILLKEFHASHMGGHSRCLRTYRRMVESLYWVGMKTMIQEFVKGCDVCQRQNSNLGGHISQFYHGTPKIERVRSSVCGGGQGELWYNTTFHISSRMTPFEAVYGRKPPTFGRVVQGETRVEAAETELLDRDEALR

SEQ ID NO: 152688 - protein, 112 aa, Glycine max
  Coding DNA Sequence Number=SeqID_35910
  Pfam annotation: Domain name=Chromo; Domain location=35-89; Score =26.5; E_value=9.7e-05; Accession=PF00385.14; Description='chromo' (CHRromatin Organisation MOdifier
MHPVFHVSQLKKAIGSYSAKTILHEWLEVELEENEEPEELLASREIWKGGQLSRQWLVKWKKRAVEDTTWDDESLLKSQFPTLSLEDKAISAGEVVIGHQYPMSIFEMLRTT

SEQ ID NO: 152689 - protein, 41 aa, Glycine max
  Coding DNA Sequence Number=SeqID_35911
MEKEILAVLYALKKFQSYHTYAPMSHPIRALCPDVLQHKVS

SEQ ID NO: 152690 - protein, 719 aa, Glycine max
  Coding DNA Sequence Number=SeqID_35912
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=98%, HitCoverage=94%, E-value=1e-129, Identity=39%"; Hit description =Strubbelig receptor family 3
  Pfam annotation: Domain name=LRRNT_2; Domain location=30-70; Score =15.7; E_value=0.02; Accession=PF08263.3; Description=Leucine rich repeat N-terminal domain
  Pfam annotation: Domain name=LRR_1; Domain location=118-140; Score =14.9; E_value=0.29; Accession=PF00560.23; Description=Leucine Rich Repeat
  Pfam annotation: Domain name=LRR_1; Domain location=142-163; Score =11.4; E_value=2.1; Accession=PF00560.23; Description=Leucine Rich Repeat
  Pfam annotation: Domain name=LRR_1; Domain location=164-183; Score =8.2; E_value=8.4; Accession=PF00560.23; Description=Leucine Rich Repeat
  Pfam annotation: Domain name=LRR_1; Domain location=73-92; Score=0.8; E_value=2e+02; Accession=PF00560.23; Description=Leucine Rich Repeat
  Pfam annotation: Domain name=LRR_1; Domain location=96-115; Score =13.3; E_value=0.88; Accession=PF00560.23; Description=Leucine Rich Repeat
  Pfam annotation: Domain name=Pkinase; Domain location=453-719; Score =41.7; E_value=4.8e-11; Accession=PF00069.15; Description=Protein kinase domain
  Pfam annotation: Domain name=Pkinase_Tyr; Domain location=453-719; Score=52.4; E_value=1.1e-15; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=30-70::118 -140::142-163::164-183::73-92::96-115::453-719::453-719
MGNMKLELHVGVFVICMVILIGSFCVGDTDMVDVAAINSLYVSLASPPLQGWKPVGGDPCLELWQGVACVFSNITAIHLGGMNLGGQLGSNLNFPSIIELDLSNNHIEGPIPFTFPPTLRSLSLSANQLNGSIPDALSLLTQLSNLHLQNNQLSGTLYVLQDLPLQDLNIENNLFSGPIPPKLLTIPNFSKNGNPFNTTIIPSPPAVAPAPVAIGSSPQESPWKVAHGPSALTAPVPASTRKSVIAKSVIWIAGAGLLVFIILGVFLLMLRCIKRRPEKKNANKLDVGVFVGPLNKPTRSDSDVEAANQEEKGKFEVPNRSTDFIPKVQEEQDIYWKVVSATSEGNNGRESINTGGGSKLSSLQPPPQHFLPTSPGEKVIINPAITTQVTKRQVMSNSIRVYTVALLQQYTNSFSQENCIGEGTLGPVYRAELPGGKYPSPIYILFQQYTNSFSQENCIGEGTLGPVYRAELPGGKLLAVRKLDATASMGQSHEQFLQLVSSISKIQHANIARLVGYCAEHSQRLLVYEYCSNGTLHDTLHGYDNHCIKLPWNARIQVALGAARALEYLHENFQPPIVHRNFRSANVLLNDNLEVCISDCGLGPLLSSGSTGQLSGRLLTAYGYSAPEFESGSYTQQSDVFSFGVVMLELLTGRKSYEKSLPRGEQVLVRWAVPQLHDIDALSKMVDPCLKGTYPMKSLSRFADIVSSCIQVQQVWQDL

SEQ ID NO: 152691 - protein, 174 aa, Glycine max
  Coding DNA Sequence Number=SeqID_35913
MTAADAKLGDNHTTVPREYAINICNETDASPPSPTTGRSSGHHRKQPLFLSKSKTTLLSLNPKYFQVHSLFSQTVNNRTYTFLIIDIAFVFFAISNNTASDPPPTTTTTSPHSRFNESQFHFHNNNSTEGVKAKELGLIVIFCKELSVVLNAFIRGDRCLFKDYPELQETLVWI

SEQ ID NO: 152692 - protein, 1209 aa, Glycine max
  Coding DNA Sequence Number=SeqID_35914
  Gene Ontology: Mol. function=RNA-directed DNA polymerase activity; Cellular component=chromatin; Biological process=one-carbon compound metabolic process
  Pfam annotation: Domain name=Chromo; Domain location=1109-1157; Score= 33.5; E_value=7.3e-07; Accession=PF00385.14; Description='chromo' (CHRromatin Organisation MOdifier
  Pfam annotation: Domain name=RVP; Domain location=165-258; Score= -14.2; E_value=0.095; Accession=PF00077.10; Description=Retroviral aspartyl protease
  Pfam annotation: Domain name=RVP_2; Domain location=154-263; Score= -44.5; E_value=0.0029; Accession=PF08284.2; Description=Retroviral aspartyl protease
  Pfam annotation: Domain name=rve; Domain location=814-958; Score=4.3; E_value=0.0026; Accession=PF00665.16; Description=Integrase core domain
  Pfam annotation: Domain name=zf-H2C2; Domain location=755-796; Score =17.9; E_value=0.0015; Accession=PF09337.1; Description=His(2)-Cys(2) zinc finger
  Pfam module annotation: Pfam domain module=Chromo::RVP::RVP_2::RVT _1::rve::zf-H2C2; Domain location=1109-1157::165-258::154-263::396 -565::814-958::755-796
  Subcellular localization annotation: CTP_CleavageSite=3; ConfidenceScore=5.17e-01
MAQAAGLARLQEEKLFDARRQGRNRFGPTFPSPIVNHTSPSPLTNTNPNTFPNPTPSSPPISPTNHNPPLLPTPLKLPPPNPNPVPLRRLSLAELASRRDKGLCFTCDEKYHRGHRCPSRAFLLIGDDDDPSYEDTLPPDLIPDPPKDPSPTLAQISIHSLSGHPAPETLRLLGYINAHPVVILVDGGSTHNFIQAPLAKLLGLSSRITNPLGVMLCVDVPVWIQNKQFTVDLHLLPLSGVNLVLGVQWLKALGPILTDYNTLSMKFFHDGNLVELKGDDASTLSLLSHPQVHRLLRKDGANTYFHIVITTSEPPSNPITTTLPPELQPLITKFTTIFQPPQSLPPSRPTDHHIHLQPHSEPMNVRPYRYPHFQKHEIERQIKDMLQRDLIRPSISPFSSPVLLVRKHDGSWRLCVDYRALNAITVKDRYPIPTIDELVDELGGANWFSKLDLLQGYYQIRMHESDVAKTAFCTHHGHYEFKVMPFGLCNVPSSFQATMNDIFQPYLRRFIIVFFDDILIYSRTLPEHLIHLEQAFETLLHNQFVLKFSKCSFAQPQVEYLGHVVSGHGVAPVASKIQAIDQWPIPTTTKALRSFLGLAGFYRRFIRGYTSIAAPLIKVTTKDPFEWTTEADEAFKALKTALISAPVLVLPNFTLPFTLETDASGVGMGAVLSQKGHPIAFFSKPFTPRMLQASTYVRELCAITTAVKRWRQYLLGHQFIILTDHRSLKELLTRGNRIWLPQGIPFLQVLFTEYHSTPTGGHMGVSKTLARLTENFYWLGVRHDVKQFVAACVDCQQTKYETKRAAGLLCPLLVPCWPWEDLSLDFITGLPSFHGHTTILVVVDRFSKGVHLGMLPTQHSAYAVATIHEHYRKTPWHATKLGLRPRPSLYQPILEGAVSVKWHTAEDELSLSPPNRRPNGAFVHKKPSSWGKFLPWAEWSYNTSRHSGTGVSPFEVTFVRRPPDLPSYVTGTSKVEAVDEFLTNRESIFQDLKKKLPKAQVIMKHSADKRRRDIEFKIGDLVMVRLRPRQQASVTGHHRGSHKLSKRYYGPFKVLDRIGPVAYKLELPDSSRIHPVFHVSMLKQFHQENTTPTHTLALPPVAVGNEPVISPLTILNTRYRLDSNQRILQVLVQWKGLLPEDATWEDWEALQAEYHLEDKVSFEGPGNDSQQAEYQSAEKQNYAANPNYAENRPKRKSSTPAYLKDYNLG

SEQ ID NO: 152693 - protein, 73 aa, Glycine max
  Coding DNA Sequence Number=SeqID_35915
MKQALVEGDAKISGPNMYEKGAGRQRISRKKGKRDFSLVFLDPSLPEPPNDFKVKNPARLSKLTTSGVSLSSP

SEQ ID NO: 152694 - protein, 113 aa, Glycine max
  Coding DNA Sequence Number=SeqID_35916
MADVPELLFGSPETVPRRNNSGGSGRGLQENGLGRELSIARHPLEPGQVAAIHGERRHGQPFMFLSRVILEELVDLEDPTEGVCSVESGNFKLHAVNNELVNLMGEVMQGIVE

SEQ ID NO: 152695 - protein, 97 aa, Glycine max
  Coding DNA Sequence Number=SeqID_35917
  Gene Ontology: Mol. function=protein heterodimerization activity; Cellular component=cytoskeleton; Biological process=cell division
  Homolog annotation: Hit_ID=Q8H0T9; Match level="QueryCoverage=71%, HitCoverage=9%, E-value=3e-19, Identity=56%"; Hit description =Katanin p80 WD40-containing subunit B1 homolog 1
  Pfam annotation: Domain name=WD40; Domain location=48-86; Score=29.0; E_value=1.7e-05; Accession=PF00400.22; Description=WD domain, G-beta repeat
MLWERARWDLEIVAEVKGNFQEEFVAHSASVNCLNIGKKACRLFITGGDDHKSLSGHTSPVESVAFDSGEVLVLGGASTGVIKLWDLEEAKNCKLEK

SEQ ID NO: 152696 - protein, 291 aa, Glycine max
  Coding DNA Sequence Number=SeqID_35918
  Homolog annotation: Hit_ID=Q8H767; Match level="QueryCoverage=81%, HitCoverage=72%, E-value=1e-106, Identity=69%"; Hit description =Lysine ketoglutarate reductase trans-splicing related 1
  Pfam annotation: Domain name=DUF707; Domain location=42-291; Score =310.3; E_value=3.5e-90; Accession=PF05212.3; Description=Protein of unknown function (DUF707)
MKHLPFLAVLCTIMLFIVYRTTKYQYHQEEIDKKWSFWGQPKVYPSTYGKLKGLPRGIIHDNSDLELRPLWSRSSSRSKAVYSNSNLLAVPVGIKQKQNVDAMVQKFLQENFTIILFHYDGNVDGWWNLDWSSKAIHIIARNQTKWWFAKRFLHPDIVSIYDYIFLWDEDLGVEHFSPSRYVEIIKREGLEISQPALDPNSTEIHHRITIRARTKKFHRFVEGMAPVFSQSAWYCTWHLIQNDLVHGWGVDMKLGYCAQGDRTKKVGVVDSEYVFHKGIQTLGGSGHRMTK

SEQ ID NO: 152697 - protein, 483 aa, Glycine max
  Coding DNA Sequence Number=SeqID_35919
  Gene Ontology: Mol. function=DNA binding; Cellular component=nucleus
  Homolog annotation: Hit_ID=Q84YJ6; Match level="QueryCoverage=75%, HitCoverage=56%, E-value=1e-25, Identity=26%"; Hit description=DNA -binding protein family-like
  Pfam annotation: Domain name=Bromodomain; Domain location=281-364; Score=47.8; E_value=3.8e-11; Accession=PF00439.15; Description =Bromodomain
  Pfam annotation: Domain name=Myb_DNA-binding; Domain location=6-59; Score=26.4; E_value=0.0001; Accession=PF00249.21; Description=Myb -like DNA-binding domain
  Pfam module annotation: Pfam domain module=Bromodomain::Myb_DNA -binding; Domain location=281-364::6-59
MGTEVMGRWGTWEELLLGGAVLRYGTRNWNVVAAELRARTACPYTITPEVCKAKYEDLQQRYTGNKAWFEELRKTRVAELKRALELSEDSIGLLNILVPRSLESKLESLEAGKNEKKDDCHVDKGSAGPKLHVASQKLERVESSTKETSKDGLSAGSFTHETRTNWSPECPVPAGFAEDMETKPEVSHSTEQAKVLNVDELTRTIYEGQGGSFKKRRGKRKRKDCGRNMKEASVGESDLLDSADVVSWCKESSTSNCGEVAKSCGVDDQNRNLKKDRVEDMMEILDFIFETKGASAFQRRLDSQKRGRYKKMILQHMDFDTIRSRISSQTIKSSVELFRDLLLLTNNALVFYSKSTREYKTALLLRGIVTKKMRESLKGTSNKATTQATNFPIKLLVHNPHVKPRSVRPGNRKIVAKAVGGKNSASGESHGTKKPSKVDSPSSVESLTMKKKGFGRPKKVGRGAAAGQRPAMPMKGKKRVRTK

SEQ ID NO: 152698 - protein, 206 aa, Glycine max
  Coding DNA Sequence Number=SeqID_35920
  Gene Ontology: Cellular component=integral to membrane; Biological process=protein transport
  Homolog annotation: Hit_ID=Q8H5X5; Match level="QueryCoverage=99%, HitCoverage=66%, E-value=7e-67, Identity=62%"; Hit description =Putative secretory carrier membrane protein
  Pfam annotation: Domain name=SCAMP; Domain location=118-206; Score =85.2; E_value=2e-22; Accession=PF04144.4; Description=SCAMP family
MAHRYDSNPFDEEEVNPFSEPAVRGKTSSQSSYSGGAFYTTNPGSVAPATNSRLSPLNPEPADYNYGFGATVDIPLDPSTDLKKKEKELQAKEAELRKREQEVRRKEEAAARAGIVLEEKNWPPFFPIIHHDIANEIPIHLQRLQYVAFTSLLGLALCLTWNIVAVTSAWIKGEGVKIWFLAIIYFIAGIPGAYVLWYRPLYRAFR

SEQ ID NO: 152699 - protein, 87 aa, Glycine max
  Coding DNA Sequence Number=SeqID_35921
MYKIKRKKRMCSPRISLDSEQSLFEALPRDILVQISCGVNHKDLKQVFMSQKRLEKCNYIVYYMMAKEHFDVANTNGFKEIEAPNTG

SEQ ID NO: 152700 - protein, 136 aa, Glycine max
  Coding DNA Sequence Number=SeqID_35922
MLAGSRLFKEEVLTGKNYKASDQASFPSKIVFLCYGGFISSWICVHQVPKVVLCWVFMLEATYALLCVYMFGYKCFFILLSDTTEEEGFLIFNSYKIGEFPEVRYIYYGLPLLLSSLVSITPVSDLMKAASSKFPA

SEQ ID NO: 152701 - protein, 78 aa, Glycine max
  Coding DNA Sequence Number=SeqID_35923
MDSLSVYAQADANLTEEEKFTNASSIFSMDMQTKTELPWERFIAKQANLVSVSLKRGNYCQPFISDTFIINLLSPLPT

SEQ ID NO: 152702 - protein, 135 aa, Glycine max
  Coding DNA Sequence Number=SeqID_35924
MTRGNPSDLQPFDPKIDRTFHRLVRHHLVPFEHPEHFVIGDFEHYSFEHSDFEHSKNMAQPPPRERTLWEMAAPNFTYGSLCIQYPDEDVPYVLKTGLIHLLPKFHGLAEGVAKDWLYYLAPRSITSWDDLKRVF

SEQ ID NO: 152703 - protein, 64 aa, Glycine max
  Coding DNA Sequence Number=SeqID_35925
MDLKLKRSNGVRIVQKCTVSQYVAHMALLHVLGITKKNHFSLPPPPNAILPLDTGNGSGYCIGN

SEQ ID NO: 152704 - protein, 210 aa, Glycine max
  Coding DNA Sequence Number=SeqID_35926
  Pfam annotation: Domain name=SWIM; Domain location=81-117; Score =16.9; E_value=0.0063; Accession=PF04434.8; Description=SWIM zinc finger
MTRQLMKSGGMRGRLNMIPPVCGLLSAPHEKYAAEVFTMESYKSFLSEMWLETHLFVLNIDEGSNFRKYMLGNSEHQSLACEVMFKPSSPSIKCSCLEFETTGFPCCHAIHIINCERLEKFPKTSYIQDGQNQQINELSVAPDASNSDALGIPTNEKGGAPVSSERSKGDDAHSRNVEHIKHVISVADKSPIIMQHTLGNSSDQGKGPCY

SEQ ID NO: 152705 - protein, 119 aa, Glycine max
  Coding DNA Sequence Number=SeqID_35927
  Homolog annotation: Hit_ID=Q1RW27; Match level="QueryCoverage=45%, HitCoverage=10%, E-value=9e-15, Identity=74%"; Hit description =Octicosapeptide/Phox/Bem1p; CBS
MIGMIYDVMKKILRDREKNRVEMYDMHVETIREFMYKKEASLKKMYGKRKPLTITSLLKFHSLNRCSNGTPVLSSALHPRYGIIKAFGNIQHGNDFTIFHDREVSEFTYQLKSQIISLT

SEQ ID NO: 152706 - protein, 63 aa, Glycine max
  Coding DNA Sequence Number=SeqID_35928
MEMEMGKMNQGNILRGNTNGNHADVAPKFSPLKIVHFGNPSQDTVDPRDGDFGGRLWRWKWEK

SEQ ID NO: 152707 - protein, 91 aa, Glycine max
  Coding DNA Sequence Number=SeqID_35929
  Homolog annotation: Hit_ID=Q1RW27; Match level="QueryCoverage=82%, HitCoverage=14%, E-value=3e-20, Identity=65%"; Hit description =Octicosapeptide/Phox/Bem1p; CBS
MSSTETSSINKKTKRHQKKSLSLPARNGINPPDDGGERTVKKLRLSKALTIPDGTTVSEACRRMAARRIDAVLLTDSNALLAGILTDKVTI

SEQ ID NO: 152708 - protein, 187 aa, Glycine max
  Coding DNA Sequence Number=SeqID_35930
MRYDESQLEILLFGVLLSGASIVVALVFCQWSISKDKEATFGGVFVLFGTHSVRISFGGLVEVAASSTPHYELQKSVAEYIDANGCWQIDTIKDYLSPNVVKMVTDMEATQKTTQKNHALFMEVSKWKGPEYYYSRYSGATELHPSFFPLNSACEWGPIQQEVRQGTVATSRNLHCNKGQRQDQAAQ

SEQ ID NO: 152709 - protein, 512 aa, Glycine max
  Coding DNA Sequence Number=SeqID_35931
  Gene Ontology: Mol. function=homocysteine S-methyltransferase activity
  Homolog annotation: Hit_ID=Q8LLE5; Match level="QueryCoverage=90%, HitCoverage=76%, E-value=9e-85, Identity=44%"; Hit description =Coiled-coil protein
  Pfam annotation: Domain name=DUF869; Domain location=50-508; Score =244.2; E_value=2.7e-70; Accession=PF05911.2; Description=Plant protein of unknown function (DUF869)
MFFYHDLKVYPTQTTPSPEGTCEAAPNDEVNDVKTLTERLSAALLNSSAKEDLAKQHAKVAEEAVSGWEKAENELLILKQQLDTAKQKNSVLEDQVSHLNEALKECMRDLQQAKEEQEQKIHEALTNNSYGLESKKPDHEWKVVDAAKADDAASSVHLELQQRLGDKEKENSSLKIELQSQLEELKFRTIERDLSTQAAEAASKQHLESIKKVAKLEAECRRLKAMARKTLSANDHRSVAASSVYVESFTDSMSDIGERQLVVESDMQKLGGWDVSEGEPNHHDSWPSALIKELDQFNNENTAGKNSMVFSTEINLMDDFLEMERLVALPDTESVSSFPVERTASDQLNVGCGTKNAEVEAIVQKNAALEKKLEKMEAEKLELEMDLTECQKQLEASLSRIKEVELEVVELQTKLALANKSNEEAYEKLKATQEKKEIDESKLRVAHTEAEELVSKICSLEEEIEKERALSAENLAKCGKLEDELLRIKNEAQLQKDTEILYGEGANSELKQ

SEQ ID NO: 152710 - protein, 199 aa, Glycine max
  Coding DNA Sequence Number=SeqID_35932
  Homolog annotation: Hit_ID=Q1S6B9; Match level="QueryCoverage=98%, HitCoverage=42%, E-value=4e-63, Identity=60%"; Hit description =Senescence-associated
  Pfam annotation: Domain name=Senescence; Domain location=72-197; Score=-76.1; E_value=1.2e-07; Accession=PF06911.3; Description =Senescence-associated protein
MASQNPNQRNSLYPQVIDSNPDAPSPLLITNHSSSSQPCLYPSVDYNDLVENLFSEDATAACSPSAPPEATEEVLFRIPGAILNLVDKDYSVELACGDFSVIRLRQGDNAVAVYARVADEIQWPLAKDAAAVKLDDSHYFFSFRVPKGFDPDEEEDVLSYGLTIASKGQERLVKDLNAVLENCSCFSVQSVSENAKKKG

SEQ ID NO: 152711 - protein, 501 aa, Glycine max
  Coding DNA Sequence Number=SeqID_35933
  Gene Ontology: Mol. function=protein binding; Cellular component =protein complex; Biological process=chromosome segregation
  Homolog annotation: Hit_ID=Q1S6B8; Match level="QueryCoverage=88%, HitCoverage=100%, E-value=1e-152, Identity=67%"; Hit description=Von Willebrand factor, type A; Ubiquitin interacting motif
  Pfam annotation: Domain name=UIM; Domain location=317-334; Score =14.5; E_value=0.31; Accession=PF02809.10; Description=Ubiquitin interaction motif
  Pfam annotation: Domain name=UIM; Domain location=387-404; Score =17.7; E_value=0.041; Accession=PF02809.10; Description=Ubiquitin interaction motif
  Pfam annotation: Domain name=UIM; Domain location=419-436; Score =10.6; E_value=1.1; Accession=PF02809.10; Description=Ubiquitin interaction motif
  Pfam module annotation: Pfam domain module=UIM::UIM::UIM; Domain location=317-334::387-404::419-436
  Subcellular localization annotation: CTP_CleavageSite=40; ConfidenceScore=5.44e-01
MVVFIVWFTTTAIVVIPSSNSMTCGQVGMVNNSKEELSTRLQNRTNFFHSFASESSTMVLEATMICIDNSEWMRNGDYSPSRFQAQADAVNLICGAKTQSNPENTVGVLTMAGKGVRVLVTPTSDLGKILACMHARVGPCSPQWSRVHLGLLVGFIAGLQQWVPQSCVNHFVARLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAATAAAGGVSGFEFGVDPNLDPELALALRVSMEEERARQEAAAKKAAEDAANLEKGDEQQASSQHATMTERAGAATSEAENKTSDLMDDENALLQQALAMSMDDSAISHDVKDTDMSEASASDPDLALALQLSITDSAKDQSSQSDMSKLLADQSFVSSILASLPGVDPNDPSVKDLLASMQNQSEPQQKNDDKPSNEEEKK

SEQ ID NO: 152712 - protein, 144 aa, Glycine max
  Coding DNA Sequence Number=SeqID_35934
  Gene Ontology: Mol. function=thiosulfate sulfurtransferase activity; Cellular component=chloroplast
  Homolog annotation: Hit_ID=Q1S3S6; Match level="QueryCoverage=80%, HitCoverage=88%, E-value=9e-44, Identity=69%"; Hit description =Rhodanese-like domain
  Pfam annotation: Domain name=Rhodanese; Domain location=27-131; Score= 30.5; E_value=6e-06; Accession=PF00581.10; Description=Rhodanese-like domain
MEYSLKYDERCSNRPGPPKGAKVVTIDVRAAKSLIQTGSIYLDVRTVEEFKKGHVYADNVLNIPYMLNTPKGKVKNGDFLKEVSSACNKEDHLVVGCQSGVRSLYATADLLSDGFKNAKDMGGGYVDWVKNKFPVNIPEAKEEL

SEQ ID NO: 152713 - protein, 402 aa, Glycine max
  Coding DNA Sequence Number=SeqID_35935
  Gene Ontology: Mol. function=calmodulin binding; Cellular component =integral to membrane; Biological process=cell death
  Homolog annotation: Hit_ID=Q1SPR9; Match level="QueryCoverage=91%, HitCoverage=83%, E-value=1e-145, Identity=65%"; Hit description=Mlo -related protein
  Pfam annotation: Domain name=Mlo; Domain location=1-354; Score=262.7; E_value=7.6e-76; Accession=PF03094.6; Description=Mlo family
MPQWLDRTKRKSLLSALDKIKEGAHFTENSSHASQGHESLASYESLEQLHRFVFVLGITHITYSFIAVALAMIKSLFRYIAGEHGKTKQRLLLYKAYKLCFSRQFWSSIHRADYMALRLGFITNHGLPTTYDFHNYMLRSMDEEFRDIVGVSVLLWVYAICCIFLNFHGSNFYFWLSFVPAILILIIGTKLHRVVVKLAVEIINRCPNMKPHQFNLRDELFWFGKPRFLLRLIQLISFLNAFEMATFLWSLWEIKDPSCFMSNRTFIVIRLSFGVTSQVWCSFITFPLYVIITQMGSRFKKTVVSENVRKSLSKWQRRVKEKQSSTCAVLTTTSPSSLNSLMYGTDKSNSRASISEEGSSSGTKDICLSYLDHVSKTKGNAPFPSYENDHDVIHDSSPPPLS

SEQ ID NO: 152714 - protein, 316 aa, Glycine max
  Coding DNA Sequence Number=SeqID_35936
  Gene Ontology: Mol. function=molecular_function; Cellular component =cellular_component; Biological process=defense response
  Homolog annotation: Hit_ID=Q1S6B1; Match level="QueryCoverage=92%, HitCoverage=93%, E-value=1e-114, Identity=67%"; Hit description =Thaumatin, pathogenesis-related
  Pfam annotation: Domain name=Thaumatin; Domain location=35-241; Score= 306.5; E_value=4.8e-89; Accession=PF00314.8; Description=Thaumatin family
MALFSHHRHSYETLLGFLLFLVFREVSGATFTFVNKCDHTVWPGILGAPQLGSTGFELVKGGSKSFQAPTGWSGRFWGRTGCQFDGSGKGTCATADCGSGEVNCNGAGASPPATLAEFTLGNGSMDYYDVSLVDGYNLPMMVVARGGSGSCAATGCGEDLNQRCPSELRVEGGDACQSACGAFGKPEYCCNGAFSNPSTCKPSMYSQMFKSVCPKAYSYAYDDATSTFTCSGADYTITFCPSSPSLKSSTDSSPKGMDAGSGSGGGSSVEQSELASTSWLADMATATGASTRTRPFVASKVSFSVVVVFILSLLVA

SEQ ID NO: 152715 - protein, 271 aa, Glycine max
  Coding DNA Sequence Number=SeqID_35937
FDEFKEELERRHWDEELTDFGDDNIDVAIVKEFYANLYDPEDKSPKQELAAKLCIPGWGFELHADGQPLKILRKNMTTLAQTWSVLSFSNLIPTSHTSDVTLDRARLIYGIIMKMDMNVGYLISHQISLTAQHDTSRFGFLALITALCKARGVQSDSRSLESLSPTINLAYIKKNYWNLDDPTTTFRGPRKAKGKRSEASSTSPSEAPAPSSSALSPSSSTQIPVIPPAPSQIPLPAPLSTGPVDFIFTPQMLHSMLQSIHRGQSIIMQSL

SEQ ID NO: 152716 - protein, 420 aa, Glycine max
  Coding DNA Sequence Number=SeqID_35938
MSSFLSDSAISMGDKEDTLCSASDSDSSSLEKPSDAIGEPVPVTVILPPFSFGGVRIGRGSGDVKVSPYMRCSHSIGSPSSTLAVAGYNLVRDEILKYKSCLTLAASVAALQCQVKLVSPKDSYKCLFEVLGLILALAAFQCALLEHLNVAPSQLHPNSWAMMKLTGKIGWVSLNSMSKKLFEFDLNVFRHFKDHFFKSDPIKFKSFDEDLLTLVEWVDKAILEQLPASLNMQAIMSLSSASDPLAALDGKVKPTGENVPPSAATFAGEWGQPVGEDDGVGPFGRKKSKALMSLRTLRQTVGLMPGVGCPSIMQDVPTTPPAVEASAAAPSIIDVSALAALASFVVVPSSTIATPLLSVGVATTSAPMVLSPSYSTPMIPPFTIMATSSPSLSSHPPVSSGHLYTSSDAGLLWGDTYKLE

SEQ ID NO: 152717 - protein, 182 aa, Glycine max
  Coding DNA Sequence Number=SeqID_35939
MASAMYERVHHMHCTQDSSNPSSALGDPHRIQAYKKPKVHPWYALLPNPRSTLGTHSFKTQGLPLVYTFTKPKVPPFVCSLTTTTMTTVKGPNSKKRTTTILFGNTFNRVEVILTPYNHQRRNFIGEDNPSPDCMTRPSIRYKSNIFLITIRGETQQVKRPTPKLVGKTFNQGQVKCTPHKD

SEQ ID NO: 152718 - protein, 80 aa, Glycine max
  Coding DNA Sequence Number=SeqID_35940
MDEFDILVSLILSQTHLCLFNFHRNVSLFLVLGKFFLQESTASFILPCYQVVKTKMDTSEPYTGAMRGIMHEPQVNLGAD

SEQ ID NO: 152719 - protein, 97 aa, Glycine max
  Coding DNA Sequence Number=SeqID_35941
MERRSAKKHPPGIVPREIPRNQPTIKIMSESHSKRGRSRSRRKEADLGEMKDGKSFPRMFSGRPIPKRGQVKVAVVLGLAHSIAAIFCCGANEYNNS

SEQ ID NO: 152720 - protein, 128 aa, Glycine max
  Coding DNA Sequence Number=SeqID_35942
MKAVAAAKPMTATDPELETLRRWAWLLGLMAGESTSPLLSDVGLKGRGESEGETGGGGRASGGVRGGRGGGGAEGRGGGRRRRGQSSFRNGEGSRWKRGGGWRSGRSSWRKGYGGEELGVAAGESHGD

SEQ ID NO: 152721 - protein, 273 aa, Glycine max
  Coding DNA Sequence Number=SeqID_35943
  Gene Ontology: Mol. function=kinase activity; Cellular component =integral to membrane
  Homolog annotation: Hit_ID=UPI000065CD4E; Match level="QueryCoverage =78%, HitCoverage=56%, E-value=4e-24, Identity=30%"; Hit description =Homolog of Homo sapiens "Putative MAP kinase activating protein C22orf5
  Pfam annotation: Domain name=DUF300; Domain location=10-271; Score =327.4; E_value=2.4e-95; Accession=PF03619.7; Description=Domain of unknown function
MIDISTLNAAQITVLGSAFCVMLSMHFTTQLMSQHLFYWKNPKEQKAIIIIILMAPIYAAVSFVGLLDIRGSKEFFTFLESVKECYEALVIAKFLALMYSYLNISISRNIVPDEIKGREIHHSFPMTLFQPCTVRLNHHNLKLLKYWTWQFVVVRPLLGLYPTWLSWAFTIVLNISVSLALYSLVVFYHVFAKELAPHKPLAKFLCIKGIVFFCFWQGMLLDLLAAIGVIQSRHLRLDVEHIEEAMQNILYAYHPAPYSGEVEKMLKQNKKNE

SEQ ID NO: 152722 - protein, 87 aa, Glycine max
  Coding DNA Sequence Number=SeqID_35944
MVHQNTQVVVLNMDFKSVSDYKFSAPATSARDNCKIVDLIIHSTVHSAKQNDKNIHHNHIEKQKVSYITRAFILVLNFHIQMKNIQH

SEQ ID NO: 152723 - protein, 924 aa, Glycine max
  Coding DNA Sequence Number=SeqID_35945
  Gene Ontology: Mol. function=binding; Cellular component =intracellular; Biological process=RNA processing
  Homolog annotation: Hit_ID=Q8LIB1; Match level="QueryCoverage=99%, HitCoverage=97%, E-value=0.0, Identity=65%"; Hit description =Putative adapter protein ATH-55
  Pfam annotation: Domain name=HAT; Domain location=441-477; Score=6.6; E_value=1.9; Accession=PF02184.7; Description=HAT (Half-A-TPR) repeat
  Pfam annotation: Domain name=HAT; Domain location=612-646; Score=6.9; E_value=1.7; Accession=PF02184.7; Description=HAT (Half-A-TPR) repeat
  Pfam annotation: Domain name=HAT; Domain location=721-755; Score=4.9; E_value=3.8; Accession=PF02184.7; Description=HAT (Half-A-TPR) repeat
  Pfam annotation: Domain name=Suf; Domain location=557-809; Score= -132.8; E_value=0.028; Accession=PF05843.5; Description=Suppressor of forked protein (Suf)
  Pfam annotation: Domain name=TPR_2; Domain location=249-282; Score =7.3; E_value=4.7; Accession=PF07719.7; Description=Tetratricopeptide repeat
  Pfam annotation: Domain name=TPR_2; Domain location=427-460; Score =10.4; E_value=2; Accession=PF07719.7; Description=Tetratricopeptide repeat
  Pfam annotation: Domain name=TPR_2; Domain location=598-631; Score =2.9; E_value=15; Accession=PF07719.7; Description=Tetratricopeptide repeat
  Pfam annotation: Domain name=TPR_2; Domain location=634-667; Score =5.2; E_value=8.1; Accession=PF07719.7; Description=Tetratricopeptide repeat
  Pfam module annotation: Pfam domain module=HAT::HAT::HAT::Suf::TPR _2::TPR_2::TPR_2::TPR_2; Domain location=441-477::612-646::721 -755::557-809::249-282::427-460::598-631::634-667
MAIAQDLYPSEDDLLYEEELLRNPFSLKLWWRYLIARSEAPFKKRFVIYERALKALPGSYKLWHAYLRERLDLVRNLPVTHSQYDTLNNTFERALVTMHKMPRIWIMYLKTLTNQKLVTRTRRTFDRALCALPVTQHDRIWEPYLLFVSQKGIPIETSLRVYRRYLKYDPSHIEDFIEFLLNSSLWQEASERLASVLNDDQFYSIKGKTKHRLWLELCDLLTRHANEVSGLNVDAIIRGGIRKFTDEVGRLWTSLAEYYIRRGLHEKARDVFEEGMSTVITVRDFSVIFDSYSQFEESMLAYKMEEMGLSDEEGDEEEGEESGVEEGDEEDIRFKGRLVEEDFERKILHGFWLNDKKDIDLRLARFDYLMERRPELANSVLLRQNPHNVEQWHRRVKLFEGNPTKQILTYTEAVRTIDPMKAVGKPHTLWVAFAKLYEQHKDLANARVIFDKAVQVNYKTVDNLASVWCEWAEMELKYKNFNGALELMRRATAEPSVEVKRRVAADGNEPVQMKLHKSLRLWTFYVDLEESLGTLESTCAVYERILDLRIATPQIIINYAYFLEVWCAVMEHKYFEDAFKVYERGVKIFKYPHVKDIWVTYLSKFVRRYGKNKLERARELFENAVESAPADQVKPLYLQYAKLEEDYGLAKRAMKVYDQATKAVPNNEKLSMYEIYIARAAEIFGVPKTREIYEQAIESGLPDKDVKTMCLKYAELEKSLGEIDRARGIFVFASQFADPRSDPEFWNKWHEFEVLHGNEDTFREMLRIKRSVSASYSQTHFILPEYLMQKDQTVNLDEAKDKLKQAGIPEDEMAALERQLAPAVDNTVTKDRKVGFVSAGVESQCDRGVKTSANHEDIELPEESDSDDDDKIEIAQKDVPSAVFGGLIRKRDENENNGEVDVTKDKDNENRLGALERIKRLRQN

SEQ ID NO: 152724 - protein, 304 aa, Glycine max
  Coding DNA Sequence Number=SeqID_35946
  Gene Ontology: Mol. function=protein transporter activity; Cellular component=integral to membrane; Biological process=intracellular protein transport
  Homolog annotation: Hit_ID=Q69X85; Match level="QueryCoverage=91%, HitCoverage=91%, E-value=1e-111, Identity=71%"; Hit description =Putative syntaxin-related protein Nt-syr1
  Pfam annotation: Domain name=SNARE; Domain location=208-270; Score =89.9; E_value=7.9e-24; Accession=PF05739.9; Description=SNARE domain
  Pfam annotation: Domain name=Syntaxin; Domain location=32-139; Score =99.3; E_value=1.1e-26; Accession=PF00804.15; Description=Syntaxin
  Pfam module annotation: Pfam domain module=SNARE::Syntaxin; Domain location=208-270::32-139
MNDLFSSSFKKYSDLKEQAHIDDVEAGKESVNLDKFFDEVENVKEDMRLVEKLYRKLQESNEESKIVHNAKTMKDLRARMDQDVQQVLKRVKLIKGKLESLERSNAANRNIPGCGPGSSADRTRTSVVSGLGKKLKDLMDDFQGLRARMQNEYKETVERRYFTITGEKADEDTIENLISSGESESFLQRAIQEQGRGQIMDTISEIQERHDAVKEIEKNLIELHQVFLDMAALVESQGQQLNNIESHVAHASSFVRRGTEQLQDAREYQKSSRKWTCYAILLGIVLVIVLLFPLLTSLLPHLLI

SEQ ID NO: 152725 - protein, 755 aa, Glycine max
  Coding DNA Sequence Number=SeqID_35947
  Gene Ontology: Mol. function=zinc ion binding; Cellular component =mitochondrion; Biological process=regulation of transcription, DNA -dependent
  Homolog annotation: Hit_ID=Q8H349; Match level="QueryCoverage=77%, HitCoverage=62%, E-value=1e-155, Identity=52%"; Hit description =VP1/ABI3 family regulatory protein-like protein
  Pfam annotation: Domain name=B3; Domain location=211-314; Score=86.9; E_value=6.3e-23; Accession=PF02362.12; Description=B3 DNA binding domain
  Pfam annotation: Domain name=zf-CW; Domain location=443-488; Score =83.3; E_value=7.4e-22; Accession=PF07496.5; Description=CW-type Zinc Finger
  Pfam module annotation: Pfam domain module=B3::zf-CW; Domain location= 211-314::443-488
  Subcellular localization annotation: CTP_CleavageSite=61; ConfidenceScore=5.29e-01
LRDLSGKGWSQLAGSGPVPWKQAPSLFNSASSSDMIPEVPSLVELSNSFDKMYCNERLPVSALEKKNEDLSGMSVNWNIKLGSREMMLMNGMRNEDKSSSCLNMCQQPSSLKEESSPQPFGLPVPNSCQNERNGKLGVTGSHPQQTPPPGKQFNGTMHLAPDSSGEAQVRNGRPRADARGRNQLLPRYWPRCTDLELQQISIEYPSNHMIVVLKTLSASDAGRIGRLVLPKKCAETYFPPISQPEGLPLKILDAKGKEWIFQFRFWPNNNSRMYVLEGVTPCIQSMQLQAGDTVTFSRLEPEGRLVMGFRKASSAVPSDQDNETKTGNGFSAHGEVELADPNSWSKVDKSGYIAKEALGSKSLISRKRKSNILGSKSKRLRIENEDLIELKITWQEAQGLLRPPPSHIPSIVVIEGFEFEEYEEAPVLGKPTIFTSDSVGEKIQWAQCEDCFKWRKLPASALLPSKWTCSDNSWDPERSSCSAAQELTAEQLENLLPPCSSAVPKKMKAAKQDPDNAEALEGLDTLANLAILGEGEALPASAQATTKHPRHRPGCSCIVCIQPPSGKGPKHKQTCTCNVCLTVKRRFRTLMLRREKKQSEKEAETTRKKQQQQHPQPLPSSEILLDEDSLPCSNTGDSSPNQNKEGNDGSDDDPNRIKSSALPFKGQIDLNIQPEREEELSPGSDSGGMMKLLHDATERYLKQQTVNSGTGDSSGSQSRLVGDAMREDKLSNGVAHGSGSHNTDKEHAQSLSMNV

SEQ ID NO: 152726 - protein, 53 aa, Glycine max
  Coding DNA Sequence Number=SeqID_35948
MASASSSSSKLCFNSDCKELKSERPKKGWRLRSGELAELCDRCGFGHSSCKFG

SEQ ID NO: 152727 - protein, 268 aa, Glycine max
  Coding DNA Sequence Number=SeqID_35949
  Gene Ontology: Mol. function=diacylglycerol kinase activity; Cellular component=integral to membrane of membrane fraction; Biological process=protein kinase C activation
  Homolog annotation: Hit_ID=Q4RLF1; Match level="QueryCoverage=91%, HitCoverage=71%, E-value=4e-17, Identity=30%"; Hit description =Chromosome undetermined SCAF15021, whole genome shotgun sequence
MAKSLLDSVGDPCEVANAVLAIIRGSKRPLDVATITQGETRFFSILMLAWGLVADIDIESEKYRWMGSARLDFYGLCRLLNLRQYIGCVSFVPAPGYEAFGEPTSYPGKSTTSKGSNNDPSEAERANLQRLCYLGPEINLENLNWRVINGPFISVWLHNVPWGAEDTMAAPDAKFSDGYLDLIIIKNCPTLPLLSMMSELNKGGHVKAFNLQPGPRTKDQEKEGIIDSDGEVLARGKGTYKCEQKTLMAYDKLQITVDQGLATLFTPL

SEQ ID NO: 152728 - protein, 635 aa, Glycine max
  Coding DNA Sequence Number=SeqID_35950
  Gene Ontology: Mol. function=calmodulin binding
  Homolog annotation: Hit_ID=Q9FKL6; Match level="QueryCoverage=97%, HitCoverage=97%, E-value=0.0, Identity=59%"; Hit description =Calmodulin-binding protein
  Pfam annotation: Domain name=Calmodulin_bind; Domain location=95-398; Score=652.7; E_value=3e-193; Accession=PF07887.2; Description =Calmodulin binding protein-like
MQTRYIERSSSSAREKRALDSGSADEDQPQRKRPALASVIVEALKVDSLQKLCSSLEPILRRVVSEEVECALAKLVPAKLSGRSSPKGIEGPDDSSLQLQFRTRLSLPLFTGGKVEGEHGSAIHIVLIDTTTGHVVTCGPASCVKLDVIVLEGDFNNEDDDNWSEEYFDSHVVKEREGKRPLLTGDLQVTLKEGVGTLGELTFTDNSSWIRSRKFRMGLKVSPGCYEGMRIREAKTEAFTVKDHRGELYKKHYPPALNDEVWRLEKIGKDGSFHKRLNKAGIYTVEDVVQLVVRDPQRLRNILGSGMSNKMWDVLVEHAKTCVLSGKLYVYYPDDARNVGVVFNNIYELSGLITNDQYYSADSLSDGQKVYVDTLVKKAYENWMHVIEYDGESLLNYNQNKTLGTSQPLAPVGSHDYSISNSLDQQTSIPSLPVPLTTGQPSMNPAVTVGGYHNVTTTRCSMQPQNDNLHSSIQFDNTAFPLQNQLMSASHHSQFPRNENGLTLGTRQPATPGFQNVSISNPNYRGLEDYFPEDEIRTRSHEMLENEDMQHLLRIFNMGGGQSHAPFNTQEDAYPYSSAYMPAASMSSNLDDEQNRSSGKAVVGWLKLKAALRWGIFIRKRAAERRAQLVELDDQ

SEQ ID NO: 152729 - protein, 154 aa, Glycine max
  Coding DNA Sequence Number=SeqID_35951
  Homolog annotation: Hit_ID=Q1SPB9; Match level="QueryCoverage=54%, HitCoverage=14%, E-value=2e-09, Identity=39%"; Hit description =Transposase
METISKRFEEIDVCGKVTLKSKVREIVYSDLNSRCVSPEKGQNKSNSSIKCSASSFEQPKPRIIIPMLDQFHPCIHDFIENIVDIKPNGNCGYRAIATLLGMSEDSWSLICNHLLKELAKWSNEYINLLGGINRFEELKWSLLVNRLSMVTMDK

SEQ ID NO: 152730 - protein, 712 aa, Glycine max
  Coding DNA Sequence Number=SeqID_35952
  Gene Ontology: Mol. function=nucleic acid binding; Cellular component= heterogeneous nuclear ribonucleoprotein complex; Biological process =regulation of transcription, DNA-dependent
  Homolog annotation: Hit_ID=UPI00004BB2CE; Match level="QueryCoverage =85%, HitCoverage=67%, E-value=3e-78, Identity=33%"; Hit description =E1B-55kDa-associated protein 5 isoform d
  Pfam annotation: Domain name=SPRY; Domain location=81-228; Score =28.8; E_value=1.9e-05; Accession=PF00622.18; Description=SPRY domain
MASNKRHFAEEDDDPHSFSKKSKESESESDASPSSLRVFLNPADCDLDFHIDGNGHVGYGLHEEGFAYCWSGARANVGITRGRYCFACKVVSAQTVNMQDTAPEQQHICRLGISRGDNAVGNLGESRQSFGYGGTGKFSNCGRFLDFGDKFGVGDTIVCCVDLDLESRPLASIGFSKNGKWLGAATQFDAARLGVVDSPPGNLQWTSALFPHVLLKNVVVQMQFSVKDGLVPEDGFKPWASAMEDGNIVMGPSFSEPRDCEVIMMVGLPASGKTTWAEKWVKDHPEKRYVLLGTNSILDQMKVPGLLRRNNYGERFDLLMDRATRIFNILLSRAANIPRNYIIDQTNVYKSARKRKLEPFADYQKIAVVVFPKPDELKIRSDKRFTEMGKEVPPDAVNKMIANYVLPKSKDMPRSDEFFDQVMFVELNRGESQKYLDQMKQNLAYISSNNSSTLPPGGSFESFAGSNLPNKRSFTVLLFNDLNNNALLVKTTTMHFGSGSGLHQPGSYSPIAPPNYGMPGQVSQVNANGGMNSFSGVYPGCQIPHVARAASPCEPYYNNESNCFARDIAGYNQTYGAIPTGDMRNYNSSVVRGPYRPNIVENNMIFRDAFPDAYRSRMNEPSPIASARSMSFDYSTHTEPYPDAYRSGMNESSPIARARATRNEPYPKEDSSHSYRDSLSPYGTLTPRPSYGSSPNNMPYSGTYASQRPRYF

SEQ ID NO: 152731 - protein, 303 aa, Glycine max
  Coding DNA Sequence Number=SeqID_35953
  Pfam annotation: Domain name=Brevenin; Domain location=62-108; Score =9.1; E_value=0.019; Accession=PF03032.6; Description=Breveninesculent ingaegurinrugosin family
MEEESEFLLEMKLIIISLCTETLSLLSVHSSQPLFSCIVTFCFLILLYLPHLFWKIVFSPVLILSGVLLLLLLRLGAIQRSQNEEKKNSVEPEPIANEENRGNREEKQGNPIEPVETDSLDHVYRWVTSQSQKEIKSQMGFQSSSRFDESFVEWNVKAPLEVIYEGEETEQDQNEKRDEGILRYPSLSRYYPETDSDSSSESEFPATENWDSPENMCFRWDEEDREGLIEIALDGCKKRDVGFHFDEENLIEIDISPTRHREFSGKDDPFSGKGKIRDLELLWVMAEYACFGCGHRCTLLSKL

SEQ ID NO: 152732 - protein, 50 aa, Glycine max
  Coding DNA Sequence Number=SeqID_35954
MRVLSTYFDNIEDEHRPIDRLKAGENRTWGFTEKISPSTLCRCSLHYSVI

SEQ ID NO: 152733 - protein, 289 aa, Glycine max
  Coding DNA Sequence Number=SeqID_35955
MQRKKERKKKMLPLKLVRSLVLGETINHNPHHILTQNHHHNSDDDDDDEAHGTSQPQHHRRRRKYKRPGLIFLPTKEIIRDTYRLATIARDLGLDLYPTPSLSHIIFSNPSSSKPSSLSISFSCSLQSDAVPIPFPSLSATPLAHLRCFLTLSPRAFKIVLFNSDHHPDDASGTSGNANNWDCGSFSLHSRAVGVRVDTMEEFCRILAGKGWSFYKTKKAPSSDQRHGGAFYLFRRVDVNRVRVGGVGAPEDGACRVRELRLPHLDFGNAPLRILQYILLMTDDIFCLA

SEQ ID NO: 152734 - protein, 288 aa, Glycine max
  Coding DNA Sequence Number=SeqID_35956
  Homolog annotation: Hit_ID=P02519; Match level="QueryCoverage=48%, HitCoverage=99%, E-value=2e-59, Identity=75%"; Hit description=17.3 kDa class I heat shock protein
  Pfam annotation: Domain name=CS; Domain location=46-126; Score=16.4; E_value=0.00055; Accession=PF04969.6; Description=CS domain
  Pfam annotation: Domain name=HSP20; Domain location=49-140; Score =126.2; E_value=9.2e-35; Accession=PF00011.11; Description=Hsp20alpha crystallin family
  Pfam module annotation: Pfam domain module=CS::HSP20; Domain location= 46-126::49-140
MSLIPSFFGGRRSNVFDPFALDVWGPFKDLSFPSSLSAENSAFVNTRLDWKETPEAHVFKVDIPGLKKEQVKVEIEDDKVLRISGERSVERSSAKFLRKFRLPENTKFDQVKASMENGVLTVTLPKEEVKKPDVKAVQISVRQPQLPHPTCPILRSSDATDPNPVHVHPSEEVKRAAVALIGRWGFLGFVKAPTFSGENPAKLLHGVNPNADGPRVERERAAVPVVGVAGGSGGVVGVVVGVEKDDLEGAWGEREEAAEGMGTASLWREQEKEMESDEGLDDDGLEKM

SEQ ID NO: 152735 - protein, 463 aa, Glycine max
  Coding DNA Sequence Number=SeqID_35957
  Gene Ontology: Mol. function=catechol oxidase activity; Cellular component=chloroplast; Biological process=metabolic process
  Homolog annotation: Hit_ID=Q7Y249; Match level="QueryCoverage=95%, HitCoverage=71%, E-value=1e-156, Identity=61%"; Hit description =Polyphenol oxidase
  Pfam annotation: Domain name=Tyrosinase; Domain location=63-392; Score=529.9; E_value=2.7e-156; Accession=PF00264.10; Description =Common central domain of tyrosinase
PNPEEGKPSHNIVAGKNRRDVLIGFGGLYGASTLTNNNNNNPLAIAAPILPPDLKTCGPPDLATGAKPVNCCPPISSTIIDFKLPSSGAPLRVRPAAHLVNDVYIAKYREALKRMKALSPNDPRNFTQQANVHCAYCDGAYHQVGFPNLDLQVHNCWLFFPYHRWYLYFYERILGNLIGDPTFALPFWNWDNPKGGMTIPSFYVDKNSPLYDPLRNLNHQPPVLIDLDYNRRDDDDPSASESVDPNEQIASNLSIMYRNVISNGKLPRLFLGSPYRAGDEPEPGAGSLENVPHGPVHSWTGDKREPNRENMGIFYSAARDPIFFSHHANVDRMWSIWKTIPGGKRRDFTDPDWLESAFFFYDENKNLVRVKVKDSLDTRKLGYVYQDVDIPWLKNKPKPKRSKAKKLALAQDFIVGAAQAVETTPKSVKFPLTLDSKVSTLVKRPKLLREQGGEGRRGGGVGD

SEQ ID NO: 152736 - protein, 281 aa, Glycine max
  Coding DNA Sequence Number=SeqID_35958
  Homolog annotation: Hit_ID=P93322; Match level="QueryCoverage=44%, HitCoverage=30%, E-value=2e-51, Identity=79%"; Hit description =Cdc2MsE protein
  Subcellular localization annotation: CTP_CleavageSite=52; ConfidenceScore=5.30e-01
MSVKSMLSALVPCQPGDTFVNYPTRPVDTTTDFEGTANMQPSQPVSSGAAVSGNMPGGHVSNRSVPRPMNVGGMQRIPHQAMQGYNLSSQAGMGAGMNPGGIPMQRGVPQQQLRRKDQMGMPGYPPQQKSRQTNLAVQKTGRIMLIWAIRSVTDFSHVVCEQLEFVRVLKYHVSWLGCAGRDQVKINLRSTLGNLSSFRTIHDPPSSDSLLPFLRTSLFYCSQRILLEQQLSPWKGMGELLEPGGTSVSQVKRLDTLGVFAKIELLDLAFVTTYEVFGTYL

SEQ ID NO: 152737 - protein, 215 aa, Glycine max
  Coding DNA Sequence Number=SeqID_35959
  Gene Ontology: Mol. function=protein serine/threonine kinase activity; Cellular component=nucleus; Biological process=protein amino acid phosphorylation
  Homolog annotation: Hit_ID=Q7XBS1; Match level="QueryCoverage=98%, HitCoverage=52%, E-value=9e-93, Identity=77%"; Hit description =Protein kinase domain containing protein, expressed
  Pfam annotation: Domain name=Pkinase; Domain location=18-215; Score =91.5; E_value=2.6e-24; Accession=PF00069.15; Description=Protein kinase domain
  Pfam annotation: Domain name=Pkinase_Tyr; Domain location=18-215; Score=-40.8; E_value=5.7e-10; Accession=PF07714.7; Description =Protein tyrosine kinase
  Pfam module annotation: Pfam domain module=Pkinase::Pkinase_Tyr; Domain location=18-215::18-215
MGDDSGSNRSKPEWLQQYDLIGKIGEGTYGLVFLARIKSSTNRGKSIAIKKFKQSKDGDGVSPTAIREIMLLREITHENVVKLVNVHINHMDMSLYLAFDYAEHDLFEIIRHHRDKVNQSINQYTVKSLLWQLLNGLNYLHSNWIIHRDLKPSNILVMGEGEEHGVVKIADFGLARIYQAPLKPLSENGVVVTIWYRAPELLLGAKHYTSAVGIL

SEQ ID NO: 152738 - protein, 818 aa, Glycine max
  Coding DNA Sequence Number=SeqID_35960
  Homolog annotation: Hit_ID=Q1PEB4; Match level="QueryCoverage=87%, HitCoverage=98%, E-value=7e-90, Identity=46%"; Hit description =Hydroxyproline-rich glycoprotein family protein
  Pfam annotation: Domain name=Extensin_2; Domain location=329-555; Score=-141.4; E_value=0.09; Accession=PF04554.4; Description =Extensin-like region
  Pfam annotation: Domain name=Vps53_N; Domain location=355-807; Score=- 204.4; E_value=0.074; Accession=PF04100.3; Description=Vps53-like, N -terminal
  Pfam module annotation: Pfam domain module=Extensin_2::Vps53_N; Domain location=329-555::355-807
  Subcellular localization annotation: CTP_CleavageSite=34; ConfidenceScore=5.01e-01
MATVGFCGLKPLLFRRKANIFEAMKGSTPKRSSSAKAKSKANEESLELSFVGADQLILMVEIHKKILAFRDIMDLAPCNSSASLREMVMKTLKDLHGLYPGIIPKNEVSKIKDKPIDKSMAYFCKALKSLGESWMMNNDWMNKLNIVLPSCKDNNNMRQLGETMLTTLDSLMKLASERFDIELTEEDEHKKEFSPRSSSFGKHIMRSTSFSDSSFSCCSSPATPKSVLPELMKYSARSGDSPRSSCASPLLLSLRVQAVGKLNPIDVKRLSFQMSPTQIHKIEEEPSVPTTELDDKASNIIHGKDSSEDLVFHLDATEEELESIINDHKTNKPQAIREVRLSLSPGQFQPKSPPKPPQIPLEQQEQVLVSSPPITQQDPPKPCIPQPPPPPPPLPSMIMVKATPPPPPPPPPPLPPSPPPPPTASSSMIKPNVTLPPPPPPPPPPPPSAPKLEQSVAPIIKMVPPPPPPPPPKGSTSSGGSATTAAAPPPPPPIPLKGGSVPAPPPPVPGGAKGGAPPPPPPLGGGRSLGARATTKLKRSTQLGNLYRTLKGKVEGSSLNGKSLAGKKGGIGAASTGGKQGMADALAEMTKRSSYFQQIEEDVQKYTKQILELRSTITNFKTKDMTELSRFHRDVESVLENLTDESQVLSRFEGFPTKKLEALRMAAALYNKLDSILTELQNWKIVPPLGQQLEKIERYFTKSKTELDALERTKDEESKKFKGHNIEFDFHILVKIKEALVDVSSSCMELALKENRNAAAKNDAPKKEGGSMLWKSFQFAFRIYTFAGGIDDRADKLTRELAQEIESDPNTNPNPNQP

SEQ ID NO: 152739 - protein, 44 aa, Glycine max
  Coding DNA Sequence Number=SeqID_35961
MTNWPKQRMRLTASQFAPQVEQPTANFESTPTPYIESVPTPTIT

SEQ ID NO: 152740 - protein, 253 aa, Glycine max
  Coding DNA Sequence Number=SeqID_35962
  Gene Ontology: Mol. function=binding
  Homolog annotation: Hit_ID=Q5ZC01; Match level="QueryCoverage=50%, HitCoverage=13%, E-value=2e-30, Identity=54%"; Hit description=IFA -binding protein-like
  Pfam annotation: Domain name=DUF593; Domain location=103-196; Score =139.4; E_value=9.9e-39; Accession=PF04576.6; Description=Protein of unknown function, DUF593
MGEVLQKIGTEETTSTNTHPVVCDSAPINPKEENSSNINMSSVTTKEREETGFIKEKPTTEEVDAEASSLNKVQIFRKSSSVESGLDSLDESNISEIQRESNDDRLRRRIEYYKKCNDSLQKEVEEERNASAVATNEAMSIITRLQEEKAALEMEALQYFRMMEKQAEYDNDELEKVNGLLTEKEKEIQDLEAELEFYRSNMTSSNGSLEDHLACKNNTPPLSWQARIRIAAETAAALAAASMIFKKVDPTYS

SEQ ID NO: 152741 - protein, 239 aa, Glycine max
  Coding DNA Sequence Number=SeqID_35963
  Gene Ontology: Mol. function=pepsin A activity; Cellular component =cellulose and pectin-containing cell wall; Biological process =proteolysis
  Homolog annotation: Hit_ID=Q8LCW1; Match level="QueryCoverage=92%, HitCoverage=51%, E-value=8e-77, Identity=62%"; Hit description =Nucellin-like protein
MECLAWRGKTSLTSQLNSQGLVRNVIGHCLSAQGGGYIFFGDVYDSFRLTWTPMSSRDYKHYSVAGAAELLFGGKKSGVGNLHAVFDTGSSYTYFNSYAYQLKKESGGKPLKEAHDDQTLPLCWRGRRPFRSIYEVRKYFKPIVLSFTSNGRSKAQFEMLPEAYLIVSANKLFCQNMGNVCLGILNGSEVGMGDLNLIGDISMLNKVMVFDNDKQLIGWAPADCDQVQNPEMSAFDHKI

SEQ ID NO: 152742 - protein, 407 aa, Glycine max
  Coding DNA Sequence Number=SeqID_35964
  Gene Ontology: Mol. function=nucleoside-triphosphatase activity; Cellular component=integral to membrane; Biological process=transport
  Homolog annotation: Hit_ID=Q9SZR9; Match level="QueryCoverage=94%, HitCoverage=61%, E-value=1e-104, Identity=49%"; Hit description =Probable white-brown complex homolog protein 9
  Pfam annotation: Domain name=ABC_tran; Domain location=74-263; Score =155.5; E_value=1.4e-43; Accession=PF00005.17; Description=ABC transporter
MASERFYSVSQRLQSDEAKQDIYLKVNKPLTLRFEDVVHKIKISKGKGLLCYNKEVSSEETLVLKGISGVIFPGELLVILGPSGCGKTTLLAALGGRLNHSITRGSITYNGKPLSKSVKQNLGFVSQQDVFYPHLSVSETLIFSALLRLPNSVSKEEKILKAQAIMNELDLTHCKDTIMGGPLLRGVSGGEWKRVSIGQQLLTNPSLLLVDEPTSGLDSTTARRIVLTLCELAKDGRTVIMTIHQPSSKLFYMFQKILLLSDGRSLYFGKGENVMNYFSSIGYTPSVAMNPTDFLLDLANGIYSENLEEDTNATKQVLLSAFESNLASQVKMELQISRDSIHHNSEDEIFGQHCTTWWQQFTILLRRGFKERKYEQFSPHKICHVFVLSFFAGSLWWQSGADQMHDQ

SEQ ID NO: 152743 - protein, 188 aa, Glycine max
  Coding DNA Sequence Number=SeqID_35965
  Homolog annotation: Hit_ID=Q1S6B9; Match level="QueryCoverage=63%, HitCoverage=25%, E-value=4e-44, Identity=75%"; Hit description =Senescence-associated
  Pfam annotation: Domain name=Senescence; Domain location=1-124; Score= 3.1; E_value=5.7e-12; Accession=PF06911.3; Description=Senescence -associated protein
  Subcellular localization annotation: CTP_CleavageSite=52; ConfidenceScore=5.14e-01
MTEKVANGFLSGVVKVSGFFTSSVINSKAGKKIFSFLPGEVLLASLDGFSKVCDAVEVTGKNVMSTSSTVTTELVDHRYGEQAAEATSEGFSAAGHALGTAWAAFKIRKALNPKSVLKPTSLAKAGAKAAASEFKSKNSKYRQILNVWVDDLKFCKISAGGKAALISSAFVGGGTMLIVKHFVLRTDD

SEQ ID NO: 152744 - protein, 38 aa, Glycine max
  Coding DNA Sequence Number=SeqID_35966
MTIPVKIQISKFIGSTVADGEATSHDQKQVHNYRKMGE

SEQ ID NO: 152745 - protein, 190 aa, Glycine max
  Coding DNA Sequence Number=SeqID_35967
  Gene Ontology: Mol. function=nucleoside-triphosphatase activity; Cellular component=integral to membrane; Biological process=transport
  Homolog annotation: Hit_ID=Q9C6W5; Match level="QueryCoverage=95%, HitCoverage=28%, E-value=2e-37, Identity=45%"; Hit description=White- brown complex homolog protein 14
  Pfam annotation: Domain name=ABC2_membrane; Domain location=1-131; Score=-30.7; E_value=0.045; Accession=PF01061.14; Description=ABC-2 type transporter
MIIKERSFYMYRLSSYIIASNLDDLPLQLALPTLLVTVTYWMGGLKAKASIFFRTLAVALLYSLVSQGFGLAIGALLINNQKVAITVGTVVMTLFLLVNGFFVRNTPAFVSWIKYLSHGYYSYKLLLGSQFNGYDTYHCGQNVTCSAVNYPTIKHVGIDKQGLSVAALVAMLVGYRLIAYFALRIGTKLN

SEQ ID NO: 152746 - protein, 55 aa, Glycine max
  Coding DNA Sequence Number=SeqID_35968
  Gene Ontology: Mol. function=protein binding; Cellular component =ribonucleoprotein complex; Biological process=mRNA metabolic process
  Homolog annotation: Hit_ID=Q8LAK5; Match level="QueryCoverage=76%, HitCoverage=48%, E-value=2e-13, Identity=83%"; Hit description=Small nuclear ribonucleoprotein homolog
  Pfam annotation: Domain name=LSM; Domain location=1-43; Score=13.4; E_ value=0.0052; Accession=PF01423.12; Description=LSM domain
MVGFDEYMNLVLDDAEEVNVKKKSRKTLGRILLKGDNITLMMNTHLTYRVLSSML

SEQ ID NO: 152747 - protein, 924 aa, Glycine max
  Coding DNA Sequence Number=SeqID_35969
  Gene Ontology: Mol. function=beta-galactosidase activity; Cellular component=beta-galactosidase complex; Biological process =carbohydrate metabolic process
  Homolog annotation: Hit_ID=Q1SJD6; Match level="QueryCoverage=99%, HitCoverage=92%, E-value=0.0, Identity=56%"; Hit description =Galactose-binding like
  Pfam annotation: Domain name=Glyco_hydro_35; Domain location=455-730; Score=493.0; E_value=3.6e-145; Accession=PF01301.10; Description =Glycosyl hydrolases family 35
MAVGLNTGVPWVMCKQTDAPDPVINTCNGMRCGETFTGPNSPNKPALWTENWTSFYQVYGGLPYIRSAEDIAFHVTLFIARNGSYVNYYMYHGGTNFGRTASAYVITGYYDQAPLDEYGKQPKWGHLKQLHEVIKSCSTTLLQGVQRNFSLGQLQEGYVFEEEKGECVAFLKNNDRDNKVTVQFRNRSYELLPRSISILPDCQNVAFNTANVNTTSNRRIISPKQNFSSLDDWKQFQDVIPYFDNTSLRSDSLLEQMNTTKDKSDYLWYTLRKPTLSVQSAAHVAHAFINNTYIGGEHGNHDVKSFTLELPVTVNQGTNNLSILSAMVGLPDSGAFLERRFAGLISVELQCSEQESLNLTNSTWGYQTTFDTPEGDDPVVLDLSSMGKGEAWVNEQSIGRYWILFHDSKGNPSQSLYHVPRSFLKDTGNVLVLVEEGGGNPLVALSGNVSYDGRSLLIDGQRKLLISASIHYPRSVPAMWPGLVQTAKEGGVDVIETYVFWNGHELSPGNYYFGGRFDLVKFAKTVQQAGMYLILRIGPFVAAEWNFGGVPVWLHYVPGTVFRTYNQPFMIENEYGYYENFYKEDGKKYALWAAKMAVSQNTGVPWIMCQQWDAPDPVIDTCNSFYCDQFTPTSPNRPKIWTENWPGWFKTFGGRDPHRPAEDVAFSVARFFQKGGSVHNYYMYHGGTNFGRTAGGPFITTSYDYDAPVDEYGLPRLPKWGHLKELHRAIKLCEHVLLNGKSVNISLGPSVENFHDWLFVVQFKEVNFSFVIVSTVGGRVLAAYNIPPPYLRIAKSLWTMGYEADVYTDSSGACAAFISNVDDKNDKTVEFRNASYHLPAWSVSILPDCKNVVFNTAKTNVVAMIPESLQQSDKGVNSLKWDIVKEKPGIWGKADFVKSGFVDLINTTKDTTDYLWHTTRYVLG

SEQ ID NO: 152748 - protein, 189 aa, Glycine max
  Coding DNA Sequence Number=SeqID_35970
  Homolog annotation: Hit_ID=Q9LD44; Match level="QueryCoverage=21%, HitCoverage=10%, E-value=3e-11, Identity=85%"; Hit description =Jasmonic acid regulatory protein-like
MKSSWFTTSREKLLQHPFPSPSSPMLIYTSSTLESYQVLALKIHFCEDSAVQRVRISSVAQWILHKNPRDPKSSLTGLGGKQQEKDAKEEKYLNRCMSPSHRRRCINLAAPSHCGEGKRKRKKRKGSGEEEASAGEEVERAGRLKEREKKRKGNVQGERKEKKKRKTRKGMEKLKIKINVTIERWTTHV

SEQ ID NO: 152749 - protein, 168 aa, Glycine max
  Coding DNA Sequence Number=SeqID_35971
  Gene Ontology: Mol. function=transition metal ion binding; Cellular component=cytoplasm; Biological process=proteolysis
  Pfam annotation: Domain name=Transposase_21; Domain location=79-168; Score=-61.2; E_value=2.2e-09; Accession=PF02992.5; Description =Transposase family tnp2
MGMEYQKIHACPNDCILYRHEFQEMSKCPICGSSRYKVKDEEESSSDENSKKGPPAKVLWYLPIIPRFKRLFANEDDAKDLTWHANGRISDGMVCHPADCLQWKKIDGMNPYDTLSTQHSSWSVLLLKYMMFSKMISSPRQPGDDFDVYLSPLVEDLRKLWDIGGFSV

SEQ ID NO: 152750 - protein, 329 aa, Glycine max
  Coding DNA Sequence Number=SeqID_35972
  Homolog annotation: Hit_ID=Q0GPH0; Match level="QueryCoverage=96%, HitCoverage=76%, E-value=3e-61, Identity=41%"; Hit description=BZIP transcription factor bZIP80
  Pfam annotation: Domain name=DUF632; Domain location=1-206; Score =115.2; E_value=1.9e-31; Accession=PF04782.3; Description=Protein of unknown function (DUF632)
MEHEKKLALLRKVEMKRADYVKTEKTKKEVEKLESQMMVASQAIDSTSSEIIKLREVELYPQLIELVKGLMCMWRSMYECHQVQKHIVQQLEYLNTIPSKNPTSEIHKQSTLQLELEVQQWHQSFCNLFKAHHDYIQSLTGWLRLTLFQFSKTPINRTPEESKIYTLCEEWHLAVDRIPDKVASEGIKILLTVIHAIALQQAKEQKQKKKSDSTFKELEKKVVQLRSLECKYGPYSMPESSGSLRTRDPITEKRTKVDALKAKADEEKSKYNKSVSVTRAMTLNNLQMGCPHVFQGIVGFSSVCMEVFESVYNKAKASEQEHDVKRILP

SEQ ID NO: 152751 - protein, 114 aa, Glycine max
  Coding DNA Sequence Number=SeqID_35973
MDTIEGYQVKPEFIPMLRKILSKHGDVMEMFLRIPWYSQRYSELQDKGLDKITEDELRNMFGVANEIKNMKVNTEWLFLRLEEILEARQILGQSGILKEEKDNNRKVIETAKRK

SEQ ID NO: 152752 - protein, 289 aa, Glycine max
  Coding DNA Sequence Number=SeqID_35974
  Gene Ontology: Mol. function=hydrolase activity, acting on ester bonds; Biological process=lipid metabolic process
  Homolog annotation: Hit_ID=Q1S3U7; Match level="QueryCoverage=76%, HitCoverage=59%, E-value=9e-69, Identity=61%"; Hit description =Lipolytic enzyme, G-D-S-L
  Pfam annotation: Domain name=Lipase_GDSL; Domain location=44-258; Score=59.0; E_value=1.6e-14; Accession=PF00657.12; Description=GDSL -like LipaseAcylhydrolase
MKFLFQNLLSQLPIVILWYFSTVIISQQHVSAVSLPNNETVPAVIVFGDSIVDSGNNNYINTILKCNFQPYGRDFAGGNQPTGRFSNGLTPSDIIAAKFGVKKILPAYLDPKLQPQDLLTGVSFASGGSGYDPLTSKTVSVLSLSDQLDKFSEYKNKIKETVGENRMATIISKSIYVLCTGSNDIANTYSLSPVRRAHYDVPEYTDLMASQATNFLQYILKLTDLNVRNYGLGDKFSDMMEYVAVPNTMGCLTANSISTLSYWVKIQNPIALEASNMNVRVNVSKAHVH

SEQ ID NO: 152753 - protein, 139 aa, Glycine max
  Coding DNA Sequence Number=SeqID_35975
  Gene Ontology: Mol. function=metal ion binding; Biological process =metal ion transport
  Homolog annotation: Hit_ID=Q8LGG1; Match level="QueryCoverage=96%, HitCoverage=82%, E-value=1e-12, Identity=37%"; Hit description =Farnesylated protein
MEARVEIKVRMQCECTGCDRKVEKMKKSVQGMEGVAQVQVDREEQGNCKLTVIGRVDPNHVLKALRRLTHKKVELLPVPQVQDDVVPQPSQPEPVNVHNVLRHDHDDQEASMLPRANFLGDPNYTTAFSEDSPNACPIM

SEQ ID NO: 152754 - protein, 449 aa, Glycine max
  Coding DNA Sequence Number=SeqID_35976
  Gene Ontology: Mol. function=RNA-directed DNA polymerase activity; Cellular component=intracellular; Biological process=RNA-dependent DNA replication
  Homolog annotation: Hit_ID=Q5N752; Match level="QueryCoverage=78%, HitCoverage=64%, E-value=2e-37, Identity=30%"; Hit description =Pentatricopeptide (PPR) repeat-containing protein-like
  Pfam annotation: Domain name=ECSIT; Domain location=206-433; Score= -103.9; E_value=0.096; Accession=PF06239.2; Description=ECSIT (evolutionarily conserved signaling intermediate in Toll pathways)
  Pfam annotation: Domain name=PPR; Domain location=184-218; Score =21.9; E_value=0.0023; Accession=PF01535.11; Description=PPR repeat
  Pfam annotation: Domain name=PPR; Domain location=219-253; Score =38.8; E_value=1.8e-08; Accession=PF01535.11; Description=PPR repeat
  Pfam annotation: Domain name=PPR; Domain location=254-288; Score =24.3; E_value=0.00043; Accession=PF01535.11; Description=PPR repeat
  Pfam annotation: Domain name=PPR; Domain location=289-323; Score =11.4; E_value=0.33; Accession=PF01535.11; Description=PPR repeat
  Pfam annotation: Domain name=PPR; Domain location=357-391; Score =24.3; E_value=0.00043; Accession=PF01535.11; Description=PPR repeat
  Pfam annotation: Domain name=PPR; Domain location=392-426; Score =20.4; E_value=0.0066; Accession=PF01535.11; Description=PPR repeat
  Pfam annotation: Domain name=PPR; Domain location=74-108; Score=12.0; E_value=0.28; Accession=PF01535.11; Description=PPR repeat
  Pfam module annotation: Pfam domain module=ECSIT::PPR::PPR::PPR::PPR:: PPR::PPR::PPR; Domain location=206-433::184-218::219-253::254 -288::289-323::357-391::392-426::74-108
MRRGLISISRSSLLRPFQWHLSTATATATATITPPPDDATVRQTLLSFNNDWKRALEFFNWVEDSHSQFHHSTDTFNLMLDILGKFFEFKLCWDLIRRMNAHPSSPPNHATFRLMFKRYVSAHSVNDAIDTFNRLGEFNLKDHTSFSNLLDALCEYKHVIEAQDLLFGNDNRVTLSVDPIGNTKIHNMVLRGWFKLGWWSKCNEFWEEMDKKGVHKDLHSYSIYMDILCKGGKPWKAVKLFKEIKKKGFKLDVVVYNIVIRAIGLSHGVDFSIRVFREMKELGINPTVVTYNTLIRLLCDCYRHKEALALLRTIMPRDGCHPTAVSYHCFFASMEKPKQILAMFDEMVESGVRPTMDTYVMLLNKFGRWGFLRPVFMVWNKMKQLGCSPDAAAYNALIDALVDKALIDMARKYDEEMLAKGLSPKPRKELGTKLLAADESQSTIQTQHY

SEQ ID NO: 152755 - protein, 510 aa, Glycine max
  Coding DNA Sequence Number=SeqID_35977
  Homolog annotation: Hit_ID=Q8RU74; Match level="QueryCoverage=16%, HitCoverage=18%, E-value=1e-23, Identity=69%"; Hit description =Dehydroquinate synthase
MLVKRMYHSESGEADLARRPLFFREINPQPRKHTLWQATSDFTGGQASINRRHFLQCPQGLLGKHFEKLIQCDPRLNYLSQHPDLVLDSPYFEPGTTSVHDHIESSDGFDRKSEERSGIFGLQDVESGSAVQSSSSKSEHNLGKAVENVNQEITSPSSVMNIHAMEDFRSRGAETLKFLSNLDQIKLPGLHPSMSMDDLVSHIGHCISEQMGSDNPSLAGDSLYSRSILEEFSQYLFNDSQHATTSDEQRVMSRVNSLYCLLQKDPSSAEDINTMAKNGNSLRDANALSRVNSLYSLLQHAEDTMTRNGNGLRDADVMSRVNSLYCLLQKDPSTAEDTNTMTRNDNGLDADEGGKVGVSNSNTTELSPCKIKVPDLEVQPDDASGCKQGVSGMSRKESAGDLLLNLPRIASLPQFLFNMSEDSVNKFHLRWIDDSLVKRVGDILKQAKLPTAPPETVTVDMFKSVMAVDKKVADGLLRLILLKGPLGNCVFTGDYDRKALDNTLRAFCKS

SEQ ID NO: 152756 - protein, 425 aa, Glycine max
  Coding DNA Sequence Number=SeqID_35978
  Gene Ontology: Mol. function=oxidoreductase activity, acting on the CH-OH group of donors, NAD or NADP as acceptor; Cellular component =chloroplast; Biological process=branched chain family amino acid biosynthetic process
  Homolog annotation: Hit_ID=P93832; Match level="QueryCoverage=91%, HitCoverage=91%, E-value=1e-157, Identity=70%"; Hit description=3 -isopropylmalate dehydrogenase 2, chloroplast precursor
  Pfam annotation: Domain name=Iso_dh; Domain location=41-410; Score =633.2; E_value=2.2e-187; Accession=PF00180.10; Description =Isocitrateisopropylmalate dehydrogenase
  Subcellular localization annotation: CTP_CleavageSite=33; ConfidenceScore=5.23e-01
MATSLQLFQCKLARPFRPFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPKKLHIPALLVVPWNGRQTDQENLRDVFYDVLVDASTLKREVAEGVDIMLIRELTGGIYFGEPRGFGTNENGEEIGFNTEIYATHEVAQKRCGKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAKRIENAVVDTLNRGFRTGDIYSAGTKLVGCKQLGEEILKSVESNVHAGAATV

SEQ ID NO: 152757 - protein, 517 aa, Glycine max
  Coding DNA Sequence Number=SeqID_35979
  Gene Ontology: Mol. function=3-dehydroquinate synthase activity; Cellular component=cytoplasm; Biological process=aromatic amino acid family biosynthetic process
  Homolog annotation: Hit_ID=Q30D01; Match level="QueryCoverage=75%, HitCoverage=85%, E-value=0.0, Identity=83%"; Hit description =Putative 3-dehydroquinate synthase
  Pfam annotation: Domain name=DHQ_synthase; Domain location=169-480; Score=586.9; E_value=1.8e-173; Accession=PF01761.10; Description=3 -dehydroquinate synthase
MVCTGEMGSIVDKKSWYEEDTKSQRKPTKKYDSQCQQAYQTAKKGKDAQAQAHHVIVIVGFFTQQPPNHTVAPIPSLIPPMASTATNFSLSLCANQQTPIPKPSFFSNNNHLHFNSNNNWAWASVSTSRKSRICATSSQVMDPSAAKSEPALPTIVEVDLGSRSYPIYIGSGLLNQPDYLQRHVHGKRVLVVTNETVAPLYLDKVVDALTRGNPNVSVESVILPDGEQYKDMDTLMKVFDKAIESRLDRRCTFVALGGGVIGDMCGFAASAFLRGVNFIQIPTTVMAQVDSSVGGKTGINHRLGKNMIGTFYQPQCVLIDTDTLNTLPDRELASGLAEVIKYGLIRDAEFFEWQEKNMHLLLARDPSVMAYAIKRSCENKAEVVSLDEKESGLRATLNLGHTFGHAIETGVGYGQWLHGEAVAAGTVMAVDMSYRLGWIDDSLVKRVGDILKQAKLPTAPPETVTVDMFKSVMAVDKKVADGLLRLILLKGPLGNCVFTGDYDRKALDNTLRAFCKS

SEQ ID NO: 152758 - protein, 155 aa, Glycine max
  Coding DNA Sequence Number=SeqID_35980
  Gene Ontology: Mol. function=metal ion binding; Biological process =metal ion transport
  Homolog annotation: Hit_ID=Q9ZRD7; Match level="QueryCoverage=80%, HitCoverage=92%, E-value=2e-14, Identity=36%"; Hit description=GMFP7
  Pfam annotation: Domain name=HMA; Domain location=33-97; Score=45.1; E_value=2.3e-10; Accession=PF00403.16; Description=Heavy-metal -associated domain
MGVQNIISGLVRCWQGCWHEELETVEIGLATVEIMMMNMYCQCKGCKRKVKRSVKNMEGVREVEVDLEQGKLTVTGYVDPNEVLERVRRRAWKESEFWAMADEPYVVPYAYAPQPYVLQPKHDTEPPTLAHASFFQDLNYATPFNHDNPNACSIM

SEQ ID NO: 152759 - protein, 298 aa, Glycine max
  Coding DNA Sequence Number=SeqID_35981
  Gene Ontology: Mol. function=DNA binding; Biological process =transposition, DNA-mediated
  Homolog annotation: Hit_ID=Q1SDX7; Match level="QueryCoverage=95%, HitCoverage=45%, E-value=2e-21, Identity=25%"; Hit description =Cyclin-like F-box
MAGQLARSRRLETQQQDQSRAKWTTSLTKILAALMVDQVHKGNKHNNLFNKKAWKYICDEFYKKTGLKWDKEQLKNRYSVLRRQYIIVKSILDQSDFSWDEATGSITANDEIWAEYIKKHPDAETVKTGGCSIFKELCTIFSEPATNGKHEYFAASEGEHTYTTLCPEPLNTHQEESSSESQDEEDATNDFQTVQPTTPTAISTRKRGRKGIDDAIADAIFEMASASKMRAAAIEQQIARFSMADCIRDLDLMQGVDQQLYFAALELFDKPNAREIFLSLKRDKRLTWLRRKCAVASN

SEQ ID NO: 152760 - protein, 731 aa, Glycine max
  Coding DNA Sequence Number=SeqID_35982
  Gene Ontology: Mol. function=protein binding; Cellular component =integral to membrane; Biological process=protein amino acid phosphorylation
  Homolog annotation: Hit_ID=Q9C905; Match level="QueryCoverage=95%, HitCoverage=86%, E-value=1e-120, Identity=32%"; Hit description =Putative disease resistance protein; 46848-50365
  Pfam annotation: Domain name=LRR_1; Domain location=143-166; Score =6.1; E_value=20; Accession=PF00560.23; Description=Leucine Rich Repeat
  Pfam annotation: Domain name=LRR_1; Domain location=17-39; Score =18.7; E_value=0.022; Accession=PF00560.23; Description=Leucine Rich Repeat
  Pfam annotation: Domain name=LRR_1; Domain location=192-215; Score =9.9; E_value=4; Accession=PF00560.23; Description=Leucine Rich Repeat
  Pfam annotation: Domain name=LRR_1; Domain location=218-240; Score =21.9; E_value=0.0024; Accession=PF00560.23; Description=Leucine Rich Repeat
  Pfam annotation: Domain name=LRR_1; Domain location=242-261; Score =7.0; E_value=14; Accession=PF00560.23; Description=Leucine Rich Repeat
  Pfam annotation: Domain name=LRR_1; Domain location=267-287; Score =1.1; E_value=1.7e+02; Accession=PF00560.23; Description=Leucine Rich Repeat
  Pfam annotation: Domain name=LRR_1; Domain location=288-310; Score =14.4; E_value=0.42; Accession=PF00560.23; Description=Leucine Rich Repeat
  Pfam annotation: Domain name=LRR_1; Domain location=311-333; Score =10.5; E_value=3.1; Accession=PF00560.23; Description=Leucine Rich Repeat
  Pfam annotation: Domain name=LRR_1; Domain location=335-357; Score =10.9; E_value=2.6; Accession=PF00560.23; Description=Leucine Rich Repeat
  Pfam annotation: Domain name=LRR_1; Domain location=359-380; Score =18.1; E_value=0.032; Accession=PF00560.23; Description=Leucine Rich Repeat
  Pfam annotation: Domain name=LRR_1; Domain location=381-403; Score =9.6; E_value=4.5; Accession=PF00560.23; Description=Leucine Rich Repeat
  Pfam annotation: Domain name=LRR_1; Domain location=405-427; Score =9.8; E_value=4.2; Accession=PF00560.23; Description=Leucine Rich Repeat
  Pfam annotation: Domain name=LRR_1; Domain location=41-63; Score =11.9; E_value=1.7; Accession=PF00560.23; Description=Leucine Rich Repeat
  Pfam annotation: Domain name=LRR_1; Domain location=431-453; Score =9.1; E_value=5.6; Accession=PF00560.23; Description=Leucine Rich Repeat
  Pfam annotation: Domain name=LRR_1; Domain location=455-477; Score =14.7; E_value=0.34; Accession=PF00560.23; Description=Leucine Rich Repeat
  Pfam annotation: Domain name=LRR_1; Domain location=534-556; Score =9.4; E_value=5; Accession=PF00560.23; Description=Leucine Rich Repeat
  Pfam annotation: Domain name=LRR_1; Domain location=558-580; Score =18.8; E_value=0.02; Accession=PF00560.23; Description=Leucine Rich Repeat
  Pfam annotation: Domain name=LRR_1; Domain location=582-604; Score =13.2; E_value=0.95; Accession=PF00560.23; Description=Leucine Rich Repeat
  Pfam annotation: Domain name=LRR_1; Domain location=606-627; Score =5.1; E_value=32; Accession=PF00560.23; Description=Leucine Rich Repeat
  Pfam annotation: Domain name=LRR_1; Domain location=65-88; Score=7.6; E_value=11; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1; Domain location =143-166::17-39::...
  Pfam module annotation: Domain location=192-215::218-240::242 -261::267-287::288-310::311-333::335-357::359-380::381-403::405 -427::41-63::431-453::455-477::534-556::558-580::582-604::606-627::65- 88
MAPFLPRVIAYWFKLKKLEELYLSRNEFEGPLPSSFVNMTSLRNLEISGNHFIGNFDSNLASLTSLEYFDFTGNQFEVPVSFTPFANLSKIKFIYGEGNRVVLDSQHSLQTWIPKFKLQKLIVSSTTETKSLPLPNFLLYQNNLTYIDLSGWKLEGDFPHWLLENNTKMTDALFRNCSFTGTFQLPMSPLPNIQTIDVSDNTVNGQIPSNNISSIYPNLQYLNLSGNNIQGSIPSELGQMSLLYLLDLSENQLSGKIPENILADGHPLQFLKLSNNMLEGPILNIPNGLETLILSHNRFTGRLPSNIFNSSVVLLDVSNNHLVGKLPSYVEKFSRLQGLYMSNNHFEGSIPIELAEPENLSHLDLSQNNLTGHVPSFANSNLQFIHLNNNHLSGLSKRMFNENSSLVMLDLSYNEISSKIQDMIQDLSYTRLNFLLLKGNHFIGDIPKQLCQLTDLSILDLSHNNFSGAIPNCLGKMPFEVKDPAELLQDFYHLIPEPDNRDGTERYELPNVQEKSNFTAKKRTDTYMGSILVYMSGIDLSHNKLKGNIPSELGNLTKIRTLNLSHNDLTGQIPATFSHLVQTESLDLSFNMLNGRIPPQLTTLTSLEVFSVAHNNLSCPTPEFKEQFSTFDESSYEGNPLLCGLPLPKSCNPPPIVIPNDSDTDEHYDSLVDMNFFCVSFVVSYTSALLVIATALYINPYWRQAWFYYMELVSMNCYYFIMDNCSKVFKI

SEQ ID NO: 152761 - protein, 39 aa, Glycine max
  Coding DNA Sequence Number=SeqID_35983
MNCSVDVAEMEEVISRVKWKGTTDLKQNISLLSRNSREE

SEQ ID NO: 152762 - protein, 804 aa, Glycine max
  Coding DNA Sequence Number=SeqID_35984
  Gene Ontology: Mol. function=RNA-directed DNA polymerase activity; Cellular component=chromatin; Biological process=chromatin assembly or disassembly
  Pfam annotation: Domain name=RVP_2; Domain location=306-439; Score= -40.3; E_value=0.0014; Accession=PF08284.2; Description=Retroviral aspartyl protease
  Pfam module annotation: Pfam domain module=RVP_2::RVT_1::Retrotrans _gag; Domain location=306-439::518-679::95-185
MAEHGTRRTITDRLEEAIVALSERHSDLAHKVEAMCERLSQFTTPTPPATQPSYPSRPPVKLDVPRFGGHDPLGWIFKISQFFEYQGTLEEERITVVSFYLDGPALSWFQWMFQNGFITSWSALLQAVEARFAPSFYDDPRGTLFKLVQWSSVTEYLTAFEKLANRIIGLSPSILLSCFISGLSPEIRREEDKINDRRRYHSRTSPSLPPSQSSLPPTHTSQPPKHKPPFIQRTQEDMAYRREKGLCYNCDEKWSSSHRCKGRVLFLIADSEEPLPSEITLEDPPRTYPLEPQPDIHEPEPTFDPSTLQPHVSLHAMAGVPATNTFRLYGFINKTRVTILIDSGSTHNFVQPRVAKFLNLPVEDTLPLRVMVGNGSVMTCNQLCSDTKLLIQDHTFTVTLRILPLSGAEVVLRVEWLRTLGPVITNYASFTMQFSYSGKSINLHADVQSDPNPASANQVKRMLSTSSTSGLFHLSLLPADSPTPSSPPLHHIPAINTLLHKYQSLFQQPSSLPPSQQHDHHINLLPTANPINVRPYRYPHFQKTEIERQVSALLDAGLIWLSRSPFSSLGFHQILMAEEDTPKTAFRTHHCHYEYRVMLFGLCNTPLTFQAAMTPFSGPFCASLRQFFFYGILIYSETFSDHLHHLECVFNSLLQARYYLKQSKYFIGQQQLNYLGHVVSGSGVRPNPTKIQAIVEWIMPRSPKDLRAFLGLAGFYRKFVRGYAAIAAPLTKLLCKNTFQWSSESQTAFEKLKTVLTAAPILALPDFSISFILETDASNIAMGAILQQNGHPIAYFSKPFCPRL

SEQ ID NO: 152763 - protein, 302 aa, Glycine max
  Coding DNA Sequence Number=SeqID_35985
  Gene Ontology: Mol. function=chromatin binding; Cellular component =chromatin; Biological process=chromatin assembly or disassembly
  Homolog annotation: Hit_ID=Q1SAV4; Match level="QueryCoverage=80%, HitCoverage=92%, E-value=2e-58, Identity=38%"; Hit description =Integrase, catalytic region
MAAATATPSDEQVHKVALKVLVDKEKNKVLFAEARKDFVDALFEWWGSLLTAAASIIRPWENHLVLKVVGVANVNPIFLGGVFGGQALPLHEYETCGWLWGGVNTASGGSGVEAGRSGIRGGSWIPRGRLAMGSKLDMDELVYLINHITVLLIREMFHSLLRFDKLTLEDCVGLFACTKGRFAVDDFVWGHTGARVPRGIIGPLHECEKLVPSSWLVMYEGAEVLLERPVHHLRLTIRLWVVGGTHAETMVFAHGIHEKGSYLEGAIHHDHDCGEPMGGGEMGYEVHGDVFPSARGNRNWLE

SEQ ID NO: 152764 - protein, 50 aa, Glycine max
  Coding DNA Sequence Number=SeqID_35986
MSISHRPPGFNPPRKVRNSAYFDQFKIHVFDVLPKKEIPTPRALSNGDST

SEQ ID NO: 152765 - protein, 229 aa, Glycine max
  Coding DNA Sequence Number=SeqID_35987
  Pfam annotation: Domain name=DUF674; Domain location=1-203; Score= -274.7; E_value=7.3e-05; Accession=PF05056.3; Description=Protein of unknown function (DUF674)
MADVKTEVTLKLVVIIGRNEVLFVEAGKDFVDALFSFLKLPLRTVARLVLKEPNVQPIEVASLSSLYQRKEDFADFISSLLTIPLGGMLHLTEVKNNLVDRVLAPQFKLSNLMTSIYKDVSKYFCYTENSYTNLSHAHYIRAVITISETANSKGYVKGPIMYMATDDLVVTLMSSISVISLLSSVCIHVNDLEEKVVNIGINVGVLILQASLTSTSVLSVGLGHLLTPR

SEQ ID NO: 152766 - protein, 63 aa, Glycine max
  Coding DNA Sequence Number=SeqID_35988
  Gene Ontology: Mol. function=hydrolase activity, acting on ester bonds; Biological process=lipid metabolic process
  Homolog annotation: Hit_ID=Q1S3U7; Match level="QueryCoverage=97%, HitCoverage=17%, E-value=4e-22, Identity=69%"; Hit description =Lipolytic enzyme, G-D-S-L
FKVTNEGCCGTGIIEAGILCNPFTLQICSNTANYIFWDSFHPTEEAYNVLCSLVLDNKIKDFF

SEQ ID NO: 152767 - protein, 40 aa, Glycine max
  Coding DNA Sequence Number=SeqID_35989
MENGSEIDYLVLGVANWVHVFKCRNVSCTYGGLCMSYLMI

SEQ ID NO: 152768 - protein, 141 aa, Glycine max
  Coding DNA Sequence Number=SeqID_35990
  Gene Ontology: Mol. function=hydrolase activity, hydrolyzing O -glycosyl compounds; Biological process=carbohydrate metabolic process
  Homolog annotation: Hit_ID=Q1SJD9; Match level="QueryCoverage=85%, HitCoverage=13%, E-value=3e-47, Identity=76%"; Hit description =Glycoside hydrolase, family 31
MGASKIETLCWEMCHGCAFVVALNSSQAAEGELYIDDGSSFNFLQGGYIHRRFIFSNGKLTSIDLAPASSSKGRYPSDAFIERIILLGHAPSSKNALIEPSNQKVDIELGPLWVLRARAPAVTTIRRPNVRVAEDWTITVI

SEQ ID NO: 152769 - protein, 55 aa, Glycine max
  Coding DNA Sequence Number=SeqID_35991
MDRLLEVGFTCGQAPHCRKQHRTEAVSDKSKRERDTKSDSEGRRAPSRKAMPVIT

SEQ ID NO: 152770 - protein, 71 aa, Glycine max
  Coding DNA Sequence Number=SeqID_35992
  Gene Ontology: Mol. function=DNA binding; Cellular component=nucleus; Biological process=regulation of transcription
  Homolog annotation: Hit_ID=Q9FRL6; Match level="QueryCoverage=80%, HitCoverage=45%, E-value=3e-15, Identity=61%"; Hit description=Myb -related protein; 20671-21051
  Pfam annotation: Domain name=Myb_DNA-binding; Domain location=12-61; Score=23.9; E_value=0.00058; Accession=PF00249.21; Description=Myb -like DNA-binding domain
MTTSTLSSPDTSLRWTSEKNKLFENALAIYDKDTPERWNNIAMFVGGTTEVQVKRQYEILLEDIKNIESGK

SEQ ID NO: 152771 - protein, 121 aa, Glycine max
  Coding DNA Sequence Number=SeqID_35993
MRHVLDAATPICPHDPHDDDDNFNEKCHHFKSNINFRRTDVELALLKMMESSGAEHNRAYALWTWVTCCWVTMWVEGAGMQQHQYALTTPMTTMTASTVREQRCRKHYGGGTKRRKEIKAE

SEQ ID NO: 152772 - protein, 352 aa, Glycine max
  Coding DNA Sequence Number=SeqID_35994
  Gene Ontology: Mol. function=protein serine/threonine kinase activity; Biological process=protein amino acid phosphorylation
  Homolog annotation: Hit_ID=Q8H0Z0; Match level="QueryCoverage=93%, HitCoverage=49%, E-value=1e-47, Identity=38%"; Hit description =Putative serine/threonine protein kinase
MGIEEDNIRKYTTPAYRAPEVTIEGCGESTTASSKLWEFLGSILDCPSGEQMWDLFLREVINEKVDIWVWFRVNEQLPINLQKSLPDRPPESPSSNNHEGVSMPSNRSPPMPRRNPPPPPSSGEPKTSPQPPPASRGGGSGGALGAFWSTQHAKESLVAEDKSKPIFDEEPSSHHISPKHDRILPENEQLPKNVGPNKVVNTQTHTVKSSTHGKLHKPDTVPSKDFEINLFKDKDRVRESTTNFQNQAFNTFVAEFDTTNLNSGLSNKPEREQALEAEVEKLKEQLKEANLEKAEITSKYEKLSAICRSQRQELQDLKQALTARTPSPIRDGLKTSPAVTSSASASAVISIL

SEQ ID NO: 152773 - protein, 167 aa, Glycine max
  Coding DNA Sequence Number=SeqID_35995
  Gene Ontology: Mol. function=inositol 2-dehydrogenase activity; Biological process=electron transport
  Homolog annotation: Hit_ID=Q0S9V0; Match level="QueryCoverage=97%, HitCoverage=49%, E-value=1e-28, Identity=43%"; Hit description =Probable inositol 2-dehydrogenase
MRDQAIHFFDLLRWLTEDEVVTVGALGAALAMPAIRDIDVDTSVLIMRLQQGALAQLDNARRTAYGYDERISVMGSLGMLASESQAVRGATLYQGQHIRQPGLYADWFSRVQETYYSHLDAFVRHLGGEKVAGLPGLIDGLRAQAIAEAAQLSLTRGEFVEVEWVTV

SEQ ID NO: 152774 - protein, 150 aa, Glycine max
  Coding DNA Sequence Number=SeqID_35996
  Gene Ontology: Cellular component=exocyst; Biological process =exocytosis
  Homolog annotation: Hit_ID=Q69P90; Match level="QueryCoverage=75%, HitCoverage=18%, E-value=1e-22, Identity=49%"; Hit description =Putative leucine zipper-containing protein
MTLNQTRRQYPASNSSRTFHRLHEASVVDGSYDAVEDLLTELLLARKESSNPDLGDFYPASDFVLELLLLEALNVSDVELFDVELAKARVHKGFSHAIVDLDALAEVTGEELALSDAAEVIDGVEGNQINLVDAASGTVTAVVNGVAEMI

SEQ ID NO: 152775 - protein, 520 aa, Glycine max
  Coding DNA Sequence Number=SeqID_35997
  Gene Ontology: Mol. function=binding; Cellular component =intracellular; Biological process=protein kinase C activation
  Homolog annotation: Hit_ID=Q1T411; Match level="QueryCoverage=88%, HitCoverage=84%, E-value=0.0, Identity=64%"; Hit description =Pentatricopeptide repeat
  Pfam annotation: Domain name=PPR; Domain location=122-156; Score =15.8; E_value=0.1; Accession=PF01535.11; Description=PPR repeat
  Pfam annotation: Domain name=PPR; Domain location=192-226; Score=9.5; E_value=0.57; Accession=PF01535.11; Description=PPR repeat
  Pfam annotation: Domain name=PPR; Domain location=254-288; Score =37.9; E_value=3.5e-08; Accession=PF01535.11; Description=PPR repeat
  Pfam annotation: Domain name=PPR; Domain location=341-374; Score =21.2; E_value=0.0038; Accession=PF01535.11; Description=PPR repeat
  Pfam annotation: Domain name=PPR; Domain location=411-445; Score=4.3; E_value=2.3; Accession=PF01535.11; Description=PPR repeat
  Pfam module annotation: Pfam domain module=PPR::PPR::PPR::PPR::PPR; Domain location=122-156::192-226::254-288::341-374::411-445
MAIKLSASENRENQAPNEWPEESPRANGSHSETLFARAPSPSPSPTTILHQRRLSLFSHFDALLQNSCRNARHLLQMQALLVTSSLFRNPFLARTVLSRASHLCNFAYTLLIFRTINSLGTFCVNTVIKSYCNSHAPREAIVFYFRSLMCGFFPNSYTFVPLVASCAKMGCIDSGKECHAQATKNGVDSVLPVQNSLIHMYACCGDVQLARVLFDGMLSRDLVSRNSIIDGIMMVGELNAAHRLLNEMPDRNLVTWNVMISGYLKGRNPGYAMKLFREMGRLGLRGDARTMEGKSVYGSIVRMLVRSSLILDTVLIDMYCKCRKVEDARRVFERMGERNLVSWNAMILGHCIRGSPEDGLGLFDVMIGMGKMKYGVESDETPRLLPDEMLAEGRSFFKQMTDAFGVKPNYAHFWCMANLLANLGLVGEAEEFLRSIAEFDGDMSRESLAWASLLGLCHFKRDAYLGERIAKILIEMDPKNRACYQFLLIIYAVSAQWQNVSGVQKLIKERRLGIIARSSL

SEQ ID NO: 152776 - protein, 123 aa, Glycine max
  Coding DNA Sequence Number=SeqID_35998
MQPLTETRSLPQRWNNKMELQVLNANNEPPNARQTNFHGKQTAPTGEEARTSSQKQPNDIGKRNICIAHHKKWNRETGLDTYPKERAPTMRLIHSFFVDKKNEAMHWPDREQECFPQVNPYQV

SEQ ID NO: 152777 - protein, 142 aa, Glycine max
  Coding DNA Sequence Number=SeqID_35999
  Gene Ontology: Mol. function=nucleic acid binding; Biological process= DNA integration
  Homolog annotation: Hit_ID=Q1RWP6; Match level="QueryCoverage=68%, HitCoverage=9%, E-value=9e-22, Identity=50%"; Hit description=Zinc finger, CCHC-type; Polynucleotidyl transferase, Ribonuclease H fold
MGHSQQKVCQQDSCQIMYMKERLTHFTKGSRSTIDYLHGIKSMVDELAIINAPLGDVDLVIHTLNGLGVKYKEFESYFKRDDNNNDTSFVATAHATHKGAAWVEVKVLPVGGSCCGGWFVVKGTLGTRVGDAGFPEWVDPYV

SEQ ID NO: 152778 - protein, 233 aa, Glycine max
  Coding DNA Sequence Number=SeqID_36000
  Gene Ontology: Mol. function=receptor activity; Cellular component =integral to membrane; Biological process=red or far red light signaling pathway
  Homolog annotation: Hit_ID=Q6R8G0; Match level="QueryCoverage=69%, HitCoverage=20%, E-value=1e-41, Identity=57%"; Hit description=PHO1 -like protein
  Pfam annotation: Domain name=SPX; Domain location=27-138; Score= -21.1; E_value=0.00012; Accession=PF03105.10; Description=SPX domain
MDESHQQKDSMVGPEDNPLQQANRNTHYEEQAEANNNYITKDPLEILQHVKVDNVPQSPISTIKKAFTDSSDNELSFSKEELRKVKEQLRLVFVEFYQKLLHLKDYSFMNLSAFSKIMKKYEKHTSRAASAAYMTVVDNSYVGSSDEVNFLLEKVESTFIRNFTHSNHKKGRKLLRQKTKTERHNTTFFTGASGNEKEQLTSDDDVGVILRRKAARELRLRFHGGGGGGSSNL

SEQ ID NO: 152779 - protein, 111 aa, Glycine max
  Coding DNA Sequence Number=SeqID_36001
MLNTTKHTTSMPSKKAISAGGVLYGAAADDDDISYSDEDTVLRSGLFAWMRGQNVKRDSRSYANGFLRVVDSGSIYEDSDAEDGKGCLCASPYEKDERTSVRTLFVVYMKA

SEQ ID NO: 152780 - protein, 274 aa, Glycine max
  Coding DNA Sequence Number=SeqID_36002
  Gene Ontology: Mol. function=zinc ion binding; Cellular component =integral to membrane; Biological process=ubiquitin cycle
  Homolog annotation: Hit_ID=Q1SZZ2; Match level="QueryCoverage=97%, HitCoverage=84%, E-value=9e-68, Identity=50%"; Hit description=Zinc finger, RING-type; RINGv
  Pfam annotation: Domain name=PHD; Domain location=64-109; Score=-0.3; E_value=0.061; Accession=PF00628.19; Description=PHD-finger
  Pfam annotation: Domain name=zf-C3HC4; Domain location=65-106; Score =34.2; E_value=4.4e-07; Accession=PF00097.15; Description=Zinc finger, C3HC4 type (RING finger)
  Pfam module annotation: Pfam domain module=PHD::zf-C3HC4; Domain location=64-109::65-106
MCKYCFSGVINTWASQPIISSSLIRLTPFRSPPRGLDPKLLQVFPTFPYASIKDLSKDQKYDLECAICLLEFEDDNMVRLLTLCCHVFHQDCIDLWLRSHKTCPVCRRHLDSPPNEIEKVVDVNEGVVVTSTSREIHIDVTEGKLDGCGDDDDDDTSGGNKKQEHEHGHENHEVITHQQGGKTFARSHSTGHSIVLIRRDGNKEKNDHEKYTLILPEHVLRERHNNKHNCTRSCVSYKDMAMLVAPLPVAPYSNCGFVQPVSPAGTSSPDHTRK

SEQ ID NO: 152781 - protein, 254 aa, Glycine max
  Coding DNA Sequence Number=SeqID_36003
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=7e-37, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GCTPSPIRGLHVLAITWLHALTIKELHVLAFKGLHALAFRGLHVLAIRGLHVRAFRGLHALTLGGLHVLTIRGLHALAITRLHVLAFKGQHVQTFRGLHVLPIKGLHPSPSEDYTPSPLENYTGLHVLAIRGLHVLAIRGQHALAFRGLHVLAIRGLQALTFRGLHVLAISGFQVLAIKGLHALTFKELHVLAFRGLHALTFRGLHILVFRGLHVLAIRGLHALAIRGLHVLAITWLHALTFRGLHVLAIRELH

SEQ ID NO: 152782 - protein, 115 aa, Glycine max
  Coding DNA Sequence Number=SeqID_36004
MTPTHDALLYFNGSWNMPRQHDFVGYSFTRKNPKRFDIPSGCSIDGLKDVIKKVALQGIPPYGIHESQMLKIDDDMLKVLVQSNYWKQFGPIEILAVFSKLVIIMEDNMSRLQHD

SEQ ID NO: 152783 - protein, 606 aa, Glycine max
  Coding DNA Sequence Number=SeqID_36005
  Gene Ontology: Mol. function=oxidoreductase activity; Cellular component=mitochondrion; Biological process=electron transport
  Homolog annotation: Hit_ID=Q2HTY1; Match level="QueryCoverage=99%, HitCoverage=100%, E-value=0.0, Identity=74%"; Hit description=FAD -dependent pyridine nucleotide-disulphide oxidoreductase; Calcium- binding EF-hand
  Pfam annotation: Domain name=Pyr_redox; Domain location=217-325; Score=74.7; E_value=2.9e-19; Accession=PF00070.17; Description =Pyridine nucleotide-disulphide oxidor
  Pfam annotation: Domain name=Pyr_redox_2; Domain location=53-372; Score=95.5; E_value=1.6e-25; Accession=PF07992.4; Description =Pyridine nucleotide-disulphide oxidor
  Pfam annotation: Domain name=efhand; Domain location=378-406; Score =23.9; E_value=0.00056; Accession=PF00036.22; Description=EF hand
  Pfam module annotation: Pfam domain module=Pyr_redox::Pyr_redox _2::efhand; Domain location=217-325::53-372::378-406
MSSITFFQHLSRAFRDNQSHLKLVLLCTAVSGGGLWAYGESVAPEEAVSEKKKVVVLGTGWAATSFMKNLKNPKYEVQVVSPRNYFAFTPLLPSVTCGTVEARSIVEPVRNIFKKKVDVQFSEAECFKIDAENRKVYCRSSVNNNLNGKEEFVVDYDYLIVAVGANVNTFNTPGVTENCHFLKEVEDAKKIRRTVIDCFERANLPDVSEDEKKRILHFAIVGGGPTGVEFAASLHDFVNEDLLRLYPGIKDLVKITLLEAGDHILGMFDKRITTFAEDKFRRDGIDVKTGSMVVKVSEKEISTKELKNGGEIKTIPYGMAVWSTGIGTRPFIKDFMAQIGQASRRALATDEWLRVEGCSNVYALGDCATINQRKVMEDIVAIFKKADKESSGTLTVKQFQEVMKDICERYPQVELYLKNKQMHNIADLLKEAKGDDKKESIELNIEELKTALSKVDSQMKFLPATAQVHAIICLWHSQRLHLSKALTWPSVLIGWKSVKKILRVLSGSGEKVTIGSNPLGFPFANVFTHSHIVDCSPRYKHLGQFAPLGGEQTAAQLPGDWVSIGHSSQWLWYSVYASKQVSWRTRALVVSDWTRRFIFGRDSSSI

SEQ ID NO: 152784 - protein, 203 aa, Glycine max
  Coding DNA Sequence Number=SeqID_36006
  Gene Ontology: Mol. function=DNA binding; Cellular component=nucleus; Biological process=regulation of transcription
  Homolog annotation: Hit_ID=Q4BX02; Match level="QueryCoverage=85%, HitCoverage=43%, E-value=1e-28, Identity=42%"; Hit description =Hypothetical protein precursor
MGIDLLAGVEAVISHLVVKEFQIPCAHAPAMSPLPMSLSLSPKSAAEECRFGNYGVDNLCQIKSIGYTFLPCVLAGLSNAPQYLVMDSKCLEKGCILASDVDSVILPKDACGGDASLAFARNKNKKPLIITVEENQTVLDDTADKFGLEVLHVSNYWEAIGVIAAHKAGIDPFSLRRDKILNIGCSSFMPINGHSIPRERVVS

SEQ ID NO: 152785 - protein, 175 aa, Glycine max
  Coding DNA Sequence Number=SeqID_36007
MIRIEALRWALDRVLGRVLGGQITDDEKEVPQCRRLTTFACRQQTTVAVAKNVDHVDHAADELHEQPRELVTDHEHTELKLTFHGRKVGKFGRSALEIEGIVTATELSSLIICLLETSAFHTFDAIDVDKVVDLLIELLEANTQEARDEIEQCKWAYVCLASLRDIYRSKYDTRQ

SEQ ID NO: 152786 - protein, 76 aa, Glycine max
  Coding DNA Sequence Number=SeqID_36008
MDGSKGHGYFGQCGGNRATQSVGCFCLERRGTMQVQREREGSEQAMVNLSILKVILDMRHKRYANYGSTKRQGRFI

SEQ ID NO: 152787 - protein, 95 aa, Glycine max
  Coding DNA Sequence Number=SeqID_36009
  Homolog annotation: Hit_ID=P75991; Match level="QueryCoverage=81%, HitCoverage=100%, E-value=2e-18, Identity=60%"; Hit description =Hypothetical protein ycgZ
MAAINDGGEHSGAHMQQNGYIPDTANAIAQYFNKASLPSQQETLGEIVMDILTEGRHLNRKALCTKLLSRLDVARAPEEENHYQTLIGLLFERQE

SEQ ID NO: 152788 - protein, 172 aa, Glycine max
  Coding DNA Sequence Number=SeqID_36010
RTTRPRLHRAADLRLQRTQGPPPLMVNRGLRSRPKREAIVKLLCIPGQDFTQPLQGDEYGSCTPPQLRSPPAGVSVGIVPTRHPVDVEKSNMALGFLALVVGLCQSYRVLVPPARSCHRDIGIAPIRHSVGPEKSSRVLGFPALTTSLSQFYGVPVAPNKVIRPPTNRAFIR

SEQ ID NO: 152789 - protein, 213 aa, Glycine max
  Coding DNA Sequence Number=SeqID_36011
  Homolog annotation: Hit_ID=Q1S7U5; Match level="QueryCoverage=98%, HitCoverage=27%, E-value=2e-68, Identity=60%"; Hit description =Calcium-binding EF-hand; Tesmin/TSO1-like, CXC
  Pfam annotation: Domain name=CXC; Domain location=11-52; Score=81.8; E_value=2.1e-21; Accession=PF03638.5; Description=TesminTSO1-like CXC domain
DDPNKTPASARHKRGCNCKKSSCLKKYCECYQGGVGCSISCRCEGCKNTYGRKDGSVPSGLEAEPEEETEACEKGVVENASLKTETKNTEDHPDQSLATTPLPLSRSLLPLSFSSKCKPPRSSVITISSSGLLVGQKLGKSNAPWSQSQPKCEKPLETVPDDDSSVTCIKTSSPNGKRISSPNCKVGSSPTRRGGRKLILQSISSFPSLTPHH

SEQ ID NO: 152790 - protein, 1804 aa, Glycine max
  Coding DNA Sequence Number=SeqID_36012
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=99%, E-value=0.0, Identity=54%"; Hit description =Prefoldin
  Pfam annotation: Domain name=KIP1; Domain location=14-87; Score =180.1; E_value=5.6e-51; Accession=PF07765.3; Description=KIP1-like protein
MATLLHSESRRLYSWWWDSHISPKNSKWLQENLTDMDAKVKAMIKLIEEDADSFARRAEMYYKKRPELMKLVEEFYRAYRALAERYDHATGELCQAHKTMAEAFPNLLTDDSPCNSSDTGAEPPHTPEMPHGPHPIRALLDSVNLQKDSFGFSLIQNTLKMNGESLEESANGLSRKGLKQLNEIFGLSQLSAEKQNVKAQNHAESERSQKAENEVQTLKKVLEDIQSDKDSIFLQHQKSLEKLSEMERELNKAQKDAGGLDERASKAEIEITVLKEALAELKYEKDAGLVQYKQCVERIASLETMLSLAQMDAKGNDERAAKAETEAKNLKKELATLEAEKDAAHLQYNQCLEKISVLEAKIAHADEYSRKLNEQIERTELEVKSLRKDIAELNGEKEAVTVLYKQCLQKISTLESEILLAQEISERLNREIESGAEKLKTAEKHCDMLEKSNRSLQLEADVLLQKISLKDEKLLEKHTELERLQTLMHAEKSRFLHIESTLHTLQKSYSQSHEEQRSLALELKHGLQLLEDLELSKQSFKEEMQQIMEENRTLHELNFSSTRSLKNQQMEISELKKIKEKLEREFAVKVEESNVLQWESHQIKDEILGLNNRYQAILEELGSVGLNPKSFAASVKDLQKENTMIKEACKMERDEKEALHEKSKDMDKLLSENAYMGSSLSNLKDELHGLRDTVKKFQESCGVLREEKSILAAEKSSLLSQLQIITESMQNLLEKNTLLEKSLSDAKIELEGLRAKSSSLEEFCNLLNNEKHNLLNERNVLVSQLEGVEAKLGNLEKRFTKLEEKYSDMEKDKESQVCQVEELHALLLAQKEKHANHKHSSEARMANLENLVLRLQEERRLGKIEFEEELDKAVNAQVEMFILQKCVEDLEQKNLGLLIECQKHMEASKFSDEVISELESENLMQQMELEFLLDEIRKFKMGIHQVLAALQIDSGGGHGKGIKQEEMPISHIFNNIEGLKGSLVKTQEEKLQLLVENSILLTVLLQQESEGEELVLEKRILEQEFENTREQHAMLQKVKLELLEMNKQLRSEVTKGEEKESELQPKLEALQVELIDLQRTNLVFEEENCKLLEEKNLLLGSVLELKDAKFAAEQENSVILHEALALKNLSLVYESFFTEKVLEQRALAEHLSDLHSVNSDLKQELVLLREKFEVKESENVYLKESVERMDKDLHEAKTENDHFNCQIESSEHLLEKKNVELLEMEGRLKAAEMLSAEFCRDIEKLKMEKQQSRLINENLERQILELSEGCMNHKREIEHLNEANRSLQSEMRCLRQEVEQQRAREETLSSELLDKTNEFELWEAEAATFYFDLQISSISEALLENKVNELTGVCMRLEDESDAKSLEIKQMTERVSLLESEIGGLKGQLSAYNPVISLLKEDFASLEHTALVRINKMPVECNQEQNDAVIETCLQGNGYQSSTDNKSALIPDGVSDLLSVKARIRAVEKSMVEEIERHVKEQNLTTTANLGALTKVPNVENRNRKELKDESTHDVNSWRTRTENGSLMKDIPLDHISDNSASKSGRRENSGADDQMLELWETAEQDCFDSPMVSEAMKQSSVPTEDVITYHQSDHSGKFQNTSSELDVEKELGVDRLQLSRSIKERTQDGKRRKILERLSSDAQKLTVLKTAVQDLKQKTETKKRSKKGAGTEYETVKRQIDEVEGAVVKLVDTNDQLTKDLEESAPSLNRQTSVELEKSRHIQRKRITEQARKGSEQIGRLQFEVQNIQYTLLKLADESKGKSRFTGKTVVLLRDFIHSGSKRTSKKRNKGFCGCSRPSTDEH

SEQ ID NO: 152791 - protein, 472 aa, Glycine max
  Coding DNA Sequence Number=SeqID_36013
  Homolog annotation: Hit_ID=Q1S7U5; Match level="QueryCoverage=97%, HitCoverage=59%, E-value=1e-110, Identity=49%"; Hit description =Calcium-binding EF-hand; Tesmin/TSO1-like, CXC
  Subcellular localization annotation: CTP_CleavageSite=97; ConfidenceScore=5.09e-01
MDTPDRSKINTPLSQFEDSPVFNYISNLSPIEPVKSVHLTHTFNSYSFSSPPSVFTSPHGNCHKESRFLKRHNLLETSKPKVWSEDVNSVYSSEETLADSTQACHESSEQQENTAQKISIGDASIEPCNENPNISIELPQVLKCNLGSPGYEPLLCCDEANSLLELPGNGKPASDVAYVPEGSEKDSIEGEMHLLGLCQIEEAKVEGPNCGVDSLITEVSDLLMLSPPNVTEAFKGLNKQLNPSIELGNFMTLIPQSATNDGQQMHIGNAVASGSEHEIEDHPSESAAATGTGQRQDNLANVALVASHPSENMDNKLVYARHRGIRRRCLDFEMAIVQWKNPADNSNTNSSTAISDEGNVGNEKQLLPTKHSGDSRRCVLPGIGLHLNALASLKDCKNVKIENLSSGRQPNLHCSPSSVQLSASQELQLSLVPASSEIDLVPSENEVQPGEDFQQNSPKKKRQVQLLIINSA

SEQ ID NO: 152792 - protein, 653 aa, Glycine max
  Coding DNA Sequence Number=SeqID_36014
  Gene Ontology: Mol. function=kinase activity; Cellular component =mitochondrion; Biological process=protein amino acid phosphorylation
  Homolog annotation: Hit_ID=Q2HTV1; Match level="QueryCoverage=96%, HitCoverage=99%, E-value=0.0, Identity=79%"; Hit description=Protein kinase-like
  Pfam annotation: Domain name=ABC1; Domain location=298-424; Score =133.3; E_value=6.8e-37; Accession=PF03109.7; Description=ABC1 family
MSYLIKFSMYPFLECNIMQYLSGNKRYLMLRNIRRAAQSVCRINRRYLEVSENGAVALVGPNIHHCRLYMQYKFPSEACSSFLWHGTREGFRKCGSFRNFSVTSASNAVTHHSQIAWKRLYRKYCSSGDGTFPPTVNMIAQAVSLALARSYFLVPGILAFTWGELALAQRNWAEAERYPSQNGLYMRAQDGYNYMFTFTFIIVEGLILLMRALYLAILFSPSIVMAPFADCFGPNFRKLWLNVVHRTLEKSGPAFIKWGQWAATRPDLFPRDLCTKLSELHTKAPEHSFSYTKKTIERAFGRKISEIFDNFEELPVASGSIAQVHRASLKCRYPGQQAKPLLVAVKVRHPGVGESIRRDFAIINLAAKISKFIPALNWLRLDESVQQFAVFMMSQVDLAREAAHLSRFIYNFRRWKDVSFPKPVYPLVHPAVLVETYEKGESVSYYVDDLQGHERVKSALAHIGTHALLKMLLVDNFIHADMHPGNILVRVSQSKSRKRLFKSKPHVVFLDVGMTAELSGSDRVNLLEFFKAVARRDGRTAAECALNLSKQQNCPNPEAFIEEVEESFTFWGTPEGDIVHPAECMEQLLEKVRRHRVNIDGNVCTVMVTTLVLEGWQRKLDPGYNVMQTLQTLLLRADWAKSLSYTIDGLMAP

SEQ ID NO: 152793 - protein, 368 aa, Glycine max
  Coding DNA Sequence Number=SeqID_36015
  Gene Ontology: Mol. function=DNA binding; Cellular component=nucleus; Biological process=regulation of transcription
  Homolog annotation: Hit_ID=Q0PJF3; Match level="QueryCoverage=53%, HitCoverage=100%, E-value=1e-112, Identity=99%"; Hit description=MYB transcription factor MYB77
  Pfam annotation: Domain name=Myb_DNA-binding; Domain location=14-61; Score=43.2; E_value=8.6e-10; Accession=PF00249.21; Description=Myb -like DNA-binding domain
  Pfam annotation: Domain name=Myb_DNA-binding; Domain location=67-112; Score=48.2; E_value=2.7e-11; Accession=PF00249.21; Description=Myb -like DNA-binding domain
  Pfam module annotation: Pfam domain module=Myb_DNA-binding::Myb_DNA -binding; Domain location=14-61::67-112
MGRAPCCDKNGLKKGPWTTEEDQKLIDYIQKNGYGNWRTLPKNAGLQRCGKSCRLRWTNYLRPDIKRGRFSFEEEETIIQLHSILGNKWSAIASRLPGRTDNEIKNYWNTHIRKRLLRMGIDPVTHSPRLDLLDINSILNASFYGSSQINIQRLLGMHQYMVNPELLKLASSLFSTSQQQHNDPDDMPAQKGQLQNQLCDPQIQNHVPHFVQFQDPVQEVPACSTMFSTPCVSIPLTQPQLVEPNNVDQYPSSTFTDFSYQQLSDWQLSSLTDDYVPQLSSYNYYSSDGQNLMYDPLSEPSNFHSNNSNQNFRFASVLSTPSSSPTPLNSNSTIINGSNTEDERDQSYDSSNMLKFEIPDILDVNEFM

SEQ ID NO: 152794 - protein, 334 aa, Glycine max
  Coding DNA Sequence Number=SeqID_36016
  Gene Ontology: Mol. function=inositol or phosphatidylinositol phosphatase activity; Cellular component=mitochondrion; Biological process=sulfur metabolic process
  Homolog annotation: Hit_ID=Q9M0Y6; Match level="QueryCoverage=96%, HitCoverage=96%, E-value=7e-82, Identity=46%"; Hit description =Putative PAP-specific phosphatase, mitochondrial precursor (3'(2') ,5'- bisphosphate ...
  Homolog annotation: Hit description=nucleotidase) (EC 3.1.3.7) (3'(2'),5-bisphosphonucleoside 3'(2')-phosphohydrolase)
  Pfam annotation: Domain name=Inositol_P; Domain location=41-333; Score=19.1; E_value=2.7e-07; Accession=PF00459.15; Description =Inositol monophosphatase family
  Subcellular localization annotation: CTP_CleavageSite=29; ConfidenceScore=5.10e-01
MAMDILRSPVSAVRLFNGGATRSRRFNVRATLPFPQQNAKHYKELQAAIDVVQRACRLCLNVKSSLFSTDGKVLEKNDQTPVTVADFGVQALISFGIENFGFISYVVVKTELNKLFPSIPLVAEEDSAFLRTRNLAGTVLDAVTDTASSTCKPLTQDDVLEAIDRGGKDAFVFGSKPATYWVLDPIDGTRGFLKAGKALYVVGLALVVEGEIVIGVMGCPNWKEDLSEKSSVEIEEGWDSLGGSGTVMIAHKGCGTWMKSLNSQLKSSGAWDHAVGIICVHEAGGKVTDWKGSDIDLAADHVGRRIIFPSGGVLVANGNLHNKILQIINQTSRV

SEQ ID NO: 152795 - protein, 215 aa, Glycine max
  Coding DNA Sequence Number=SeqID_36017
  Homolog annotation: Hit_ID=Q2HTV0; Match level="QueryCoverage=44%, HitCoverage=6%, E-value=3e-17, Identity=47%"; Hit description=Zinc finger, RING-type; Transcription factor jumonji, jmjC; Zinc finger, C2H2-type
  Pfam annotation: Domain name=WRC; Domain location=14-59; Score=59.2; E_value=1.3e-14; Accession=PF08879.1; Description=WRC
MGKKSSPAEGEEAVPEHLRCSRTDGRQWRCRRRVKENLKLCEIHYVQARRRQHKKTLKLKRKRQNDAVEVQIGAKRDRKSREALVNRRNQLELIRMVLQREVEKKKKKQSQLNLNLHLHFNHELKKELPNGVMAIASNMASSRYFRSKNAERGSVSCAVWTKHKEGEEEEVSLVSENHSPFVKGGLLWWCHRLQWRVYMAEFWPFTITAIVNIGS

SEQ ID NO: 152796 - protein, 697 aa, Glycine max
  Coding DNA Sequence Number=SeqID_36018
  Gene Ontology: Mol. function=metal ion binding; Cellular component =nucleus; Biological process=regulation of transcription, DNA -dependent
  Homolog annotation: Hit_ID=Q2HTV0; Match level="QueryCoverage=99%, HitCoverage=73%, E-value=0.0, Identity=60%"; Hit description=Zinc finger, RING-type; Transcription factor jumonji, jmjC; Zinc finger, C2H2-type
  Pfam annotation: Domain name=C1_3; Domain location=108-136; Score =9.9; E_value=0.035; Accession=PF07649.3; Description=C1-like domain
  Pfam annotation: Domain name=JmjC; Domain location=600-696; Score= -6.4; E_value=0.0024; Accession=PF02373.13; Description=JmjC domain
  Pfam module annotation: Pfam domain module=C1_3::JmjC; Domain location=108-136::600-696
MRLRWHVQFVEELAPVKIACQVNTKRVKEYLAGKNRVDRILHFHYLVCMLLPVLKQIKEDHHVGVEKTAKIKGGNYGSSDMMASRLQPGKRTSDIIIKPVDFVCNEKNYCNYCKTPILDLHRSCLSCSYSLCLSCSQALSQGSTSEEINSSISNLPDKINACIFSEGHLLDDKVISNGNLTDTSTLVEWTNCNGADIVSCPPTKLGDCGDSHLDLKYVFPLSWIKEMEVKAEEIVCSYDFPETLDRSSSCSLCVDKDHKTSRYKQLPEAAQREDSNDNFLFYPTILDISCNHFEHFRKHWGIGHPVVVRDVLQSMPNLSWDPLVMFCTYLERSMTRYENNKDLLEACLDWFEVEINVSQYFTGSLKCQPQKNNWHEMLKLKGWLSSQLFKEQFPAHFAEVIDSLPIQEYMNPWSGLLNLAANLPQGSTKHDIGPHVYISYGCADEEADSVTNLCYDSYDMVNIMAHTMDIPLSTDQLAKISKLLKKHKTLCQKVSSSKTTSEHSEDREQNEMHGMVREGTDFLRRVNRTASISTEAKPISNQKLDTNISDDEECGSDSETEKAQSSLPFQRRVLSTEMSPDHNPRNPFENSNSDKRKKFTENSGAHWDVFRRQDVPKLLEYLKRHSDEFSYNSECHEKMVHPILDQSFFLDNTHKMRLKEEFKIEPWTFEQHVGEAVIIPSGCPYQIRNPKVSVTIV

SEQ ID NO: 152797 - protein, 318 aa, Glycine max
  Coding DNA Sequence Number=SeqID_36019
  Gene Ontology: Mol. function=nucleoside transporter activity; Cellular component=membrane; Biological process=transport
  Homolog annotation: Hit_ID=Q69S29; Match level="QueryCoverage=98%, HitCoverage=75%, E-value=1e-114, Identity=64%"; Hit description =Putative equilibrative nucleoside transporter ENT8 splice variant
  Pfam annotation: Domain name=Nucleoside_tran; Domain location=18-313; Score=43.2; E_value=1.5e-12; Accession=PF01733.8; Description =Nucleoside transporter
LDLATSGKGGIGPYIGLCALSACFGVADAHVQGGMVGDLSFMCPEFIQSFFAGLAASGALASGLRLLTKVGFEKSDHGLRKGAMLFFAISTLFEFFCVILYAIYFPKLSIVKYYRSKAASEGSKTVSADLAAAGIHNDTNLQVGFDAKQQERLSNKQLILQNMDYAADLFLIYVLTLSIFPGFLFENTGSHQLGTWYPLVLIAMYNLLDLISRYIPLIKCLKLESRKGLLIAVLSRFLLVPAFYFTAKYGDQGWMILLVSFLGLTNGYLTVCVFTVAPQGYKGPEQNALGNLLVLFLLIGIFSGVALDWLWLIGKSGF

SEQ ID NO: 152798 - protein, 407 aa, Glycine max
  Coding DNA Sequence Number=SeqID_36020
  Gene Ontology: Mol. function=nucleoside transporter activity; Cellular component=membrane; Biological process=transport
  Homolog annotation: Hit_ID=Q69S29; Match level="QueryCoverage=97%, HitCoverage=98%, E-value=1e-136, Identity=58%"; Hit description =Putative equilibrative nucleoside transporter ENT8 splice variant
  Pfam annotation: Domain name=MFS_1; Domain location=22-397; Score= -43.3; E_value=0.03; Accession=PF07690.6; Description=Major Facilitator Superfamily
  Pfam annotation: Domain name=Nucleoside_tran; Domain location=115 -402; Score=34.5; E_value=4.7e-12; Accession=PF01733.8; Description =Nucleoside transporter
  Pfam module annotation: Pfam domain module=MFS_1::Nucleoside_tran; Domain location=22-397::115-402
MDANDDSGAPRQPEGKYKAMAICFILGIGSLVSWNSMLTIGDYYYILFPKYHPARVLTLVYQPFAIGTMLILAYYESKINTRMRNLAGFTLFFFSTFFVLVVDLASSGKGGLGPYIGICVLAACFGIADAQVEGGIIGELCFMCPEFIQSYLAGLAASGALISILRMLTKVAFEKSNNGLRKGAILFLAISTFIELVCIILYAICFTKLPIVKYYRSKAALEGSKTVAADLAAAGIQTKTNDQGGYDSKKEERLSNKQLFVENLDYAVDLFLIYVVTLSIFPGFLYENTGTHQLGTWYPVVLIAMYNVVDFIARYIPLVPWLKLESRKGLLIAVFSRFLLIPAFYFTAKYGDQGWMILLTSFLGLTNGYLTGPEQNALGNLLVLCLLSGIFAGAVLDWLWIIGKGTF

SEQ ID NO: 152799 - protein, 218 aa, Glycine max
  Coding DNA Sequence Number=SeqID_36021
  Gene Ontology: Cellular component=plastid; Biological process =peroxisome organization and biogenesis
  Homolog annotation: Hit_ID=Q2QQS3; Match level="QueryCoverage=97%, HitCoverage=39%, E-value=1e-42, Identity=43%"; Hit description =LILLIM08, putative, expressed
MICRAWGTVCLSLAFVWQLYAIFLLVQLHESVPGIRHSRYLFLAMAAFGKKLGKVAALFPVMYLSGGTCVMIIITGGGTLKQLLKTLCDNDDHVHEQITCNAHALSGAEWFLVFTCVAILIAQLPNLNSMAMVSLVGAVTSVTYCTLFWVLSVKNGRPNNVSYSSSLQSQEHTPVAKINDVLNAIGIIVLAFRGHNVLPEIQASISSLHTLVYSIHIA

SEQ ID NO: 152800 - protein, 601 aa, Glycine max
  Coding DNA Sequence Number=SeqID_36022
  Gene Ontology: Mol. function=hydrolase activity, acting on glycosyl bonds; Cellular component=membrane; Biological process=metabolic process
  Homolog annotation: Hit_ID=Q9SW48; Match level="QueryCoverage=53%, HitCoverage=73%, E-value=1e-113, Identity=80%"; Hit description =Invertase-like protein
  Pfam annotation: Domain name=ER_lumen_recept; Domain location=423 -587; Score=-21.3; E_value=1.7e-12; Accession=PF00810.9; Description =ER lumen protein retaining receptor
  Pfam annotation: Domain name=Invertase_neut; Domain location=25-371; Score=518.4; E_value=8.1e-153; Accession=PF04853.3; Description =Plant neutral invertase
  Pfam module annotation: Pfam domain module=ER_lumen_recept::Invertase_ neut; Domain location=423-587::25-371
  Subcellular localization annotation: CTP_CleavageSite=49; ConfidenceScore=5.51e-01
MSTTIIGTTKGEVLFVSSSSSASPEKSFGAHRRSKATAKIRTTLGVFVRDFVPSALVFLTKGEPEIVRNFILKTLRLQSWEKTIDKFHLEEGVMPASFKVLHDPVRNHETLIADFGESAIGRVSHIDSGFWCAYTKSTGDNSLAELPECQKGMRLILNLCLSEGFDTFPTLLCADGCCMIDRRMGVYGYSIEIQSLFFMALGCALLLLKEDAEGEEFRERITTRLHALSYHLRSYFWLDLKQLNDVYHFKTEEYSHTAVNKFNVIPDSLPDWVFDFMPLKVLLWLLVAASIKTGRPHIAKRALEIAETRLLKDNWTEYYDGKLGRYIGKQARKYQTWSIAGYLVAKMFLDDPSHLGMVALEEDKHQKPHWESISDPMRPQRTSIHAVTTWVRRQPPKVKAFLAVVSGMAALVLLRFIVHDHDNLFVAAEAVHSLGISVLIYKLMKEKTCAGLSLKSQELTAIFLAVRLYCSFVMEYDIHTLLDFATFVTTVWVIYMIRFKLKASYMEEKDNFAIYYVIVEPFTAHYVFALGVARFLSCAHWVLQVLDSRGHLLVALGYGLWPSMVLISEIVQTFILADFCYYYVKSVFGGQLVLRLPSGVV

SEQ ID NO: 152801 - protein, 331 aa, Glycine max
  Coding DNA Sequence Number=SeqID_36023
  Gene Ontology: Mol. function=transporter activity; Cellular component= integral to membrane; Biological process=transport
  Homolog annotation: Hit_ID=Q8W1A7; Match level="QueryCoverage=58%, HitCoverage=70%, E-value=1e-14, Identity=29%"; Hit description =Aquaporin-like protein
  Pfam annotation: Domain name=MIP; Domain location=43-279; Score=33.7; E_value=4.9e-12; Accession=PF00230.10; Description=Major intrinsic protein
MDSANSHVVVKQLPCSVQSSKPICLMGKNSLKRKCFASIGAHEIFRPEMWKAALTELTATASLMFTLTTSIIACLDSHEIDPKLLVPFAVFTIAFLFLIVTVPLTGGHMSPVFTFIAALKGVVTLTRALIYVLAQCIGSIIGFFILKCVMDPKLAYTYSLGGCAISGQGVINSSSGGIKPLDALLVEFTCTFVVLFVGVTLAFDKKRSRDLGLPMVCLVVAGAMALAVFVSITVTGRAGYAGVGLNPARCLGPALLHGGLLWEGHWVFWLGPFLACVVYYAVSINLPREGLVWVDGEYDVLKLALGSCGNVYNTSVSKDHQLEEPSAGFQV

SEQ ID NO: 152802 - protein, 52 aa, Glycine max
  Coding DNA Sequence Number=SeqID_36024
  Homolog annotation: Hit_ID=Q5NTA6; Match level="QueryCoverage=92%, HitCoverage=63%, E-value=2e-07, Identity=43%"; Hit description =Putative amino acid transporter-like protein
MTLVPITYAYPCFMWLSLKKPRPRGMLLSALLVAAAIRTLALNGLDANFFKP

SEQ ID NO: 152803 - protein, 602 aa, Glycine max
  Coding DNA Sequence Number=SeqID_36025
  Gene Ontology: Mol. function=oxidoreductase activity; Cellular component=cellulose and pectin-containing cell wall; Biological process=lignin catabolic process
  Homolog annotation: Hit_ID=Q1RXS8; Match level="QueryCoverage=86%, HitCoverage=95%, E-value=0.0, Identity=72%"; Hit description =Multicopper oxidase, type 1
  Pfam annotation: Domain name=Cu-oxidase; Domain location=222-359; Score=205.7; E_value=1.1e-58; Accession=PF00394.12; Description =Multicopper oxidase
  Pfam annotation: Domain name=Cu-oxidase_2; Domain location=439-579; Score=152.7; E_value=9.8e-43; Accession=PF07731.4; Description =Multicopper oxidase
  Pfam annotation: Domain name=Cu-oxidase_3; Domain location=96-212; Score=195.0; E_value=1.8e-55; Accession=PF07732.5; Description =Multicopper oxidase
  Pfam module annotation: Pfam domain module=Cu-oxidase::Cu-oxidase _2::Cu-oxidase_3; Domain location=222-359::439-579::96-212
MMLDNSKDVVDVLPTSQEHYNNMLNSIEEYKKQVVLHNVVEACFKFNVSSLTSALKHLMRSLRWCRVTGVLGRRRNWYGRGAFVAAEDPYRFFDWTITYGDIYPLGVKQQVILINGQFPGPEIYSVTNDNLIINVHNNLTEPFLLSWNGVQQRRNSYQDGVYGTTCPIPPGKNFTYTLQVKDQIGSFFYFPSLAFHKAAGGFGAIKILSRPRIPVPFPDPAGDFSLLIGDWYQINHKKLQSVLDFGHRLPFPQAVLINGRPSGTTFTVEQGKTYRLRISNVGLQNTLNFRIQGHDMKLVEVEGTHTIQTTYSSLDVHVGQSYSVLITVDQAPKDYYIVVSTRFTNKIFTSTAILHYSNSQQSVSGPIPSGPTTQIDWSIKQARSIRTNLTASGPRPNPQGSYHYGLINISRTITLVSSTAQVNKKQRYAVNSVSFTPADTPLKLADYFNIGGIFQVGSIPDSPSGRPMYLDTSVMGADFRAFVEVVFQNHENIIQSWHIDGYSFWVVGMDGGVWTPNSRNQYNLRDAVSRSTTQVYPKSWTAIYMALDNVGMWNMRSEFWARQYLGQQFYLRVYLPVGSIRDEYPIPKNALLCGKAAGRTTR

SEQ ID NO: 152804 - protein, 268 aa, Glycine max
  Coding DNA Sequence Number=SeqID_36026
  Gene Ontology: Mol. function=galactosyltransferase activity; Cellular component=Golgi stack
  Homolog annotation: Hit_ID=Q2MGS1; Match level="QueryCoverage=52%, HitCoverage=23%, E-value=2e-26, Identity=44%"; Hit description =Glycosyltransferase sugar-binding region containing DXD motif; Alpha 1,4-glycosyltransferase conserved region
MLRNLRSRRHPRYGVFLCVVVVVVSGLLLLACVTVSLLHSPHSHPSSRDFNYDSLVSDSGNDDSVADDETLDTIDTLDVVEDEPEDTIDADVDTDDEESLDQNAAASGYFFHHAEGVIRRAFSKSSFINYDNNKPFVDPTEDRSKTAFGSDDVAVEENVRSKAIQVKGVEDALLLKSTGRRVSPLREGWGDWFDKKVDFLRKDKMLRSNLEGLNPLRNPILQDPDALGLTGITKADRIIRNSLLRDLKTKKLPYFPPRKIIQYHNNLL

SEQ ID NO: 152805 - protein, 187 aa, Glycine max
  Coding DNA Sequence Number=SeqID_36027
  Homolog annotation: Hit_ID=Q9T005; Match level="QueryCoverage=37%, HitCoverage=14%, E-value=2e-14, Identity=50%"; Hit description=Amino acid permease-like protein
  Subcellular localization annotation: CTP_CleavageSite=13; ConfidenceScore=5.09e-01
MVWATREFSSTCRAWLRFSFYRSLKTVWEWSGGRVTVPGGTSRICSFLPEASPGPFSSPTASASRDTAFSRSTASQVTLRDHQRTLRLHGLPLLLRLAKGREAVVVLREEVEGLASRPLRARVRIAAATKRALRSIPTQPSATLKHQTKPLGRGFLRDSHMKQGYAYVMGTRVMLPSSADRRGRNGN

SEQ ID NO: 152806 - protein, 237 aa, Glycine max
  Coding DNA Sequence Number=SeqID_36028
  Gene Ontology: Mol. function=transporter activity; Cellular component= integral to membrane; Biological process=transport
  Homolog annotation: Hit_ID=Q7XLR1; Match level="QueryCoverage=71%, HitCoverage=56%, E-value=1e-11, Identity=27%"; Hit description =Probable aquaporin PIP2.6
  Pfam annotation: Domain name=MIP; Domain location=2-195; Score=1.5; E_ value=6.3e-10; Accession=PF00230.10; Description=Major intrinsic protein
MVELIATFCTNAHPNELQYAFPLSGGHMNPIFTFIAALKGVVTLSRALLYVSAQCIGSIIGFFVLKSVMEPKLADTYSLGGCALGDLKGKIPGIKPQDALLLEFSCTFLVLFLGLTLAFDKKRCKELGLPMVCLVVAASLALAVFVSITVTGRPGYAGAGLSPARCLGPALLLGGPLWNGHWVFWLGPFLACIIYYSVSINLPKKDLDGVDGEYDVLKLALGSCGTISNNVVINDLP

SEQ ID NO: 152807 - protein, 171 aa, Glycine max
  Coding DNA Sequence Number=SeqID_36029
  Gene Ontology: Mol. function=DNA binding; Cellular component =cytoplasm; Biological process=DNA integration
  Homolog annotation: Hit_ID=Q1T010; Match level="QueryCoverage=69%, HitCoverage=8%, E-value=7e-36, Identity=61%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=18-168; Score=53.1; E_value=9.6e-13; Accession=PF00665.16; Description=Integrase core domain
MGCSNHMTGNKHWLMNLDTSQGSKVRFVDSFLISCEDVHCMTAEGNDVNWLWHFRKSEVFAIFQKFKAYAEKQSGATLKILRKNRGEEYTSKEFEDFCESKSIVYEVTTPYTSQHNGLTERRNKTLLNMARSMLKLKGLPKELWGEAVTTVAYILNKSPTKKLEEITQEEV

SEQ ID NO: 152808 - protein, 670 aa, Glycine max
  Coding DNA Sequence Number=SeqID_36030
  Gene Ontology: Mol. function=guanyl-nucleotide exchange factor activity
  Homolog annotation: Hit_ID=Q93ZY2; Match level="QueryCoverage=84%, HitCoverage=100%, E-value=0.0, Identity=66%"; Hit description=Rop guanine nucleotide exchange factor 1
  Pfam annotation: Domain name=DUF315; Domain location=101-563; Score =685.5; E_value=4.1e-203; Accession=PF03759.4; Description=Domain of unknown function (DUF315)
MSLLSAPCHFYNKGPHISTDPMVVEDEIFPNQRMPRHELDPRVTERHSLQTAFLFLLLPPPPSHLRQRYQLTLAVPHSAASSLFTVAVTALCDINQCCEICVGTMGSVSSEDASDHMSNRCGSYSLSADVSESESCSSFSARRFDAEGASSSANLSPRPVAAHFNFPPAQVLLPVIGGKDVFVWDHKRDLDLSEVEMMKERFAKLLLGEDMSGGGKGVCTALAISNAITNLSATVFGELWRLEPLAPQKKAMWRREMEWLLCVSDSIVELVPSVQQFPGGGTYEVMATRPRSDLYINLPALKKLDGMLLSMLDGFHDTQFWYVDRGIILGDSKDCDAYGRPSVRQEEKWWLPSPKLPPNGLSEESRKRLQQCRDCTNQILKAAVAINTSVLAEMEIPGAYIESLPKNGKACLGDIIYRYLTADQFSPECLLDCLDLSSEHHTLDIANRIEAAIHVWRLKDHKKHLSSAKSRRPWGGKVKGLVADSEKNKNNFLAQRAETLLESLKHRFPGLPQTALDMAKIQYNKDVGQSILESYSRVMESLAFNIMARIDDVLYVDDSIKRCAAADSLSLFSRGGFGGMPIQKRFSPSPFSIQHTPYASPFATPTFCSSTPVTGSPCSPARIHDVKRNAPKEGADSKTDKLATSEFERVWSYAGNLSARRVSGDAPERD

SEQ ID NO: 152809 - protein, 101 aa, Glycine max
  Coding DNA Sequence Number=SeqID_36031
MGYYYCKPRPCDTRTPNVVLILAVALLLLCAPKLFSGEAEEEEETNNTSPFVVPIIVVQAEEGFVSSHHIVSVRMPATVTDSAIAVITDLISKFMCVKLNF

SEQ ID NO: 152810 - protein, 135 aa, Glycine max
  Coding DNA Sequence Number=SeqID_36032
  Gene Ontology: Mol. function=protein-tyrosine kinase activity; Cellular component=integral to membrane; Biological process=protein amino acid phosphorylation
  Homolog annotation: Hit_ID=Q6RZV9; Match level="QueryCoverage=96%, HitCoverage=58%, E-value=2e-30, Identity=45%"; Hit description =Hypothetical protein G9-6
  Pfam annotation: Domain name=Hin1; Domain location=5-132; Score=-2.5; E_value=0.0025; Accession=PF07320.4; Description=Harpin-induced protein 1 (Hin1)
MGGQSIVFENLNVQSGNDGTGVPTDMLSLNSTVRILYRNPATFFGVHVTSTPLHLSYYQLAIASGQMQKFYQSRKSQRKLAVVVLGHQIPLYGGVAFILGRLVKSKFYRRITCSVTLHGNKLGKHLNLTDSCVYK

SEQ ID NO: 152811 - protein, 61 aa, Glycine max
  Coding DNA Sequence Number=SeqID_36033
MESSFLKGLSEFSSRAFPLEKYHERPSKMKISAKINRTGYGKGIQSEAIQNSGGSASTISH

SEQ ID NO: 152812 - protein, 80 aa, Glycine max
  Coding DNA Sequence Number=SeqID_36034
MTQELVARGDTLRLSAPRHSVTPSVIDEQRPMWSSAPFPEMSASSGGDFFKSHKLSRTTSKSLAFVGHLHKFCHADTRVT

SEQ ID NO: 152813 - protein, 64 aa, Glycine max
  Coding DNA Sequence Number=SeqID_36035
  Subcellular localization annotation: CTP_CleavageSite=47; ConfidenceScore=5.08e-01
MRGSGEFVPFLDTTSRGSKMPQRTFLRRRHGPSVVSRGIILFEEHIVAVGTTSNNKFSKKKSSR

SEQ ID NO: 152814 - protein, 228 aa, Glycine max
  Coding DNA Sequence Number=SeqID_36036
  Gene Ontology: Mol. function=nucleotidyltransferase activity; Cellular component=intracellular; Biological process=regulation of growth rate
  Homolog annotation: Hit_ID=O35948; Match level="QueryCoverage=73%, HitCoverage=26%, E-value=4e-19, Identity=34%"; Hit description =Homolog of human Werners syndrome protein
MPPKQKVQQTICRRRKNNASNLTGDKGINSSIRNLLVSEVAIVPAAHGDVFGLVNLKAQDVVAQRGEPGPLQLKHLKLLRGEGAKLSDIGDAEIVVSQKLVGVFLDADPDEDDVGVVEEGGEGAWDKGRVEDLEDEAVVADAELEGGDGVGRLHVGPGVGLPFHVQAHNHEVIRVVADVGGEPGADLGGGSGDEGLDGVVTHGDFVAFVVVGAGAVFFYQYCRRNHCG

SEQ ID NO: 152815 - protein, 175 aa, Glycine max
  Coding DNA Sequence Number=SeqID_36037
  Gene Ontology: Cellular component=integral to membrane
  Homolog annotation: Hit_ID=Q1SJE3; Match level="QueryCoverage=99%, HitCoverage=31%, E-value=7e-51, Identity=60%"; Hit description=Amino acid/polyamine transporter II
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTTSLLADCYRCGDPVTGKRNYTFMDAVQSILGHINYEASIPIRISDMTSTRTCGYYDTFCGVVQYSNLYGTAVGYTIAASISMM

SEQ ID NO: 152816 - protein, 68 aa, Glycine max
  Coding DNA Sequence Number=SeqID_36038
MWNPKRRFVLVVAAAVGSENEFGQPNHTEQLALITLVVYSIAGLKIRFNFGVWDNDHFLCHNRSHFPT

SEQ ID NO: 152817 - protein, 439 aa, Glycine max
  Coding DNA Sequence Number=SeqID_36039
  Gene Ontology: Mol. function=protein binding; Cellular component =integral to membrane; Biological process=protein amino acid phosphorylation
  Homolog annotation: Hit_ID=Q9C6A6; Match level="QueryCoverage=97%, HitCoverage=76%, E-value=1e-57, Identity=27%"; Hit description =Disease resistance protein, putative; 11609-15699
  Pfam annotation: Domain name=LRR_1; Domain location=143-166; Score =5.3; E_value=29; Accession=PF00560.23; Description=Leucine Rich Repeat
  Pfam annotation: Domain name=LRR_1; Domain location=17-39; Score =21.7; E_value=0.0027; Accession=PF00560.23; Description=Leucine Rich Repeat
  Pfam annotation: Domain name=LRR_1; Domain location=192-215; Score =9.9; E_value=4; Accession=PF00560.23; Description=Leucine Rich Repeat
  Pfam annotation: Domain name=LRR_1; Domain location=218-240; Score =21.9; E_value=0.0024; Accession=PF00560.23; Description=Leucine Rich Repeat
  Pfam annotation: Domain name=LRR_1; Domain location=242-265; Score =8.5; E_value=7.5; Accession=PF00560.23; Description=Leucine Rich Repeat
  Pfam annotation: Domain name=LRR_1; Domain location=267-287; Score =4.9; E_value=35; Accession=PF00560.23; Description=Leucine Rich Repeat
  Pfam annotation: Domain name=LRR_1; Domain location=288-310; Score =14.4; E_value=0.42; Accession=PF00560.23; Description=Leucine Rich Repeat
  Pfam annotation: Domain name=LRR_1; Domain location=311-333; Score =12.4; E_value=1.3; Accession=PF00560.23; Description=Leucine Rich Repeat
  Pfam annotation: Domain name=LRR_1; Domain location=335-357; Score =13.2; E_value=0.96; Accession=PF00560.23; Description=Leucine Rich Repeat
  Pfam annotation: Domain name=LRR_1; Domain location=359-380; Score =17.4; E_value=0.053; Accession=PF00560.23; Description=Leucine Rich Repeat
  Pfam annotation: Domain name=LRR_1; Domain location=381-403; Score =1.6; E_value=1.4e+02; Accession=PF00560.23; Description=Leucine Rich Repeat
  Pfam annotation: Domain name=LRR_1; Domain location=405-427; Score =8.9; E_value=6.2; Accession=PF00560.23; Description=Leucine Rich Repeat
  Pfam annotation: Domain name=LRR_1; Domain location=41-63; Score =10.4; E_value=3.2; Accession=PF00560.23; Description=Leucine Rich Repeat
  Pfam annotation: Domain name=LRR_1; Domain location=65-88; Score=1.0; E_value=1.8e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=143-166::17-39::192-215::218-240::242 -265::267-287::288-310::...
  Pfam module annotation: Domain location=311-333::335-357::359 -380::381-403::405-427::41-63::65-88
MAPFLPRVIAYWFKLKKLEELDLSGNQFEGPLPSSFVNMTSLRKLEISENHFIGNFDSNLASLTSLEYFGFIGNQFEVPVSFTPFANLSKIKFIYGEGNKVVLDSHHSLQTWIPKFKLQELIVSSTTATKSLPLPNFLLYQNNLTNIDLSGWKLEGDFPHWLLENNTKITKALFRNCSFTGTFQLPMRPLHNIQTIDVSDNTVNGQIPSNNISSIYPNLQYLNLSGNNIQGSIPSELGQMSLLYSLDLSENQLSGKIPENTFADGYRLRFLKLSNNMLEGPIFNIPNGLETLILSHNRFTGRLPSNIFNSSVVSLDVSNNHLVGKIPSYVYNFSTLTGLYMSNNHFEGSIPIELAELEDLTYLDLSQNNLTGHVPSFANSPVKFMHLNNNHLSGLSKRMFNENSSLVMLDLSYNEISNNIQDMIQDLSYTKVEFYPFER

SEQ ID NO: 152818 - protein, 216 aa, Glycine max
  Coding DNA Sequence Number=SeqID_36040
  Homolog annotation: Hit_ID=Q1SJE5; Match level="QueryCoverage=43%, HitCoverage=20%, E-value=5e-30, Identity=65%"; Hit description=Amino acid/polyamine transporter II
MNDDQVLWPECGWQPVSLTDLITAAAVRKVYRKATLCTHPDKVQQKGATIQQKYIAEKVFDLLKRVCWKECSKGIILLKNWYPVLHSICALHHRCLLSICCIPVSPANGWGLINDYVHRAAPVRSSTILATEPTAAATDTMRQTTLKICIPIHLLLHLGVLFCLILICTGRKTLKGQNPSAPRSPKTSLKNGINIATIVVMITNTVLQTNLNGLRL

SEQ ID NO: 152819 - protein, 230 aa, Glycine max
  Coding DNA Sequence Number=SeqID_36041
MTYLFLILDTPLKLKLPKLRELVPNKPTKAHNDNGDQCDSCQRCVTLCVRELYTLKKGPAWGHMQRCFELTVHMNGMAIFGDERQWLNVSSDGKTTGSLSHKGRAAAWGNSTNGSAAAMAAGCAGTMEHENAPMRSSPPPLCRSVDSDAGGWVTSRKGTVAPAAATRKCEGKEERVIGISMTDHKGPLGTVEYIAGQIGFFVVLFLAVPVLSITGTAGKGTAEKPGPLRD

SEQ ID NO: 152820 - protein, 303 aa, Glycine max
  Coding DNA Sequence Number=SeqID_36042
  Homolog annotation: Hit_ID=Q680Q1; Match level="QueryCoverage=93%, HitCoverage=68%, E-value=3e-58, Identity=45%"; Hit description=MRNA, complete cds, clone: RAFL22-41-F10
  Pfam annotation: Domain name=ENT; Domain location=54-127; Score =130.1; E_value=5.9e-36; Accession=PF03735.5; Description=ENT domain
MEHFSHASPLPAVGTDDDFPPTHQNRIPRGAHLAGNGSAVGSIPYARMYGEIDMETQIHQLEKEAYSSVLRAFKAQADVITWEKESLTTELRKELRLSNEELRELLGHVNADDVIQNIREWRQAGGNQLGVLSFGQAIHDSIPSPPISASRKKQKITPSALSQSFGGPSPFHPQSVDAPVQSSLVEKRGPVSGSKGKKHKPGHALPGVSSIKQYPSSGLGGRNQVPNRVTSGTVMGELAEGASLDSLVGRRVRTRWPDDNNFYEAVISDYNRSEGLHALFYDLGTANESWEWVNLSEGKLNLL

SEQ ID NO: 152821 - protein, 144 aa, Glycine max
  Coding DNA Sequence Number=SeqID_36043
  Gene Ontology: Mol. function=zinc ion binding
  Homolog annotation: Hit_ID=Q1T406; Match level="QueryCoverage=89%, HitCoverage=98%, E-value=1e-40, Identity=64%"; Hit description=Zinc finger, RING-type; RINGv
  Pfam annotation: Domain name=zf-C3HC4; Domain location=59-100; Score =35.9; E_value=1.4e-07; Accession=PF00097.15; Description=Zinc finger, C3HC4 type (RING finger)
MTLKGLVSLVINLIGLAEGTRNNDAPPLPCYMLSSHIQNNKQQSSESASASNFNEDSWCCVCLSRLKAKDEIRVLPCSHKFHKICVNKWLKGRHKTCPLCRFSMGAEEKSHRAEMFTEEMLIWFSSFHVAVFYKQSLALLSSFV

SEQ ID NO: 152822 - protein, 137 aa, Glycine max
  Coding DNA Sequence Number=SeqID_36044
  Homolog annotation: Hit_ID=Q6H5H5; Match level="QueryCoverage=92%, HitCoverage=31%, E-value=2e-20, Identity=42%"; Hit description=Emsy N terminus domain-containing protein-like
MEAVLFHMSPADIQWVGEDPGVNRRQGFGGSGNGMRRSVGRGSVPGVGKGRGTAKGQSRKDFLPSQNGIGMKTPDDIQILHTDTLVKEVERVFNAKHPDALEIEQVKKVLKDHEQALIDAIARLADLSDGESGISQF

SEQ ID NO: 152823 - protein, 66 aa, Glycine max
  Coding DNA Sequence Number=SeqID_36045
MNSARKGHSWVSEKKWRMDNWRTALHNNFMGLQTRWWRTHEQRLAMTFMGLRKKVENGELANSATQ

SEQ ID NO: 152824 - protein, 773 aa, Glycine max
  Coding DNA Sequence Number=SeqID_36046
  Gene Ontology: Mol. function=heat shock protein binding; Cellular component=integral to membrane; Biological process=protein folding
  Homolog annotation: Hit_ID=Q1SJE9; Match level="QueryCoverage=82%, HitCoverage=68%, E-value=7e-68, Identity=55%"; Hit description=Heat shock protein DnaJ, N-terminal
  Pfam annotation: Domain name=TolA; Domain location=418-735; Score= -104.4; E_value=0.00064; Accession=PF06519.2; Description=TolA protein
  Subcellular localization annotation: CTP_CleavageSite=50; ConfidenceScore=5.40e-01
MFSGSIENAVAWVVILKCVSQREASSQISLLASFPNCNLSSLRVTSPSTLAAPAPATFLSLVWGKITGSGPFDPVSKSLKLVFHCSHDLVCSWCDVEVVPLPLICDIVATSRLPKQRFFFLRTCLCSYFEVRLTIPDINLSPEPTIDASKTASSTTDDPFKVFESTSAPVDSSSDYFTDPLEEISKFTSSRSTKNDRSSNSNGEVYDDIDPFGGLGNSVPAFSAERNSMKGSSSPTPRSNTSSSWTRDKESNDISSVRSPDRKTPNKILVDHDQEFHQAAFDMPTYSSDSYKPVGQRSTFPSYDNNGFKQANTLEDMSPKYEEKLESNDDIWLMVSEIPLFTQPTAAPPPSRPPPPRPVHILKSGAGSSASANVRKKDNDFSYFPSSTQFSQGPKSAPAAAKFSSASQFDELEDFAMGKSRDNDDEGVNGLADKELEMNSAAAAMKEAMDRAEAKFRHAKGVRERENTKVAKSKEPVQLDKDGKVVSEDRGKQERLDHEWQQKEREEKEQRRCEKEREEKEREQQRLERERERARQAVERATREARERAAAEARQRAERAAVEKANAEARKRAERTAVQRAQAEARERAAAEAKEREVRERAAAARAEPEARVKAERAAVERAAAEARERAVAQARERAAAAARMSQQQNDNDLESFFSTDARANSAPRPPRPSSSDSVFDAQFQSDVTRKSTGVSSSMKKASSSTNIVDDLSSIFGAAPSSSGEFQEIEGETEERRRARLERHQRTQERAAKALAEKNQRDLQTQRDQAERH

SEQ ID NO: 152825 - protein, 70 aa, Glycine max
  Coding DNA Sequence Number=SeqID_36047
  Homolog annotation: Hit_ID=Q69SU2; Match level="QueryCoverage=46%, HitCoverage=7%, E-value=8e-08, Identity=75%"; Hit description =Putative UVB-resistance protein
MRRLPERLTYHSRLEASEAQENPQNFHVLAGHICSTQSNQESFKIHSQKKKNKNKPSEVGDANIKNATTL

SEQ ID NO: 152826 - protein, 176 aa, Glycine max
  Coding DNA Sequence Number=SeqID_36048
  Gene Ontology: Mol. function=heat shock protein binding; Cellular component=integral to membrane; Biological process=protein folding
  Homolog annotation: Hit_ID=Q9SU09; Match level="QueryCoverage=91%, HitCoverage=21%, E-value=1e-15, Identity=36%"; Hit description =Auxilin-like protein
  Subcellular localization annotation: CTP_CleavageSite=54; ConfidenceScore=5.73e-01
MNDFDGLLATDFGFKPQGKSAPMAASKVSSNNKTSSLNFDLGSRSTRTSNSSVNAAAAAASFDDLFGDSSVFRASADFRSKSVNVPVHDGPVFDKPVYDDDDDIFDGVPGLKSSSKVSYDDVFAPGGSAAAAAAFDDLLGRLGKSEKVEKGAADFDDLIPGFRSSKASTDGYVAHA

SEQ ID NO: 152827 - protein, 144 aa, Glycine max
  Coding DNA Sequence Number=SeqID_36049
MEGAGTGAGAGADGVGGAEEKGAEVPGPLALVLRVLRKVIVRSFGFQQFFWIYAKLMVGLRDSKVRESDTTPLAMHKAVMSAGMPSREELGWAICYIWPEMSEPKWGRGWSMKALSKSGRGWSGPSSGASRALPQHSIQNLALE

SEQ ID NO: 152828 - protein, 119 aa, Glycine max
  Coding DNA Sequence Number=SeqID_36050
MAYACISRLSTWRPLWPRLPGQESSLLLWGELDTEPEATPEAEATPEETPEITPAATPSEALEEGNGAADTYYVADMAAAQSTWDPWPTPTLETSLPVQDAPSSPQDDPIPAQMTEDRT

SEQ ID NO: 152829 - protein, 99 aa, Glycine max
  Coding DNA Sequence Number=SeqID_36051
MVQRSCIQPYLPTTTGARGTVVETSKNNDGVLTTDVDILPNNVGGEPTTDVDRKQNKYGCYAYPTLIWTTTTTSLANPTLKWTKTTTGCIKCASLNPFL

SEQ ID NO: 152830 - protein, 121 aa, Glycine max
  Coding DNA Sequence Number=SeqID_36052
  Homolog annotation: Hit_ID=Q1SJF0; Match level="QueryCoverage=65%, HitCoverage=18%, E-value=6e-30, Identity=80%"; Hit description =Regulator of chromosome condensation/beta-lactamase-inhibitor protein II
  Pfam annotation: Domain name=RCC1; Domain location=75-119; Score =20.0; E_value=0.0049; Accession=PF00415.9; Description=Regulator of chromosome condensation (RCC1)
MSSVLLNCISALVTSFLSAQGAATFFILCFWGDFGRLGHGNSSDLLIPQPIIALQGLRIKQIACGDSHCLAVTMEGEVQSWGRNQNGQLGLGNTEDSLVPQKIQAFKVPVSKTFIKVICDK

SEQ ID NO: 152831 - protein, 84 aa, Glycine max
  Coding DNA Sequence Number=SeqID_36053
MVGTIRMAIIQHLVIANRKRRSIICRIKPNLNRASKETTKATEAKRREGQAAGISLSEAYVLSECHPISEALSSLSMMRNPRRG

SEQ ID NO: 152832 - protein, 122 aa, Glycine max
  Coding DNA Sequence Number=SeqID_36054
  Gene Ontology: Mol. function=binding; Cellular component=integral to membrane; Biological process=transport
  Homolog annotation: Hit_ID=Q84UC7; Match level="QueryCoverage=44%, HitCoverage=17%, E-value=6e-14, Identity=61%"; Hit description =Mitochondrial basic amino acid carrier
  Pfam annotation: Domain name=Mito_carr; Domain location=33-117; Score= 9.4; E_value=0.00048; Accession=PF00153.17; Description=Mitochondrial carrier protein
MYRPSHGFKVHPQGAQGLIEQLTNFLQHCGSSSGYKENVVGLFTGIAAVATGHPFDTVKVMLQKHNAKAHTIQYRNGWHCTARILKTEGGQIEAWDESALLLFRRIISNWAWIRNWDEPAWT

SEQ ID NO: 152833 - protein, 390 aa, Glycine max
  Coding DNA Sequence Number=SeqID_36055
  Gene Ontology: Mol. function=DNA binding; Cellular component=nucleus
  Homolog annotation: Hit_ID=Q84YJ6; Match level="QueryCoverage=85%, HitCoverage=47%, E-value=1e-15, Identity=27%"; Hit description=DNA -binding protein family-like
  Pfam annotation: Domain name=Bromodomain; Domain location=12-87; Score=26.9; E_value=6.8e-06; Accession=PF00439.15; Description =Bromodomain
MANSRNFPVGEKYFIFPPNFGKQTKQDTDRYKDLVKQPMDLETIQLRLQKGHYSSCTSAFFRDLLLLFTNATVFFSHDTLESQVGRQLHRLATTEMKNHGQAQSDPIPRKNDSLPPNASLAKPDSLISKNKASGPILVCRKRSSMLAKPSSATFGQKGDQPTFNDKKERPSSDAKPPMKPSSSDTDEEELPKAKEKPVTGARSLRRSYKNLNNNNNKKPSSNSTPKTGSSGNKPSETVKPEKSKAEGGPDKKRNAAADFLKRIKRNTSAEASKGGSGGSGGGGSGGGGGSSSSSKGGGGGNGVKEQKKMVNNGKGDKGKERASRHNNVGGGSGSGDKRNSKNVENNSQSKRSVGRPPKKAAETNAGSAKRGRESSASAGKDKRPKKRSKK

SEQ ID NO: 152834 - protein, 72 aa, Glycine max
  Coding DNA Sequence Number=SeqID_36056
MAYLLKEAFRVERGTRISPATTRTNVTENESVLGGVSIPGPIWNILEGGCFRWKLPSSPGQAGRQPPPSFLL

SEQ ID NO: 152835 - protein, 275 aa, Glycine max
  Coding DNA Sequence Number=SeqID_36057
  Gene Ontology: Mol. function=nucleic acid binding
NDSITFEKVKSGHYSRELRLKASENVDEVYASELSIIDSTKGMTHHWKATWFWLLVNNYNNILNNRYWTQVVLIICVHTDIGCAQINIHDGVIKTLIKVSHVLELKKNLVSMSVMDSKGFSWWVEGGVMQIKIMRPMASLKILCGICIWHCISGKQHRTKFPKVMHTTKAMLDYVHSMLGAFESSITGRDKEFLGRDSQHNMLSRESLTIHHHKLQDPFKPRGKKEFFMGYGDGVKGFLDIIYHFIHSKKRVEVPKVNTWESPTDMFTKAYFKKQ

SEQ ID NO: 152836 - protein, 197 aa, Glycine max
  Coding DNA Sequence Number=SeqID_36058
  Gene Ontology: Mol. function=hydrolase activity; Cellular component =cytoplasm
  Homolog annotation: Hit_ID=Q9LUG8; Match level="QueryCoverage=57%, HitCoverage=51%, E-value=9e-27, Identity=49%"; Hit description =Similarity to endo-1
MSGPECCSNPPVLNPNARVGHVEKLAGLNSYLSSSLNSNAIPLISDIYGYEAPNLRLQLLVVPDFSHGDPYNPKNASRSIPVWLKDHGTDKGFEVAKSIIEALKSKATIGLAAYENPFGVVLGNFETSNALFKHIFFLQKVVASGGSNLARLGELGGKLLPYFAINRGRSEGRRGSAFLALPILSKLLRKIVSVKKI

SEQ ID NO: 152837 - protein, 153 aa, Glycine max
  Coding DNA Sequence Number=SeqID_36059
  Gene Ontology: Mol. function=nucleic acid binding
MKSEFSASKKIVRKYSREKWTQAYDGGKRYVHMTTNFVECMNFALKGAHTLPIIVSVKATFERIKACSVERGMHVSSMLHVGHGYPKKALRLPCSHVIAICSSCHQQTDLFVDLTYKLHTIYKIYELQFHSLGNKDYWSQYMDPNFVPNLDKR

SEQ ID NO: 152838 - protein, 588 aa, Glycine max
  Coding DNA Sequence Number=SeqID_36060
  Gene Ontology: Mol. function=RNA binding; Cellular component =ribonucleoprotein complex; Biological process=RNA processing
  Homolog annotation: Hit_ID=Q1T402; Match level="QueryCoverage=95%, HitCoverage=97%, E-value=1e-148, Identity=52%"; Hit description=RNA -binding protein Lupus La
  Pfam annotation: Domain name=La; Domain location=343-411; Score=29.6; E_value=5.1e-06; Accession=PF05383.7; Description=La domain
  Subcellular localization annotation: CTP_CleavageSite=54; ConfidenceScore=5.35e-01
MAMTGNHSPRHSSDNHQSRRATRLPASSPWNQVVCGESEPVAAVPSSSTEDFPSAAAPVEDFSSSATESSDNGGAAKRPVWNKPSPNGAAAAAASEVRPEMDANSWPLPSESTRAATKSESLKGLLDGSSVPQSQGLGSMSSSSPSQREVSDNASTNSVVPARQKSTKHHSSNASSNGGHMQHSASQVSIAATGSRNSSPKDHTQRSGFASHDHPQQRNSFRNRNGGQHQRGDGSHHHNYGNRHDQDWNNNRTFGSRDTHVPPRVVPRFIRPPPPPNSAQFFHPSPMRPFGSPIGFHELAPQLVFVAAPPPPPDSLRGVPFVPPMPHHSLFFTGPDPQLHNKIVNQVDYYFRELTVDIPQLVYCSNENLVKDTFLRQNMDDQGWVPIKLIAGFNKHVLCPTGCIVCTISVENMLDREKLGSLKSSFCIKIFKVMLSVAVLQLSSEAVQVMHSFKNFSYLEVMHLTDNIQVILDAIRTSSVVEVQGDKIRRRNDWRRWIMHPPVQFSNATTIGVLNPDMLAEQVHNIALETSDYDGAGGPDVLPDTSRHRSTFRDLQLSTSEGPGPGQVGIQEAQITPFQEEIRAVNVL

SEQ ID NO: 152839 - protein, 129 aa, Glycine max
  Coding DNA Sequence Number=SeqID_36061
MKAFIHVNIGAGFSETKLTREPCRRNPQKPIPQNPVAGSSLPLSRNRHWRYHPCTLSLLSRQLQGRDTLSLSYPASSKGGTPLSLISPPIPPAAMAAPLPLSPSQPLSHHWHWRFKLPASVNGGTHVHK

SEQ ID NO: 152840 - protein, 324 aa, Glycine max
  Coding DNA Sequence Number=SeqID_36062
  Gene Ontology: Mol. function=structural constituent of ribosome; Cellular component=intracellular; Biological process=translation
  Homolog annotation: Hit_ID=Q7XIR7; Match level="QueryCoverage=78%, HitCoverage=71%, E-value=4e-45, Identity=41%"; Hit description =Myosin-like protein
MSGRNRGQPLPPPHAAGLSPPLHDQLYGARAHHHHHLVGPVPPHPHHLLEDFRDSQLGLGPPRGGPIPLHPAAIIEERLAAQHQDIQGLLGDNQRLAATHVALKQELEAARHELQRVAHFRDSLRADTEARMPELHDKAAQLEAELCGAEAARTELLQVRADVKELTAVRQDLSGQVQAMTQDLARMTTDAKRVPALRADVEAMKQELQCARAAIEYEKKGFAENYEHGQVMEKKLVAMAREMEKLRAEIANAEKRARAAVAAGNPGQGYNANYGNADAGYAGNPYPSIYGMNPVQPGVENFPHYGPGPAAWGAYDMQRAQGHR

SEQ ID NO: 152841 - protein, 408 aa, Glycine max
  Coding DNA Sequence Number=SeqID_36063
  Gene Ontology: Mol. function=pepsin A activity; Cellular component =anchored to membrane; Biological process=proteolysis
  Homolog annotation: Hit_ID=Q8VYV9; Match level="QueryCoverage=98%, HitCoverage=80%, E-value=1e-127, Identity=57%"; Hit description =Putative chloroplast nucleoid DNA-binding protein
  Pfam annotation: Domain name=Asp; Domain location=3-343; Score=-84.2; E_value=1.2e-08; Accession=PF00026.14; Description=Eukaryotic aspartyl protease
LHFANVSVGTPPLSFLVALDTGSDLFWLPCNCTKCVRGVESNGEKIAFNIYDLKGSSTSQTVLCNSNLCELQRQCPSSDSICPYEVNYLSNGTSTTGFLVEDVLHLITDDDETKDADTRITFGCGQVQTGAFLDGAAPNGLFGLGMGNESVPSILAKEGLTSNSFSMCFGSDGLGRITFGDNSSLVQGKTPFNLRALHPTYNITVTQIIVGGNAADLEFHAIFDSGTSFTHLNDPAYKQITNSFNSAIKLQRYSSSSSDELPFEYCYDLSSNKTVELPINLTMKGGDNYLVTDPIVTISGEGVNLLCLGVLKSNNVNIIGQNFMTGYRIVFDRENMILGWRESNCYVDELSTLAINRSNSPAISPAIAVNPEETSNQSNDPELSPNLSFKIKPTSAFMMALLVLLTIL

SEQ ID NO: 152842 - protein, 448 aa, Glycine max
  Coding DNA Sequence Number=SeqID_36064
  Pfam annotation: Domain name=Chromo; Domain location=332-386; Score =50.8; E_value=4.6e-12; Accession=PF00385.14; Description='chromo' (CHRromatin Organisation MOdifier
  Pfam module annotation: Pfam domain module=Chromo::Retrotrans_gag; Domain location=332-386::69-212
MEAKVAAIESEVAGLKTAMKSMQLKAEENHERLIKAELPMFDREDPTGWIVCVEVYFQVQEMHPDVKVSLAQLCMDGSTIHFFKSLLNEHNVLTWEQLKAELLERYGGIGDGDIFEQLAAIQQEGSINEYITKFECLTAQYAYAGSINVFEDDESHQGDGIIVPRGKEIGMGFDHPIRGRSGLGQGNRNSPSFTSEFHGSDLSPILNHNVLPPMTEAFVIYPTRSSRSARGKGSATREEMDDEANAMIAEDELDDEEDEGECILVLVDRGAHITSSPRRNVQGCYLGSGFIVVNSGHSVILFGGHQLDFGGSLAHSFGGDASGLASNSTITPEPEAVLAPRSVQKGGELVNQVLVQWKDEGLEEATWEEEFNIKSQFPDLRLEDKSLFEGGIDRNGSVGLEVRERPKIWRVNARRNKSVKERDGYWEFLEFCHGERIVTSLEELGSGQ

SEQ ID NO: 152843 - protein, 96 aa, Glycine max
  Coding DNA Sequence Number=SeqID_36065
  Subcellular localization annotation: CTP_CleavageSite=33; ConfidenceScore=5.10e-01
MKLNPNLKQATSKPNYHIQIETPTRFCPKSIFVAKAVVQNSDFMGSKPKTKPDQRFAAKVNGDTKDKWRLLVAMVFDGMVFRLKEKIGKEDDVLCC

SEQ ID NO: 152844 - protein, 384 aa, Glycine max
  Coding DNA Sequence Number=SeqID_36066
  Gene Ontology: Mol. function=sequence-specific DNA binding; Cellular component=nucleus; Biological process=regulation of transcription, DNA-dependent
  Homolog annotation: Hit_ID=Q45RR3; Match level="QueryCoverage=81%, HitCoverage=92%, E-value=2e-54, Identity=70%"; Hit description=Type II homeodomain-leucine zipper protein
  Pfam annotation: Domain name=HALZ; Domain location=258-302; Score =85.4; E_value=1.8e-22; Accession=PF02183.8; Description=Homeobox associated leucine zipper
  Pfam annotation: Domain name=HD-ZIP_N; Domain location=2-157; Score= -19.3; E_value=0.014; Accession=PF04618.3; Description=HD-ZIP protein N terminus
  Pfam annotation: Domain name=Homeobox; Domain location=203-257; Score= 65.2; E_value=2.1e-16; Accession=PF00046.19; Description=Homeobox domain
  Pfam module annotation: Pfam domain module=HALZ::HD-ZIP_N::Homeobox; Domain location=258-302::2-157::203-257
MELGLSLGDSSRPLLGFMEKPREASNQLGLGFNTTLSIGPIITTHKDHQQDEDEEYQEEEEEETKPKNNNTHRIQGPDGLSSNPNNNNNTVLHQLDLLPQLALPWHPPSENGSLSSELGGSSRGLDVNAQPPAVEDEAEEAAALSSSPNSAASSFQMDLCIYSSRGGSSYKRDFEGEAYDQRTSSRASDDDDNNNGSGGNTRKKLRLSKEQSAFLEESFKEHNTLNPKQKLALAKQLNLQPRQVEVWFQNRRARTKLKQTEVDCEYLKRCCETLTEENRRLHKELQELRALKTSNPFYMQLPATTLTMCPSCERVATNSTSTSLSISATINATNSGAMASVKTSNNNNNNDSPSKAIGFPFGKPRFHPFVHTSQQPHQHQSTAS

SEQ ID NO: 152845 - protein, 174 aa, Glycine max
  Coding DNA Sequence Number=SeqID_36067
MREKLVKLSDAIVELDLGEDTILICGCGQAGCGCLKLDGRQACRGLCGGVRGYDGGRLMAKGALGHWITLAKRHPQQKDVIKALPKPLPASMVASYLSNKKEDEKDEDEKEENEQSVEHLSPQDLLKRHIKRAKNVRARTLLDLVDSKVVKNCDFTCKIVRSYELWMASMLDSV

SEQ ID NO: 152846 - protein, 893 aa, Glycine max
  Coding DNA Sequence Number=SeqID_36068
  Gene Ontology: Mol. function=RNA binding; Cellular component=nucleus; Biological process=35S primary transcript processing
  Homolog annotation: Hit_ID=Q2QX78; Match level="QueryCoverage=96%, HitCoverage=96%, E-value=0.0, Identity=44%"; Hit description=Nrap protein, expressed
  Pfam annotation: Domain name=Nrap; Domain location=83-890; Score =708.9; E_value=3.6e-210; Accession=PF03813.5; Description=Nrap protein
MDSDAIAKDSTELKLTELLKEVTVDHSHQFSKLVDDTVSAIKTSIDKIPNDFKVTADLASRFVTDIGADKVEFKFKKPAFVKIGGSCSIQSLAKPEVNVDLIIRLPKECFHEKDYLNYRYHAKRCLYLCLVKKYLEKSPSIDRVEWSTLQNEARKPLLVVYPAAKLVEVPGFFVRIIPSAKAIFSTAKLNLKRNNIHNLSNGTSLQATPKYNSSILEDMFIEDAEFINNYYLGWKELKEALILLKQRMQLKESFPVVICHPSGGFNLAFRMSRIGFTRLQNEATLTLRCMEKCRDCGFEEVFMTKIDYAVKYDYCMSSQLQGLSVLDKVPLFVGFSVSSLEKAFRMVDIGPNAESKEEALEFRKFWGEKADLRRFKDGRIAESTVVVDQLDFSLLHGAGDPISYSGSLLGAFDVLSKRLRLIEDLPLKVSSVQPLDSAFRFTSVFPPEPHLLANEKNESLRLNKLVPSCIQPLEVMIQLEGSGNWPMDEIAIEKTKCSFLIQIGVSLQKMWGMTCTATEDNVDVLMSGYLFRLKILHERGLSLLNKEIGSDQAKRIPSADKKLFIHSQHANMINGLQSRYPIFGPVVRLAKRWAASHLFSACLLEEAVELLVAYLFLNPLPYDVPCSRITGFLRFLRLLSHYDWTFSPLVVDINHDLSPSDEKEINDNFLLKRKGQGENGQSVGPAMFLATVYDKESEAWTGLSPSGMELKRLVAYARSSANLLAKLTFQEEIGPYRWECLFRTPLNNYDAVVILHKDKLPYPQRLLFPSEVNHGTHVAEGHASKCFQPFLLPKDLKGRPEELKNKLLVDFDPSKCFIRDLKACTQEFSTTFQVWHDYLGGDVIGLTWGESYPSKKRKREDVVDPCKVLKAVGEVGKGFVRSIYFLKPPKLMN

SEQ ID NO: 152847 - protein, 222 aa, Glycine max
  Coding DNA Sequence Number=SeqID_36069
  Gene Ontology: Mol. function=anthranilate synthase activity; Cellular component=cyanelle; Biological process=glutamine metabolic process
  Homolog annotation: Hit_ID=Q1GYF4; Match level="QueryCoverage=76%, HitCoverage=90%, E-value=1e-80, Identity=82%"; Hit description =Glutamine amidotransferase of anthranilate synthase or para- aminobenzoate synthase
  Pfam annotation: Domain name=GATase; Domain location=45-222; Score =243.2; E_value=5.5e-70; Accession=PF00117.18; Description=Glutamine amidotransferase class-I
  Pfam annotation: Domain name=Peptidase_C26; Domain location=24-204; Score=-86.4; E_value=0.00084; Accession=PF07722.3; Description =Peptidase C26
  Pfam module annotation: Pfam domain module=GATase::Peptidase_C26; Domain location=45-222::24-204
MDVAIAIRTAVIKDSKLYVQAGAGIVADSVPQSEWEETQNKAKAVIRAAELYFGELGQDVHVHRNDEITLEQIKAMKPEKIVISPGPCTPNEAGISVPLIHEFAGKIPLLGVCLGHQSIGQAFGGKIIKAKTLMHGKTSLIHHTNTGVFRNLPNPYTATRYHSLVIERETIPDCLEITAWTEDGEIMGVKHKTLAVEGVQFHPESILTEYGHELLDNFLKGY

SEQ ID NO: 152848 - protein, 59 aa, Glycine max
  Coding DNA Sequence Number=SeqID_36070
MAVMMQPFFVINSILLVDGDNLLIVVEVVEVQYELSVVGVCGDLHVPHHDHVAKEREEI

SEQ ID NO: 152849 - protein, 72 aa, Glycine max
  Coding DNA Sequence Number=SeqID_36071
MLGFTSSSPQISASPHQLDFTPYASRSYSAQWNVQELLHDMHMLHSSRILGKMEVEEPWQGLWLPLHYQACG

SEQ ID NO: 152850 - protein, 77 aa, Glycine max
  Coding DNA Sequence Number=SeqID_36072
MYRGDWLVVHGVNHMLSGTHHGKRHPTHRAKKNDSYRVSVEEEQDGGDQESSSGFEDHRHREGEENSPHHYHFSAFH

SEQ ID NO: 152851 - protein, 162 aa, Glycine max
  Coding DNA Sequence Number=SeqID_36073
MDKDTLGYSGRKCSKNLGELASGDYLTFGALIWRSWKLQDRFTMSPYVAITPDYHPHKCIRPSRPRRIGGSGWVLIGAEDSPLQPTTFKFKRCLWSRTLYELGVLSRHIEPHDAQEFIVTIMRFNVRDNILSWRFELVRLMQVIEDRGDHAYMMLEEEEVLD

SEQ ID NO: 152852 - protein, 190 aa, Glycine max
  Coding DNA Sequence Number=SeqID_36074
  Gene Ontology: Mol. function=acetylglucosaminyltransferase activity; Cellular component=membrane; Biological process=electron transport
  Homolog annotation: Hit_ID=Q9ARU3; Match level="QueryCoverage=92%, HitCoverage=43%, E-value=5e-62, Identity=59%"; Hit description =Putative xylosyltransferase I
MNVECFPFLAGSPWVILSRSFLEYCIFGWDNLPRTLLMYFTNVKLSQEGYFHSVVCNAPEFKNTTVNGDLRYMIWDNPPKMEPLFLNVSVYDQMVESGAAFARQFEVGDRVLDMIDKKILKRGRNQAVPGAWCSGRRSWWVDPCSQWGDDVTILKPGPQAKKLEESVSSLLDDWSSHTNQCLITSEETED

SEQ ID NO: 152853 - protein, 219 aa, Glycine max
  Coding DNA Sequence Number=SeqID_36075
  Gene Ontology: Mol. function=acetylglucosaminyltransferase activity; Cellular component=membrane; Biological process=electron transport
  Homolog annotation: Hit_ID=Q9ARU3; Match level="QueryCoverage=58%, HitCoverage=32%, E-value=1e-35, Identity=58%"; Hit description =Putative xylosyltransferase I
  Pfam annotation: Domain name=Branch; Domain location=50-215; Score =37.1; E_value=1.5e-10; Accession=PF02485.11; Description=Core-2I -Branching enzyme
MGVERKWLFTLFTAAFLSFIILMFSSFSCFTSPMPFPSIVHYGPHHPPAFAYFISGGNRDSDRIFRLLLAVYHPRNRYLLHLGMDARDEERQRLAAATMSVPAIRAFRNVDVVGKADYVTYLGSSNVAVALRAASVMMKLDGGWDWFVTLSARDYPLVTQDARLEPKQKLSGPQDMVKKFGVENDGGVQSGLEPRQKLRGPQDMEKKFRVENHGGVQCC

SEQ ID NO: 152854 - protein, 140 aa, Glycine max
  Coding DNA Sequence Number=SeqID_36076
  Gene Ontology: Mol. function=protein-methionine-S-oxide reductase activity
  Homolog annotation: Hit_ID=Q10S38; Match level="QueryCoverage=60%, HitCoverage=62%, E-value=1e-18, Identity=50%"; Hit description =Expressed protein
MTAPTSSTDCDLVISIGKSASAPFPSLVLRSSTSGDDSREKDKIYVDHRPRSSKDTGTGVARDLGPLSLDSPVVDDFKEGTNLVLLHKLELGGIHNGEQDGALVVGFKVEVRRVHINGVQIQVGPALRTTVHESHGSIGM

SEQ ID NO: 152855 - protein, 69 aa, Glycine max
  Coding DNA Sequence Number=SeqID_36077
MVTKGNHWKLTVKEMGLRKLMTTDENRDQTPEIGRKRAARQCATVRSSSGIWRSAVKSSLEGACTCKGT

SEQ ID NO: 152856 - protein, 121 aa, Glycine max
  Coding DNA Sequence Number=SeqID_36078
MTCLQPSLITSLVKVLRIQVCVFLTVWLSARLTLSSNSLTRAKHENGAKCDVKIRKPFLSLICTELKESQENCSLLKGMKSVNFRERRAEQGAKFSSFREISEFLSDCEIPRGGGDIPTPL

SEQ ID NO: 152857 - protein, 173 aa, Glycine max
  Coding DNA Sequence Number=SeqID_36079
MPFITRGFSDPNARVLRGVRKAWDAVQRKDKELRGNGNGIINRYRKWLRFHTQGLDWLPKFRVVAEEEAEALEESEEVQALKAELEKAQAVKEKFKSTTIKVRKEYDELKDINLATVKALEQETKRARKKEHDRNKFRGALWGSNKEPKLRRDERDQSRVEGMILKGRVKGLS

SEQ ID NO: 152858 - protein, 71 aa, Glycine max
  Coding DNA Sequence Number=SeqID_36080
  Homolog annotation: Hit_ID=Q1RXR7; Match level="QueryCoverage=97%, HitCoverage=5%, E-value=2e-11, Identity=52%"; Hit description =Tyrosine protein kinase, active site
MEVNEKCDVYSFGVLAIQTPFGEYHEDFITSLLTSSSNFIDSTLDIPSLMGKLDQRLPYPPNPIAKEIVLT

SEQ ID NO: 152859 - protein, 168 aa, Glycine max
  Coding DNA Sequence Number=SeqID_36081
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=99%, HitCoverage=16%, E-value=6e-57, Identity=64%"; Hit description =Tyrosine protein kinase, active site
  Pfam annotation: Domain name=Pkinase; Domain location=13-167; Score= -62.1; E_value=7.3e-05; Accession=PF00069.15; Description=Protein kinase domain
  Pfam annotation: Domain name=Pkinase_Tyr; Domain location=13-167; Score=-107.0; E_value=6.7e-06; Accession=PF07714.7; Description =Protein tyrosine kinase
  Pfam module annotation: Pfam domain module=Pkinase::Pkinase_Tyr; Domain location=13-167::13-167
MVSENIVEAKKEFDNKHLIGVGGQGNVFKAELHTGQIVAMKKLHSIQNGEMPNIKALSREIQSLTKIRHRNIVKLFGFCSHSRFLFLVYEFLEKRSMGIEGSMQLIKGVASALCYMHHDCSPPIVHRDILSKNVLSDLEHVAHVSDFGRAKLLNLNSTNWTSFAVTFG

SEQ ID NO: 152860 - protein, 66 aa, Glycine max
  Coding DNA Sequence Number=SeqID_36082
MKHSSKLESGGRMNENAIHGLRKKGGEWRIALRAIMKHSSKLEGGGRMNENTIHGLRKKGENGGFL

SEQ ID NO: 152861 - protein, 165 aa, Glycine max
  Coding DNA Sequence Number=SeqID_36083
  Gene Ontology: Mol. function=metal ion binding; Biological process =metal ion transport
  Homolog annotation: Hit_ID=Q1SEG6; Match level="QueryCoverage=99%, HitCoverage=99%, E-value=2e-53, Identity=64%"; Hit description=Heavy metal transport/detoxification protein
  Pfam annotation: Domain name=HMA; Domain location=28-107; Score=18.3; E_value=0.016; Accession=PF00403.16; Description=Heavy-metal -associated domain
MGVLDYISEFFSVSPATGKKRKAMQTVEIKVKMDCDGCERRVRNSVVHMKAIFMVTRWHNNYNSNMLVNGVKQVEVNRKQSKVTVTGYVDRNRVLKKVQSTGKRADFWPYIPYNLVAYPYVAQAYDKKAPSGYVKNAAQALPASNSLDEKLTSLFSDENPNACSI

SEQ ID NO: 152862 - protein, 150 aa, Glycine max
  Coding DNA Sequence Number=SeqID_36084
MGEVEEVQKQMKADMEAMKEQMATMMEAMMSMKKIMEANAVAVAVTSAVAKVNPMPPCGLNQINHSTSDMVGLEGKELEGTGSPHLVRKISMPSHHMAGLPTIHRPMWRTLPVRMPITPLLYPLRADNPKLIIHMSLKPWGRHMKFLTTI

SEQ ID NO: 152863 - protein, 111 aa, Glycine max
  Coding DNA Sequence Number=SeqID_36085
MGKVDHQEERLKAIEGGKDYAFANLEELFLVPNIITPPKFKVLDFDKYKGTTCPKNHLKMYCWKMGAYATDEEMLIHFFQKSLTRVAVTWYTSLEPSQVHSWNDLMVAFIR

SEQ ID NO: 152864 - protein, 118 aa, Glycine max
  Coding DNA Sequence Number=SeqID_36086
  Subcellular localization annotation: CTP_CleavageSite=56; ConfidenceScore=5.36e-01
MRLSKANEPARSLSVISTWLVQTNRRASCTEKSNFHSSISAPSKGNFRDMNGIRLKFSNAWKHSKFSFEKNSISMNFGSTMEREQKRFVYHICCSSDENNDPEGMEGGIGASYDPECR

SEQ ID NO: 152865 - protein, 100 aa, Glycine max
  Coding DNA Sequence Number=SeqID_36087
TRSSLDGKAQNDHNLSLCTIGHDRLWMGKRVQNDHNLSLRAIGHDCVWMAKRHDRAWMERCRMTTICHYAPSDTIASGWRKGVRNDHNLSPHVIGLAASG

SEQ ID NO: 152866 - protein, 122 aa, Glycine max
  Coding DNA Sequence Number=SeqID_36088
MEECSTRLGYGQLYGFFEPQLIHNAKDRCDEAHNYIQTWVKESHREVYLGPYMNHLSLCALGMMLLCGSIHCATLDGKCNQVAPHWIKVKSHAQSRGYEYDYYVMHWMWNIVMSGFKNEWTK

SEQ ID NO: 152867 - protein, 245 aa, Glycine max
  Coding DNA Sequence Number=SeqID_36089
  Gene Ontology: Mol. function=transition metal ion binding; Cellular component=nucleus; Biological process=DNA integration
  Homolog annotation: Hit_ID=Q7Y095; Match level="QueryCoverage=93%, HitCoverage=61%, E-value=1e-21, Identity=41%"; Hit description =Putative TNP2-like transposase
  Pfam annotation: Domain name=Transposase_21; Domain location=1-101; Score=-138.2; E_value=0.0082; Accession=PF02992.5; Description =Transposase family tnp2
MIAGTRQPGNDSDVYLTPLIEDLKKLWVDRVDVFDGNPQQTFKLRVMEYESVSKPLAGNEVYDQSDLEVRHCIDVMHVDKNVCDSLIDTLLNIKGDQVVWSGLFAVDVSSWALHEEYVELVKPIGLPQCRHDNIRREVAPFIDTHKDFLMVAHTKMNMMKVLQEHNRSFINWFKETTFCDDSTSKTLRLLAIGPNLNVPTWKGYDINNYFFYVKSQDDKSSMQNNGVNLEPDSDHFCRASDNNPI

SEQ ID NO: 152868 - protein, 230 aa, Glycine max
  Coding DNA Sequence Number=SeqID_36090
MAQEISDKIDSLQEEMTQGSFVPHGYEDILDTVIGRLEHPSRVRAAGSGVTISQFFGQAPRSMNNSSASINLQQSDEIIGNLKEQWRREFEEENRQSLEKMKEELKEQIKMDTKGSYGEAAANPSGEENVMDVKPTMGLHVVHDNSTRLVALGKVYEGASTIHNIPYANDVIRVSVEKVYDGDAQIPFPMSEDELIHRSTVVGGTDLLVDLIQNMHDLNEKLLEMLWNGT

SEQ ID NO: 152869 - protein, 95 aa, Glycine max
  Coding DNA Sequence Number=SeqID_36091
MSHFRVSDIVVTRRVVTEEVRTRGGCSIVGYYTTRCYVTHCHPAIDLVATMLSLRDREVLLGPHGGLQNDIFFLHNLLLGSLKGGVPTRGTPILK

SEQ ID NO: 152870 - protein, 83 aa, Glycine max
  Coding DNA Sequence Number=SeqID_36092
  Subcellular localization annotation: CTP_CleavageSite=53; ConfidenceScore=5.41e-01
MKHGHPSLSPLSCSVSDSTPTPTRHRRLCGGVVDKTWIHTLMLLSSGGSSILMSTAISSQSTKLSGCVSNLTNSRGQMFGITC

SEQ ID NO: 152871 - protein, 978 aa, Glycine max
  Coding DNA Sequence Number=SeqID_36093
  Gene Ontology: Mol. function=4 iron, 4 sulfur cluster binding; Cellular component=mitochondrion; Biological process=metabolic process
  Homolog annotation: Hit_ID=Q6YNR9; Match level="QueryCoverage=98%, HitCoverage=100%, E-value=0.0, Identity=80%"; Hit description =Putative aconitase
  Pfam annotation: Domain name=Aconitase; Domain location=95-646; Score= 602.9; E_value=2.9e-178; Accession=PF00330.10; Description=Aconitase family (aconitate hydratase)
  Pfam annotation: Domain name=Aconitase_C; Domain location=774-904; Score=221.9; E_value=1.4e-63; Accession=PF00694.9; Description =Aconitase C-terminal domain
  Pfam module annotation: Pfam domain module=Aconitase::Aconitase_C; Domain location=95-646::774-904
MKGSIFGVISTENPFNSILTTLEKPGGAGEFGKYFSLPALNDRRIAISVMIDELNLNLGRLRIDGDIRVFGNTDRLPYSVRILLESAIRNCDEFQVKSNDVEKIIDWENTSPKLVEIPFKPARVLLQDFTGVPAVVDLACMRDAMNKLGGDSNKINPLVPVDLVIDHSVQVDVARSENAVQANMELEFQRNKERFGFLKWGSNAFNNMLVVPPGSGIVHQVNLEYLGRVVFNTNGVLYPDSVVGTDSHTTMIDGLGVAGWGVGGIEAEAAMLGQTCVVLTIGEVIPMSMVLPGVVGFKLLGKLRDGVTATDLVLTVTQMLRKHGVVGKFVEFYGEGMSELSLADRATIANMSPEYGATMGFFPVDHVTLQYLRLTGRSDETVSMIESYLRANKMFVDYSEPQVERVYSSYLELNLEDVEPCVSGPKRPHDRVPLREMKVDWHACLNNKVGFKGFAVPKESQNKVAEFTFQGTPAHLRHGDVVIAAITSCTNTSNPSVMLGAALVAKKACELGLQVKPWIKTSLAPGSGVVTKYLQRSGLQKYLNELGFNIVGYGCTTCIGNSGDINEAVASAITENGTYPLVNGIFSLYSLVNLRGYLSIGFLNIPDIVAAAVLSGNRNFEGRVHPLTRANYLASPPLVVAYALAGTVDIDFDTEPIGIGKDGTKIFFRDIWPSSEEIANVVQSSVLPAMFRDTYNAITQGNPMWNNLSVPTGTLYAWDPTSTYIHEPPYFRDMSMSPPGSHGVKDAYCLLNFGDSITTDHISPAGSIHKDSPAARYLIERGVDRRDFNSYGSRRGNDEVMARGTFANIRIVNKFLNGEVGPKTIHIPSGEKLSVFDAAEKYKSEGHDMIILAGAEYGSGSSRDWAAKGPMLLGVKAVIAKSFERIHRSNLVGMGIIPLCFKPGDDADSLGLTGHERYTIDLPSNVNEIRPGQDVTVVTDAGKSFVSTLRFDTEVELAYFNHGGILQYVIRNMVNAKH

SEQ ID NO: 152872 - protein, 172 aa, Glycine max
  Coding DNA Sequence Number=SeqID_36094
  Gene Ontology: Mol. function=DNA binding; Cellular component=beta -galactosidase complex; Biological process=DNA integration
  Pfam annotation: Domain name=rve; Domain location=1-116; Score=34.3; E_value=4.2e-07; Accession=PF00665.16; Description=Integrase core domain
MWIYLIKHKSKRFDVLQKFKAMSGRHSGTMIKSLRTDGGKEYTSRELENLCEQLGIQHEITPPYTPQHNGIAKRRNRSVLNMARSIMKQKSIPHSFWGEAATTVSLKEKVPEEYWSGRKPLVSHLRVFDSLCYKHITDARRRKLEDKSKPMILIGYHITSAYRLYSPKKGKN

SEQ ID NO: 152873 - protein, 50 aa, Glycine max
  Coding DNA Sequence Number=SeqID_36095
MVRTEYRTLRELVLFGTYREDPTEDLAFHTRKPPLQQREEQDERLQKYKW

SEQ ID NO: 152874 - protein, 79 aa, Glycine max
  Coding DNA Sequence Number=SeqID_36096
  Homolog annotation: Hit_ID=Q00M75; Match level="QueryCoverage=48%, HitCoverage=6%, E-value=5e-10, Identity=81%"; Hit description=PPR -repeat containing protein
MLYAALPLHMQRGCFRIRTHDQQVTKAQLYRCTRARPREPLLYKPEKKGSDTGEVCNMFKHEEDIPNALFGHHPNITIP

SEQ ID NO: 152875 - protein, 212 aa, Glycine max
  Coding DNA Sequence Number=SeqID_36097
  Homolog annotation: Hit_ID=Q9M8Y5; Match level="QueryCoverage=20%, HitCoverage=11%, E-value=2e-07, Identity=60%"; Hit description =Putative GDSL-motif lipase/acylhydrolase
MMILKIILWNKRILAETFPMKVVELFLTTRIMVDKGNDRKHDNEDYDVGYGGCAAMHSLENMSIEIAKDTSECGNDFKNNYFLVANSARSRQYPLPQYVKYVISKYQKLLQPLLSMTRFSSTLAFEIDHKSKIDNPLVRLPLPLAYKLELNLVAKRNAGNVPFVWEKAPGSPKDESKLLMQSSQGRDPSPKPWLGDSKKIGPEMQEEALGFS

SEQ ID NO: 152876 - protein, 249 aa, Glycine max
  Coding DNA Sequence Number=SeqID_36098
  Gene Ontology: Mol. function=zinc ion binding; Cellular component =integral to membrane
  Homolog annotation: Hit_ID=Q1SJ34; Match level="QueryCoverage=75%, HitCoverage=45%, E-value=5e-48, Identity=51%"; Hit description=Zinc finger, RING-type
  Pfam annotation: Domain name=zf-C3HC4; Domain location=118-158; Score= 18.9; E_value=0.0018; Accession=PF00097.15; Description=Zinc finger, C3HC4 type (RING finger)
VDGTNLCIELKFVMEHLGQIEERIRCLEAVVFRARQRQRWRPSQAPIRITNYAGESVTVADLQAEEDRVHQEFGGVDVGGEMMGSGRMGKRKASYLVAKALGVETNQGEGFATNLFHCNICLDKARDPVLTSCGHLFCWPCFHKLSYAYSNVRECPVCKGDVTEEGIIPIYGNASVDNNGKFESNEIGLTVPARPRPHRIEIPGEASGISIFTMSIKTHNLALLPQTNQSHTPDVAATTFAASSSVSSS

SEQ ID NO: 152877 - protein, 62 aa, Glycine max
  Coding DNA Sequence Number=SeqID_36099
MSALKEQMASMMEAMLEARCFDVLMMLKDQVLLSFIQDKNPRKSRYMIKFDLLESLGRSFPN

SEQ ID NO: 152878 - protein, 94 aa, Glycine max
  Coding DNA Sequence Number=SeqID_36100
MYALHVKHLLFLYSSCTAEIFEDFFNKVVFSYISGGVTSTTLRPKRVVYTLKYGDNVNAMLCMGMVRSKCSLKGLHHPQLSLEEHSLEDKGFLQ

SEQ ID NO: 152879 - protein, 67 aa, Glycine max
  Coding DNA Sequence Number=SeqID_36101
MEKLPDEGMAEETREGTAAEVTKISKNVNGGHKGWHEREGTWKGGIIYNPATTSNTTTVLAKKHRGF

SEQ ID NO: 152880 - protein, 107 aa, Glycine max
  Coding DNA Sequence Number=SeqID_36102
MASYGVTKHSKGKTKERGSSISNDGDEACEDARDLLSRIESFFVSFSVSGLSGWDKQEVQTFGSFSSDHQQGRDFMIHRFLLAAKAMTFEASQYASKKALIGQEHQK

SEQ ID NO: 152881 - protein, 136 aa, Glycine max
  Coding DNA Sequence Number=SeqID_36103
MSVVLELLIAKKTEEIKKKGVSPRIKSVRKKQPNPCVGQASPRPPAATAKTKTHKPKRNHHYHPTSDPSKNQPQPNPQILSMECIVRERYVNGSRSHHSHGDCAIDLYGTAYGEAMEERESRMRKEMRGHEMTAPR

SEQ ID NO: 152882 - protein, 57 aa, Glycine max
  Coding DNA Sequence Number=SeqID_36104
MKKRIFSTGHLDGDQRKQACCRVQPPLRPHQHDRRRLESETPDLAHRRKQKFFVYTS

SEQ ID NO: 152883 - protein, 261 aa, Glycine max
  Coding DNA Sequence Number=SeqID_36105
MALIHINEVALNMILVMKAMDKNSSILTQYSELDLKRQLATKWVDEECTLASSKVRYNGKIDLESQCLTKLGHQEIFGASFFGLPIVLPSLKAPSESWLKRTLPTICKKNITSQSNLTANICARSKTPDTTSSLCPKWETMMLKPNLHVCLHNLLLSKTADEEKKIAKHKLTSANEDVVNLKKIIARLEGELHVKDKVQSDLVSKLEEAQRQVVVLLLDFDCKILDVNCDVVDGEIVRDSQLCYDEEEEEQKNEVESNAAI

SEQ ID NO: 152884 - protein, 109 aa, Glycine max
  Coding DNA Sequence Number=SeqID_36106
MVSRSQQGCKNQGKERYQGEYHKSQRYHFEPDKPSQGKLRKTEELQQRLYCRLEEFRTCCNGGNSDSKRRDERNAKRGDDDVESSKNKLGFQQICNIGITYFDLETQSN

SEQ ID NO: 152885 - protein, 198 aa, Glycine max
  Coding DNA Sequence Number=SeqID_36107
  Homolog annotation: Hit_ID=Q1SRM6; Match level="QueryCoverage=82%, HitCoverage=39%, E-value=5e-22, Identity=37%"; Hit description=PRLI -interacting factor A
MMPHSQIFQNNQNYAVWTHPLPPYPPENAAVFSRRETFNPHPGRVTGNKRKDCHRTGSGPPALRSGGKGRRIHHPKRIFGRGGGSSRLTPPFAPRNTTSFIIRAKNCGGMVSPPTPEAAIFPAASLSPATFDEKSAKEQWGFNGYGSMKGLIRLRPGNLDSGAGRFEMVYPNSGEEHNNLDKRVSEQDTHIAHLEEQN

SEQ ID NO: 152886 - protein, 45 aa, Glycine max
  Coding DNA Sequence Number=SeqID_36108
MPTSSRRLGGSSPESYSLHPAAVILLPRTMFVIITGINHTIQNCK

SEQ ID NO: 152887 - protein, 477 aa, Glycine max
  Coding DNA Sequence Number=SeqID_36109
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9AUE0; Match level="QueryCoverage=88%, HitCoverage=21%, E-value=1e-177, Identity=69%"; Hit description =Callose synthase 1 catalytic subunit
MAFELYGMLAGNVSPLTGEPVKPAYGGDNEAFLMKVVKPIYDVIAKEAKRSNMGKAKHSHWRNYDDLNEYFWSVDCFRLGWPMRVDSDFFSVPFPQQERQVNKDEENRGPASDRWSGKTNFVEIRTFWHIFRSFDRMWSFYILCLQAMIIIAWNGSGELSSIFRGDVFKQVLSIFITAAILKLAQAILDIFLSWKARKVMSLHVQLRYIFKAILAAAWVIILPVTYAYSWKNPSGFAQTIKNWFGNGTGSPSLFILAVFIYLSPNILSALLFVFPFIRQFLERSNNGVVKLMMWWSQPRLFVGRGMQEGPISLLKYTSFWVMLILSKLAFSYYLEIKPLVAPTKAIMNAHVSVYRWHEFFPHARNNIGVVIAIWSPIILVRVSFCHMSHQVYFMDTQIWYAIFSTIVGGIYGAFRRLGELKLIREKSQISIDKNLRRTIPPKLSAIVRVQYLINLMLEYHTSNVELEFHTLHWILTK

SEQ ID NO: 152888 - protein, 798 aa, Glycine max
  Coding DNA Sequence Number=SeqID_36110
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=99%, HitCoverage=40%, E-value=0.0, Identity=78%"; Hit description=IMP dehydrogenase/GMP reductase
  Pfam annotation: Domain name=Glucan_synthase; Domain location=1-665; Score=530.4; E_value=1.9e-156; Accession=PF02364.6; Description=1,3 -beta-glucan synthase component
MYIRQALELQAFLDMAKDEELMKGYKAAELESMESTTGERSLWTQCQSLADMKFTYVVSCQQYSIHKRSGDSRAKEILKLMIKYPSLRVAYIDEVEEHIKDSSRKTDKVYYSALVKAALPSKSNDSSETVQSLDQVIYKIKLPGPAILGEGKPENQNHAIIFTRGEGLQTIDMNQDNYMEEAFKMRNLLQEFLKQHDGPRMPTILGLREHIFTGSVSSLAWFMSNQEHSFVTIGQRLLAYPLKVRFHYGHPDVFDRLFHLTRGGVSKASKVINLSEDIFAGMYFSFSSCYNSTLREGNVTHHEYIQVGKGRDVGLNQISMFEAKIAAGNGEQTMSRDIYRLGHRFDFFRMLSCYYTTIGFYFSTLITVLTVYVFLYGRLYLALSGVEESLNKQRAIRDNKALQVALASQSVVQIGFLLALPMLMEIGLERGFREALSEFVLMQLQLAPVFFTFSLGTKTHYYGRTLLHGGAEYKGTGRGFVVFHAKFADNYRLYSRSHFVKGIELMILLVVYHIFGHGYRGVVAYILITVTMWFMVGTWLFAPFLFNPSGFEWQKIVDDYTDWQKWISNRGGIGVSPQKSWESWWEKEHEHLRHSGKRGIATEIILALRFFIYQYGLVYHLSVTDEKTQSVLVYGLSWLIIFVILGLMKGMLLSVDCLHMRRLSADYQLLFRLIEGSIFLTFLAIFIILILLANMTIKDIIVCILAVMPTGWGMLLIAQACKPLIEKTGFWGSVRALARGYEVIMGLLLFTPVAFLAWFPFVSEFQTRMLFNQAFSRGLQISRILGGQRSERSSNHKE

SEQ ID NO: 152889 - protein, 248 aa, Glycine max
  Coding DNA Sequence Number=SeqID_36111
  Gene Ontology: Mol. function=oxidoreductase activity; Cellular component=integral to membrane; Biological process=response to oxidative stress
  Homolog annotation: Hit_ID=Q948P1; Match level="QueryCoverage=93%, HitCoverage=95%, E-value=5e-33, Identity=37%"; Hit description =Peroxisomal ascorbate peroxidase
  Pfam annotation: Domain name=peroxidase; Domain location=52-191; Score=-74.6; E_value=0.0018; Accession=PF00141.13; Description =Peroxidase
MVEPIVVDEEYRKEIEMARRELGVFITNNKCAPLMLQFAYLTLLNYCFHVFLANSLHCLRWWNDAATYDAKSRRGGPNGSIRLRIGQELKHEANKGLEKAVQYCEIVKTKLKLKKVSYANLYQDSNESPRTEGRFIDGEEDARNLRKIFSRMGLSDEQDIVALCGGHTLIRTMYPKVSMDEEIFFKEYAISHKKLSELGFNLNNLDQPKGPYAKLNQHKGLIGIGIASVVVTVILGYLLKRKKNQLKN

SEQ ID NO: 152890 - protein, 152 aa, Glycine max
  Coding DNA Sequence Number=SeqID_36112
  Subcellular localization annotation: CTP_CleavageSite=51; ConfidenceScore=5.35e-01
MEKLFQIKRNFLKFLTKQPAAALVVAFQNPTMMSPCRSPARMVSIIPKEARRKHKGESFSAREPTSPTVSCMGQVQGKKKKKARKQKRAQAHKDSIGEKKKILLWIQKGSDEGRKHRVLEEKAVEAPSLNTMKKFASGRGSLYDFDVKIAER

SEQ ID NO: 152891 - protein, 438 aa, Glycine max
  Coding DNA Sequence Number=SeqID_36113
  Gene Ontology: Mol. function=phospholipase D activity; Cellular component=membrane; Biological process=phosphatidylcholine metabolic process
  Homolog annotation: Hit_ID=Q8H1U0; Match level="QueryCoverage=94%, HitCoverage=47%, E-value=1e-165, Identity=67%"; Hit description =Phospholipase D delta isoform 1b
  Pfam annotation: Domain name=C2; Domain location=17-138; Score=79.0; E_value=1.5e-20; Accession=PF00168.20; Description=C2 domain
  Pfam annotation: Domain name=PLDc; Domain location=366-401; Score =35.3; E_value=2.2e-07; Accession=PF00614.12; Description =Phospholipase D. Active site motif
  Pfam module annotation: Pfam domain module=C2::PLDc; Domain location =17-138::366-401
MADTGDDNGVTYLHGDLDLKIIEARHLPNMDIFSERLRRCVTACDTIKFHSDAPAAADGDGGSQRTRTHHHRRIITSDPYVTVSVPQATVARTRVLKNAQNPVWKEQFHIPLAHPVVDLEFRVKDDDVFGAQSMGTVKVPARRIATGAKISEWFPVLLPSGKPPKPDTALHVEMQFTPVSENLLYQRGIAADPEHNGVRHTYFPVRKGSSVRLYQDAHCTESGEGKIPEIKLENGNVYRHGKCWEDICYAISEAHHMVYLVGWSIYHKVRLVREPTRPLPRGGDLTLGELLKYKSEEGVRVLLLVWDDKTSHDKVFLKTAGVMGTHDEETRKFFKHSSVMCVLSPRYASSKMSFLKQQASVGVVGTVFTHHQKCVIVDTQAAGNNRKITAFIGGLDLCDGRYDTPEHRLFRNLDDVFDGDFHNPTFPKTGKSYFNYFQ

SEQ ID NO: 152892 - protein, 1870 aa, Glycine max
  Coding DNA Sequence Number=SeqID_36114
  Gene Ontology: Mol. function=DNA-directed RNA polymerase activity; Cellular component=DNA-directed RNA polymerase II, core complex; Biological process=transcription from RNA polymerase II promoter
  Homolog annotation: Hit_ID=P18616; Match level="QueryCoverage=84%, HitCoverage=83%, E-value=0.0, Identity=83%"; Hit description=DNA -directed RNA polymerase II largest subunit
  Pfam annotation: Domain name=RNA_pol_Rpb1_1; Domain location=12-365; Score=503.8; E_value=2e-148; Accession=PF04997.3; Description=RNA polymerase Rpb1, domain 1
  Pfam annotation: Domain name=RNA_pol_Rpb1_2; Domain location=367-535; Score=361.0; E_value=1.9e-105; Accession=PF00623.11; Description=RNA polymerase Rpb1, domain 2
  Pfam annotation: Domain name=RNA_pol_Rpb1_3; Domain location=538-730; Score=195.6; E_value=1.1e-55; Accession=PF04983.8; Description=RNA polymerase Rpb1, domain 3
  Pfam annotation: Domain name=RNA_pol_Rpb1_4; Domain location=755-861; Score=199.7; E_value=6.7e-57; Accession=PF05000.7; Description=RNA polymerase Rpb1, domain 4
  Pfam annotation: Domain name=RNA_pol_Rpb1_5; Domain location=868 -1461; Score=532.8; E_value=3.8e-157; Accession=PF04998.8; Description=RNA polymerase Rpb1, domain 5
  Pfam annotation: Domain name=RNA_pol_Rpb1_6; Domain location=934 -1118; Score=352.4; E_value=7.2e-103; Accession=PF04992.5; Description=RNA polymerase Rpb1, domain 6
  Pfam annotation: Domain name=RNA_pol_Rpb1_7; Domain location=1203 -1337; Score=297.6; E_value=2.4e-86; Accession=PF04990.3; Description= RNA polymerase Rpb1, domain 7
  Pfam annotation: Domain name=RNA_pol_Rpb1_R; Domain location=1579 -1593; Score=12.3; E_value=1.5; Accession=PF05001.4; Description=RNA polymerase Rpb1 C-terminal repeat
  Pfam annotation: Domain name=RNA_pol_Rpb1_R; Domain location=1594 -1607; Score=20.0; E_value=0.0085; Accession=PF05001.4; Description =RNA polymerase Rpb1 C-terminal repeat
  Pfam annotation: Domain name=RNA_pol_Rpb1_R; Domain location=1608 -1621; Score=22.1; E_value=0.002; Accession=PF05001.4; Description =RNA polymerase Rpb1 C-terminal repeat
  Pfam annotation: Domain name=RNA_pol_Rpb1_R; Domain location=1622 -1635; Score=18.4; E_value=0.026; Accession=PF05001.4; Description =RNA polymerase Rpb1 C-terminal repeat
  Pfam annotation: Domain name=RNA_pol_Rpb1_R; Domain location=1636 -1649; Score=19.2; E_value=0.015; Accession=PF05001.4; Description =RNA polymerase Rpb1 C-terminal repeat
  Pfam annotation: Domain name=RNA_pol_Rpb1_R; Domain location=1650 -1663; Score=17.1; E_value=0.065; Accession=PF05001.4; Description =RNA polymerase Rpb1 C-terminal repeat
  Pfam annotation: Domain name=RNA_pol_Rpb1_R; Domain location=1664 -1677; Score=17.1; E_value=0.065; Accession=PF05001.4; Description =RNA polymerase Rpb1 C-terminal repeat
  Pfam annotation: Domain name=RNA_pol_Rpb1_R; Domain location=1678 -1691; Score=20.8; E_value=0.0048; Accession=PF05001.4; Description =RNA polymerase Rpb1 C-terminal repeat
  Pfam annotation: Domain name=RNA_pol_Rpb1_R; Domain location=1692 -1705; Score=17.1; E_value=0.065; Accession=PF05001.4; Description =RNA polymerase Rpb1 C-terminal repeat
  Pfam annotation: Domain name=RNA_pol_Rpb1_R; Domain location=1706 -1719; Score=17.1; E_value=0.065; Accession=PF05001.4; Description =RNA polymerase Rpb1 C-terminal repeat
  Pfam annotation: Domain name=RNA_pol_Rpb1_R; Domain location=1720 -1733; Score=18.8; E_value=0.02; Accession=PF05001.4; Description=RNA polymerase Rpb1 C-terminal repeat
  Pfam annotation: Domain name=RNA_pol_Rpb1_R; Domain location=1734 -1747; Score=19.8; E_value=0.0098; Accession=PF05001.4; Description =RNA polymerase Rpb1 C-terminal repeat
  Pfam annotation: Domain name=RNA_pol_Rpb1_R; Domain location=1748 -1761; Score=17.1; E_value=0.065; Accession=PF05001.4; Description =RNA polymerase Rpb1 C-terminal repeat
  Pfam annotation: Domain name=RNA_pol_Rpb1_R; Domain location=1762 -1774; Score=7.5; E_value=12; Accession=PF05001.4; Description=RNA polymerase Rpb1 C-terminal repeat
  Pfam annotation: Domain name=RNA_pol_Rpb1_R; Domain location=1775 -1787; Score=2.6; E_value=97; Accession=PF05001.4; Description=RNA polymerase Rpb1 C-terminal repeat
  Pfam annotation: Domain name=RNA_pol_Rpb1_R; Domain location=1788 -1801; Score=19.1; E_value=0.016; Accession=PF05001.4; Description =RNA polymerase Rpb1 C-terminal repeat
  Pfam annotation: Domain name=RNA_pol_Rpb1_R; Domain location=1802 -1815; Score=15.5; E_value=0.2; Accession=PF05001.4; Description=RNA polymerase Rpb1 C-terminal repeat
  Pfam annotation: Domain name=RNA_pol_Rpb1_R; Domain location=1816 -1829; Score=9.2; E_value=5.8; Accession=PF05001.4; Description=RNA polymerase Rpb1 C-terminal repeat
  Pfam annotation: Domain name=RNA_pol_Rpb1_R; Domain location=1830 -1842; Score=9.7; E_value=4.8; Accession=PF05001.4; Description=RNA polymerase Rpb1 C-terminal repeat
  Pfam annotation: Domain name=RNA_pol_Rpb1_R; Domain location=1843 -1856; Score=10.1; E_value=4.1; Accession=PF05001.4; Description=RNA polymerase Rpb1 C-terminal repeat
  Pfam module annotation: Pfam domain module=RNA_pol_Rpb1_1::RNA_pol _Rpb1_2::RNA_pol_Rpb1_3::RNA_pol_Rpb1_4::RNA_pol_Rpb1_5::RNA_pol_Rpb1_ 6::RNA_pol_Rpb1_7::RNA_pol_Rpb1_R::RNA_pol_Rpb1_R::RNA_pol_Rpb1 _R::RNA_pol_Rpb1_R::...
  Pfam module annotation: Pfam domain module=RNA_pol_Rpb1_R::RNA_pol _Rpb1_R::RNA_pol_Rpb1_R::RNA_pol_Rpb1_R::RNA_pol_Rpb1_R::RNA_pol_Rpb1_ R::RNA_pol_Rpb1_R::RNA_pol_Rpb1_R::RNA_pol_Rpb1_R::RNA_pol_Rpb1 _R::RNA_pol_Rpb1_R::...
  Pfam module annotation: Pfam domain module=RNA_pol_Rpb1_R::RNA_pol _Rpb1_R::RNA_pol_Rpb1_R::RNA_pol_Rpb1_R::RNA_pol_Rpb1_R; Domain location=12-365::367-535::538-730::755-861::868-1461::934-1118::1203- 1337::1579-1593::...
  Pfam module annotation: Domain location=1594-1607::1608-1621::1622 -1635::1636-1649::1650-1663::1664-1677::1678-1691::1692-1705::1706 -1719::1720-1733::1734-1747::1748-1761::1762-1774::1775-1787::1788 -1801::1802-1815::...
  Pfam module annotation: Domain location=1816-1829::1830-1842::1843 -1856
MDIRFPFSPAEVAKVRMVQFGILSPDEIRQMSVVQIEHGETTERGKPKVGGLSDPRLGTIDRKLKCETCTASMAECPGHFGHLELAKPMFHIGFLKTVLTIMRCVCFNCSKILADENDHKFKQALRIRNPKNRLKKILDACKNKSKCEGGDEIDIPGQDTDEPVKKSRGGCGAQQPKITIEGMKMIAEYKAQRKKSDDQEQLPEPVERKQTLSAERVLGVLKRISDEDCQLLGLNPKYARPDWMILQVLPIPPPPVRPSVMMDTSSRSEASALWHCFMCFWLLQDDLTHQLAMIIRHNENLKRQERNGSPAHIISEFAQLLQFHIATYFDNELPGLPRATQRSGRPIKSICSRLKAKEGRIRGNLMGKRVDFSARTVITPDPTINIDQLGVPWSIALNLTYPETVTPYNIERLKELVEYGPHPPPGKTGAKYIIRDDGQRLDLRYLKKSSDHHLELGYKVERHLNDGDFVLFNRQPSLHKMSIMGHRIKIMPYSTFRLNLSVTSPYNADFDGDEMNMHVPQSFETRAEVLELMMVPKCIVSPQSNRPVMGIVQDTLLGCRKITKRDTFITKDVFMNILMWWEDFDGKVPAPAILKPEPLWTGKQVFNLIIPKQINLIRYSSWHSESERGSITPGDTMVRIEKGELLTGTLCKKTLGTSTGSLIHVICCETLWLWKLFQSVPFFFVYVTESLLEYREEVGPDAARKFLGHTQWLVNYWLLQNAFSIGIGDTIADASTMETINQTISAAKEKVKQLIREAQEKKLEAEPGRTMMDSFENRVNQTLNRARDDAGNSAQKSLSESNNLKAMVTAGSKGSFINISQMTACVGQQNVEGKRIPYGFIDRTLPHFTKDDYGPESRGFVENSYLRGLTPQEFFFHAMGGREGLIDTAVKTSETGYIQRRLVKAMEDIMVKYDGTVRNSLGDVIQFLYGEDGMDAVWIETQKLDSLKMKKTEFDRVFRYEFDDENWKPTYMLEEPVEDLKTIREFRNVFEAEVQKLEADRYQLATEIATTGDSSLPLPVNLKRLIWNAQKTFKVDFRRPSDMHPMEIVEAIDKLQERLKVVPGEDLLSQEAQKNATLLFNILLRSTFASKRVLEEYRLSREAFEWVVGEIESRFLQSLVASGEMIGCVAAQSIGEPATQMTLNTFHYAGVSAKNVTLGVPRLREIINVAKRIKTPSLSVYLRSDVGKTKERAKSVQCALEYTTLRSVTQATEVWYDPDPMSTIIEEDADFVKSYYEMPDEEVALEKISPWLLRIELNREMMVDKKLSMADIAEKINLEFDDDLTCIFNDDNAEKLILRIRIMNDEAPKGEIQDESAEDDVFLKKIESNMLTEMTLRGIPDINKVFIKNTKVQKFDENQGFKPNEEWMLDTEGVNLLAVMCHEDVDATRTTSNHLIEVIEVLGIEAVRRALLDELRVVISFDGSYVNYRHLAILCDTMTYRGHLMAITRHGINRNDTGPMMRCSFEETVDILLDAAVYAETDYLRGVTENIMLGQLAPIGTGECALYLNDEMLKNAIELQLPSYMDGLDFGMTPARSPISGTPYHEGLMSPSYLLSPNLRLSPTSDAQFSPYVGGMAFSPTSSPGYSPSSPGYSPSSPGYSPTSPGYSPTSPGYSPTSPGYSPTSPTYSPSSPGYSPTSPAYSPTSPSYSPTSPSYSPTSPSYSPTSPSYSPTSPSYSPTSPAYSPTSPAYSPTSPSYSPTSPSYSPTSPSYSPTSPSYSPTSPSYSPTSPAYSPTSPGYSPTSPSYSPTSPSYSPTSPSYNPQSAKYSPSLAYSPSSPRLSPSSPYSPTSPNYSPTSPSYSPTSPSYSPSSPTYSPSSPYNSGVSPDYSPSSPQFSPSTGYSPSQPGYSPSSTSQYTPQTSDKDDGGTR

SEQ ID NO: 152893 - protein, 748 aa, Glycine max
  Coding DNA Sequence Number=SeqID_36115
  Gene Ontology: Mol. function=binding; Cellular component=nucleus; Biological process=mRNA editing
  Homolog annotation: Hit_ID=Q2QTL4; Match level="QueryCoverage=90%, HitCoverage=90%, E-value=0.0, Identity=35%"; Hit description =Pentatricopeptide, putative, expressed
  Pfam annotation: Domain name=PPR; Domain location=111-145; Score =12.1; E_value=0.27; Accession=PF01535.11; Description=PPR repeat
  Pfam annotation: Domain name=PPR; Domain location=174-208; Score =33.2; E_value=9e-07; Accession=PF01535.11; Description=PPR repeat
  Pfam annotation: Domain name=PPR; Domain location=236-270; Score =30.1; E_value=7.8e-06; Accession=PF01535.11; Description=PPR repeat
  Pfam annotation: Domain name=PPR; Domain location=298-332; Score =36.0; E_value=1.3e-07; Accession=PF01535.11; Description=PPR repeat
  Pfam annotation: Domain name=PPR; Domain location=360-394; Score =36.6; E_value=8.8e-08; Accession=PF01535.11; Description=PPR repeat
  Pfam annotation: Domain name=PPR; Domain location=422-456; Score =27.8; E_value=3.7e-05; Accession=PF01535.11; Description=PPR repeat
  Pfam annotation: Domain name=PPR; Domain location=49-83; Score=29.5; E_value=1.2e-05; Accession=PF01535.11; Description=PPR repeat
  Pfam annotation: Domain name=PPR; Domain location=523-557; Score =44.0; E_value=5.1e-10; Accession=PF01535.11; Description=PPR repeat
  Pfam annotation: Domain name=PPR; Domain location=558-592; Score=7.4; E_value=1; Accession=PF01535.11; Description=PPR repeat
  Pfam annotation: Domain name=PPR; Domain location=594-627; Score=8.0; E_value=0.84; Accession=PF01535.11; Description=PPR repeat
  Pfam annotation: Domain name=PPR; Domain location=660-694; Score=0.9; E_value=5.9; Accession=PF01535.11; Description=PPR repeat
  Pfam module annotation: Pfam domain module=PPR::PPR::PPR::PPR::PPR::PP R::PPR::PPR::PPR::PPR::PPR; Domain location=111-145::174-208::236 -270::298-332::360-394::422-456::49-83::523-557::558-592::594 -627::660-694
MKLKLGIRSIGEAGKHAFNHNRQIIQLGKLGKVEEAIRIFFNMTHKNLVTYNSMISVLAKNARIRDARQLFDQMSLRNLVSWNTMIAGYLHNNMVEEASELFDVMPERDNFSWALMITCYTRKGKLEKARELLELVPDKLDTACWNAMIAGYAKKGQFNDAKKVFEQMPAKDLVSYNSMLAGYTQNGKMHLALQFFESMTERNVVSWNLMVAGYVKSGDLSSAWQLFEKIPNPNAVSWVTMLCGLAKYGKMAEARELFDRMPSKNVVSWNAMIATYVQDLQVDEAVKLFKKMPHKDSVSWTTIINGYIRVGKLDEARQVYNQMPCKDITAQTALMSGLIQNGRIDEADQMFSRIGAHDVVCWNSMIAGYSRSGRMDEALNLFRQMPIKNSVSWNTMISGYAQAGQMDRATEIFQAMREKNIVSWNSLIAGFLQNNLYLDALKSLVMMGKEGKKPDQSTFACTLSACANLAALQVGNQLHEYILKSGYMNDLFVGNALIAMYAKCGRVQSAEQVFRDIECVDLISWNSLISGYALNGYANKAFKAFEQMSSERVVPDEVTFIGMLSACSHAGLANQGLDIFKCMIEDFAIEPLAEHYSCLVDLLGRVGRLEEAFNTVRGMKVKANAGLWGSLLGACRVHKNLELGRFAAERLFELEPHNASNYITLSNMHAEAGRWEEVERVRMLMRGKRAGKQPGCSWIEVQNQIQHFLSHDPAKLRPKNIQIILNTLAAHMRDKCNTSDMKSAFDIL

SEQ ID NO: 152894 - protein, 78 aa, Glycine max
  Coding DNA Sequence Number=SeqID_36116
  Subcellular localization annotation: CTP_CleavageSite=63; ConfidenceScore=5.14e-01
MQRILGCLAATFSACLAPGRGNDRSVVTLSPLASVPMYLQLVSTSNRDLRRPCPCYHKICMCMCMYVPYAITFLVKAG

SEQ ID NO: 152895 - protein, 276 aa, Glycine max
  Coding DNA Sequence Number=SeqID_36117
  Gene Ontology: Mol. function=transferase activity, transferring acyl groups, acyl groups converted into alkyl on transfer; Cellular component=cytoplasm; Biological process=tricarboxylic acid cycle
  Homolog annotation: Hit_ID=Q96544; Match level="QueryCoverage=97%, HitCoverage=65%, E-value=1e-108, Identity=66%"; Hit description =Citrate (Si)-synthase
  Pfam annotation: Domain name=Citrate_synt; Domain location=1-260; Score=305.4; E_value=1e-88; Accession=PF00285.11; Description =Citrate synthase
MAKVVQSEFQKAYEGGIAKARYWEPTYEDTMNLIARLPAIAAYIYRRKYKDGKIIPLDDSLDYGANYAHMLGFDDPEMLEFMRLYISIHSDHEGGNVSSHTAHLVASPLSDPYLAFAAALNGLAGPLHGLANQEVLRWIRSIVAEFGTPNISTEQLADYINKTLSRGQVVPGYGHGVLRQTDPRYTCQREFALKHLPNDPYFQLVKNPWPNVDAHSGVLLNYYGLTEENYYTVLFGVSRSFGVGPQLIWDRALGMPLERPKSVTLEKLEQLVAKSS

SEQ ID NO: 152896 - protein, 194 aa, Glycine max
  Coding DNA Sequence Number=SeqID_36118
  Gene Ontology: Mol. function=binding; Cellular component =intracellular; Biological process=protein kinase C activation
  Homolog annotation: Hit_ID=Q10AH5; Match level="QueryCoverage=89%, HitCoverage=45%, E-value=2e-39, Identity=44%"; Hit description =Pentatricopeptide, putative, expressed
MLPLNLKLCLITLLSLLLACVNLVAFNLIKEIHGCAVRNSIHLHHQLSSALIEVFERCGSLRCASLVFEKMRDEDKDVVMWSNLIPTCTFHGEAEACNHVGLVDEAVWYFARMSGEYGVEAGSDHYSCLVNVLGRAGRLQEAYEVIKGMSVKVTEKAWEGLLGACKNFEELRLAKVASRALVEVESGNAANYVL

SEQ ID NO: 152897 - protein, 73 aa, Glycine max
  Coding DNA Sequence Number=SeqID_36119
MVEANLVGARASNFNVLNELNIVVVVVAISYDYDNDGDAGGGVNDRGGISVGVGDNGGDSDGVSDSDNEKCHS

SEQ ID NO: 152898 - protein, 47 aa, Glycine max
  Coding DNA Sequence Number=SeqID_36120
MQGPLPHGGLGQGLDLGLGPDQDLLKNKGQDPSREVVEDQDQDVTKG

SEQ ID NO: 152899 - protein, 245 aa, Glycine max
  Coding DNA Sequence Number=SeqID_36121
  Gene Ontology: Mol. function=sequence-specific DNA binding; Cellular component=nucleus; Biological process=regulation of transcription, DNA-dependent
  Homolog annotation: Hit_ID=Q8LC79; Match level="QueryCoverage=93%, HitCoverage=94%, E-value=3e-41, Identity=40%"; Hit description=GATA transcription factor 19
  Pfam annotation: Domain name=GATA; Domain location=127-162; Score =75.1; E_value=2.2e-19; Accession=PF00320.17; Description=GATA zinc finger
  Subcellular localization annotation: CTP_CleavageSite=17; ConfidenceScore=5.17e-01
MHRCCSGSQGHVMGPCTCGMFHSQTTSSFAMFFSMPNHKPPPYDDSDNIYDYSSFTPSSSSSVDCTLSLGTPSTRFSEDEEKRSRHERRSVSNFCWDLLQSKHNNPQSHSKSSRTTNTTDPLLARRCANCDTTSTPLWRNGPRGPKSLCNACGIRFKKEERRASAAAATPASAASGGVMESAQVYNNSWYAHQQSQKMQCFSPGMGNEFRFVDDADRDAADNGIPFLSWRLNVTDRTSLVHDFTR

SEQ ID NO: 152900 - protein, 69 aa, Glycine max
  Coding DNA Sequence Number=SeqID_36122
MDIAALLTSAGVNISYYGNNPAMSMCTFEESLLSGCTWSQESYARSTCFDNMAPTSCTTKTLDQYLLKC

SEQ ID NO: 152901 - protein, 355 aa, Glycine max
  Coding DNA Sequence Number=SeqID_36123
  Gene Ontology: Mol. function=transferase activity, transferring nitrogenous groups; Cellular component=cytoplasm; Biological process= ethylene biosynthetic process
  Homolog annotation: Hit_ID=O80334; Match level="QueryCoverage=99%, HitCoverage=76%, E-value=1e-138, Identity=67%"; Hit description=1 -aminocyclopropane-1-carboxylate synthase
  Pfam annotation: Domain name=Aminotran_1_2; Domain location=1-332; Score=279.4; E_value=7.2e-81; Accession=PF00155.11; Description =Aminotransferase class I and II
MAKIRENGIKFASEKLVLTAGATPANEILMFCLADPGEAFILPTPYYPGFDRDLKWRTGVEIVPMHCSSSNGFRITSSALEQAYQQAQKLNLKIKGVLVTNPSNPLGITMTKTELNHLVDFAIDKNIHIISDEIYSGTVFDSPKFVSITEVVNERITTVNNNSITSIWNRIHIVYGFSKDLGIPGFRVGMIFSNNETVVAAATKMSSFGLVSSQTQYLVANLLKDKKFTCKHMEETQKRLKRRKEMLVSGLRNAGIRCLKSNAGLFCWVDMRHLLGSATTFEAEKELWMNILCKVGLNISPGSSCHCCEPGWFRVCFANMSEDTLEVAMRRIKAFADSITISTSVVRGSIAKWEN

SEQ ID NO: 152902 - protein, 100 aa, Glycine max
  Coding DNA Sequence Number=SeqID_36124
  Subcellular localization annotation: CTP_CleavageSite=66; ConfidenceScore=5.25e-01
MSMCGFLLFSRMRVKAPSSLMTQKSKVGAVNKQIMSHRKWEYNSGSNTYKRKRLGTATRKGLLLISTMTKMPSQPFISPKDTRELHVLNCDGFGCRLVAS

SEQ ID NO: 152903 - protein, 395 aa, Glycine max
  Coding DNA Sequence Number=SeqID_36125
  Gene Ontology: Mol. function=phosphoribosylformylglycinamidine synthase activity; Cellular component=cytoplasm; Biological process =purine nucleotide biosynthetic process
  Homolog annotation: Hit_ID=Q8PGR7; Match level="QueryCoverage=64%, HitCoverage=19%, E-value=1e-98, Identity=70%"; Hit description =Phosphoribosylformylglycinamidine synthase
MAFNHRRIVAVRAERVLRGLLVGVLDHPEQRAVLLLTVDGPAGVEDLVPAVLGIGLREHHQFDVGRRAAQRGEAFAQVVDLVLGHGQAEALVGGLQLVHRHAFQFATGRRREQRLALLHGLQHRLRHRVVQRLDQRLLGGGIGRPALHVDAQAALDPAHRLPGTTDQLGGLARPRRQRAQARHHDAADRAFGHGLGLRRRFEDAAQGGQVGGGAAFGLHEVDVPGTTDAQGGSDGLQAGFKTFAAERRQGGRALEDHHVRGTVVGKRARSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 152904 - protein, 148 aa, Glycine max
  Coding DNA Sequence Number=SeqID_36126
  Gene Ontology: Mol. function=metal ion binding; Biological process =metal ion transport
  Homolog annotation: Hit_ID=Q1SXE7; Match level="QueryCoverage=73%, HitCoverage=54%, E-value=6e-43, Identity=58%"; Hit description=PPAK motif; Heavy metal transport/detoxification protein
  Pfam annotation: Domain name=HMA; Domain location=34-95; Score=47.3; E_value=5.2e-11; Accession=PF00403.16; Description=Heavy-metal -associated domain
MGEEAKQESPKAHESKPEENQEEKKEPKPPSPCVLFLDLHCKGCAKKIKKSIMKMRGVEGVVIDMAKNEVTIKGTVEPQAICNMISKKTKKRAKVISPLPEAVEGEPIPSQASEPVIVELNISMHCEACAAQLKRKILKMRERDVNNK

SEQ ID NO: 152905 - protein, 133 aa, Glycine max
  Coding DNA Sequence Number=SeqID_36127
MKADTEAMKEHMTTMMEAMMSMRKMMEVNTTTVVAASTATEMDPIHPSSFNRERLRAIEGGGNYAFTDITELCLVPDVVIPLKFKVPDFDKYKGTTCPKNHLKMYCRKMGVYAKDEKLLMHFFQESLAGAAIT

SEQ ID NO: 152906 - protein, 310 aa, Glycine max
  Coding DNA Sequence Number=SeqID_36128
MDQVQRQSFSKLAPTIEEFEGILGCPIGGRKPYLFSGYYPSMERVVGVVKILELLFPNIDGLVDLATVDAFLAYHHNKESLLRYHMRGAPLEETIMPFIARGFNEANTKILQKIRKAWNKVGRKDKELRGRSNGVIGNYHKWLKSRVQGAELEKTKVVKKKMKVVVTRVRKECDRLIDINMSATEALEQEMKKARKEDNELKLRKAETDKSRMENVMLKDELRNCQESKGSLKEQLSKREKNMLIIIDQYKEKKNLPAGRGQVLKDEHAKVSAFQVEREAREEVIELLHEVDGQICSHSKWKSRASKAIS

SEQ ID NO: 152907 - protein, 59 aa, Glycine max
  Coding DNA Sequence Number=SeqID_36129
  Subcellular localization annotation: CTP_CleavageSite=12; ConfidenceScore=5.00e-01
MAEPSKKRKGVSTSSAVTGTRSYGASKAHTTQIPPSISSPTLFSSEEQHIWNGYPHHSA

SEQ ID NO: 152908 - protein, 36 aa, Glycine max
  Coding DNA Sequence Number=SeqID_36130
MVQVVVDMLLVQVFATGMQILSRIILRPREEVEVVD

SEQ ID NO: 152909 - protein, 87 aa, Glycine max
  Coding DNA Sequence Number=SeqID_36131
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=22%, E-value=1e-18, Identity=61%"; Hit description =Integrase, catalytic region
MLILNEVLLGLNNSRQKLLTKNRVLVRYQTLRKIVEFTDIIEEELCDSIRVELGLESPEMHNFRKYVNYRHDDSIPLRMWKTGDEIH

SEQ ID NO: 152910 - protein, 83 aa, Glycine max
  Coding DNA Sequence Number=SeqID_36132
MRDKFHLEDKVSSLGGGIDSNQEPEPSPLENIEPAVQLEIPSSQEGRPKRSTTRPVYLNEFVKCGNKQLSPSTCLSEAEPFPD

SEQ ID NO: 152911 - protein, 149 aa, Glycine max
  Coding DNA Sequence Number=SeqID_36133
AAGPMTCGEPFGPAIFHLLSSRGGGGGGLDDMRRQILVIPHTFSPFRHSRVRWHSETNFVFCAFCHPEPFRHSRVRWHAETNIVFCAFCHPEAAGPMTCGEPFGPALFHLLSSRGGEPDDMRGTIWSSESSDKHAETNYGHSAPFVIQG

SEQ ID NO: 152912 - protein, 354 aa, Glycine max
  Coding DNA Sequence Number=SeqID_36134
  Gene Ontology: Mol. function=endonuclease activity
  Homolog annotation: Hit_ID=Q1T6I5; Match level="QueryCoverage=100%, HitCoverage=72%, E-value=1e-167, Identity=80%"; Hit description =Calcium-binding EF-hand; Endonuclease/exonuclease/phosphatase
  Pfam annotation: Domain name=Exo_endo_phos; Domain location=9-281; Score=-3.4; E_value=0.02; Accession=PF03372.13; Description =EndonucleaseExonucleasephosphatase family
DPSCRESDYRAYWLARNHRILDWLLNDRSSIICLQEFWVGNEELVNLYEKSLGDAGYVSFKLGRTNNRGDANGSFSQLNCNPALINVVMFHVLSFDPELPVEDLCLLIAVQREYFNILNYKELHFNDFGDRVAQLLHVELASPISQWRNSNIRQEILIVNTHLIFPHDSTLSLVRLQQVYKILQYVESYQNDFQLKPMPIVLCGDWNGSKRGHVYKFLRSQGFVSSYDTAHHYTDADAHKWVSHRNHRGNICAVDFIWLLNPDKYRKLLKASWSEAVFGMFKYLLRRAILTESDAFAFLKVDNEDCITYSGFCEALKQLSLTGHCHGLSDEEIKDLWVQADVDGNGVLDYKKFL

SEQ ID NO: 152913 - protein, 224 aa, Glycine max
  Coding DNA Sequence Number=SeqID_36135
  Gene Ontology: Mol. function=helicase activity
  Homolog annotation: Hit_ID=Q9ZQ61; Match level="QueryCoverage=93%, HitCoverage=22%, E-value=5e-31, Identity=33%"; Hit description =Putative helicase
MTRDRLQDVQVNNIKLKLIANREKDGCTYNVPTVPEVATLIVGDFDANSKIDIIIETQHGQLQRIHELHSSYLALQYPLLFPYGEDGYRPDILHSSRSDVRKAFLHQKQPKKTFEVTKFCSLQQSLDDGSGRGLNKAMWASQICFITLTCNPNWPEIHRLLNPLNLKAADRPDIISRVFKLKYEQMLMDLTKNHMLGKVIAYEIDQIISAEIPSQQDDPELYSL

SEQ ID NO: 152914 - protein, 95 aa, Glycine max
  Coding DNA Sequence Number=SeqID_36136
MGTGGGGGGCVRVNSGGEETGGYSGDNNQPMKKEVLSKGISSLVASNRLLPMANPKHFATPTHILYADDIFVFWRGTKKNIVNLMDLFHSNGEVS

SEQ ID NO: 152915 - protein, 127 aa, Glycine max
  Coding DNA Sequence Number=SeqID_36137
  Gene Ontology: Mol. function=hydrolase activity, acting on ester bonds; Biological process=lipid metabolic process
  Homolog annotation: Hit_ID=Q9FVV1; Match level="QueryCoverage=94%, HitCoverage=32%, E-value=3e-14, Identity=36%"; Hit description =Putative GDSL-motif lipase/acylhydrolase; 82739-81282
  Subcellular localization annotation: CTP_CleavageSite=26; ConfidenceScore=5.10e-01
MTTSITTLKPSIMIQASATCLNPLLNSSLKGSLSNLRKLYGLGARKLIMFEIGPIGCIPSVSRKHLHKGDCIEETNQMVTYFNERLPPMLKNLTSSLPGSTFVLGRSNSLGYDAIKNPSKYGKIPKQ

SEQ ID NO: 152916 - protein, 113 aa, Glycine max
  Coding DNA Sequence Number=SeqID_36138
  Gene Ontology: Mol. function=nucleic acid binding
  Homolog annotation: Hit_ID=Q1SHC9; Match level="QueryCoverage=91%, HitCoverage=21%, E-value=1e-18, Identity=45%"; Hit description=Zinc knuckle, putative
MGATERVADYITRVLNLANQMKGCGKKITEQMIIEKIMRTLIPCFDYIGVAIEESKDIEVMKVKELQGSLEAQELRLIQRELHNKRPGRRLKNWSSTLNASKQPFSARSQLGG

SEQ ID NO: 152917 - protein, 74 aa, Glycine max
  Coding DNA Sequence Number=SeqID_36139
MVGENALHIGPWNEGFNLFFFSLTFGNANKAIGGGALESTRNVPIDNGEHLNENIEVRDEFIAIGIRMNMCKDP

SEQ ID NO: 152918 - protein, 489 aa, Glycine max
  Coding DNA Sequence Number=SeqID_36140
  Gene Ontology: Mol. function=phenylalanine-tRNA ligase activity; Cellular component=cytoplasm; Biological process=tRNA aminoacylation for protein translation
  Homolog annotation: Hit_ID=P08312; Match level="QueryCoverage=64%, HitCoverage=96%, E-value=1e-167, Identity=91%"; Hit description =Phenylalanyl-tRNA synthetase alpha chain
  Pfam annotation: Domain name=Phe_tRNA-synt_N; Domain location=131 -203; Score=131.2; E_value=2.9e-36; Accession=PF02912.9; Description =Aminoacyl tRNA synthetase class II, N-terminal domain
  Pfam annotation: Domain name=Ribosomal_L20; Domain location=2-109; Score=239.3; E_value=8.2e-69; Accession=PF00453.8; Description =Ribosomal protein L20
  Pfam annotation: Domain name=tRNA-synt_2d; Domain location=206-441; Score=540.5; E_value=1.8e-159; Accession=PF01409.10; Description =tRNA synthetases class II core domain (F)
  Pfam module annotation: Pfam domain module=Phe_tRNA-synt_N::Ribosomal_ L20::tRNA-synt_2d; Domain location=131-203::2-109::206-441
MARVKRGVIARARHKKILKQAKGYYGARSRVYRVAFQAVIKAGQYAYRDRRQRKRQFRQLWIARINAAARQNGISYSRFINGLKKASIEIDRKILADIAVFDKVAFTALGISIVRFLSRQDLVARATAAIDEASDIAALDAVRVEFLGKKGHLTLQMTTLRELPAEERPAAGAVINDAKQQVQDRLNARKDTLESAALNARLAAETIDVSLPGRRIENGGLHPVTRTIDRIETFFGELGFPLATGPEIEDDYHNFDALNIPGHHPARADHDTFWFDATRLLRTQTSGVQIRTMKNQQPPIRIIAPGRVYRNDYDQTHTPMFHQMEGLIVDKDISFTNLKGTLHDFLNNFFEENLQIRFRPSYFPFTEPSAEVDVMGKNGKWLEVLGCGMVHPNVLRNVGIDPEIYSGFAFGMGMERLTMLRYGVTDLRAFFENDLPLDSAALSEQITMAGLEVDGVDPVAGAFHGVVVGEVVERDQHPNADKLRVTKIN

SEQ ID NO: 152919 - protein, 224 aa, Glycine max
  Coding DNA Sequence Number=SeqID_36141
MTYTKKTDQMMFEAAKEIANKIGRFHGGTGLTGFLCRPWTLRSNVTIKQYFGPTPRTSHTSSSMAPKDMEQLTQKIRDQLEESITEKVTRQVLALPPEPVDGRSATHVSTKENVVIWFCSLHNRLDFLKGIIIRSDIFFNTFTLALFGNINILIVQFTSMFVLNNALKGFDDTPQSKSKATARWIVVKCNRQKGSTACEYYVMHRMSTIILGSFKNNWKMVNLG

SEQ ID NO: 152920 - protein, 160 aa, Glycine max
  Coding DNA Sequence Number=SeqID_36142
  Gene Ontology: Mol. function=hydrolase activity
  Homolog annotation: Hit_ID=Q3SC78; Match level="QueryCoverage=87%, HitCoverage=44%, E-value=1e-56, Identity=69%"; Hit description=ACI14
VIGYLNGGSILNLECCSSVNCDLVKAVPDDHKKFLADLVWVHEEDDVFVNTDDGVKCCKLIAVHAGLEKGKDVKEQLKLLKARDTRVPKVEALSGRKSVWDIPEELTASPAIVVSGHHAKLHVEGLRLIIDEGGGYKDRPVAAIILPSMKIIRDTDELAK

SEQ ID NO: 152921 - protein, 218 aa, Glycine max
  Coding DNA Sequence Number=SeqID_36143
  Homolog annotation: Hit_ID=Q8L8A7; Match level="QueryCoverage=84%, HitCoverage=58%, E-value=2e-37, Identity=42%"; Hit description =Transcription activator
  Pfam annotation: Domain name=WRC; Domain location=15-60; Score=98.4; E_value=2.1e-26; Accession=PF08879.1; Description=WRC
SVLESGYYWGRAALDPEPGRCRRTDGKKWRCSKDAVAGQKYCDRHMHRGRNRSRKPVEQRDGSLSAIASVSSSPSSSFNLLHLSESSSGAKSDNKSFFENHDHVDGDGNSAKSDGHVLRHFFDDWPRTLQEPDNGESNGCQNNNSGTCLSMSTPGITSSDVSLKLSTGHGEDACHAASMGGPLAEALRSSTTSSTSSPTSVLLQLPPSSASEASFIST

SEQ ID NO: 152922 - protein, 62 aa, Glycine max
  Coding DNA Sequence Number=SeqID_36144
MALSNLLFPIIQAFDLDNLIFVEPNDDAQSEEDLDDDDGDGDHDESDDIHGDDPIRGLDMLL

SEQ ID NO: 152923 - protein, 746 aa, Glycine max
  Coding DNA Sequence Number=SeqID_36145
  Gene Ontology: Mol. function=protein serine/threonine kinase activity; Cellular component=cytoplasm; Biological process=protein amino acid phosphorylation
  Homolog annotation: Hit_ID=Q9LFA2; Match level="QueryCoverage=99%, HitCoverage=85%, E-value=0.0, Identity=51%"; Hit description=Protein kinase-like
  Pfam annotation: Domain name=Pkinase; Domain location=361-693; Score =241.3; E_value=2.1e-69; Accession=PF00069.15; Description=Protein kinase domain
  Pfam annotation: Domain name=Pkinase_Tyr; Domain location=361-693; Score=-6.7; E_value=4.6e-12; Accession=PF07714.7; Description =Protein tyrosine kinase
  Pfam module annotation: Pfam domain module=Pkinase::Pkinase_Tyr; Domain location=361-693::361-693
  Subcellular localization annotation: CTP_CleavageSite=43; ConfidenceScore=5.06e-01
ASEMAAMKRLSKSTASPRISEVGKIQTLYNSVVVEGRRSGPSNAESKGSTSEISLVPEESNSLSLDNASQSHPTVKSTSLSPNVQSSKIAAAIATTQNDTGASLMPSDLASSSSKVGVLSQSSEPAQIEKQTSESSSSSCNTNGSKLEFPENASSPKKIGNKASASNSGRKGRLQTVSSSSTSVNGNRVCKLSRNAPRTVKSFIKNKKFGKKKVKQDSVSALFDPTSNEVNNKSVSGTTQLVCERCWCAIENNEGVTSLDSLSPGEGINSVNVHSGAASAGCNSSREVTKVKKNTVLKEQLEFSQSSKSSQGDYSSSTSTSDESNLSGSSCGNRPHMSKDVRWKAIRHAQMQHGVLGLRHFNLLKKLGCGDIGTVYLAELIGKNCLFAIKVMDNEFLARRKKTPRAQTEREILRMLDHPFLPTLYAQFTSDNLSCLVMEYCPGGDLHVLRQKQLGRSFSEPAARFYVAEVLLALEYLHMLGVVYRDLKPENILVREDGHIMLTDFDLSLRCDVSPTLLKSSSDVDPAKISGPCAQSSCIEPFCIEPACQVPCFSPRILPPAAKARKLKTDLAAQLRSLPQLVAEPTDARSNSFVGTHEYLAPEIIKGEGHGAAVDWWTFGVFLYELLYGRTPFKGSNNEETLANVVLQGLRFPDTPFVSIQGRDLIRGLLVKEPENRLGSEKGAAEIKQHPFFEGLNWALIRCAIPPELPDLREFGVSEMTLQSQGKGVKYVECNAAGELVEFELF

SEQ ID NO: 152924 - protein, 128 aa, Glycine max
  Coding DNA Sequence Number=SeqID_36146
  Subcellular localization annotation: CTP_CleavageSite=79; ConfidenceScore=5.28e-01
MLHIKPASSKNWFPAIFSSIQSFHQSVKSTKQIKSNHSQGRIQEQQQLLLLPFQSEVPKPQKEKFEISVNGIRQNNTVMSEHERTSNNTVNRRLTERDITNQTVQARNAIENTEAAPASKQRRRNDAH

SEQ ID NO: 152925 - protein, 45 aa, Glycine max
  Coding DNA Sequence Number=SeqID_36147
MAKSFKCVAISLGSQPVSLLTKIESESKSDTDIEEFQRGVSESEK

SEQ ID NO: 152926 - protein, 99 aa, Glycine max
  Coding DNA Sequence Number=SeqID_36148
SALFSPIAITNGERQKRKAKGSEILFLSFSSAPEKILWRKDSDLNVWKPVEHSSDAKLAGESDPLGELMKILFYVYQNPVEVSWEASQFGLPDIGATIS

SEQ ID NO: 152927 - protein, 1014 aa, Glycine max
  Coding DNA Sequence Number=SeqID_36149
  Gene Ontology: Mol. function=DNA binding; Biological process =regulation of transcription
  Homolog annotation: Hit_ID=Q1SXG6; Match level="QueryCoverage=48%, HitCoverage=75%, E-value=1e-146, Identity=56%"; Hit description=No apical meristem (NAM) protein
  Pfam annotation: Domain name=M20_dimer; Domain location=857-965; Score=32.3; E_value=1.7e-06; Accession=PF07687.4; Description =Peptidase dimerisation domain
  Pfam annotation: Domain name=NAM; Domain location=22-150; Score =286.6; E_value=4.7e-83; Accession=PF02365.6; Description=No apical meristem (NAM) protein
  Pfam annotation: Domain name=Peptidase_M20; Domain location=672-1002; Score=22.1; E_value=6.6e-05; Accession=PF01546.18; Description =Peptidase family M20M25M40
  Pfam module annotation: Pfam domain module=M20_dimer::NAM::Peptidase _M20; Domain location=857-965::22-150::672-1002
MGSVDCYPSRVDDAAVVSLDSLPLGFRFRPTDEELVNYYLRQKINGNGREVWVIREIDVCKWEPWDMPGLSVVQTKDPEWFFFCPQDRKYPNGHRLNRATNNGYWKATGKDRKIKSGTILIGMKKTLVFYTGRAPKGNRTNWVMHEYRPTLKELDGTNPGQNPYVLCRLFKKHDESLEVSHCDEAEPTASTPVAAYYSTEEIQSDLAVVAGSPSQVTEDDKHQSMIPAHSEEAISNVVTPVDRRTDGYDACDAQNQIELPTAEEFQPLNFDIYYDPRSELLDGKLFSPVLAHIQPEFHYQANIESDGRYGLQYGTNETNMSDFLNSVVNWDQVPFEDPNCQQQSYPLFNVKDNILNSDLDSELANMTCMQAGYAEGAIDGRIPLLITSEFCSTTGIPVDCVGDEQKSNVGLFQNNSQRAFTDVNMGQVYNVVDDYEQQRICSAVASGNTGIIRRHREVRNEQLSINSTQGTAQRRIRLSMATHGSNKTVKSESCAQEELYAKPVIAVGEKGSENHASDESATLTNDGNELQKTPESTGKRKISQQVTKAGSTLGLKDLFLLRRCGEMSAYLITAIHLLLVFLSSSTSLSTVFGSEEEQFYAKEILGAAQKEKEWLVSVRRKIHEHPELAFQEYETSSLIRSELDKLGISYTYPVAKTGIVAHLGSGSRPIIAIRADIDALPMQELVEWEHKSKIEGRMHACGHDAHTTMLLGAAKLLNQRQDNLQLIWEKHGGGVEVKSAMMELFVDPNKLGSIPSTKVYVQDVAQYGLFSSGSEVIAVPLKHMSVLTLIPPVAGLDGMLQIISSLKGTVRLLFQPGEEGARGALQMINEGVLQDVEAIFALHIDTTTPTGAIASIPGALTAAGCMFEAKIVGVGGHAASPHKNVDPVLATSFAILALQQLVSRESDPLHNQVLSVTFVEGGTALNVIPSYVKFGGTLRSLTNEGMYHFRQRLKEIIEGQAAVHRCNAYVDFKEEYFTPYPAVVNDNNLHLHVERVGQILLGPDNVHAAKKVMA

SEQ ID NO: 152928 - protein, 90 aa, Glycine max
  Coding DNA Sequence Number=SeqID_36150
MGETVERAREDTRVLFWGDFKEPCVVITAPSLDKRPQLLDSENENLGNGELTNKLDLRRMLLFFGGEQRVKKPLRQEKTKVAYHLLIHPA

SEQ ID NO: 152929 - protein, 84 aa, Glycine max
  Coding DNA Sequence Number=SeqID_36151
MGGCVSAPKEVALNEGELAPVAETVVAQENTQEEGDKKEEPLVELTEAKEEKVEAKAEEAETKEPEKEEVNAEDKKSEEPLVTL

SEQ ID NO: 152930 - protein, 131 aa, Glycine max
  Coding DNA Sequence Number=SeqID_36152
  Homolog annotation: Hit_ID=Q8RV99; Match level="QueryCoverage=40%, HitCoverage=40%, E-value=1e-15, Identity=67%"; Hit description =Serine protease inhibitor-like protein
  Subcellular localization annotation: CTP_CleavageSite=51; ConfidenceScore=5.05e-01
MAGITKTSHFSVVLIAVVALCVFPAATSDNVASAVLGLPSHVAGEGKNLCSAAAPSSCPVKCFRTDPVCSVDGVTYWCGCSEAAYASAQIAKLGFCEVGNGGSVTLSGQALLLVHIVWLIVLGFSVFFGLF

SEQ ID NO: 152931 - protein, 439 aa, Glycine max
  Coding DNA Sequence Number=SeqID_36153
  Gene Ontology: Mol. function=transcription factor activity; Cellular component=cytoplasm; Biological process=regulation of transcription, DNA-dependent
  Homolog annotation: Hit_ID=Q4WCK4; Match level="QueryCoverage=88%, HitCoverage=78%, E-value=1e-80, Identity=42%"; Hit description =DUF895 domain membrane protein
  Pfam annotation: Domain name=DUF895; Domain location=35-185; Score= -18.4; E_value=1.8e-06; Accession=PF05978.7; Description=Eukaryotic protein of unknown function (DUF895)
  Pfam annotation: Domain name=MFS_1; Domain location=35-415; Score =2.4; E_value=0.00025; Accession=PF07690.6; Description=Major Facilitator Superfamily
  Pfam module annotation: Pfam domain module=DUF895::MFS_1; Domain location=35-185::35-415
MGTLGNEQPGTQIPENAKSFSLFRYNSPFIQIVLIGLVCFCCPGMFNALSGMGGGGQVNSTASNNALTALYTTFAIFGIVGGGIYNILGPHLTLFAGCSTYVLYAGSFLYYNHYQHQFFAIVAGAILGVGAGLLWAAQGAIMTSYPPENRKGTYISIFWSIFNMGGVIGGLIPFILNYNRGDSAATVNDGTYIGFMVFMSVGAVLSLTILPASKVVRNDGTRCTNMLYSNVATESVEILKLFYNWKMLLIIPAAWSSNFFYTYQFNHVNKPQFNLRTRGFNNVFYWGAQMVGSVGIGYVMDFSFKSRRKRGVLGIGVVALLASAIWGGALANQINHDSRVILDFKDSGSRFGLLDAMFQSMVYWVIGALANDSEILSRYAGFYKGIQSAGAAVAWQIDNQNVSAMAQLIVNWVLTTDNKGEEEPIKQVAPSSAENGFVQ

SEQ ID NO: 152932 - protein, 74 aa, Glycine max
  Coding DNA Sequence Number=SeqID_36154
MKDQTPSLLTDLVQLVMERTSFKLSVGNQHPFFAHRTKAKLNIPHIIQANTNAENCKGQKGRQMEMLQTLEKVR

SEQ ID NO: 152933 - protein, 219 aa, Glycine max
  Coding DNA Sequence Number=SeqID_36155
  Gene Ontology: Mol. function=protein binding; Cellular component =anchored to membrane; Biological process=response to biotic stimulus
  Homolog annotation: Hit_ID=Q9FLU2; Match level="QueryCoverage=71%, HitCoverage=65%, E-value=1e-53, Identity=64%"; Hit description =Thaumatin-like protein
  Pfam annotation: Domain name=Thaumatin; Domain location=1-157; Score =98.4; E_value=2.2e-26; Accession=PF00314.8; Description=Thaumatin family
MQQELENAKQVTGGRLECEGNGSAPPTSLFEITLGAGNGQDYYDVSMVDGNNLPLLALPRGVYGGVCNATGCITDINRGCPRELQLLGGHQNQQVVGCRSACEAFKTDKYCCRNTCKPSYYSTIFKKACPRSYSYAFDDGTSTFTCKAYEYDIVFCPNSNGMRRPNLASPPPIRQPFWKHQQEKKGTINEMESMDSKKILHLKNPLKTNDSESSLLKLQ

SEQ ID NO: 152934 - protein, 121 aa, Glycine max
  Coding DNA Sequence Number=SeqID_36156
  Subcellular localization annotation: CTP_CleavageSite=34; ConfidenceScore=5.17e-01
MVTYRWTWQRYSTISVLIAKSSAVKLYYFTPFISLNSTGNCSPLSILSLIRLSGSGISLAAQALIYPCRSLYNNDGPKQPLCICKGKAVYNIPPPYLRIAKSLWAMGYEVFYHFLPVDCSD

SEQ ID NO: 152935 - protein, 80 aa, Glycine max
  Coding DNA Sequence Number=SeqID_36157
MEIYVVFRADYICQALTREVRGQADIPQVIYVVLRADYLCQALTRETNVVFCTLCQSEASEPVDTRRFTLSSAQTTSVNH

SEQ ID NO: 152936 - protein, 99 aa, Glycine max
  Coding DNA Sequence Number=SeqID_36158
  Homolog annotation: Hit_ID=Q1S7B8; Match level="QueryCoverage=85%, HitCoverage=11%, E-value=4e-08, Identity=34%"; Hit description=RNA -directed DNA polymerase
MVQVVLPQDTISHFCQHNVVGKGKAQATAWKVVWVAIMCCIWNFRNKIVFRHRILASEDLLESIRIKTWMWLKTNVKGFSYSMFEWINSSDLCLSNMEG

SEQ ID NO: 152937 - protein, 91 aa, Glycine max
  Coding DNA Sequence Number=SeqID_36159
MAEIDQGKTMTGHDWSHIIWLLLAGSSGKTLTHEEGGDMVNVPLKKKWQDLNEKALGLCCILKQWGMPHCPHPLAIYVQTCAHQVLGEMPQ

SEQ ID NO: 152938 - protein, 339 aa, Glycine max
  Coding DNA Sequence Number=SeqID_36160
  Homolog annotation: Hit_ID=Q9FIR7; Match level="QueryCoverage=68%, HitCoverage=65%, E-value=2e-57, Identity=51%"; Hit description =Arabidopsis thaliana genomic DNA, chromosome 5, P1 clone:MXC17
  Pfam annotation: Domain name=DUF1671; Domain location=135-322; Score =18.4; E_value=2.2e-10; Accession=PF07910.3; Description=Protein of unknown function (DUF1671)
MVVIAMGRWIQIHSLVAPSAIHKYPFLNVLGMHVSVLVHNMHVHFHFLPAFEYYDSANKRRHFKTHFWDLDDDFDLPPTPQSQSLPREQAPNGSRSGANYSCGGETNSDNGECKVNDKISCLIGSQTRSNFYKVEGGLMALLRNCLDSEVGNSYSILSGYVDHFQCLESEDAGWGCGWCNIQMLCSHLLVERPEARKALFGGSGFVPDILSLQRWLEIAWEKGFDAPGSAQFNYVICGSKEWIGTTECTALLRSFALRARVVDFGPKESQSLTGSSVDNMRDKANIHNIVKRKAEKSEGYQVLMDFVWNYFSDKSSILFCQQHVVISLYTFNIMVTQEQ

SEQ ID NO: 152939 - protein, 458 aa, Glycine max
  Coding DNA Sequence Number=SeqID_36161
  Homolog annotation: Hit_ID=Q8GU79; Match level="QueryCoverage=24%, HitCoverage=60%, E-value=3e-38, Identity=66%"; Hit description=MDR -like ABC transporter
  Pfam annotation: Domain name=ABC_tran; Domain location=305-458; Score= -5.9; E_value=5.7e-07; Accession=PF00005.17; Description=ABC transporter
VILRKRKRSTIPIPNLDTKAKRDKSATEVVNGSIDVTNQGDETIATPDVGRVETPADNYEPEREPEVFRCLSCFSFFIPMRNGIKLFPSFGGTREPETSQKPLVTPSSNVEDPSIVVAASNANWFFNLFTSIKGRKDSAQVDASIEDSRTDPASIEDSRVDNPESPLANTAISQSVNLSADIKPGHGGVNSSIPSILKSVIKIESWIEKSKKSNVALQNEPLVDQNDSWDFSAKEQLLTENVKTDVGDKNRDSVVGIKTDTVADISKRDSVLLTTVATTENVRTDLGEKNRDPVEVIKTANHHVQSIYSLLPSGAGKSSVLALLLRFYDPQAGKVLIDGKDIQKYNLRWLRTHIGLVQQEPLLFNCSIRDNICYGNNGASESEIVEVAKEANIHEFVSDLPLSAFRRTKAKNSHCQNITIEACNSECFKSNTTEGRQWLVREKNEGVKEQGSYIISGF

SEQ ID NO: 152940 - protein, 235 aa, Glycine max
  Coding DNA Sequence Number=SeqID_36162
  Gene Ontology: Mol. function=peptidase activity; Biological process =aromatic compound metabolic process
  Homolog annotation: Hit_ID=Q2QTQ5; Match level="QueryCoverage=87%, HitCoverage=55%, E-value=3e-68, Identity=62%"; Hit description =Expressed protein
MGAVTSSMAAKFAFFPPDPPSYTVAEEVEGRARMAEVALRENVDVLKVKTERGNSVVAMYIKNPTASLTLLYSHGNAADLGQMYELFSELSIHLRVNLMGYDYSGYGQSSGKPSEQNTYADIEAVYKCLLEKYGAKEEDIVLYGQSVGSGPTIDLASRLSNLRAVILHSPILSGLRVMYPVKRTYWFDIYKNIDKIPLVNCPVLVIHLGTRYISLHRNGWNCTMLLKVFFHLSTA

SEQ ID NO: 152941 - protein, 123 aa, Glycine max
  Coding DNA Sequence Number=SeqID_36163
MGQDSWSVVRNHLLKELANFSEDYIKLFGGTERFEELRMSLLVDGLTKVTTDKWMDIMNMGHVIASRYNVYLKERCPLPPVSLLWSSNCHPQAKSWPNPYISRMQHYKSFVMFKRDYVDINDD

SEQ ID NO: 152942 - protein, 503 aa, Glycine max
  Coding DNA Sequence Number=SeqID_36164
  Gene Ontology: Mol. function=RNA-directed DNA polymerase activity; Cellular component=chromatin; Biological process=chromatin assembly or disassembly
  Pfam annotation: Domain name=RVP_2; Domain location=204-309; Score= -46.8; E_value=0.0044; Accession=PF08284.2; Description=Retroviral aspartyl protease
METRFAPSYYDDPYGDLFKLHQRATVNDYLSDFERLANRVVGLAPPILLSCFISGLSPDLRREVQALQPMCLPQAMALAKLQEDKLADRRRGHCSSTSAGMVPHHNPSHSVPSSQPNNPSPNCFPVHRLSPEEMDLKRDKGLCYYCDDKWTTGHRCSPRIHLLIATDDVEIPPSLDSSHKSRPKSPPSDPPFQLSLNAGMPAPKTFRVYGSVLHHRFSILVDGGSTHNFVQLRVARFLGLHAVPISPLPVMVGDGDIIQCTHRYPRVAISIQGNTFVTDLLGLELQGADIVLGVQWLRELGPVTTDYTTLSMHFTHMGLPVRLLADVPATPPTASAHQLKRMIQTHAISGLFQLTLSPPSSITTSSPTSSSPILLESTSPSPDLTSLLTKFHHLFAEPTQLPPTRTISHHIHLLPDSKPITVKPYRYLHSQKTELENQVRSMLDSGLIRLSHSPYSSPVLLVKKKDGTWRCCIDYRALNSITVKHKFPMPTIDELLDELGAAS

SEQ ID NO: 152943 - protein, 503 aa, Glycine max
  Coding DNA Sequence Number=SeqID_36165
  Gene Ontology: Mol. function=chromatin binding; Cellular component =chromatin; Biological process=chromatin assembly or disassembly
  Homolog annotation: Hit_ID=Q1SAV4; Match level="QueryCoverage=77%, HitCoverage=99%, E-value=1e-139, Identity=60%"; Hit description =Integrase, catalytic region
  Pfam annotation: Domain name=Chromo; Domain location=422-475; Score =17.0; E_value=0.0097; Accession=PF00385.14; Description='chromo' (CHRromatin Organisation MOdifier
  Pfam annotation: Domain name=rve; Domain location=120-276; Score =85.6; E_value=1.5e-22; Accession=PF00665.16; Description=Integrase core domain
  Pfam module annotation: Pfam domain module=Chromo::rve; Domain location=422-475::120-276
MTDLKNSIVQSPEYRTLRDQVLQDPANHPDYDLSTEWLCFRGKIWIPANNPFIPMLLYEYHSTPLGGHMGITKTLRRLRDTSFWETMSRDVHRFVSTCSTCQQIKSPCRKQAGLLQPLPIPSGLWEDLSLDFISGLPSSHNFTTILVVVDRFSKGTHLGALPSKYSAHRVAQLFIDTICKLHGFPRSLVSDRVPVFLSAFWRELFRLSGTKLRYNTAYHPESDGQTEVLNRTLEQYLRSFVHDRPSSWFSYLSLAKWSYNTSALTSTDISPYELTYGKPPPSMPTFTSGSSPIEAADTLLSTRQAMHAKFCQRLIKAQSTMKMYADRNRRDVSFKVGDWVYLRLRPYRQLSLRPHYSKLAKRFYGPYQIIERIGQVAFRLQLPEDSKLHFVFHVSLLKLHHGIPPVTNDPLPSNTVDHHPIVEPLSFLDWKWNSDCTPPSRMVLVQWRGLAPEDTSWEDWDSLQAAYNLEDEVGFPGEGIDSNTAQSRPKRTHRVPARYRDPA

SEQ ID NO: 152944 - protein, 737 aa, Glycine max
  Coding DNA Sequence Number=SeqID_36166
  Homolog annotation: Hit_ID=Q2QYH7; Match level="QueryCoverage=49%, HitCoverage=78%, E-value=3e-83, Identity=40%"; Hit description =Cytochrome P450 family protein, expressed
  Pfam annotation: Domain name=p450; Domain location=1-362; Score=73.5; E_value=6.6e-19; Accession=PF00067.12; Description=Cytochrome P450
MKQHLYVNQPDLVREMNQCITLDLGKPTYITNKLAPMLGNGILRANGLSWAQQRKLVAAEFFMDKVKGKEVFSKLRSIQKAMSKHGGFLFGLSSFRDKLKHLSSKKQNEIASLEKEIESLIWELVEERKRECSGTSSSEKDLMQLLLEAAMTDQSLGKDFSKRFIVDNCKNIYFAGHETTAVAASWCLMLLALHPEWQTRIRTEVAELCPNGVPDADSVPLLKTVAMVIKEVLRLYPPAAFVSREAYEDIQIGNLNVPKGVCLWTLIPTLHRDPEIWGPDANEFKPERFSEGVSKACRFPHAYVPFGLGTRLCLGKNFAMVQLKVVLALIISKFSFSLSPSYRHSPAYRMIVEPGHGRKTHFGETSRKGDRHEQVIMVEATHLEWLKNTCLYTKGGYSRAIFHGRTKLSIYEDLKNMIDGAKEWLKEIFEYIVPWSLEQATGNQKMSEIEGRSYTVRIVEEMEIQRVTIDTCYGEERLRSVDGSSIIGGDRLPATVNGKTKVDVSKEGSLGNGDSLCQAFNADGTEKQSEGQIQQRSLCLEHMCDGMKHRRGRKGSEASCSHKATSKKTKGLTNEKETGVGEGIESLNKDRLGLSTAVPWLLRMTRLRQKEKGVFDVTDHLSGVGFLGITGIWKKGNFNYKEFYLYRSNSYSKSRLDKYLVSEEYELDRNLSHHCPIVMKNVVIGWCPKPSKVLNGYQVERIRGLRNKEEHEELNKKIEELVVNIHILDVKDEDEGL

SEQ ID NO: 152945 - protein, 571 aa, Glycine max
  Coding DNA Sequence Number=SeqID_36167
  Homolog annotation: Hit_ID=Q2QQD3; Match level="QueryCoverage=94%, HitCoverage=89%, E-value=6e-90, Identity=58%"; Hit description =Expressed protein
MEGGRRITVSPRPCCGRRIVAAKKRPRANDGFVNSVKKLQRREISSKRDRAFTMSDAQERFRNIRLQEEYDTHDPKGPSSMVLQFLRKRSKIIEIVAARDIVFALAQSGVCAAFSRENNQRICFLNVSADEVIRSLFYNKNNDSLITVSVYASDSYSSLKCRSTRIDVLVYWCGIVAAIRLSWSGIVGAIAVVEWEQLQKLKEIPKMPLFHDWNGGYFGDFSCARAFKGGNTLDKLFVPPSLLGTFWNQHKAIILFTAAAIQPAIWSVAIATTLNCSASVFRGHSALLCTITCYLSPAPHSQKRRIEKTKLLKGTPDAGFALFESESLKWPGFVEFDDVNGKVLTYSAQDSIYKVFDLKNYTMLYSISDKNVQEIKISPGIMLLIYAKASSHVPLKILSIEDGTVLKSFSHLLYRNKKVDFIEQFNEKLLVKQENENLQILDDHLLWHPDCNTNNIYITSDQDLIISYCKADSDDSLSEGNAGSINVSNILTGKCLAKIRASNSFPVDNNCSCSDKPSRSYCCNSKKRKHGSKMRSTVAEALEDITALFYDEERNEIYTGNRLGLVHVWSN

SEQ ID NO: 152946 - protein, 86 aa, Glycine max
  Coding DNA Sequence Number=SeqID_36168
MARKIEVLFEERKPRNTTTTPQRRTLTVSLWCCQGRTQGTVNFFCCGGVVLLKRCLVCMLVTWIHESPREISKTNSVFSELCEGLF

SEQ ID NO: 152947 - protein, 666 aa, Glycine max
  Coding DNA Sequence Number=SeqID_36169
  Gene Ontology: Mol. function=binding; Cellular component=nucleus
  Homolog annotation: Hit_ID=Q337E1; Match level="QueryCoverage=98%, HitCoverage=91%, E-value=1e-116, Identity=35%"; Hit description=TPR Domain containing protein, expressed
  Pfam annotation: Domain name=TPR_1; Domain location=125-158; Score =14.4; E_value=0.1; Accession=PF00515.18; Description=Tetratricopeptid e repeat
  Pfam annotation: Domain name=TPR_1; Domain location=625-658; Score =3.4; E_value=2.1; Accession=PF00515.18; Description=Tetratricopeptide repeat
  Pfam annotation: Domain name=TPR_1; Domain location=63-96; Score =14.9; E_value=0.089; Accession=PF00515.18; Description =Tetratricopeptide repeat
  Pfam annotation: Domain name=TPR_2; Domain location=125-158; Score =11.5; E_value=1.5; Accession=PF07719.7; Description=Tetratricopeptide repeat
  Pfam annotation: Domain name=TPR_2; Domain location=625-658; Score =2.5; E_value=17; Accession=PF07719.7; Description=Tetratricopeptide repeat
  Pfam annotation: Domain name=TPR_2; Domain location=63-96; Score =22.8; E_value=0.0012; Accession=PF07719.7; Description =Tetratricopeptide repeat
  Pfam module annotation: Pfam domain module=TPR_1::TPR_1::TPR_1::TPR _2::TPR_2::TPR_2; Domain location=125-158::625-658::63-96::125 -158::625-658::63-96
METLKAAIPENLKRAIGDSDVDDLRSTCSSLHRFFLHFHPFHQMITELADPKYALCAKNKDAALKSRLLGNQCFSNADYAKALDCYTQALREAPLDTASDMETLHHYRTDEFLHLYQVVVAKDIDAAWYRRGKANASLGNYKNAICDLNVAKSVEPSMGGKRQIEGELKILLDQCKSTTAVEQIQHTENNCNTVGEMPHIKLQRVSTPDKGRGIVSSCVISPGFLVHAEEPYAMIILKQCRETHCHYCLNDLPADRVPCILCSIPLYCSHQCRIRATGQMFKIYPEYNGFFKNLPSDLGEYAAEVIQCNDSELEIGDITEHKHECQGVHWPMVLPSEIVLAGRILARFLLNIPPEDIINFVERLVVIIISQIKVNCMTVVRLKSIDAHGLSGRFGEFPFQSGAHSTSNVEQVRVGKAIYKAGSLFNHSCQPNIHAYFLSRTLYLRTTNVVAAESQLELSYGPQVGLWDCKDRLNFLKDEYAFLCQCTGCSEVNLSDIVLNAFHCVNTNCSGTVLESRVHDSEKQKIKHFPISDHVDKNADIYEVCLRVFKQNGASIDIQPGYCLKCGSYCDLESSRAAVSKALTCIKRLQDAILSQQISSITISDALKSLRLLRLNLHAYNKLIAEAEDSIAQAFCLVGELQLSLDYCKASIQVFKSLSLHNSDSS

SEQ ID NO: 152948 - protein, 883 aa, Glycine max
  Coding DNA Sequence Number=SeqID_36170
  Gene Ontology: Mol. function=chitin binding; Cellular component =extracellular region; Biological process=chitin metabolic process
  Homolog annotation: Hit_ID=Q10LY8; Match level="QueryCoverage=97%, HitCoverage=81%, E-value=1e-117, Identity=33%"; Hit description =Expressed protein
MDLRLTALSEKLVETFNKATGATCSPEDLSYLGKFSQHFDATNIEHSLCKFIELTQKSQDVGPLSKETTLHSCDVTKDDANKAVKTLQIAKPLPSDTPVKYGVSPAKAAQVERHSSTESEESSKSSDEDQRSAERSRSLVRSATPRRSASPMRRVQIGKAGPRRAAALTIKSLNYFPGRERPISFRDAAENDFEGEVFELPNKKSEIDVKRITVQDAISLFESKQRDQTTDVQKRKSLVDVSVSTNKSVLRRWSAGMGETSVQDQAEHVPEDPVPVTSNDVVHAEAPTNSEVGVVSDFITESHNNNDNTDPDVKPERQENIGSFAADNPDETNPTVKGETNKKLAASAEWNQRKQEEFNQILKKMVESKPVLFGKSKPSRNQNISFEQRGGSYDNYKEKRDAKLRGAKAGKQVEKEAQFQQMQQLLDKRKVEMPKSVSASKKSSPRMPQNSLRKSTPPANSTKETSKPLTTKKISSRTSPMPATRKSWSATPSPRAAGTSPAKVRGGISSANTTPTRRKPVSTTSVPQPTSQREKSMPWNRNEKETQTNNARSLKSMDEKRQPAVPNKNKAIKAKVTKASEEASVPSKTNIGNKGTKKSSVVPLESKPFLRKGSRMGHGTADLNKKKGPPKMDKSQRESADLIEDQESELVVNASDLVSQHSDGDTVTPIHQNAATEPDPQIHNQLQCSETENLDQNPTDGEVLTYTEESSLNIRNEESTISPSAWVETEEDLEMPKPCEDDTFQSVSLANAAPVGSASPRVRHSLSQMLQEESSEPDTCEWGNAENPPAMIYQKDAPKGFKRLLKFARKSKGDAGSTGWSSPSVFSEGEDDAEEFKNSNKRNADNLLRKAALNVKSYGQPKNSVHEGYERNLGSTFSPFALF

SEQ ID NO: 152949 - protein, 158 aa, Glycine max
  Coding DNA Sequence Number=SeqID_36171
  Gene Ontology: Mol. function=peptidase activity
  Homolog annotation: Hit_ID=Q67VK9; Match level="QueryCoverage=96%, HitCoverage=39%, E-value=5e-30, Identity=45%"; Hit description=Cgi67 serine protease-like
QLWENCKQKYEPLWIKGGNHCDLELYPQYIKHLKKFITVIEKSPHQKTGSDRIPDQLDKPRNSIDFREKSRPSMDQRENLKSIDQKEKPSASTDHKEKSRASVDRRDKSRKSIDRPEKSYNGSDIPEKARNSIDRFGEMVRSVGLCNIDCFRPTATHA

SEQ ID NO: 152950 - protein, 193 aa, Glycine max
  Coding DNA Sequence Number=SeqID_36172
  Gene Ontology: Mol. function=N-acetyltransferase activity; Biological process=metabolic process
MVTIMRVAAQTQTQLQLKKHMIEGFGSKYMELKWVRRRTSKSSQLEKTKKLSSKPPFPIYISTDPRHVDPHRLRDLFADCNHSTHRFPTRPEPVDIRKLRTALSHSAVLVSVFYNPQHVNAVFHQNSSSSSIADIFMPVSPSRDQLVGFGRAVSDYGLTASIYDVMVIPSLQRMGIGQMIVKKIVRYAVVDET

SEQ ID NO: 152951 - protein, 333 aa, Glycine max
  Coding DNA Sequence Number=SeqID_36173
  Homolog annotation: Hit_ID=UPI000034EE59; Match level="QueryCoverage =99%, HitCoverage=40%, E-value=9e-39, Identity=32%"; Hit description =transcription factor
  Pfam annotation: Domain name=C2; Domain location=6-94; Score=21.3; E _value=0.0032; Accession=PF00168.20; Description=C2 domain
MGIIWVEVCLISAHGLQLSTSLWKRQWFAVGWIDHNSKYCTKVVNSGNANPVWRTKFVIPVDDSVSNIQDLALNVEVYSIDPVFFTEKLLGSATVFLREFLVKRVKNSEVSKPRQKEVGSYQLRKKKSSKPRGFIDILIRISDKKKEPNSHPGSKEGILLLDDGDGTQLTIEEGIRQVYPQKPQVSIHQPEKDHVQTNVPDYHSVPFATTDYYDPYVGEASNHEMGEPSYHEVAGPSYLLPRTITPPPPPPPSNVGYIPTFLPRNDGLSPSYTEMSTSRAAPGQRVPAGVAMGLGAGALAAGAIIFGDDFMSGFDVPPGIGDSSFNRGIDPAF

SEQ ID NO: 152952 - protein, 92 aa, Glycine max
  Coding DNA Sequence Number=SeqID_36174
  Gene Ontology: Mol. function=RNA-directed DNA polymerase activity; Biological process=RNA-dependent DNA replication
  Homolog annotation: Hit_ID=Q1RV13; Match level="QueryCoverage=96%, HitCoverage=21%, E-value=3e-19, Identity=50%"; Hit description=IMP dehydrogenase/GMP reductase
MSRGLKQGDLLVPFLFLVVAKGLSGLMRMAHMGGLFSEYKVGENNVEVSLMQFVDDNLFFVEPLVQNVMCIKATLRCFEMASGLEMNFHKGY

SEQ ID NO: 152953 - protein, 433 aa, Glycine max
  Coding DNA Sequence Number=SeqID_36175
  Gene Ontology: Mol. function=nucleotide binding
  Homolog annotation: Hit_ID=Q5VNG4; Match level="QueryCoverage=90%, HitCoverage=78%, E-value=1e-165, Identity=71%"; Hit description =Putative auxin-independent growth promoter
  Pfam annotation: Domain name=DUF246; Domain location=118-433; Score =607.2; E_value=1.5e-179; Accession=PF03138.5; Description=Plant protein family
MMLRWAKMSDGKGDHCDSEEMEMGFNVLGGGDEIVKSKRLIVRPGIKVWMARAITTVILWTCVVQLMAIGELRGPRLLKGMPYCFSHQDASQPMSNAYVPARVVLPPKRIHKNNGYLVVSCNGGLNQMRAAICDMVAIARHLNVTLIVPELDKTSFWADPSEFQDIFDVDNFIGSLRDEVRILKQLPPRPKRRVERGLFYSLPPVSWSNISYYEKQILPLLLKHKVVHLNRTDARLANNGLPLEIQKLRCRVNFNALRFTSQIEQLGRRIIRILREKGPFLVLHLRYEMDMLAFSGCTHGCDGREVEELTRMRYAYPWWKEKVINSELKRQDGLCPLTPEETTLILTALGIDQNIQIYIAAGEIYGGQRRMASLQAAFPNLVRKETLLEPSDLMYFQNHSSQMAALDYLVSLESDIFIPTYDGNMAKVVEGHR

SEQ ID NO: 152954 - protein, 67 aa, Glycine max
  Coding DNA Sequence Number=SeqID_36176
MAVSYPNFVWGLLLEGIQPLIDRFKILSTLCCTICEVPRCAENQKKAWWKQPSSPGRARWQPPPPFC

SEQ ID NO: 152955 - protein, 94 aa, Glycine max
  Coding DNA Sequence Number=SeqID_36177
IVKGILQDSGTLKRVAWGLDIGTRISEATCPTTGGSGSMLQHKLSCWRSAPIQLLALPTILDTCGRGGREVGSMGEEVPHQVKEYKVYKENVEH

SEQ ID NO: 152956 - protein, 93 aa, Glycine max
  Coding DNA Sequence Number=SeqID_36178
MKLCFYMWNIDRVSDFGLARVHSHFGLIAYACKVHSTSWWTLFIFLTLVEIRDIYNNGSRNWNLLTTPLAAPVKDIINSISLIKSTYKWITCA

SEQ ID NO: 152957 - protein, 80 aa, Glycine max
  Coding DNA Sequence Number=SeqID_36179
  Gene Ontology: Mol. function=RNA-directed DNA polymerase activity; Biological process=DNA integration
EVNVKQPEGFSSSSGAHLVCKLKKSIYGLKQAFRQWCLKFHGIISSFGFDENPMDQYIYHRDMGDASYVIGIKIHKDRLQ

SEQ ID NO: 152958 - protein, 106 aa, Glycine max
  Coding DNA Sequence Number=SeqID_36180
MVVVAVIMLVVITVVMMVITVVTTITIILVMVVVDDHASDCNGNHDTCGGNDRDNGDSHSDHRKSESLKEPKQSSSFMDSWRLLPLPCQFLVFGIWVGLTQQPIAY

SEQ ID NO: 152959 - protein, 119 aa, Glycine max
  Coding DNA Sequence Number=SeqID_36181
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=90%, HitCoverage=11%, E-value=6e-32, Identity=62%"; Hit description =Protein kinase
MATLFNKLVLTGYLVPDYYTSQQLTKKSDVYSFGVLMLKLIIARKPIEQGKYIMKVVTSTIDKTKDLYGLHEIIDSTICSRSTLERFEKLVDLAMECVEDSGVDMLTMSDVVKEIEGML

SEQ ID NO: 152960 - protein, 138 aa, Glycine max
  Coding DNA Sequence Number=SeqID_36182
  Homolog annotation: Hit_ID=Q39558; Match level="QueryCoverage=41%, HitCoverage=20%, E-value=1e-10, Identity=59%"; Hit description=14-3 -3 protein 32kDa endonuclease
MASTRTPHEEFMYMAKLAKQVECYKEMVDFMEKVFAFTVSEELIMGECNLLFIAYKNRESLCFLDIYVLVIYALELPKSPDWSQYFYVVSQQKLFNLVKKQNDGTVEVDLEKDAPLASEFLKFQSFEESTMSGTIIYE

SEQ ID NO: 152961 - protein, 176 aa, Glycine max
  Coding DNA Sequence Number=SeqID_36183
MYNLQIVTRNLQKLVIRVIYKTKVERKHIDLIDEEEAQIGGDRSSATSNKAEIYNEEAWKKKQKHKLKRVESVNDDAEAFAEALDHTKKRDTGHQSVSLENETGDSTMLKMGDSAKVVIKQDMKGREHKYGFNNNEREKPEKKRVVDDETGDKHELDEVLRRQIETKNRCLNQRKM

SEQ ID NO: 152962 - protein, 43 aa, Glycine max
  Coding DNA Sequence Number=SeqID_36184
MLGIAEKREREGALNSRKSMKSEIHRELDRAGSGYRMSGHGVR

SEQ ID NO: 152963 - protein, 452 aa, Glycine max
  Coding DNA Sequence Number=SeqID_36185
  Gene Ontology: Mol. function=pseudouridylate synthase activity; Biological process=RNA processing
  Homolog annotation: Hit_ID=Q8PQS8; Match level="QueryCoverage=48%, HitCoverage=90%, E-value=1e-101, Identity=81%"; Hit description =Pseudouridylate synthase
PRAGVRHRAPYAADQVPNTPHFALAAGMLAVPCTAGSPHDPHRTRPAVPAAPRRPAAGAGRGQRSGPGRATDRWRHQPPAVRVTGAEHDRHHAAADRGDAAAAVPAGGRTAPAQRPAAGTAEADPGADQPDPAPGPVVAAAAADVRGPLQEDLQQGRRAGDGRVLRERGRPEPAGQDPGADAERDGGHPGAHAAAVRGSAEGPGSDRQRAGKEITGRAHARLTAAASGVVHLPAEQAQRLLELAVQRRTHIHRATVRMRETQALGMQQHAVHALHAEDAVVATITVAGVADHVMREMLQVPADLPEAPGLRLATQQRVARTGELTDRDRQLAGGQALEVGDRRLLHRLARATVEVVVDPPGQFCRPATADGQVVLQHFTAHQRLAQRAGGFAVEGQQQAAAGGPVQAMHKEDRAAQLLAQAVGQEVVFPTGQLAVVDHQPGRLVDHGQAFIQ

SEQ ID NO: 152964 - protein, 94 aa, Glycine max
  Coding DNA Sequence Number=SeqID_36186
MGKWKDCFYLKDLSIYSIKSIFRKLNSLLRFRREGHRNGLVNLYKDMEPFEENDDIQVMWKMIQVQSSTPQCTCTVKRANRCLLETMFSTDLKF

SEQ ID NO: 152965 - protein, 435 aa, Glycine max
  Coding DNA Sequence Number=SeqID_36187
  Gene Ontology: Mol. function=metal ion binding; Cellular component =membrane; Biological process=protein transport
  Homolog annotation: Hit_ID=Q1RSL7; Match level="QueryCoverage=83%, HitCoverage=90%, E-value=1e-108, Identity=57%"; Hit description=WD40- like
  Subcellular localization annotation: CTP_CleavageSite=43; ConfidenceScore=5.49e-01
MLAGAPSSHMSSSVSTSQGIFPTSRIGSGESPNSGASSFTQPIADMNENDETDLLSISWNQDYGCFAAGTSHGFRIYNCEPCKETFRRDLKSGGFKIVEMLFRCNILALVGAVANSHYPPNKVLIWDDHQSRCIGEFTFRSDVRGVKLRRDRIVVVLEHKIYVYNFTDLKLLHQIETLANPRGLCCLSHHSNTFVLACPGLHKGHVRVEHFGLNVTKLINAHDSQIACFTLTLDGLLLATASVKGTLIRIFNTMDGSRLQEVRRGVDRAEINSIALSPNVQWLAASSDRGTVHVFSLRVRVSGEDSLTQPNAFQGPALFHQNSSSSLDPLISPNTGANPNSSLSFMRGVLPKYFSSEWSFAQFHLPEYTHFIVAFGSQNSVIIVGMDGSYWNALKWPMIQFSPSLFDTWECVNCRLQHSKLLNMPLMKHAVEINS

SEQ ID NO: 152966 - protein, 58 aa, Glycine max
  Coding DNA Sequence Number=SeqID_36188
MVCSRTRWHIILVQYFGRKWNVEMLISTAEPGLKKGESDLDLPLSTILTSCLPWVFAI

SEQ ID NO: 152967 - protein, 370 aa, Glycine max
  Coding DNA Sequence Number=SeqID_36189
  Homolog annotation: Hit_ID=Q8TGM5; Match level="QueryCoverage=10%, HitCoverage=58%, E-value=4e-07, Identity=74%"; Hit description =Uncharacterized protein ART3
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNYRPIGGCIPKHPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 152968 - protein, 68 aa, Glycine max
  Coding DNA Sequence Number=SeqID_36190
CISSTLTTQQKKDISMKELRPLTPPDARPPLGHGDGSDDMTAQRGLTEVDQKKKNTVKRRKMTIRTFE

SEQ ID NO: 152969 - protein, 321 aa, Glycine max
  Coding DNA Sequence Number=SeqID_36191
  Gene Ontology: Mol. function=hydrolase activity
  Homolog annotation: Hit_ID=Q10LW8; Match level="QueryCoverage=82%, HitCoverage=79%, E-value=1e-55, Identity=70%"; Hit description =Hydroxyacylglutathione hydrolase, putative, expressed
  Pfam annotation: Domain name=Lactamase_B; Domain location=6-148; Score=20.7; E_value=0.0036; Accession=PF00753.17; Description =Metallo-beta-lactamase superfamily
MINVQFMQLYLVMNIRYWLVMNVCKFCHHGRDHAGGNEKIKQLVPGIKVYGSLIDNVIGCTDKVENGDKESLGADIYILCLHTPCHTKGHISYYVTGKEEEQPAVFTGDTLFIADCGKFFKGTAEQMYQSLCVTLGSLPKPTRVYCGHGIIPNNFRPGLTGKLVQMQGLHLHLVAQISQTDLNVSCQEAIASGILTQLSMTIHRSLITQGFGDPIANFIIIIGKRSGFLLILPYSMNAKNQQQAGQLTISSTIEEEMETNPFKRVDQPDIQEKVGCKSPVEALRELRKLKDNWKGKLIIFTGGPRTESHTYLSSAEDWGMG

SEQ ID NO: 152970 - protein, 208 aa, Glycine max
  Coding DNA Sequence Number=SeqID_36192
  Subcellular localization annotation: CTP_CleavageSite=53; ConfidenceScore=5.22e-01
MESSPSSSSSGSDTSGGGGGGGGGGGGGGAVTWFGMSFPFRSPLSLVMDYCVREDSAEPVIIIPRTRPRFQAHAESDAASASDSDENACNGAAEEVAIRIIGVGEQESGSSPSSSRGRGGELGGEEAVVGRSGMLSSRRRMAEERVPLVSLDDGIVGARDSSSSSSSSTYQRYDIQQVAKWIEQILPFSLLLLIVFIRQHLQGIASSV

SEQ ID NO: 152971 - protein, 61 aa, Glycine max
  Coding DNA Sequence Number=SeqID_36193
  Gene Ontology: Mol. function=hydrolase activity
  Homolog annotation: Hit_ID=Q45NN8; Match level="QueryCoverage=90%, HitCoverage=32%, E-value=2e-17, Identity=71%"; Hit description =Hydroxyacylglutathione hydrolase
MKIYHVPCLRDNYSYLIVDKSTKEGAVVDPVEPQKVLEAANSHWVNLKLVLTTHHHGCCCY

SEQ ID NO: 152972 - protein, 50 aa, Glycine max
  Coding DNA Sequence Number=SeqID_36194
MYEMRHMYRMKVLLGIEEFKIGIEEFKRERPFQCVIAQIFRTPAPPPCLK

SEQ ID NO: 152973 - protein, 448 aa, Glycine max
  Coding DNA Sequence Number=SeqID_36195
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=90%, HitCoverage=61%, E-value=1e-113, Identity=54%"; Hit description =Receptor-like protein kinase
  Pfam annotation: Domain name=LRRNT_2; Domain location=27-66; Score =40.7; E_value=4.9e-09; Accession=PF08263.3; Description=Leucine rich repeat N-terminal domain
  Pfam annotation: Domain name=LRR_1; Domain location=120-139; Score =3.7; E_value=58; Accession=PF00560.23; Description=Leucine Rich Repeat
  Pfam annotation: Domain name=LRR_1; Domain location=142-164; Score =16.6; E_value=0.088; Accession=PF00560.23; Description=Leucine Rich Repeat
  Pfam annotation: Domain name=LRR_1; Domain location=166-187; Score =14.0; E_value=0.53; Accession=PF00560.23; Description=Leucine Rich Repeat
  Pfam annotation: Domain name=LRR_1; Domain location=188-210; Score =18.7; E_value=0.021; Accession=PF00560.23; Description=Leucine Rich Repeat
  Pfam annotation: Domain name=LRR_1; Domain location=71-94; Score=4.5; E_value=41; Accession=PF00560.23; Description=Leucine Rich Repeat
  Pfam annotation: Domain name=LRR_1; Domain location=96-116; Score =8.4; E_value=7.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=27-66::120-139::142-164::166 -187::188-210::71-94::96-116
MKLQFSIVALVLLGSTLSFCGLIVADLNSDQHALLEFASSVPHAPRLNWKNDSASICTSWVGVTCNSNGTRVVGLHLPGMGLTGTIPENSIGKLDALRVLSLHSNGLIGSLPSNVLSIPSLQFAYLQHNSFSGLIPSPVTPKLMTLDISFNSFSGTIPPAFQNLRRLTWLYLQNNSISGAIPDFNLPSLKHLNLSYNNLNGSIPNSIKAFPYTSFVGNALLCGPPLNHCSTISPSPSPSTDYEPLTPPATQNQNATHHKENFGLVTILALVIGVIAFISLIVVVFCLKKKKNSKSSGILKGKASCAGKTEVSKSFGSGVQGAEKNKLFFFEGSSHSFDLEDLLKASAEVLGKGSYGTAYKAVLEEGTTVVVKRLKEVVVGKKEFEQQLQIVGRIGNHPNVMPLRAYYYSKDEKLLVYNYMPGGSLFFLLHGSGTDNYSITNLFPRCHG

SEQ ID NO: 152974 - protein, 317 aa, Glycine max
  Coding DNA Sequence Number=SeqID_36196
  Gene Ontology: Mol. function=lyase activity; Biological process =alkaloid metabolic process
  Homolog annotation: Hit_ID=Q9SG92; Match level="QueryCoverage=90%, HitCoverage=87%, E-value=2e-82, Identity=53%"; Hit description =Putative alpha-hydroxynitrile lyase
  Pfam annotation: Domain name=Abhydrolase_1; Domain location=40-308; Score=11.2; E_value=0.0011; Accession=PF00561.10; Description =alphabeta hydrolase fold
MPKRVEGVVAMKQHFVLVHGIGGGSWCWYKIRCLMENSGCKVSCIDLKSAGIDQSDADSVLSFDDYNKPLMDFMSDLPENEQVVILVGHSAGGLSITQACHKFANKIRLAVYVAATMLKFGFLTDQDLKDCLWNLEGFPARTPLETRESNKFLAFFSFPQSDNPVYSTDPLCPQEGVPDLSEYGDVYELGFGLGHDKPPTSALVKKEFQHKIIYPLSPHEDSTLAAMLLRPGPLLALTSAQFREDGDGDGEVEKVCRVYIRTRHDKVVKPEQQEAMIKRWPPSTSYELDSDHSPFFSTPFLLFGLLLKAAAALDAIN

SEQ ID NO: 152975 - protein, 487 aa, Glycine max
  Coding DNA Sequence Number=SeqID_36197
  Gene Ontology: Mol. function=kinase activity
  Homolog annotation: Hit_ID=Q1SIP3; Match level="QueryCoverage=68%, HitCoverage=52%, E-value=2e-33, Identity=29%"; Hit description=TRNA -binding arm
MEGSENFDAGSDQGNVLVTPYYTPYPKHVLPKSGVQPVDIEFSPSSGGDSSAASMKEGPGSSSSSSSSSSDSEQENQVVGEGKTDDVSWESENRSYDELLKEFLKNEEELKLSNFKLKLSEEELKVQIEKSEGQLNNALVELKVKEEDLEYEKGQVLELQKKTADLETHVPDCSLKIAKLVAQLELAEEQLKISDDEIARLEEELNSRSLGTRELQGQLEVAQDNVAALENQLDSERKQIQDLEDRVTWYKTNETNNELEVQKLKADMVDAQAQFSLEKDQLHSEIAHLSEENKQLGSRLEEYKSRSNIFENKSRQFEAEKLKLEELLATQQMVLQGEISCLKEELDQRRHDVEAVNKEFDRHRQKYDVLMTEKDEANAKIHNLMAETRDRDNHIANLEREIIQVCGQKAELITGSAATLNLVNELKLKVDELEKEVTRQNAVISDRAEEKREAIRQLCFSIEHYRSGYKELLQAFSGHKRHAVTAA

SEQ ID NO: 152976 - protein, 368 aa, Glycine max
  Coding DNA Sequence Number=SeqID_36198
  Gene Ontology: Mol. function=RNA polymerase II transcription factor activity; Cellular component=nucleus; Biological process=regulation of transcription, DNA-dependent
  Homolog annotation: Hit_ID=Q84TW3; Match level="QueryCoverage=86%, HitCoverage=86%, E-value=4e-79, Identity=49%"; Hit description =Putative transcription elongation factor
  Pfam annotation: Domain name=TFIIS_C; Domain location=328-366; Score =83.5; E_value=6.5e-22; Accession=PF01096.9; Description =Transcription factor S-II (TFIIS)
  Pfam annotation: Domain name=TFIIS_M; Domain location=196-317; Score =166.0; E_value=9.4e-47; Accession=PF07500.4; Description =Transcription factor S-II (TFIIS), ce
  Pfam module annotation: Pfam domain module=TFIIS_C::TFIIS_M; Domain location=328-366::196-317
MVGLTQVFRSSLMDSFMLLDSVFVNNITFSSLGVLNLGGNVRDGFIIHFSFKVGKHLKVLTKHPRLKIKAFAIDLIEIWKGIIIKETSKNKNGGSDSKVESANGEKSKAGKMQKSPSVKVEKGETVKVEKIDRNGTTKSSSENMKKVQNDVKNEKTDRSASVKVEKIAKEEKPVSGAKKMSSSSAAPPKLKTMIKSNDATRDKIREILHEALSKVTGEADEDLVDVVNNSDPIRVAVTVESVLFEKWGPSNGAQKVKYRSLMFNLKDSNNPDFRRKVLLGVIEPEQLINMSTAEMASEQRKQEYQKITEKALFECERGGPPKATTDQFKCGRCGQRKTTYYQMQTRSADEPMTTYVTCVVCNNRWKFC

SEQ ID NO: 152977 - protein, 79 aa, Glycine max
  Coding DNA Sequence Number=SeqID_36199
AEYPSPPNQSQKNDDLEPVHRWIVVKFEYHVRNTITRILTVGKFDIIILSEQSEEKLEESQGTAIDAAIVVGRHVSPLR

SEQ ID NO: 152978 - protein, 92 aa, Glycine max
  Coding DNA Sequence Number=SeqID_36200
STTQVDVPSTCTTKDVPSNVLRQSSQAVKPLKLCEWGYKRILKREKGMKKMNSTVFTVWKTRKLWKAFGKRKKKKKFKETQKSIGKSLLSKE

SEQ ID NO: 152979 - protein, 75 aa, Glycine max
  Coding DNA Sequence Number=SeqID_36201
  Gene Ontology: Mol. function=transferase activity; Biological process= DNA integration
  Homolog annotation: Hit_ID=Q1SS72; Match level="QueryCoverage=92%, HitCoverage=4%, E-value=2e-14, Identity=47%"; Hit description =Integrase, catalytic region
MNIIFSKPYYVHPNKNPSAKLVTTLPNGSNYHGWVQAMTLVLEMKNKINFMDDTIPKPNEQDSNYSAWKRCNNLI

SEQ ID NO: 152980 - protein, 140 aa, Glycine max
  Coding DNA Sequence Number=SeqID_36202
MNSMFNTSNKKRKILEYPPKSSPPEQWGPFSSSSLPVAVGGLVDNDRRRVALCVFFTADDEAYASGGGGGGGGGGGEPGGEAMILYTKKPGLINITKNNYMTYMMTKEMTKSSKNNSSESRTIQEFKIRIQKNSRLKKKV

SEQ ID NO: 152981 - protein, 213 aa, Glycine max
  Coding DNA Sequence Number=SeqID_36203
  Homolog annotation: Hit_ID=Q84VH5; Match level="QueryCoverage=86%, HitCoverage=31%, E-value=7e-81, Identity=74%"; Hit description =Envelope-like protein
FSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 152982 - protein, 169 aa, Glycine max
  Coding DNA Sequence Number=SeqID_36204
  Homolog annotation: Hit_ID=Q58IU5; Match level="QueryCoverage=33%, HitCoverage=10%, E-value=4e-23, Identity=92%"; Hit description=Non -intrinsic ABC protein
MEDAPVSSRVALPPKGRLRQSKIGEDQLFYFQQMGIDYEKAMAAMISGFCHDVFNELPDEFGSEVNQLMSLKLEGLVEETFVDSEALRLEKAIILQLGKVGALELFNVYLSRSVGTSLVSNYVVKVDDYKDKVLAELEKIRTAIEEDTKPVASLSTWADASEVHEKVLQ

SEQ ID NO: 152983 - protein, 82 aa, Glycine max
  Coding DNA Sequence Number=SeqID_36205
MATIALSSRYGSKLAYDTGIWGESYRLFAAKFLFGLRYNWCLGIGRVAYGRFDPVGMVVIARVSASFSSSSFALVFTFIKAG

SEQ ID NO: 152984 - protein, 133 aa, Glycine max
  Coding DNA Sequence Number=SeqID_36206
HVHILVKSPAFVDHPTFFYHGPRSRWHTETPDGNPHTPFAIQRSESLVACRDALRLSAPFQCGHLHPFRRCQHLPVETISVSHFSQELHPEHDSIQRLTSSSAPFVNRGQQAGLHAEIYVLLRAFCHTDPEIR

SEQ ID NO: 152985 - protein, 212 aa, Glycine max
  Coding DNA Sequence Number=SeqID_36207
  Homolog annotation: Hit_ID=Q1T1Y0; Match level="QueryCoverage=79%, HitCoverage=50%, E-value=3e-11, Identity=26%"; Hit description =Ankyrin
  Pfam annotation: Domain name=DUF1723; Domain location=43-92; Score =58.7; E_value=1.9e-14; Accession=PF08330.1; Description=Protein of unknown function (DUF1723)
ERLELKLVSHGRKVDKFGSSAPEIEGLIAGTILSPLIRCSMVTDDPGLISAFAERWHRETITFHLLVGELTITLDDVACLLNLPITRALHRFEPLGVDEAVLLLMELLEVFSEEARAETIGAHGAYVATHVDVVHLEGFRDLGQFRGYVWGVVVLVHMYDQLNEASQTPTQQIGGVHQCVTDDGYAETTPRACRWLKTKAHMKGIKGVSYRA

SEQ ID NO: 152986 - protein, 70 aa, Glycine max
  Coding DNA Sequence Number=SeqID_36208
  Gene Ontology: Mol. function=transition metal ion binding
MTKNRVLKEHNKTFLNWFKDTIFGDNNTSETLRKLVYGPKRNVITWQGYDIKYSFYMESQDDKSTMQNSG

SEQ ID NO: 152987 - protein, 92 aa, Glycine max
  Coding DNA Sequence Number=SeqID_36209
MKEPLTFMEGGISARMRGGEGVTTRGRGIVIVGVLGCRCKGVSLRELREMLLRNERRKKGGGKVPLLCPNFLLERKAQYGPKQWFTSHNMYS

SEQ ID NO: 152988 - protein, 132 aa, Glycine max
  Coding DNA Sequence Number=SeqID_36210
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=Q6JAD5; Match level="QueryCoverage=65%, HitCoverage=30%, E-value=2e-42, Identity=100%"; Hit description=TATA sequence-binding protein 1
  Pfam annotation: Domain name=TBP; Domain location=1-50; Score=31.8; E_ value=1.8e-06; Accession=PF00352.12; Description=Transcription factor TFIID (or TATA-binding protein, TBP)
RFAAVIMRIREPKTTALIFASGKMVCTGAKSEQQSKLAARKYARIIQKLGFPAKFKDFKIQNIVGSCDVKFPIRLEGLAYSHGAFSSVSVKCNNHLFFLVNFMEKWSSQIPALVISPTYGPLDVGYSIGCCT

SEQ ID NO: 152989 - protein, 36 aa, Glycine max
  Coding DNA Sequence Number=SeqID_36211
MSGIFSVSKRQPNNHMQEIELRYKLLGSVLNFNQAK

SEQ ID NO: 152990 - protein, 176 aa, Glycine max
  Coding DNA Sequence Number=SeqID_36212
LEVGPSVARVNTKESCVDPSGNDLDTGDSEKCGLYVEENPPCLVALGILYEGSTTVHNIPLCHDQDKLVLRKLEMQMLPFLYPLKRFRVVEPTKPAHRPDHHVDDPLYLMTLTIPQLFLKPLQVMWDATVFGVFNDNFSLYVKHENLFDIAHGGQCLRMSIIHLWIFNRHMIETSM

SEQ ID NO: 152991 - protein, 91 aa, Glycine max
  Coding DNA Sequence Number=SeqID_36213
FHGGAGFIGFHCRPWTLRCADYCHWPTKTPWSCACCWSRCHDQTILWTGYKDLPHVFVHCSERHGAVEAKNQGPAGGVDHRKSDSTSNVVL

SEQ ID NO: 152992 - protein, 79 aa, Glycine max
  Coding DNA Sequence Number=SeqID_36214
MTLLRCVDAKEANFMIEEIHEGSFGTHANGSQYMGMDASGDRVMTDQSLPLPGAKQAENVAARQPNILCICSFFYYCLF

SEQ ID NO: 152993 - protein, 101 aa, Glycine max
  Coding DNA Sequence Number=SeqID_36215
  Subcellular localization annotation: CTP_CleavageSite=50; ConfidenceScore=5.33e-01
MSLPSAVHASTTYESGAPRSYCVAMFTNSQFSTFLLSPLNVIAWRCSCILHQRVWSPAKLLRSAVLQFSILRFFTEPHECHCLALFMHPPPLSLEPRKVIA

SEQ ID NO: 152994 - protein, 229 aa, Glycine max
  Coding DNA Sequence Number=SeqID_36216
MHTGARFHPFHCKETRIATTRHPVDPKEPNRALGFPALVTSLCQSYRAPVPPASSCHRDIGIMPVRHSMDPKKSNRVLGFPALITGLCQFYGVPVTPSKVIRPLTNRAFIKKYCAPRQVQGETPQQPGDGRQRATNAPPPPPGPLSSSTKAGALPTTRCRLAGDQVARYLGYACSKIPWICMCRNLLFGGRATRDSRVRVPRKEYARSRHQRLFEENVGKTGKDVIYEL

SEQ ID NO: 152995 - protein, 69 aa, Glycine max
  Coding DNA Sequence Number=SeqID_36217
VMATIALSSRYGSKLAYDTGIWGGLRHWNNDIVGFGGKLGRIGMAVTAWVSPSFSPSSFAPVFSVLLVG

SEQ ID NO: 152996 - protein, 75 aa, Glycine max
  Coding DNA Sequence Number=SeqID_36218
MNLRFVFEKLDAASLDLNSKRTGSYPFPSCLAGLKRLWAGDWLGRWWWFTEEEGGGSDVGLASGGSRRRRVADLM

SEQ ID NO: 152997 - protein, 70 aa, Glycine max
  Coding DNA Sequence Number=SeqID_36219
MRPQVLIDHHRFLRLGMARRIDIAIETALVMAMGGESQGFGFGHGALPQKTRPGREGSCQGRRVRTSPYL

SEQ ID NO: 152998 - protein, 445 aa, Glycine max
  Coding DNA Sequence Number=SeqID_36220
  Gene Ontology: Mol. function=two-component sensor activity; Cellular component=membrane; Biological process=two-component signal transduction system (phosphorelay)
  Homolog annotation: Hit_ID=Q2KWN7; Match level="QueryCoverage=86%, HitCoverage=90%, E-value=1e-142, Identity=62%"; Hit description =Chemotaxis sensory transducer
  Pfam annotation: Domain name=MCPsignal; Domain location=198-421; Score=160.9; E_value=3.4e-45; Accession=PF00015.11; Description =Methyl-accepting chemotaxis protein (MCP) signaling domain
  Pfam annotation: Domain name=PAS; Domain location=97-211; Score=25.3; E_value=0.00022; Accession=PF00989.14; Description=PAS domain
  Pfam annotation: Domain name=PAS_3; Domain location=1-92; Score=70.8; E_value=4.3e-18; Accession=PF08447.1; Description=PAS fold
  Pfam annotation: Domain name=PAS_3; Domain location=121-214; Score =72.0; E_value=1.9e-18; Accession=PF08447.1; Description=PAS fold
  Pfam annotation: Domain name=PAS_4; Domain location=103-216; Score =40.8; E_value=4.7e-09; Accession=PF08448.1; Description=PAS fold
  Pfam annotation: Domain name=PAS_4; Domain location=2-94; Score=1.2; E_value=0.16; Accession=PF08448.1; Description=PAS fold
  Pfam module annotation: Pfam domain module=MCPsignal::PAS::PAS_3::PAS_ 3::PAS_4::PAS_4; Domain location=198-421::97-211::1-92::121-214::103 -216::2-94
MANQNFLDTMGYELDEVIGQHHRIFVLPDERESADYLAFWDQLGQGAHDSGRYRRIRKDGGDVWLQASYNPIFDRHGRPFKVVKYATDITAQQQRQADTEGQLEAISKVQAIIEFELDGTIIRANELFLNAVGYREDEVRGRHHSMFVSPEEARGSAYADFWHKLRSGRHDTGQYLRIGKNGRQVWIEASYNPIFDAEGRPFKVVKFATDITRRFTAAQTLRVAVQGLTENADRAGQANTLAQDACRVAEEGGKTVAGVVRTMGAITESSKRISEIIGVMDGIAFQTNILALNAAVEAARAGPHGKGFAVVASEVRSLAQNSAAAAKEIKGLITTSVEQIENGAGQVQSAGVTMGDIVASSRRVTEIMAEVVEVSLAQSGKLGEVTEDITHMTADAASVRQAAHELHGGNRVLKPAVKSVAPAVRVRPAANTPLPAKPVLEYARY

SEQ ID NO: 152999 - protein, 115 aa, Glycine max
  Coding DNA Sequence Number=SeqID_36221
  Subcellular localization annotation: CTP_CleavageSite=39; ConfidenceScore=5.10e-01
MMSMKKIMEAKAVAVAATGAVAKVNPTPPSSLNQMNHPTSDMVGLGGKELGGMGGPHLVRKTSMPSHHMACLPTIRHPMWHTPPMRMSITPLLHPSRANNLNLIMQMSLDPWGDT

SEQ ID NO: 153000 - protein, 158 aa, Glycine max
  Coding DNA Sequence Number=SeqID_36222
MTDLCLVPDVVIPPKFKCWRDLATQVAPPMVEREMVTMIVDTLPIFYYGKLVGFMPSSFADLVFTGERIEVGLKRGKFDYVSLAGARGRRIGIAEAKRKEGDAHAVTSTPAWPKPPQTSYGTHQYAQHHPSFSARVEGYFDSAPAQPRAPAPPQRGAP

SEQ ID NO: 153001 - protein, 64 aa, Glycine max
  Coding DNA Sequence Number=SeqID_36223
MAVSMKIKETFVGLHINIDNDTRVVHVREITHSHVALERLSEEDSFSLSLPQKDPTTTVLNQHR

SEQ ID NO: 153002 - protein, 127 aa, Glycine max
  Coding DNA Sequence Number=SeqID_36224
  Subcellular localization annotation: CTP_CleavageSite=70; ConfidenceScore=5.13e-01
MEKLKQWLNQAAPQTWASAIICFFASKKFPHRLKASPGKVCKAKPFTTPFRHGPCSWIFQSGVVLAEVLLADSRFTRPDMGFHPTKLNFVPSDADEAPLDVSICLHAFGIVGCGSFSGVQSCEREGA

SEQ ID NO: 153003 - protein, 119 aa, Glycine max
  Coding DNA Sequence Number=SeqID_36225
MRHRITFISSVSSHGKHENGDDIMRRFSCCNESLSSQLYPPYLLLKPSWGDDDYTCQGSLIAKEAIDDEKEGDKDLEFEFEFERNNEEEDHDDEGVAYEHQILSHILRVLSPDRWRRIV

SEQ ID NO: 153004 - protein, 85 aa, Glycine max
  Coding DNA Sequence Number=SeqID_36226
MDRLFQSEIIVLLEFAKHNLQWLSARKNPEEDELSSSLSAPLQVIKRTASAHLLSETRALSQNPLMHAKRSRSALSERARTRPPI

SEQ ID NO: 153005 - protein, 312 aa, Glycine max
  Coding DNA Sequence Number=SeqID_36227
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=6e-42, Identity=32%"; Hit description= UPI00006A17C9 related cluster
HKRNTRPRLQRVTRPRLKGLHVFPFKGLRALNFRGLHVLAFTRLHVLAIRGLHVLAFRALHALAFRGLHVFAFRGLHILTFGGLHVLTFRGQHVLTFTGLHAHPSRGLHVLAFIGLHALAFRGLQVLTIRGLHTLTVRVLQVLAFRGTRLTFRGLHDLAFRGLNVLAIRGLHVLAFRGLHALALKGLHVFAFKGLHILNFRGLHVLTFRGLHVLAFRGLHVLVFRGLHALAFRGLHVLPFRRLHALTFRGLHVLAIRGLHVLTFRGLYVLTFRGLHILAFRGLHVLALRGLHVLTFRRVHVLTGRGLRVLPF

SEQ ID NO: 153006 - protein, 306 aa, Glycine max
  Coding DNA Sequence Number=SeqID_36228
MARTKKNGQMTSEASKEIADKIASQGSFVAHGHWDVLTAAIGRQEHAGRVRAAGAGPPHFFVHGSRRPGAADAKDQGPAGGANHRKSDSTTNVVLQPDAVPVGPLAARVSIKESCIDPSGNDLDTGDSEKCRLYIKENPPHLIALGRLYEGSTTVHNIPLHHDQVKVGVEEVRDANAPIPVPTQEGAVRSGKSAHRSDHHVDDPLYLMTLTIPRLFLKLLQVMWDATVFGVFNDNFPLYIKHEDLSEIPHGGQCLNISVIQLWILHMTETSMQAGNADMYGFLEPQSIQRSGQSQFESESYIKNWM

SEQ ID NO: 153007 - protein, 230 aa, Glycine max
  Coding DNA Sequence Number=SeqID_36229
MGVVWNSVNKVAQILDLILSKATLGQFKAKLAILQNLKGTFQMQKMIVEGFIVCFKNHLAPSSSSSSSSIVGIGKRSLTIGAGLNDSMLQHGLDLSFYFLFLKVGIAIRSDVYWASVGKQGDGHIGAKRSSSGTSSKSTINKKSLEEHLCPLVNLSSQLKHSPFSRRLAISSNDNLLRGIGGYLVGVGSREGGDSEAIVLWGAMILEELGYFEDPTHMIQAIESRKSTIV

SEQ ID NO: 153008 - protein, 187 aa, Glycine max
  Coding DNA Sequence Number=SeqID_36230
  Gene Ontology: Mol. function=chromatin binding; Cellular component =chromatin; Biological process=chromatin assembly or disassembly
  Homolog annotation: Hit_ID=Q1SAV4; Match level="QueryCoverage=83%, HitCoverage=39%, E-value=1e-36, Identity=50%"; Hit description =Integrase, catalytic region
MKCVADGHRWEREFKIGDWARVKLQPHRQLSATGVTYSKLTKCFYGSFQVVERIGNVAYKLQLPENSRIHPIFHCSILKPFHQPSTVTIEPISLPPTIVDNQPVISPLAIISEQWDHSTPKPKRMVLVQWASLLLEDTSCEIWSELKDTYHLEDKVLLNGLGNDTVETRDLLPTGCEAPSISLVPMV

SEQ ID NO: 153009 - protein, 76 aa, Glycine max
  Coding DNA Sequence Number=SeqID_36231
MDEDFKIIEELRDSNNYLRAQITHLERTLKQATAKEMISKGMVLEPRTEKLVSSMNIRLKGRTEKHEDVEGGRTSL

SEQ ID NO: 153010 - protein, 233 aa, Glycine max
  Coding DNA Sequence Number=SeqID_36232
MASPPTCPPPPPLVPSDASASPSAVKRHAKPYAYDHCLLDHLVLRDQWCMLILLPARLTDLIWEDIQAEFEIPEASDTDQDGVEDTVCEKYDINKEKWLQFCQTRKDPSWEDVCKKAQAIQKQNTTPHVLSREGYEYLEQRLLIEKTKKKLEEAAQSRSVDGVIDPTSPVRRHMKWKMARTKKIGEMTTEAAKEITEKIDVLTGTIGHPEHPRRVHAAGAGVTIKQYFGSAPR

SEQ ID NO: 153011 - protein, 434 aa, Glycine max
  Coding DNA Sequence Number=SeqID_36233
  Gene Ontology: Mol. function=protein serine/threonine kinase activity; Cellular component=cytoplasm; Biological process=protein amino acid phosphorylation
  Homolog annotation: Hit_ID=Q9LSF1; Match level="QueryCoverage=95%, HitCoverage=93%, E-value=1e-109, Identity=52%"; Hit description =Serine/threonine-protein kinase OXI1
  Pfam annotation: Domain name=Pkinase; Domain location=20-342; Score =218.2; E_value=1.8e-62; Accession=PF00069.15; Description=Protein kinase domain
  Pfam annotation: Domain name=Pkinase_Tyr; Domain location=20-342; Score=-34.3; E_value=2.3e-10; Accession=PF07714.7; Description =Protein tyrosine kinase
  Pfam module annotation: Pfam domain module=Pkinase::Pkinase_Tyr; Domain location=20-342::20-342
MNDGGSRQSDNAKPLDLENLRVVSAVGRGAKGVVFLARTGDRSSEECVALKVISKALIIQKKAKLNDTEEYTRVSFEEQVLRRFDHPLLPRLRGVFETDRVVGFAIDYCHGGTLRSLRKKQTEKMFSDDTIRFYAAELVLALEYLHKLGIVYRDLKPDNVMIQENGHIMLVDFDLSKKLNPKFPYSLSHNSSSNPNSEKKHTRRHWLTRFYKFCNWVISPYDSDSEPSLNNVNSARHIESNLVEKSNSFVGTEEYVAPEIVSGKGHDFSIDWWSYGIVLYEMLYGTTPFKGANRKETFYRILTKEPELTGEKTALRDLIGKLLEKDPDRRIRVDEIKGHDFFKGVKWDMVLRIVRPPYIPENEVKNKVGFGKSDVEVFVDKVFFPTGDDGGREKTKMVLEKKDSNNNGENINNMVKVDELSHVPTEKIDDFLIF

SEQ ID NO: 153012 - protein, 229 aa, Glycine max
  Coding DNA Sequence Number=SeqID_36234
  Gene Ontology: Mol. function=nucleic acid binding; Biological process= transport
  Homolog annotation: Hit_ID=Q8H6Q8; Match level="QueryCoverage=37%, HitCoverage=2%, E-value=4e-18, Identity=51%"; Hit description=CTV.20
  Pfam annotation: Domain name=MP; Domain location=80-229; Score=12.1; E_value=2.7e-05; Accession=PF01107.9; Description=Viral movement protein (MP)
  Subcellular localization annotation: CTP_CleavageSite=31; ConfidenceScore=5.15e-01
MRAKILENIIIMSRLLRSFSHISFRSNSSLSSSSRNSNLLNDQDNQTQEVAPKHNLFDEEVRFEDINQNMDDWNIPEIPQDQLYVPETIKDKHNFDYIIKTVENNIPLGQEVGEEFHLLSKNSIHEHSRKYKYLHIGCVQVAIKPLIDMGIDAAVLMCLRDIRHNQFEDSLIGTVETSLGQGPIYFNCYPNKTVSLMDRNILDSLFLNIHFHGLDMKEGSIPAALIYRI

SEQ ID NO: 153013 - protein, 97 aa, Glycine max
  Coding DNA Sequence Number=SeqID_36235
MALARMEIKKFVGEIDNFSLWEVKMNALLIHQDLDATLSESAITTREEKRRVEVMNRLIVISMKAEWRRKKDDWRCHFKEKISQEQAYHHRKPWIRA

SEQ ID NO: 153014 - protein, 86 aa, Glycine max
  Coding DNA Sequence Number=SeqID_36236
MWFKEIRCMQFIFITWNHVLREANQVADVLAKQAIMALNHFQVLRFLLHVLSMHFEMILLMFVSQEAAFGPLDGCSSPKEVYLFSE

SEQ ID NO: 153015 - protein, 79 aa, Glycine max
  Coding DNA Sequence Number=SeqID_36237
MASYSNDAREWMVEPFLVTFLGLPNSGYGLDGTFSMKSTYEIVVMNSPSPNQGLFICLHKWKRPERIISFLWKLCHERF

SEQ ID NO: 153016 - protein, 51 aa, Glycine max
  Coding DNA Sequence Number=SeqID_36238
MSSKMRRGLLKMLFKKLVSWLTITIRQSCLRQFGARSHRSFSLRSGREYLE

SEQ ID NO: 153017 - protein, 63 aa, Glycine max
  Coding DNA Sequence Number=SeqID_36239
MKKHFCNLIMYNLLKIMSILLFRKRLTRRLFIVANSAYPSSRGWTSIRSGMIHTIPKPQAQNA

SEQ ID NO: 153018 - protein, 42 aa, Glycine max
  Coding DNA Sequence Number=SeqID_36240
MEYYVLLEQGCEYKESSGILFFGGVLEANGPKNPRNLFQEYE

SEQ ID NO: 153019 - protein, 66 aa, Glycine max
  Coding DNA Sequence Number=SeqID_36241
MEHFNGDDGEKETTVANVMVREKRLGCKWMVSKVPNKSDEQGRKWMVREKKLVFPKTDVNIGFFEN

SEQ ID NO: 153020 - protein, 113 aa, Glycine max
  Coding DNA Sequence Number=SeqID_36242
  Gene Ontology: Mol. function=hydrolase activity, acting on carbon -nitrogen (but not peptide) bonds; Cellular component=cytosol; Biological process=nitrogen compound metabolic process
  Homolog annotation: Hit_ID=Q8LI89; Match level="QueryCoverage=68%, HitCoverage=13%, E-value=2e-28, Identity=65%"; Hit description =Putative NAD synthetase
MTRSRPKVLADEIGKRPRYKVDGGSNVENLSLQNIEARIRMVLAFMLPSLLPWVHSKPGFYLVLGSSNVDEGLRGYLTKARNDVERTSYYIDVGVGNDVESAGYYICASTKTI

SEQ ID NO: 153021 - protein, 68 aa, Glycine max
  Coding DNA Sequence Number=SeqID_36243
MRRIVLRCGVTRQMVRWMTTENLVSKDTGTQCSIGCDIGGVTSTSHVNFTLTPAFVADATSVSIRMPR

SEQ ID NO: 153022 - protein, 144 aa, Glycine max
  Coding DNA Sequence Number=SeqID_36244
MRILKLTKYRLKAQVEKDKAPKWRRMKAQVEKDEGPEAETLSRLLITYQGNPCGVYLDLSSFIESGVYLDLSSFIENGVIQTSVACIKQSAPSQDHIIWNLRGNDVILPRKGPITRTMSKRLQEDWARAAEEGPRVLMNLRVDF

SEQ ID NO: 153023 - protein, 111 aa, Glycine max
  Coding DNA Sequence Number=SeqID_36245
MGVFAFSSVGYNEAKAYNVDGPLATRWKPLRGFGLALPKRDWREVFSFEEGVEEIWSCADDSTPSTSLSFLLAYYVPGGYYPFQIDSPMALGAMKTLLDLRAMLESTSHHQ

SEQ ID NO: 153024 - protein, 160 aa, Glycine max
  Coding DNA Sequence Number=SeqID_36246
MNGLKHNATKSSTYLDHERLVWIKGRGIPTYAWTKNFFILMGSLYGDFLYLDDLSMNRERLDVAHFSIRTKTQDLINYVVRIKIDEDVFDIKLVDKGSEDCLKCIQGRNRKKEVMKTIMEKGRILIEDSTWMKVLVVQLVANIQQEAKEEKVQKVATELA

SEQ ID NO: 153025 - protein, 81 aa, Glycine max
  Coding DNA Sequence Number=SeqID_36247
MEVVSAQRLLEVVKRRSHADKQWSPNEIRVRQSPLPTSGPQESRLGVPLSRNPLHLLKHTRTSLPLCSNALQQETLSLLAL

SEQ ID NO: 153026 - protein, 279 aa, Glycine max
  Coding DNA Sequence Number=SeqID_36248
  Gene Ontology: Mol. function=transporter activity; Cellular component= membrane; Biological process=transport
  Homolog annotation: Hit_ID=Q2CE10; Match level="QueryCoverage=74%, HitCoverage=74%, E-value=1e-64, Identity=61%"; Hit description =Permease protein of suger ABC transporter
  Pfam annotation: Domain name=BPD_transp_1; Domain location=73-273; Score=43.2; E_value=9e-10; Accession=PF00528.12; Description=Binding- protein-dependent transport s
MLRTIWIANFADLIVVMTDGGPAGSTSILSSYIFTTAYRKLDFGYASAMAGVTLLPGGFTLSHFAKVLTDSDFPTFFINSLIVSCSTAALTTLIAAGAGYAFSRFQFRGKMVMAALLLFTQMFPLVMIIAPIYRVMAPLGLTNSLLGLILIYSAFNVPFATFLMQSFFDAIPKDLEESAMLEGCTRFQALYRVLMPLTLPGMAATLGFVFTAAWSELLFSLMLINKNEVMTFPVGLLSFVCQFAVSWGEMMAAAVLALIRALSDLRLHSTLSWFHGLTR

SEQ ID NO: 153027 - protein, 58 aa, Glycine max
  Coding DNA Sequence Number=SeqID_36249
MADGKLIEMKGRVNLGLKSENKMLMHGWLWKGLYILGSGRFLADPNGQNVDLCTRDLQ

SEQ ID NO: 153028 - protein, 111 aa, Glycine max
  Coding DNA Sequence Number=SeqID_36250
MATQLIHDRVEMECLEGAWETLKGNTRCRFQGTIQFTTTSLVHPDEPARTLQRTVEWILPTPTPYRLVEPVQVIEVTSSEEDPEEDLEELPPEPAVDALDFLEGDEDPLPE

SEQ ID NO: 153029 - protein, 315 aa, Glycine max
  Coding DNA Sequence Number=SeqID_36251
  Gene Ontology: Mol. function=sulfotransferase activity; Cellular component=nucleus; Biological process=regulation of progression through cell cycle
  Homolog annotation: Hit_ID=Q9ZR04; Match level="QueryCoverage=97%, HitCoverage=90%, E-value=2e-42, Identity=35%"; Hit description =Putative D-type cyclin
  Pfam annotation: Domain name=Cyclin_C; Domain location=176-313; Score= 13.2; E_value=0.0036; Accession=PF02984.9; Description=Cyclin, C -terminal domain
  Pfam annotation: Domain name=Cyclin_N; Domain location=18-174; Score =33.2; E_value=1.9e-07; Accession=PF00134.13; Description=Cyclin, N -terminal domain
  Pfam module annotation: Pfam domain module=Cyclin_C::Cyclin_N; Domain location=176-313::18-174
MEFDLEDPLVSLEEEQTFTISELFASESEHVPSPNCLTSTHFRVFCCEAISLILQVQVSCKLDPFVAYLAINYLHRFMSSQEIPKSKETFEQLYLNSIPQFPIFYPYAISPLSLQQGKPWFLRLVVISCLSLASKMKNTTLSFLVIQKEGCYFKAQSIQRMELLILGALKWRMRSITPFSFLHFFISLAEIKDQSLKQALKSRASEIIFNAQNAQTLNCISLMAADIKLLEYKPSTVAATALIFASHELFPQQYSILRASITASEYLDGETLSKCFDLMQDMMRMEAKELMIDTSFLSTETPVSMLERNTKRQRI

SEQ ID NO: 153030 - protein, 834 aa, Glycine max
  Coding DNA Sequence Number=SeqID_36252
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=96%, HitCoverage=97%, E-value=0.0, Identity=60%"; Hit description =Putative Na/H antiporter
  Pfam annotation: Domain name=Asp-Al_Ex; Domain location=64-178; Score= -69.8; E_value=0.077; Accession=PF06826.3; Description=Predicted Permease Membrane Region
  Pfam annotation: Domain name=Na_H_Exchanger; Domain location=42-427; Score=248.3; E_value=1.6e-71; Accession=PF00999.11; Description =Sodiumhydrogen exchanger family
  Pfam module annotation: Pfam domain module=Asp-Al_Ex::Na_H_Exchanger; Domain location=64-178::42-427
MAPYNMSDRSLICYTPLMTTTNGLWQGDNPLDYSLPLFILQLTMVVCATRFFVFILKPLHQPRVIAEILGGLLLGPSIFGRNLKFANAVFPLKSVMVLETMANMGLIYFVFLVGLEMDISIIKRTGKKTVSIAFAGMILPFLIAVCVSHLIEDKDNSMNQASYVLYIGIVLSVTAFPVLARMLADLKLISTDLGKLALSISLINDVFAWILLALAIALSEANTGTWASVLVVISNLVFVSFCFVIVRPAVSWLIERTPEGKPFSEFQLCIVLTGVMISAFITDVLGTHCAFGAFVYGLVIPNGPLGAAILEKLEDFVSGLLLPLFYAICGLKTDIKLISGASTWTFVLTVIPLTCLGKILGTFFISLIFQIPNRDGVVLGLLMNSKGLIEMIVLNVGREQKVLGDKIFSVMVIVTLVMTAVVSPIVTLIYKPRKRLIPYKRRTIQNSRLDAELRVLVCIHTPRNVPTLVNLLEATHPHKRSPICAYVLHLVELTGRASAMLVVHANRQSGGPALNKTQAQTDHIITAFQNFEEHVGHTQVQPLTAISPYSTMHEDICNLAEDKRVSLIIIPFHKQQTVDGEMHDTIPAFRMINHNLLQNSPCSVGILVDRGLNGSNRLIGNLASHKVAVLYFGGPDDREALAYGWRMSRHPRVHLTVMHFTPSKHPTQTPETDHLWANIDRSFTIIKNGREHTLDEEYISEFKKMITNDDSVVYIDKVVNNGEETVAAIRSINNVNDLFIVGRGQGTMSPLTDGLTDWSECPELGAIGDLLASSDFETTASVLVMHQYVGQGPDGEENFVVERPWQTSEHYHNMKQQQNMQRYTMPMGMGQSLL

SEQ ID NO: 153031 - protein, 144 aa, Glycine max
  Coding DNA Sequence Number=SeqID_36253
MVRTCSNRKERRVFGKGFPGSRKYLRSTRLGQERGLRVTGRFKLANGRVEVIKLTYGRVEVQDSKISGLSTISDQTPQNQLRLRAIWITVLRSSYVHILIYSKYPAQRETSTQGELSVCCNDEHSKALHLNAKYTSDMLLRFTS

SEQ ID NO: 153032 - protein, 43 aa, Glycine max
  Coding DNA Sequence Number=SeqID_36254
MALHLLNSIPSICSAYFIPSSHQVSWLRDECNGGWNTGYAILN

SEQ ID NO: 153033 - protein, 108 aa, Glycine max
  Coding DNA Sequence Number=SeqID_36255
  Gene Ontology: Mol. function=structural constituent of cell wall
  Homolog annotation: Hit_ID=Q9M6T7; Match level="QueryCoverage=75%, HitCoverage=30%, E-value=6e-21, Identity=55%"; Hit description =Proline-rich protein
MAFSCAVEKPLHSMNWMILTRRQGAFLCFWLSVLFVVVDFCYGDHSTVEVVGLGECADCKEKNIQTSQAFSGLRVTVDCKAASGNFERRGVGELDEYGNFKVSLPHDT

SEQ ID NO: 153034 - protein, 100 aa, Glycine max
  Coding DNA Sequence Number=SeqID_36256
  Gene Ontology: Mol. function=metal ion binding; Cellular component =integral to membrane; Biological process=negative regulation of nitric-oxide synthase activity
  Homolog annotation: Hit_ID=Q10N73; Match level="QueryCoverage=79%, HitCoverage=26%, E-value=5e-36, Identity=85%"; Hit description=Zinc finger, C3HC4 type family protein, expressed
MPQRHSKNNNDLAFFTYDEKRKLGYGTQKERLGKDSIKPFDACSLCLKSLIDPMSCQKGHLFCKECILQCLLSQKKDIQRLWNLAGFPMPGGGNSSTFFK

SEQ ID NO: 153035 - protein, 107 aa, Glycine max
  Coding DNA Sequence Number=SeqID_36257
MSPCKRVKSAHYKFMPSEAQSLAPLARWTKPAENMLKYSVDDASCFAIQHQQSHWHGFSPQELKWWFCLSALTTTQAGTTHAPEVEASTMLVVIDWAIEKGPSNIGV

SEQ ID NO: 153036 - protein, 46 aa, Glycine max
  Coding DNA Sequence Number=SeqID_36258
MADTSSVDASLWWDSFTVLFSELENSSLTSDLPPNLVHFQQSPFAF

SEQ ID NO: 153037 - protein, 155 aa, Glycine max
  Coding DNA Sequence Number=SeqID_36259
  Gene Ontology: Mol. function=cysteine-type peptidase activity; Cellular component=cellular_component; Biological process=ubiquitin cycle
  Homolog annotation: Hit_ID=Q8LG98; Match level="QueryCoverage=86%, HitCoverage=45%, E-value=5e-39, Identity=60%"; Hit description =Ubiquitin thioesterase otubain-like protein
MQSKEAVVEDGEIKSVTAVGSEIDGWTNFGDDDIMQQQYTIQAEEAKKEPLSSLAAEYKLGSPILLEKIKVLDEQYAAIRRTRGDGNCFFRSFMFSYLEHIMECQDQAEIDRIQANVEKSRKALQTLGYADLTFEDFFAGYCTVYELISPKHCGS

SEQ ID NO: 153038 - protein, 83 aa, Glycine max
  Coding DNA Sequence Number=SeqID_36260
  Subcellular localization annotation: CTP_CleavageSite=74; ConfidenceScore=5.01e-01
GQLSYPNFVRGPSVVGMRPSFDHFEDVPPEGGCFWRKQPSSPGRAGKSNPRCFRNVSVGDFAKIFNRSSTFFVRSSSFFDLQP

SEQ ID NO: 153039 - protein, 113 aa, Glycine max
  Coding DNA Sequence Number=SeqID_36261
  Gene Ontology: Mol. function=transferase activity, transferring acyl groups, acyl groups converted into alkyl on transfer; Cellular component=mitochondrion; Biological process=tricarboxylic acid cycle
  Homolog annotation: Hit_ID=P83372; Match level="QueryCoverage=84%, HitCoverage=20%, E-value=3e-38, Identity=77%"; Hit description =Citrate synthase, mitochondrial precursor
MAFFRSVSALSRLRSRVDLYSELKELVPEYQERVKKLKKDHGSVELGKITVDMVLGGMRGMTALVWLGSAVDPDEGIRFRGMSIPECQKKLPGAFTGGEPLPEAVLWLLLTGK

SEQ ID NO: 153040 - protein, 265 aa, Glycine max
  Coding DNA Sequence Number=SeqID_36262
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=98%, HitCoverage=66%, E-value=3e-86, Identity=54%"; Hit description =Lustrin A-like
  Pfam annotation: Domain name=DUF231; Domain location=108-263; Score =236.1; E_value=7.6e-68; Accession=PF03005.6; Description=Arabidopsis proteins of unknown function
FDGKDFLTKLKGKQIMFIGDSVSLNQWQSLICLLRSSVPQTEILEQGDVNVSNYTFQDYGVSVIIFHSTYLVDIEEEKIGRVLKLDSLQSGSIWKEMDIMVFNTWLWWYRRGPKQPWDYVQIGDKILKDMDRMEAFKLGLTTWANWVNAEVDTNKTKVLFQGISPSHYNGTGWNEPGVRNCSKETQPISGSTYPNGLPAALFVLEDVLKNITKPVHLLNITTLSQLRKDAHPSSYNGFRGMDCTHWCVAGLPDTWNQLLYAAITS

SEQ ID NO: 153041 - protein, 221 aa, Glycine max
  Coding DNA Sequence Number=SeqID_36263
  Gene Ontology: Mol. function=nucleic acid binding
  Homolog annotation: Hit_ID=Q2HRG6; Match level="QueryCoverage=97%, HitCoverage=100%, E-value=5e-72, Identity=65%"; Hit description=RNA -binding region RNP-1
MESSAEKYAAFKQKVSRTVYLDNMSPQVTESVIRTALDQFATVKNVKFIPNYIGPSNQPQCALVELDSAKKAKEILSMIAGYPFMMSGQPRPVRARPAVMEMFDDQPIKPNRKIKIRWLEPSDPDFELAKEVKNLTRKHAAEVEFLDKHSGLNLWPLANYPNSSALLLLEDEEKLAKQQEETLKVHYKKFKMIEGIMADKTAHRLARKYNLHVADDWARLD

SEQ ID NO: 153042 - protein, 142 aa, Glycine max
  Coding DNA Sequence Number=SeqID_36264
MAEPSKKRKGSTSRSQQHSGSQETPIPPSIPSGSLFSSEEQRIREGVPFEGALIDDWKFNFSVHDARRLVCTNQADMTGRLLGGSLAFESRILHYLIVRILLPRSSNLAQVSEEDLIVMWAFHKGLQIDWAHLVRYRMHKAL

SEQ ID NO: 153043 - protein, 110 aa, Glycine max
  Coding DNA Sequence Number=SeqID_36265
  Homolog annotation: Hit_ID=O22960; Match level="QueryCoverage=73%, HitCoverage=19%, E-value=4e-19, Identity=52%"; Hit description =Expressed protein
MRMHPWIFGVICLCQLLCVVTTGGGGHVESNFKWQRSEEKHELSCNMYEGRWELDDSYPLYDSSTCPHIRKEFDCLKYGRPDQQYLKYRWQPNECDLPSSYEDKDTDMER

SEQ ID NO: 153044 - protein, 219 aa, Glycine max
  Coding DNA Sequence Number=SeqID_36266
  Gene Ontology: Mol. function=4 iron, 4 sulfur cluster binding; Cellular component=molybdopterin synthase complex; Biological process=Mo-molybdopterin cofactor biosynthetic process
  Homolog annotation: Hit_ID=Q2QQ49; Match level="QueryCoverage=92%, HitCoverage=48%, E-value=1e-75, Identity=70%"; Hit description =Molybdenum cofactor biosynthesis protein 1 A, putative, expressed
  Pfam annotation: Domain name=Radical_SAM; Domain location=62-219; Score=92.2; E_value=1.6e-24; Accession=PF04055.11; Description =Radical SAM superfamily
MGSYCAARRTNRQASFSGNNEYATRAFATTSCASLSEDQPKDNPVSDMLVDSFGRLHTYLRISLTERCNLRCQYCMPADGVELTPSPQLLTKTEILRCANLFVSSGVNKIRLTGGEPTIRKDIEDICLELSNLKGLKTLSMTTNGIALARKLPKLKECGLNSVNISLDTLVPAKFEFMTRRKGHEKVMDAINASIDLGFNPVKVHNLYGKFRMPVMDAF

SEQ ID NO: 153045 - protein, 59 aa, Glycine max
  Coding DNA Sequence Number=SeqID_36267
MPSLDTDKGIYCVARSGVAAINGDLAKIGGFDDGDDASEILHGGSSDAVDGTLLEQRHA

SEQ ID NO: 153046 - protein, 162 aa, Glycine max
  Coding DNA Sequence Number=SeqID_36268
MVARASQMQVVNKIASTYATLKQERRWVCDIFSVSLTLTLSFSFSRIHMDGGDQITKPQSHQMIKIKIKGDCETSIPKQGGCAYKAPPCHASVGPQPLRHAQILVEENGRSSTAVVLSVKAKGVSIAASGDSGGNGRGSGGVFKEQGGGVSGDVCGCSYCAK

SEQ ID NO: 153047 - protein, 686 aa, Glycine max
  Coding DNA Sequence Number=SeqID_36269
  Gene Ontology: Mol. function=protein kinase activity; Cellular component=mitochondrion; Biological process=protein amino acid phosphorylation
  Homolog annotation: Hit_ID=Q1SNH1; Match level="QueryCoverage=99%, HitCoverage=95%, E-value=0.0, Identity=70%"; Hit description=Protein kinase
  Pfam annotation: Domain name=LRR_1; Domain location=111-133; Score =5.8; E_value=23; Accession=PF00560.23; Description=Leucine Rich Repeat
  Pfam annotation: Domain name=LRR_1; Domain location=135-156; Score =15.1; E_value=0.26; Accession=PF00560.23; Description=Leucine Rich Repeat
  Pfam annotation: Domain name=LRR_1; Domain location=158-177; Score =5.2; E_value=30; Accession=PF00560.23; Description=Leucine Rich Repeat
  Pfam annotation: Domain name=LRR_1; Domain location=179-201; Score =10.4; E_value=3.2; Accession=PF00560.23; Description=Leucine Rich Repeat
  Pfam annotation: Domain name=LRR_1; Domain location=203-225; Score =16.7; E_value=0.085; Accession=PF00560.23; Description=Leucine Rich Repeat
  Pfam annotation: Domain name=LRR_1; Domain location=227-246; Score =8.5; E_value=7.3; Accession=PF00560.23; Description=Leucine Rich Repeat
  Pfam annotation: Domain name=LRR_1; Domain location=251-270; Score =5.3; E_value=29; Accession=PF00560.23; Description=Leucine Rich Repeat
  Pfam annotation: Domain name=LRR_1; Domain location=39-61; Score=6.1; E_value=21; Accession=PF00560.23; Description=Leucine Rich Repeat
  Pfam annotation: Domain name=LRR_1; Domain location=63-85; Score =14.7; E_value=0.34; Accession=PF00560.23; Description=Leucine Rich Repeat
  Pfam annotation: Domain name=LRR_1; Domain location=87-109; Score =8.4; E_value=7.8; Accession=PF00560.23; Description=Leucine Rich Repeat
  Pfam annotation: Domain name=Pkinase; Domain location=405-669; Score=- 22.8; E_value=3.3e-07; Accession=PF00069.15; Description=Protein kinase domain
  Pfam annotation: Domain name=Pkinase_Tyr; Domain location=404-669; Score=-65.8; E_value=2e-08; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=111-133::135-156::158-177::179-201::203-225::227 -246::251-270::39-61:...
  Pfam module annotation: Domain location=:63-85::87-109::405-669::404 -669
  Subcellular localization annotation: CTP_CleavageSite=36; ConfidenceScore=5.29e-01
MGEKSEKPQRFNGFAVPNQTLSMNFSIVSFLSTLTRLASLRVLSLVSLGIWGPLPDKIHHFSSLQVLDLSSNFIFGAIPPKISTMVKLHALTLDDNYLNTTMPDWFDSLSNLNILSVKSNGIKGPFPSSLCKIKTLEVISLSHNELAGELPDLGSLTGLHVLDLRENQLESELPLLPKSVVTVLLSNNSFSGEVPKQFGELDQLQHLDLSSNHLSKTPPSTLFSLPKISYLNLASNALSGALPDKLSCGSKLGFVDISSNKLSGGLPSCLANTSDGRVVRYAGNCLSVDSQNQHRGSYCRESSSGWKNLKTWKVAAAMAIIVGLVLVVMVSGVFLWKKYHSRKITGQEVLLKIVHDNSTTGVSSEILANARFISQTVKLGTQTTSTCRQFSIEELKEATKNFDLSTYIGQGQGSIGKLFKGKLENGSYAAIRSLALSKKCSIQNLRAKLDLLSKLQHPNLVSLLGHCIDGGGQEDPNSHKLHLVYEYVPNGNYRTHLSEFSVDKALKWSDRLAILIGVAKAVHFLHTGVIPGCFSNQLKTKNVLLDEHRIPKLSDYGMSIITEEIEKSEAKSEKPKPRPRTKAEDDVYNFGFILFESLVGPIACDKGETFFLNEKASFGSQDGRRKIVDPIVLTTCSQESLSIAISITTKCISPESSFRPSFEDVLWNLQYAAQVQATADADHKSD

SEQ ID NO: 153048 - protein, 324 aa, Glycine max
  Coding DNA Sequence Number=SeqID_36270
  Gene Ontology: Mol. function=DNA binding
  Homolog annotation: Hit_ID=Q9FKX7; Match level="QueryCoverage=69%, HitCoverage=68%, E-value=9e-49, Identity=43%"; Hit description =Arabidopsis thaliana genomic DNA, chromosome 5, TAC clone:K2A18
  Pfam annotation: Domain name=DUF151; Domain location=123-260; Score =44.0; E_value=5.2e-10; Accession=PF02577.5; Description =Uncharacterised ACR, COG1259
  Pfam annotation: Domain name=UVR; Domain location=286-320; Score =12.0; E_value=0.022; Accession=PF02151.9; Description=UvrBuvrC motif
  Pfam module annotation: Pfam domain module=DUF151::UVR; Domain location=123-260::286-320
  Subcellular localization annotation: CTP_CleavageSite=62; ConfidenceScore=5.63e-01
MLGSRFCVRTLSGVGSAAADHTNVATTARSVPCSVAVDFSPLHLSPLRSRRRFRCRRSILISCNSSRRRSSSDNSHDNNNKNDYLEASLLLSETFSHYHMWKHRFQPEFQWKSSTPSIPLSRTDSSLLRHGFLQRFKNPTIFLRISCDGDYILPIVVGQIAIEKLMDAESEQESVECPDQYQFVENLVGRLDHEVIMVRITERVVSTYFARLYLSQPGKTDLISVDARPSDAINVANRCKAPIYVSKEIVFTDAIRIGYGMGGAHNKKAIYDVLLDSAIDGPDLVAQELSMMHNMHSAIKQERFKDAAIWRDKLANLRKSTHEL

SEQ ID NO: 153049 - protein, 153 aa, Glycine max
  Coding DNA Sequence Number=SeqID_36271
  Pfam annotation: Domain name=VQ; Domain location=36-66; Score=45.8; E_ value=1.4e-10; Accession=PF05678.4; Description=VQ motif
MTKLHTCYPSSASSKLGIDKDSHVISKTKPKIRIIHVYAPEIIKTDAANFKELVQRLTGKPKEEEGRGKSKSKTALTKDPKDSHPKKVMVMQDDEFLSLQNRTRVKNEYKEEEIQDDMWRSKSNEKFSGFLDGFLELDGFMEELSTVPSENQN

SEQ ID NO: 153050 - protein, 103 aa, Glycine max
  Coding DNA Sequence Number=SeqID_36272
MTTRPKSPRPQRGPWNFDKHLLILRVIKEGESPANVPLFNVPYWVQVHGLPIGFMSQSIGQSIGHADKLCEKLFANGVNDGVILWNGDLWSQARANTSMRLPT

SEQ ID NO: 153051 - protein, 186 aa, Glycine max
  Coding DNA Sequence Number=SeqID_36273
  Gene Ontology: Mol. function=RNA-directed DNA polymerase activity
MTWKIGDGSLANIWRQSWLRSKHNSFISSQPMIGNEHATVNALIHSNSFLVEEILPIPLLNKDDTDQIIRKQSPNGSYTVRLAYHPTHGFNCRYLEFEGPWKLEAHLEFKYSSQDQPLHLALSFGAFGTQGTTKYGKKMTIQLKWWYLTVCNTSTIGRIQVQCRSDSFQRRSFFWRWYDYPRSSRG

SEQ ID NO: 153052 - protein, 245 aa, Glycine max
  Coding DNA Sequence Number=SeqID_36274
MMWVGDLKAGGSTPWGRNCNNKTLEKKCNGGREGGGAWKKELNVKRAHVTSGNSLPWICLFRSRGFSVSNPISVSLPLCLCHCHPPKENGIVSHSLLLSRSFSFPPQPRSNPNITNHTLLYTGKIYFQQNNDHSSNDSHSVSRYRASNPSNLQPTTTTATTSSFLAAVPCESRESKTKAKLVIIVTSCPESTPIAFAYATTVEVVVVEEKIPHILIDFWITTKGGERKLFKWILSNHQSKAILLS

SEQ ID NO: 153053 - protein, 47 aa, Glycine max
  Coding DNA Sequence Number=SeqID_36275
MKSGKNCSNEYWKRMRVPLWKKKRLERDFIIMENLQSMRFKNKELKD

SEQ ID NO: 153054 - protein, 77 aa, Glycine max
  Coding DNA Sequence Number=SeqID_36276
MENLHMDEDASLEINFKPPEELKVDLSLCLVGRFLSDKNIRSQIMKECMSLVWKPFLGITISELEAGIFLFQFYHVS

SEQ ID NO: 153055 - protein, 268 aa, Glycine max
  Coding DNA Sequence Number=SeqID_36277
MEKLGDFPFIGKNSHKGSNLGQAHYYLLRIGIMKGFNFRKVWASMSKSHNPSIPPTLCRPIQNYCEPATKGRNVDVIQPHNDEKSITNVDVNDKHVEKSTTLIPSNQPQDEKDVPHNTLFEKQSGGMVIRHHQGPPRRIDHVIITHDLPSLWNVDIKGFEFITTDRLLTKVDSEMMDFVRADNSLDYTKVFLYKKIVKALNEKNSLMIGKIEIIKGIQKKIANHEKMVSMKAVENQKLVKAIESLNKNFNATVKDLEETKNTVKALND

SEQ ID NO: 153056 - protein, 122 aa, Glycine max
  Coding DNA Sequence Number=SeqID_36278
  Gene Ontology: Mol. function=DNA-directed RNA polymerase activity; Biological process=transcription
  Homolog annotation: Hit_ID=Q1SWK4; Match level="QueryCoverage=99%, HitCoverage=18%, E-value=8e-29, Identity=46%"; Hit description=Zinc finger, PMZ-type
MKTLPTKTNECPTKIIVRLKEQVWYIISVTEEHSHMLSPTKSHMFCRNRKINIHVQKSLQINDEVGVKLNKSYWTFVWEVRGYENLLFMERDVGNFVGQQRCALGKNGDGKTLLSYFARMRE

SEQ ID NO: 153057 - protein, 581 aa, Glycine max
  Coding DNA Sequence Number=SeqID_36279
  Gene Ontology: Mol. function=nucleotide binding
  Homolog annotation: Hit_ID=Q1SWW2; Match level="QueryCoverage=85%, HitCoverage=87%, E-value=0.0, Identity=73%"; Hit description=Plant protein family, putative
  Pfam annotation: Domain name=DUF246; Domain location=190-538; Score =597.7; E_value=1.1e-176; Accession=PF03138.5; Description=Plant protein family
  Subcellular localization annotation: CTP_CleavageSite=75; ConfidenceScore=5.70e-01
MAKSKNNANKLSYISVPSQIINSISSSSLQSLLDSPKKSSRNTNSRFFIFFTNTNSIIFRKPRMWFLTLFLFGFLGMLKFGLTLHTPFPPYPCATTTLLPRNMISTTPHSKPSLGAVVRENNDQKKDEVLLAHVELRAQGLEKVEGDEGVEKSEFWEQPDGLGYKPCLSFSRDYRGASERVLRDRRKYLMVVVSGGLNQQRNQIVDAVVIARILGAALVVPILQVNVIWGDESEFGDIFDLKHFKRVLANDVRVVSALPSTHLMTKPVEGSPPLHVTPSWIRSRYLRRSWLSVQFNREGVLLLRSLDSRLSKDLPSDLQKLRCKVAFNALRFAQPIQELGDRIAERMQSKGPYLALHLRMEKDVWVRTGCLPGLSPEFDEIVNSERVQRPELLTARSNMTYHERKMAGLCPLNAVEVTRLLKGLGAPKNARIYWAGGQPLGGKEALLPLIQDFPHFYSKEDLALPGELQPFANKASIMAAIDYIISEKSDVFMPSHGGNMGHAIQGHRAFAGHKKYITPNKRHMLPFFHNSSLSEEEFNKIIKELHQDSLGQPELRTIKAGRDVTKFPIPECMCNDSNAQS

SEQ ID NO: 153058 - protein, 651 aa, Glycine max
  Coding DNA Sequence Number=SeqID_36280
  Gene Ontology: Mol. function=nucleoside-triphosphatase activity; Cellular component=membrane; Biological process=protein catabolic process
  Homolog annotation: Hit_ID=Q9ZPW5; Match level="QueryCoverage=46%, HitCoverage=48%, E-value=1e-118, Identity=72%"; Hit description =Putative AAA-type ATPase
  Pfam annotation: Domain name=AAA; Domain location=68-272; Score =169.9; E_value=6.6e-48; Accession=PF00004.19; Description=ATPase family associated with various cellular activities (AAA)
  Pfam annotation: Domain name=AAA_3; Domain location=68-190; Score= -16.7; E_value=0.022; Accession=PF07726.2; Description=ATPase family associated with various
  Pfam annotation: Domain name=AAA_5; Domain location=68-196; Score =0.5; E_value=0.0016; Accession=PF07728.4; Description=ATPase family associated with various
  Pfam annotation: Domain name=LEA_4; Domain location=495-538; Score =9.9; E_value=0.089; Accession=PF02987.7; Description=Late embryogenesis abundant protein
  Pfam annotation: Domain name=Mg_chelatase; Domain location=68-202; Score=-137.3; E_value=0.0023; Accession=PF01078.11; Description =Magnesium chelatase, subunit ChlI
  Pfam annotation: Domain name=Sigma54_activat; Domain location=40-160; Score=-187.5; E_value=0.061; Accession=PF00158.16; Description=Sigma -54 interaction domain
  Pfam module annotation: Pfam domain module=AAA::AAA_3::AAA_5::LEA _4::Mg_chelatase::Sigma54_activat; Domain location=68-272::68-190::68- 196::495-538::68-202::40-160
MAKFPGSEIISQAKNKVLCNSTLAGAEKPIGSKNGLGNVILHPSLQRRIEHLARATSNTKSHQAPFRNMLFYGPPGTGKTMVAKELARRSGLHYAMMTGGDVAPLGAQAVTKIHDIFDWAKKSRKGLLLFIDEADAFLCERNSSHMSEAQRSALNALLFRTGDQSRDIVLVLATNRPGDLDSAVTDRIDEVIEFPLPGEEERLKLLKLYLNKYLCDDNNGSKGGFFLKKQPQKITIKDLSEDVFREAAKKTEGFSGREIAKLMASVQAAVYGRPDCILDAQLFREIVDYKVVEHHQRLKLAAEGYFGFINYYFVRNIGGGALAFNYLEAAYQNLFTSSYRARSQGGAKPVKAIKIGREAGHAGAPPRPFNTCPKARAPWGDDVVEDGEEAKHFAAKAVHDVEEETRSWADWAQDKFSKSFGAEEDHEKQATQNMKYQAEDAASRATERVKSAASGASDYASQKATDAKEAVSGAKVIKMPTDSINNAKHTMGDTYEDAKQKMNTASDKASSMAHNAKDNTAESMEYGKDIAANAYDQGKQKINIASDTASEKFYDAKDKASDVRHKVKGAMGCGGDKANNDAKNNMGVKMEHGRDKVAETFDQAKREVGEAYVSAKNTMTEEAKAKYEAAKEKASDATGDLGAKMRNTPNV

SEQ ID NO: 153059 - protein, 86 aa, Glycine max
  Coding DNA Sequence Number=SeqID_36281
MEVAFRFLHLHHEFVTLEVVIDGEKSKGPKTSFGADVVVDDVVDINNNTALVDHNMGDSSVDVFEPLLDEAIGGGDGGVILWGLPL

SEQ ID NO: 153060 - protein, 200 aa, Glycine max
  Coding DNA Sequence Number=SeqID_36282
  Gene Ontology: Mol. function=uroporphyrin-III C-methyltransferase activity; Cellular component=ribonucleoprotein complex; Biological process=porphyrin biosynthetic process
  Homolog annotation: Hit_ID=Q96532; Match level="QueryCoverage=79%, HitCoverage=43%, E-value=6e-69, Identity=83%"; Hit description=S -adenosyl-L-methionine-dependent uroporphyrinogen III methyltransferas e
  Pfam annotation: Domain name=TP_methylase; Domain location=2-161; Score=97.9; E_value=3.1e-26; Accession=PF00590.10; Description =Tetrapyrrole (CorrinPorphyrin) Methylases
MDFFMVDLWQEEIHELLLSFAEAGATVVRLKGGDPLVFGRGGEEMDFLQQQGIQVKVIPGITAASGIAAELGIPLTHRGIANSVRFLTGHSRKGGSDPLFVSENAADPDSTLVVYMGLSTFPSLAQKLMLNGLSPQTPAAAIERGTTLQQRTVFAELKDLHEKITSTQLNFCPAFGVSIGVVGLGTDSEPILIFHVTDWE

SEQ ID NO: 153061 - protein, 427 aa, Glycine max
  Coding DNA Sequence Number=SeqID_36283
  Gene Ontology: Mol. function=DNA binding; Cellular component=oxygen evolving complex; Biological process=DNA integration
  Homolog annotation: Hit_ID=Q1SNS9; Match level="QueryCoverage=81%, HitCoverage=43%, E-value=1e-109, Identity=65%"; Hit description =Integrase, catalytic region
  Subcellular localization annotation: CTP_CleavageSite=37; ConfidenceScore=5.10e-01
MGLRITPQTMRTHMYKMKWRSSKFQPQSSRQGGTNIEGPMVSEELLGRGKRVKQPSVHLKDFVTRTIRISPSASSSFQSKSSGTPYPIAHYVNYDKFFVQHQSFLAAVTIGYEPNTYVEAVKDECWREAMCKEIQALEDNGTWTIEDLPLGKKAIRSKWAYKIKYNSDGSIERCKVRLVILGNKQVEGIDYNDTFAPTTKMVIVRTFLAVVIAERWELHQMDVHNAFLHGELDEEVYMKLPPGFASPTPGKAPRCWFAKLAAALNKYGFQQSYSDYSLFTYKNRHLQLHVLVYVDDLIISGNDGVAVQRFKDYLSQCFHMKDLGKLKYFLGIEVAQNSKMLGREPDLLDAYSAQTVLLCAYTCTVHATVEIRTLGASFEGHSIFEGKSRTSLQTSLQRLWEHNNLTFSFASWAFRILMLHLEGGIED

SEQ ID NO: 153062 - protein, 270 aa, Glycine max
  Coding DNA Sequence Number=SeqID_36284
  Gene Ontology: Mol. function=protein binding; Cellular component =plasma membrane; Biological process=regulation of transcription
  Homolog annotation: Hit_ID=Q9M3H9; Match level="QueryCoverage=88%, HitCoverage=71%, E-value=1e-86, Identity=63%"; Hit description=Tubby- like protein
  Pfam annotation: Domain name=Tub; Domain location=1-222; Score=202.9; E_value=7.6e-58; Accession=PF01167.8; Description=Tub family
PGPRDSPIQCFIRRNRETSTYLLYIGLVPSENETDKLLLAAKKFTIYDSQPPHGAAIQPDSQPSRRFHSKQVSPRVPACNYVVSTIAYELNVLRARGPRRMHCTMNSIPVSAVQAGGNAPTPTFPEIIDEPFSPSPALKGKGPIRDLDNASLPELLPVESQGSAEPLVLKNKAPRWHEQLQCWCLNFKGRVTVASVKNFQLVSAVDPSHNVSAAEQEKPVNETNGTGSSAGAPSIPNQPVNETNGTGSSAGLYHIYNMLGTVNQAWWACN

SEQ ID NO: 153063 - protein, 732 aa, Glycine max
  Coding DNA Sequence Number=SeqID_36285
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=93%, HitCoverage=93%, E-value=1e-160, Identity=44%"; Hit description=Bg55 protein
  Pfam annotation: Domain name=U-box; Domain location=271-342; Score =63.6; E_value=6.4e-16; Accession=PF04564.6; Description=U-box domain
MVTDIGEGEELQNPRSFKVHSKICTELTELVDRISRIVPDIEAARPGYSSGIESLCLLNNAIDKVKLLLQHCSECSKFYLAMTGDTVLSRCLKATRSLEKSLIQIQDMVPVMLAVEVSRIIHDLECTRLVLDPNEEKAGRVVRELLTLTSDSADDSEVKALQFAASTLNITSPKAILIEQRSIKKLLDKLGPNDLPKKKILRYLLYLLKKHGKLMVGEHVEEVYSRSEEQAATENSNHDSLRSHHVDSDTILKYGQYKTHTNELSGVAPLEEYKCPISSRLMYDPVIIDSGVTYERMWIKKWFDEGNDICPKTRKKLVHMGLTPNMAMKDLISKWCRNNGVSIPDPSRHAEDICAWEASNTSISSLGSYFNDFTAPVDLSSMSIGPLDTSFSLDASHGKTTRGSNLMQTKSRDNSHKHQAHTEIHDTDLMLLPQLCDLQWDSQCKVIQDLKDNLKSNSQAFVSVSAENFIEPLVRNGTTNLNEDTFIMLASFLNSDVIGETLAIMEELSGYGFSKAKIAASSALSSILNMLDSENKGFQQQAIRIMYNLSFSGEVCPRMLSLRCIPKLLPFFKDRTLLRYCIYILKNLCDTEEGRKSVSETKGCLSSVAEILDTGNNEEQEHALAVLVSLCSQHVDYCKLVMREDEHIISLLIYISQNGNDRGKGSALELLHLLKDIDIAENEGCPEPNINNSSRDSNSYHPEENQPSKKSTFLKKLSPFSKSSSHASKTKR

SEQ ID NO: 153064 - protein, 74 aa, Glycine max
  Coding DNA Sequence Number=SeqID_36286
MTNLILNNISKFHENPTVNETGIVILLRPFWVFARKEKATIRKVRWPAGKIEGFGRREKNEIVRQRRLRSQSEN

SEQ ID NO: 153065 - protein, 213 aa, Glycine max
  Coding DNA Sequence Number=SeqID_36287
  Gene Ontology: Mol. function=isomerase activity; Biological process =carbohydrate metabolic process
  Homolog annotation: Hit_ID=Q9FJY6; Match level="QueryCoverage=99%, HitCoverage=91%, E-value=6e-81, Identity=59%"; Hit description =Apospory-associated protein C-like protein
  Pfam annotation: Domain name=Aldose_epim; Domain location=21-211; Score=-18.1; E_value=9.1e-07; Accession=PF01263.10; Description =Aldose 1-epimerase
MAYASSTSLGVRLTEGEGNLPKLVLTSPAGSEAEIYLFGGFITSWKVPSGKDLLFVRPDAVFNGNKPISGGVPHCFPQFGPGPIQQDGPYSCTVWDFSFHALFKASVSNASVKGLKGCKTLNKDPDPKNPVEVVTFPGFVDCAYLDASSELQLDNGLGDLISIKNTVYAVLWNPYLQMEACYKDFVCVENAKIGSVQLEPEQTWTAVQHLSIA

SEQ ID NO: 153066 - protein, 564 aa, Glycine max
  Coding DNA Sequence Number=SeqID_36288
  Gene Ontology: Mol. function=oxidoreductase activity; Cellular component=intracellular; Biological process=lignin catabolic process
  Homolog annotation: Hit_ID=Q8VZA1; Match level="QueryCoverage=95%, HitCoverage=96%, E-value=0.0, Identity=76%"; Hit description=Laccase (Diphenol oxidase)-like protein
  Pfam annotation: Domain name=Cu-oxidase; Domain location=164-315; Score=203.4; E_value=5.3e-58; Accession=PF00394.12; Description =Multicopper oxidase
  Pfam annotation: Domain name=Cu-oxidase_2; Domain location=413-548; Score=191.1; E_value=2.7e-54; Accession=PF07731.4; Description =Multicopper oxidase
  Pfam annotation: Domain name=Cu-oxidase_3; Domain location=38-154; Score=234.4; E_value=2.5e-67; Accession=PF07732.5; Description =Multicopper oxidase
  Pfam module annotation: Pfam domain module=Cu-oxidase::Cu-oxidase _2::Cu-oxidase_3; Domain location=164-315::413-548::38-154
MAAGVGFRSHKSLLIILLGFLGLFSFTVEADTKKYQFDIQVKNVSRLCHAKPIVTVNGRFPGPTIYVREGDRVLVNVTNHAKYNMSIHWHGIKQYRNGWADGPAYITQCPIQTGNSYTYDFNVTGQRGTLWWHAHIFWLRATVYGAIVIMPKPGTPFPFPQPARELEILLGEWWHKDVEEIETQGNQMGLPPNMSDAHTINGKPGPLFPCSEKHTFAMEVEQGKTYLLRIINAALDDELFFAIAGHNLTVVEVDAVYTKPFTTQAILIAPGQTTNVLVKANQVAGRYFMATRTFMDAPIPVDSNAATAIFQYKGIPNTVLPSLPSLPAANDTRFALSYNKKLRSLNTPRYPANVPLKVDRNLFYTIGLAKNSCPTCVNGSRLLASLNNVSFVMPQTALLQAHYFNIKGVYRTDFPDKPSTAFNYTGAPLTANLGTSIGTRISKVPFNSTVELVLQDTNLLTVESHPFHLHGYNFFVVGTGIGNFDPAKDPAKYNLVDPIERNTVGVPTGGWTAIRFRADNPGVWFMHCHLELHTGWGLKTAFLVEDGPGQDQSVVPPPKDLPAC

SEQ ID NO: 153067 - protein, 407 aa, Glycine max
  Coding DNA Sequence Number=SeqID_36289
  Gene Ontology: Mol. function=diacylglycerol kinase activity; Cellular component=intracellular; Biological process=protein kinase C activation
  Homolog annotation: Hit_ID=Q9FJY7; Match level="QueryCoverage=95%, HitCoverage=81%, E-value=8e-73, Identity=34%"; Hit description =Selenium-binding protein-like
MAAMLLLLPPNTKQTKALLERCSNVKELMQIYGQLLKKGTIRNQLTVSTLLASYARIELGNLAYTPMVFDSISSPNTVIWNTMIRAYTQIVMTQKQRCFCTIKCLTTQYLTILTLSLFFSKHVLLSQPLKSMPQTLSFAFMQFQATSNLHMVLFNQLPTRDIVSWNRMIDGTGMHKEALSLLQQMLVAGIKPDSITLSCSLSACAGLDMYVKCGEMEKALLVFSKLEKKCASAWTALIGGFAINGKGLTEEGKSLFESMSSVYNIKPSMEHYGCMVDLMGGAGLLKEAREFVESMPVKPNAAIWGALLNACQLHKYFELGKETGKIQIELDPDHSGRYIHLASIYAAAREWNQVTRVRSQIKHRGLLNYPGCSSITLNGVVHEFFAGAGSHPHIQEIYNMPNLLTNR

SEQ ID NO: 153068 - protein, 251 aa, Glycine max
  Coding DNA Sequence Number=SeqID_36290
  Homolog annotation: Hit_ID=Q8GYL6; Match level="QueryCoverage=93%, HitCoverage=65%, E-value=7e-44, Identity=44%"; Hit description =Regulator of chromosome condensation like
MDEHRDVFPRWQPGCRWIPIGVRIDAYEPTPVSALPSHILSVHAGHYHSLWAWGRNNQAQLARGPSSRESWHEPERVKGLETLNVRLHLTLVFQSLLVFHCIRLGDDGSVSRLDGGMLLLVLRMASCLDGGYSADDISVGIRVSKYLTALADLEAAEKRVLQGMEQENNMPIVWEPRLVEELHGVHVLDIACGLDHSLILCRDGVLLSCGSNVYGQLGRAKTDLGIFPVEMSFSPVFIARARTFIGNMRTR

SEQ ID NO: 153069 - protein, 562 aa, Glycine max
  Coding DNA Sequence Number=SeqID_36291
  Gene Ontology: Mol. function=oxidoreductase activity; Cellular component=intracellular; Biological process=lignin catabolic process
  Homolog annotation: Hit_ID=Q8VZA1; Match level="QueryCoverage=97%, HitCoverage=98%, E-value=0.0, Identity=77%"; Hit description=Laccase (Diphenol oxidase)-like protein
  Pfam annotation: Domain name=Cu-oxidase; Domain location=162-313; Score=195.9; E_value=9.7e-56; Accession=PF00394.12; Description =Multicopper oxidase
  Pfam annotation: Domain name=Cu-oxidase_2; Domain location=411-546; Score=191.5; E_value=2e-54; Accession=PF07731.4; Description =Multicopper oxidase
  Pfam annotation: Domain name=Cu-oxidase_3; Domain location=36-152; Score=237.5; E_value=2.9e-68; Accession=PF07732.5; Description =Multicopper oxidase
  Pfam module annotation: Pfam domain module=Cu-oxidase::Cu-oxidase _2::Cu-oxidase_3; Domain location=162-313::411-546::36-152
MASLGCSMSVLTFLFFIFVGLMSSSSEAAIKRYQFDIQVTNVSRLCHAKPIVTVNGRFPGPTIYVREGDRVMINVTNHVQYNMSIHWHGLKQYRNGWADGPAYITQCPIQTGGSYTYDFNVTEQRGTLWWHAHILWLRATVYGAIVIMPKAGTPFPFPQPAREFEILLGEWWNNDVEEIENQGNKMGLPPNMSDAHTINGKPGPLFPCSEKHTFAMEVEQGKTYLLRIINAALNDELFFAIAHHNLTVVEVDAVYTKPFTTRAILIAPGQTTNVLVQANQVAGRYFMATKAFMDAPIPVDNKTATAILQYKGIPNTVLPVLPQLPARNDTRFALSYNKKLRSLNSTQYPANVPLKVDRNLFYTIGLGQNACPTCLNGTRLVASLNNVSFVMPQTALLQAHYFSIRGVFRTDFPDRPPSPFNFTGAPLTANLATLTGTRVSKIAFNSTVELVLQDTNLLSVESHPFHLHGYNFFVVGTGIGNFDPAKDPAKYNLVDPIERNTVGVPTGGWTAIRFRADNPGVWFMHCHLEVHTGWGLKTAFVVENGQGQDQSVLPPPKDLPTC

SEQ ID NO: 153070 - protein, 291 aa, Glycine max
  Coding DNA Sequence Number=SeqID_36292
  Gene Ontology: Mol. function=protein transporter activity; Cellular component=membrane; Biological process=intracellular protein transport
  Homolog annotation: Hit_ID=Q1PF48; Match level="QueryCoverage=97%, HitCoverage=99%, E-value=8e-80, Identity=57%"; Hit description =Syntaxin-like protein
  Pfam annotation: Domain name=SNARE; Domain location=210-265; Score =32.9; E_value=1.1e-06; Accession=PF05739.9; Description=SNARE domain
  Pfam annotation: Domain name=Syntaxin; Domain location=42-150; Score =68.6; E_value=2e-17; Accession=PF00804.15; Description=Syntaxin
  Pfam module annotation: Pfam domain module=SNARE::Syntaxin; Domain location=210-265::42-150
MNDLMTKSFLSYVELKKQARKDLEDDDLDIEAGKLNPTEDRSLSQFFQEVEAIKFEMEEITNLLFDLQQLNEETKCTHGAKVLRGLRDRMESDMVAVLRKALIIKAMLEVLDQSNIDNRSLSESYKEGSPIDRTRMSVTNGLRVKLRDMMNDFQSLRDKILSEHKEDLKRRYYTTTGEVPTEEVMEKMVSGSLKVEFLAGKTDADLGTQVRHEALMDIQRSLNKLHQVFLDMAILVETQGEKLDNIEDNVVNADEEEEQKVVVLGFCCGADHTTRMHRCNVVFLTGAICKE

SEQ ID NO: 153071 - protein, 449 aa, Glycine max
  Coding DNA Sequence Number=SeqID_36293
  Gene Ontology: Mol. function=zinc ion binding; Cellular component =cytoplasm; Biological process=protein amino acid methylation
  Homolog annotation: Hit_ID=Q0PY38; Match level="QueryCoverage=72%, HitCoverage=72%, E-value=6e-34, Identity=30%"; Hit description =Putative zinc finger protein
AMPAQKRSLPESLDEGDTSQQNLFHSRHAKQQQQQPDQPQEHDEENHEDENEEEEEEGDEEEGEEEEEEEEEEEEEEEEEVEEAAQNDNNDEEKPQDSDDIPSSGSEEKPENNECPACRTHCASRRSLRDDPNYDALISALYPDIEKYEEEELEFREEEKNRNKQIQASIAKVVQRQSEALVKRRKDTPGTFVTRSQRNQRNRRQTQAIEGSEDNEEENDNNEKNSSSDDERSTEHRQRRRKRWARVRSSQPSSSMTSPDGGCNDSDMDISRENRGISSRQVSKHGKLTWGRGGFRSNTRHGSGGSSNSKSSRSSRLSKFVDHLRNLDENTDEFDVHLMLVSLDQQSTSSLQQPYLCCRPTLSVRHLYEHVARQTHLPVEGIEILAVKGCCSTNRDKSTNENSDLAYDELSTLVIDPHKDELEILQGHETLSGLRSKCISKMGHLVSVK

SEQ ID NO: 153072 - protein, 1405 aa, Glycine max
  Coding DNA Sequence Number=SeqID_36294
  Gene Ontology: Mol. function=heat shock protein binding; Cellular component=integral to membrane; Biological process=protein folding
  Homolog annotation: Hit_ID=O23230; Match level="QueryCoverage=96%, HitCoverage=92%, E-value=1e-49, Identity=25%"; Hit description =Trichohyalin like protein
  Pfam annotation: Domain name=TolA; Domain location=990-1369; Score= -149.6; E_value=0.052; Accession=PF06519.2; Description=TolA protein
MAHARQQNEAGFTLSSKINNNGSKSIYDDVYGGPPKFGVSSLSPRFEDYGEIFGSFHTPRASSIPLLDLPAVHDADAFFDPRSQAFNYTEVFGALDFAVPYENLFRHHTALDGASEEEAWSLAETDSFSGESDQSANNQSMSNGYLFHSVDGNAGFNVLYHNKANGTSNECKSKGKTHMTRLHAVPGFSRVYDETTQLHQTDPSFQDADVIDVDMEFSADKVEGNRPRKTIAHLRKFTTGEQTFDSDLNIQNGGSRKDSHSREMFITVSDINLRSMPSQVPPPCRPPPPALDAKKRSMSGFHSNSRLVVSEETPGAGSPPFFNVEDHMNSSATASADAMKEAMLRAEAKLRSAKELKERKKGDCESHSKSSYDAKINEAKMCKDITRLSSLNDHTLQGRHSKTKLSVTDYRQKLKKASPETLDNLEGKRVLNMFEEKDKIESRSSQESDRSSVGTWKDESEFFELVGIEESRRVTQPTKQIKDLVQGTETQKVEREASNVQEKHKQVKATAENYQGEAYEKKYKAAKQACEHDENIMKSEASNGKQRQREQMKKEKMAKVFEVEDNEKSIKIAHQHGKTEKKVTEADQSGIIEDVCEMGHGEHKQVEIQKPKEVDRQTPNEVQLTMGLRENEKKFKEVEKQQQSVQRHKQSEKIKENGKTEREAFALEQTEHGEKLKGSVEPEDMDEKSNVAFEPYYTEEKEVCKRENEMKLKLGKQIQIKKGLKEAHERVEIGKSPKSSSENEESDDGLIPAFRWNGNQKQLKEDFELEVNEIRLKEASKLRENEAYGSDQNRKKFKDVYGEGNRLQEAGDNKGIQKVMNQTPMQEQINGMLNEAQRKKVTEGTSSQTLAMEGSVDVSNENSHLEQSENMEQDVGGMEKDKGLNKAFVMERNEEEGNMKNAKATDETEEIESEEDLAAQSTSIHEEFIGKLKVSKKSVADQDIGKMRAECEVGEKKLKEIGVENQLANEKIRAPEMTAGDAEHLGTQSEKEGDTVTKADNRGTEATGPVTVQETVNVQKTAQWFHVGQSTESKAKSTNETSSMVKNAERMGRESEKDLTQTEEEGDREREREKDVEKAMLEAERERERQKDRMAVDRATFEARDRAYAEACERAAFERATVEVRYKALAEARERLEKACTEARDKSNIDKETIEARLKAERAAVERATAEAQDQAMEKLKNERTAFESREQLERSVSDKFCRRQDSSSSDMLDPQFQNLSSSTGSRHPYSLYGAASFSERSEREGESAQRCRARLERHRRTAERAAKALAEKNMRDLLAQKEQAERNRLSETLDAEVRRWSGGKEGNLRALLSTLQYRLCSVYMEFLTFRPYQILGPDSGWQLIPLTEVITSAAVKKAYRKATLKLGTNSTQRSGNMPGSQENFCPWYSKKLRNSKVNRYKAGG

SEQ ID NO: 153073 - protein, 258 aa, Glycine max
  Coding DNA Sequence Number=SeqID_36295
  Gene Ontology: Mol. function=transcriptional repressor activity; Biological process=regulation of nitrogen utilization
  Homolog annotation: Hit_ID=Q9SDZ1; Match level="QueryCoverage=90%, HitCoverage=91%, E-value=3e-95, Identity=67%"; Hit description =Isoflavone reductase homolog 1
  Pfam annotation: Domain name=3Beta_HSD; Domain location=8-195; Score=- 140.1; E_value=0.012; Accession=PF01073.9; Description=3-beta hydroxysteroid dehydrogenaseisomerase family
  Pfam annotation: Domain name=NmrA; Domain location=7-240; Score =267.2; E_value=3.2e-77; Accession=PF05368.3; Description=NmrA-like family
  Pfam module annotation: Pfam domain module=3Beta_HSD::NmrA; Domain location=8-195::7-240
MAAKSKILVLGGTGYIGKFIVMASAEAGHPTFALVRESTLSHPEKSKLIESFKTSGGDVNDHESLVKAIKQVDVVISTLGGQQIDDQVKVIAAIKEAGNIKALCSYAFAGYFLPTLGQENVTAPPRDKVVILGNGNVKVIYVTEEDVGTYTIKAVEDPRTLNKNLHQKPPANVLTFNELVSLWENKIKSTLHKIYVPEDQILKKIQKSSFPASFLVALGHSMLVKTASNNEADPSVKCQYMEALGQFLSSIRPLYAES

SEQ ID NO: 153074 - protein, 127 aa, Glycine max
  Coding DNA Sequence Number=SeqID_36296
  Homolog annotation: Hit_ID=Q9FJZ0; Match level="QueryCoverage=89%, HitCoverage=100%, E-value=2e-14, Identity=43%"; Hit description =Arabidopsis thaliana genomic DNA, chromosome 5, TAC clone:K1F13
MAHVLVLECVGSNMFRSTSTRGGPSKYERLEKELADNGTSNEEFKRSTSLPSRAMGSTFRDINLQRNPTKNANSKPKEKKSHPLFSFFDLRRKKKTTARPEFARYLEYVKEGGMWDLNSNKPVMYYK

SEQ ID NO: 153075 - protein, 487 aa, Glycine max
  Coding DNA Sequence Number=SeqID_36297
  Gene Ontology: Mol. function=acyltransferase activity; Cellular component=mitochondrial membrane; Biological process=photorespiration
  Homolog annotation: Hit_ID=Q2V987; Match level="QueryCoverage=55%, HitCoverage=99%, E-value=1e-115, Identity=77%"; Hit description =Transcription factor APFI-like
  Pfam annotation: Domain name=Hexapep; Domain location=287-304; Score =6.2; E_value=26; Accession=PF00132.14; Description=Bacterial transferase hexapeptide (three rep
  Pfam annotation: Domain name=Hexapep; Domain location=308-325; Score =2.0; E_value=81; Accession=PF00132.14; Description=Bacterial transferase hexapeptide (three rep
  Pfam annotation: Domain name=Hexapep; Domain location=336-353; Score =14.1; E_value=0.51; Accession=PF00132.14; Description=Bacterial transferase hexapeptide (three rep
  Pfam annotation: Domain name=Hexapep; Domain location=359-376; Score =9.7; E_value=9.8; Accession=PF00132.14; Description=Bacterial transferase hexapeptide (three rep
  Pfam annotation: Domain name=Hexapep; Domain location=377-394; Score =1.4; E_value=95; Accession=PF00132.14; Description=Bacterial transferase hexapeptide (three rep
  Pfam annotation: Domain name=Pyrophosphatase; Domain location=57-211; Score=304.7; E_value=1.6e-88; Accession=PF00719.9; Description =Inorganic pyrophosphatase
  Pfam module annotation: Pfam domain module=Hexapep::Hexapep::Hexapep:: Hexapep::Hexapep::Pyrophosphatase; Domain location=287-304::308 -325::336-353::359-376::377-394::57-211
MAHHEDSSAWNSSKPHPKLNERILSSLSRRTVAAHPWHDLEIGPGAPAVFNCVSFYSIVVEIGKGSKVKYELDKTSGLIKVDRILYSSVVYPHNYGFIPRTICEDSDPMDVLVLMQEPVLPGSFLRARAIGLMPMIDQGERDDKIIAVCADDPEFRHYTDIKELPPHRLAEIRRFFEDYKKNENKIVDVEDFLPAEAAIDAIKYSINSTATATTNSRMGTLGRAFYAVGFWIRETGQAIDRLGSRLQGNYLFQEQLSRHRPLMNLFDKAPSVHRDAFVAPSASLLGDVHVGPASSIWYGCVLRGDVNSITIGSGTNIQDNSLVHVAKSNLSGKVLPTIIGDNVTVGHSAVLQGCTVEDEAFIGMGATLLDGVYVEKHAMVAAGALVRQNTRIPYGEVWGGNPARFLRKLTEDEMTFFSQSALNYSNLAQAHSAENAKGLDETEFVKVLHKKFARHGDEYHSVLGGVQETPTELKSSDNVLLDKVPKA

SEQ ID NO: 153076 - protein, 147 aa, Glycine max
  Coding DNA Sequence Number=SeqID_36298
  Gene Ontology: Mol. function=DNA binding; Cellular component=nucleus; Biological process=regulation of transcription, DNA-dependent
  Homolog annotation: Hit_ID=Q52UU1; Match level="QueryCoverage=52%, HitCoverage=44%, E-value=1e-28, Identity=78%"; Hit description =Squamosa promoter binding-like protein
  Pfam annotation: Domain name=SBP; Domain location=9-100; Score=17.3; E_value=0.00024; Accession=PF03110.5; Description=SBP domain
MVVRSDRLKRDVADCGDNNQNGYVEQEKKIKGVVSCAGKKGGGGNNNSIYAVLSTPIFMRPSSTTGGTGFHELAEFDDTKRSCRSSLAGHNERRRKNSDQSQAEGSSRNKGTGHPQLKDITCGQADERGRIQITIHENAAYKHFQIR

SEQ ID NO: 153077 - protein, 239 aa, Glycine max
  Coding DNA Sequence Number=SeqID_36299
  Homolog annotation: Hit_ID=Q9FJZ1; Match level="QueryCoverage=71%, HitCoverage=42%, E-value=3e-33, Identity=44%"; Hit description =Arabidopsis thaliana genomic DNA, chromosome 5, TAC clone:K1F13
MALNLDRVREVEENAATELSMKFSSPGTEFYDAWEELSSEGMSQNSTYNIEAELCEIRLSLLVEVEKRKQAEESINNMRSQWESIRPGLYQAGIVFPAYLTAAVEDEQLISDPVEDLCQQVYIARFISNTIGKGIARAELDTEMEAQLEAKNFEIARLLERLHCYDTMNKEMSQRNQEAVEMAPRERQRSSRRQRWIWGSITTVIALSTAALAWSYLPTGKGSSSADNDLVPEHDDPAK

SEQ ID NO: 153078 - protein, 191 aa, Glycine max
  Coding DNA Sequence Number=SeqID_36300
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9FJZ3; Match level="QueryCoverage=90%, HitCoverage=40%, E-value=8e-62, Identity=62%"; Hit description =Mannan endo-1,4-beta-mannosidase
MKHFALVFLLAILVPQECFHVSVEARDDFVRTRGIHFMQNGYPYYANGFNAYWLMYTASDPSQRFKVSNAFREAASHGLTVARTWAFSDGGYRPLQYFPGFYNEQMFTGLDFVVSEARKYGIKLILSLVNNYENFGGKKQYVNWARSHGQYLTSDDDFFRSPVVKGYYMNHVRVSTIFVLLLGKIHVYAVE

SEQ ID NO: 153079 - protein, 70 aa, Glycine max
  Coding DNA Sequence Number=SeqID_36301
MKLGAPQYKAGDDPFEYLSWVQTITDEIGADDSSAIQMAGFTLKCKKARGWFKNYVKPESGQYVLGGVRT

SEQ ID NO: 153080 - protein, 194 aa, Glycine max
  Coding DNA Sequence Number=SeqID_36302
  Homolog annotation: Hit_ID=Q010J2; Match level="QueryCoverage=72%, HitCoverage=66%, E-value=7e-19, Identity=37%"; Hit description=[I] KOG3146 Dolichyl pyrophosphate phosphatase and related acid phosphatases
  Pfam annotation: Domain name=PAP2; Domain location=23-140; Score =58.9; E_value=1.6e-14; Accession=PF01569.12; Description=PAP2 superfamily
MHRSKWIVTALFGGFILWRHDAEALWFTAGSVLNAMLSVLLKRILNQERPSTLKSDPGMPSSHAQSIFFTVFFVILSGVEWLGLNGFTIAISASVLTFGSFFSYLRVSQQLHTVSQVVVGAAIGSIFSILWYWLWNGYMLDAFVSSLWNDVGLYPSDPITGGKRERDMDALCSMVLTVESLTENLQTNASAHRS

SEQ ID NO: 153081 - protein, 69 aa, Glycine max
  Coding DNA Sequence Number=SeqID_36303
  Gene Ontology: Biological process=nodulation
  Homolog annotation: Hit_ID=Q43460; Match level="QueryCoverage=90%, HitCoverage=32%, E-value=5e-30, Identity=100%"; Hit description =Nodulin 20a precursor
  Pfam annotation: Domain name=Nodulin; Domain location=7-69; Score= -84.3; E_value=0.0048; Accession=PF02451.6; Description=Nodulin
MTKIAQGAAVAEDAGIDAITPEEGKANNIIEAYESPRFQKFVTHCSSHVTQTCSGNDPLNNQEASRMNS

SEQ ID NO: 153082 - protein, 132 aa, Glycine max
  Coding DNA Sequence Number=SeqID_36304
MQKEAPQNRLFNSSEINHLKNFDFDSIAGVDKIEADEGKGTLTVTGDADPYEIIVRIRKAGKHAEVVSVGPPQAPQKKDEKKPEEKKKPEAEKKDEKPKESSIHMPYYYPPYQPVVLYMNRYEEPNPSCTIL

SEQ ID NO: 153083 - protein, 77 aa, Glycine max
  Coding DNA Sequence Number=SeqID_36305
MEMEGYNGVVIFHDVFDNEYDVGGSQIRIEGVYIWPFRQLRMVANRPSSVEPAEGDGLRLLKVKYIETCRPSPHIYN

SEQ ID NO: 153084 - protein, 78 aa, Glycine max
  Coding DNA Sequence Number=SeqID_36306
LIILKASSIVLLPEFEDPSLFWSEEVYHGLASEFQSWVSIKQSSFTAASNLKEEFSDASAHVPSLEHLIYMFQLEGEC

SEQ ID NO: 153085 - protein, 63 aa, Glycine max
  Coding DNA Sequence Number=SeqID_36307
MSLLSGAIYKKGGEQFRSIFTMEHNRNLQRFAFFTNISCNQLKYCRTYASLMSVKTIYDWITS

SEQ ID NO: 153086 - protein, 251 aa, Glycine max
  Coding DNA Sequence Number=SeqID_36308
MSSKGIVSNVDIASARAPHRTLCTDSSFFGTMIADDMMERWPWSLLRQLRNPAGGVANHNIKVSGVSMTAKQSHFVVASVLHNIHHNIPEFISNLMAYAGVIHLVDFVKALNYGPSCDSVAIIDIEGNPGVVANITGVDSFQKHGFCLLLMTQIITLCTSQITFDNTQNTIPKPQPNKPWPPQATIIVNGVIATTIVNKPLQQLANKAITARKKLEEWKRLLITVATSKLSPSLQANRKQQPQERKKREKK

SEQ ID NO: 153087 - protein, 145 aa, Glycine max
  Coding DNA Sequence Number=SeqID_36309
  Gene Ontology: Mol. function=phosphoinositide phospholipase C activity; Biological process=intracellular signaling cascade
  Homolog annotation: Hit_ID=Q43439; Match level="QueryCoverage=76%, HitCoverage=28%, E-value=1e-40, Identity=55%"; Hit description =Phosphatidylinositol-specific phospholipase C
  Pfam annotation: Domain name=efhand_like; Domain location=1-84; Score= 10.9; E_value=0.00097; Accession=PF09279.1; Description =Phosphoinositide-specific phospholipas
MQTTEAKQQVMTSKQTYSVCFYWRQWLKLVLAERQEKATEEDTQAIINRFRHFHHKGVGLNLETFFKYLFSEDNPPLLPSHGLSSDCCDIPIINALKKGVWVIELDIWPNRSKDNIDVLHGRFSSQKITCMHIGNWIFITKVYMA

SEQ ID NO: 153088 - protein, 57 aa, Glycine max
  Coding DNA Sequence Number=SeqID_36310
MILKLTLFWLLSLWLTLGSKVNGMKGRNSDPVEERNLFLLLKDSGISHVGLYDIGIN

SEQ ID NO: 153089 - protein, 346 aa, Glycine max
  Coding DNA Sequence Number=SeqID_36311
  Gene Ontology: Mol. function=protein serine/threonine kinase activity; Cellular component=membrane; Biological process=protein amino acid phosphorylation
  Homolog annotation: Hit_ID=Q40543; Match level="QueryCoverage=100%, HitCoverage=81%, E-value=1e-145, Identity=73%"; Hit description =Protein-serine/threonine kinase
  Pfam annotation: Domain name=Pkinase; Domain location=116-339; Score =125.2; E_value=1.9e-34; Accession=PF00069.15; Description=Protein kinase domain
  Pfam annotation: Domain name=Pkinase_Tyr; Domain location=116-342; Score=100.9; E_value=3.7e-27; Accession=PF07714.7; Description =Protein tyrosine kinase
  Pfam module annotation: Pfam domain module=Pkinase::Pkinase_Tyr; Domain location=116-339::116-342
MVRQADLVIIGVSVGLTLGILISCLIFFGIRWYKKRAHIRRSANESSLTTLPIRTNGLGTSSDFSASLDSSIASSWSENLKRNSHFSWWNHQNKDRFASASGILKYLYKEIQKATQNFTTTLGQGSFGTVYKATMPTGEVVAVKVLAPNSKQGEKEFQTEVFLLGRLHHRNLVNLVGYCVDKGQRILVYQYMSNGSLANLLYGEEKELSWDQRLQIALDISHGIEYLHEGAVPPVIHRDLKSANILLDHSMRAKVADFGLSKEEIFDDRNSGLKGTYGYMDPAYISTSKLTTKSDIYSFGIIVFELITAIHPHQNLMEYVNLAAMDHDGVDEILDKQLVGKCNLEE

SEQ ID NO: 153090 - protein, 165 aa, Glycine max
  Coding DNA Sequence Number=SeqID_36312
MVDKCDEASIEVGSRGLVDDLHEPIELKKIKKGQQTGKPKRIRPTPITNTFFLSTGFPSYYKQHDGVYNLFISNFRRRMDKVESIIVNSLLIFSNYQISQEGQRSSEEKKWVTKGGLHIPSILLEDYVLAEKVMHRSFLATQEVNDKAQAFGSKCVSDYGIANCN

SEQ ID NO: 153091 - protein, 116 aa, Glycine max
  Coding DNA Sequence Number=SeqID_36313
YMGDDMVLLQGLSDESVEERNNNRLSWIHCLGIPLQVWGSDCFSKVVNIYKTFVKAAKETEILEHIEFARLLIRVSSLSFINRWENHENSIKDGSMGSDIGMEQALPCLDFAGVHE

SEQ ID NO: 153092 - protein, 547 aa, Glycine max
  Coding DNA Sequence Number=SeqID_36314
  Gene Ontology: Mol. function=RNA-directed DNA polymerase activity; Biological process=RNA-dependent DNA replication
  Homolog annotation: Hit_ID=Q1S7B8; Match level="QueryCoverage=65%, HitCoverage=53%, E-value=1e-27, Identity=26%"; Hit description=RNA -directed DNA polymerase
MENWCIIGDFNGVRKLEEIIGGEGVNGIEGRGEIRDFNKFIEDIKGDGLKGMTYFLARLCLIYPREEYLGSLPLLVKSSNINLGPKPFRALDCWFLNNNFKLFVKEEWGKLKKHFKWTLCGWGVDEPRKVKDEVLKFYQRRFLEVEEERPLLDGVRFNMISHEDNTFLMGKFSLEEVKGVVWEYDSNKCPRLDGSLAQCVLLTNEVVHEAKRKRKSYLIFKVYYEKTFDSVNWKFLFYILRRLGFNEKWVLWIKAYLGSSYTSILGLCGLMRETIEKELFTSFLMGENNVQVNLLHFADDTLFIGEATWTNVVVIKSILRCFELALGLKVNFFKSNFDAFGVDSSLVESWLKTWLYGMGMRENGIFGGESGLVGNYPWWKLLTILCLVGGYLGWMMIDGYGKNDNNNGCYSMKSAYTTLTNSLTDILHNSKFSLIWNLHIPPKVSVFFWRILRSALPTIDNLKKRSILVPNYDYMCPLCGVDEESLDHVLLCMCSYQVRWMRIVSGEFSGVLFLGFYGTGGTTSLSETRCSIRIKFCMTFYIKAGLG

SEQ ID NO: 153093 - protein, 114 aa, Glycine max
  Coding DNA Sequence Number=SeqID_36315
MRGRGKARPIHQGGLREKDWGGLRENKRISIFYFSKFLENFNEHDILKVFARDNGSNRYGATTTGDPSYANVLQQLVMKEKMIWQRKQHEERQREYGVWSGMDLILWRKEKRSG

SEQ ID NO: 153094 - protein, 85 aa, Glycine max
  Coding DNA Sequence Number=SeqID_36316
  Subcellular localization annotation: CTP_CleavageSite=58; ConfidenceScore=5.06e-01
MKTVRSFQPAKLQHQTTQSPTSWQPPPQGYISCTLDASIFKDENMFAAGMCIRNNHVQFMSARSFNFHGRIRPPEPEAIALYQAL

SEQ ID NO: 153095 - protein, 185 aa, Glycine max
  Coding DNA Sequence Number=SeqID_36317
MVHGDLQLLGARVSTKGSHVESATNPSGGEDVDDGVPTMGFYVQCDHSTCLVALRKVYDGESTIHNVSYADDVVRVIVEKVYDSYTLVSFPTTKIQYVRQTLDTFVAWPSHLVKLVSHENSLKNVVEPVQKSNTLNADDLLGDFIKNLYDVYQKPVELLWDESKFGIPNKLMLISGILRRLRNYH

SEQ ID NO: 153096 - protein, 206 aa, Glycine max
  Coding DNA Sequence Number=SeqID_36318
MAKFNPEIVLEFYANAWPMEEGVRDMRSWVRGQWIPFNANALNQFLSCPLILEKDQRCEFSQKRDQASGFDKEAIAQLLCIPGQDFPWTVAGRRLVYAILTVHVAQIAPTRHPLDPEKSNKALGFSALITGLCQFYGVLVTPSKVIQPPITQAFIEKYCTPRQAQGDTQQAADAPTPQQPDPVRPLSVEQYLRHVVRQQAANHRGE

SEQ ID NO: 153097 - protein, 162 aa, Glycine max
  Coding DNA Sequence Number=SeqID_36319
MAKAMASPRMEENVAFLSKQLTELVEMLKQQKTMLEEHQKLITDLGTKKDDAQNEHSKTLEGKGDSLAKKKCTENKFNKFNSHFLLKSRMRESLTTIITSLQLYKFIMVRCSLAVENHRVTKRVNPPHLAVDPPKLSWSTLPRIRKMGWKFKSTPYMLELVG

SEQ ID NO: 153098 - protein, 459 aa, Glycine max
  Coding DNA Sequence Number=SeqID_36320
  Gene Ontology: Mol. function=transferase activity; Biological process= flavonoid biosynthetic process
  Homolog annotation: Hit_ID=Q2HVM4; Match level="QueryCoverage=94%, HitCoverage=94%, E-value=1e-119, Identity=52%"; Hit description =Transferase
  Pfam annotation: Domain name=Transferase; Domain location=1-451; Score=280.0; E_value=4.6e-81; Accession=PF02458.6; Description =Transferase family
MVTIHCSHLVVPSEPTPSSTLSLSLCDQIKLPNHGSQLYLYSNTSITHHHLIHTLSASLSKALTHYYPFAGRLRRIPGGRFQLLCNASGAVLIEATCSSQFSFKYFRDFAPVHAVPKINYDDVPIEDVPLLVAQVTRFPNGFITLGLSLCRALLDGNSASSFVNSWAKLAKGENLDSSLIPLLDRTKLDSFKLNKPPRFEHPEFLPPPLLTQQHTQMEGQLGSTILELTKGQVEKLKKKASDFGSGYGINNGNGSVRPYTSFEVITGHLWRCVCKVRYAGGDLGQPTRLTTLVNCRNRLRPSLPTAYFGNATFPTVTPTCSFDEIMHKPLSYAVGKVREAIGKMSDEYVRSALDYIASVEDFDLFRDTFYGSGDGKGKFKGDPNLYMVGWTNFKYFETDFGWGKPVSLIPGNINSNGKAFLLENASGDGFIVAVCLLESHVDALRKLFYEDMEDASSKL

SEQ ID NO: 153099 - protein, 116 aa, Glycine max
  Coding DNA Sequence Number=SeqID_36321
  Gene Ontology: Mol. function=unspecific monooxygenase activity
  Homolog annotation: Hit_ID=Q6I666; Match level="QueryCoverage=54%, HitCoverage=98%, E-value=3e-26, Identity=78%"; Hit description =Cytochrome P450 like_TBP
MIGRADIEGSKSNVAMNAWLPQASYPCDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 153100 - protein, 88 aa, Glycine max
  Coding DNA Sequence Number=SeqID_36322
MDQPDSAIWHFCQKRENGPKSSMILLSSYFGCVTKPSTVPLPPSCCHHPYDGLASSASGIEGRRTTLCGGSPSLVPFWDLGHLGLFQP

SEQ ID NO: 153101 - protein, 984 aa, Glycine max
  Coding DNA Sequence Number=SeqID_36323
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HVM0; Match level="QueryCoverage=97%, HitCoverage=98%, E-value=0.0, Identity=80%"; Hit description =Glycoside hydrolase, family 3, N-terminal; Glycoside hydrolase, family 3, C-terminal
  Pfam annotation: Domain name=Glyco_hydro_3; Domain location=130-361; Score=265.9; E_value=8.1e-77; Accession=PF00933.12; Description =Glycosyl hydrolase family 3 N terminal domain
  Pfam annotation: Domain name=Glyco_hydro_3; Domain location=750-984; Score=281.6; E_value=1.5e-81; Accession=PF00933.12; Description =Glycosyl hydrolase family 3 N terminal domain
  Pfam annotation: Domain name=Glyco_hydro_3_C; Domain location=433 -645; Score=208.9; E_value=1.2e-59; Accession=PF01915.12; Description= Glycosyl hydrolase family 3 C terminal domain
  Pfam module annotation: Pfam domain module=Glyco_hydro_3::Glyco_hydro_ 3::Glyco_hydro_3_C; Domain location=130-361::750-984::433-645
SDYESQSNALLRLCSSLLKVPSGGVKEMAKISILLVGLWVLGSWTGLLDAEYMKYKDPKQSIDTRVEDLVSRMTLEEKIGQMLQIERKYASADLVKKYFIGSVMSEGGSVPAPQASAETWIDMVNEFQKGAVSTRLGIPMFYGIDAVHGHNTIYKATIFPHNIGLGATRDPELVKRIGAATALEIRATGIQYTYAPYPRWGRCYESYSEDPKLVQAMTEIIPGLQGEIPDNLPKGVPFITGKEKVLACAKHYVGDGGTINGIDENNTVIDRDGLMRIHMPGYFNSISKGVASIMVSYSSWNGEKMHANQDLITGYLKNTLHFKGFVISDFEGIDRITSPPHANFTYSIEAGVSAGIDMFMNPKLYIEFIEDLTMLVKNKFIPMSRIDDAVRRILWVKFMMGIFETPFADYSLVRYLGIQKHRQLAREAVRKSMVLLKNGESADKPLLPLPKKVPKILVAGSHADNLGYQCGGWTIKWQGVSGNNLLKGTTILAAVKNTVDPDTTVVYKDNPDAEFVKSNGFSYAIVVVGEHPYAEMHGDNMNLTIPDHGPETITNVCGAIKCVVIIISGRPVVIEPYVGSIDALVAAWLPGSEGQGVADVLFGDYGFTGKLPRTWFKTVDQLPMNVEDPHYDPLFPFGFGPSMDLEGMAKISILLVGLWLLVNWSGLLDAKYMKYKNPKLSIDTRVEDLVKRMTLEEKIGQMLQVERKYVPADLLKKYFIGSVLSEGGSIPAPQASAETWIDMVNEFQKGALSTRLGIPMFYGIDAVHGHNTIHNATIFPHNIGLGATRDPELVKRIGAATALEVRATGIQYVYSPCIAVCRDPRWGRCYESYSEDPELVQAMTEIIPGLQGDIPNDSPKGVPFIAGKEKVIGCAKHYVGDGGTTNGIDEHNTVIDRDGLMKIHMPGYFSSISKGVATIMASYSSWNGVKMHAHHDLITGYLKNTLHFKGFVISDFEGIDRITSPPRANITYSIEAGVSAGIDM

SEQ ID NO: 153102 - protein, 155 aa, Glycine max
  Coding DNA Sequence Number=SeqID_36324
MRRAPALGLEGGGMGWVGKEMERCWCWCWCWCWCWRGRSKLGKWKGAGEKGGGKEEEGLGLGLGLEEEGGWGLKKECMSKGMGGGELWLLGEAIVNQIELSANSQQFNLIVGFEKKRDLKDGTQRLGWKWKRRNLQAKLQQFLILFSKLQKRDIR

SEQ ID NO: 153103 - protein, 156 aa, Glycine max
  Coding DNA Sequence Number=SeqID_36325
MASRDQVWSFCTHDTRRYLTVIRPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSAPPLPFGHSRVRWQAETKFGHSAHMIRGDTLR

SEQ ID NO: 153104 - protein, 100 aa, Glycine max
  Coding DNA Sequence Number=SeqID_36326
  Subcellular localization annotation: CTP_CleavageSite=39; ConfidenceScore=5.28e-01
MVTRSVKFCNVAGNQKEVLLHNPQSSPLGPSRFFLQKVVVSGGSNLARLGELGGKLLPYFAINRGRNEEGKGLAFLALGILLKLLRKIVSVKKIQTEALP

SEQ ID NO: 153105 - protein, 73 aa, Glycine max
  Coding DNA Sequence Number=SeqID_36327
MEVEEPWLGLWLPLNYRVDMGSSLAYDNGTWGEPYRLFAAKFLFVGVFVRYTGFVVDLGMTFVDNWVVGNLAV

SEQ ID NO: 153106 - protein, 65 aa, Glycine max
  Coding DNA Sequence Number=SeqID_36328
MVAAERLKLFLCKRRKGLGILLQVAFWWWVVLLLVNPVAGLRPLRERTRPWDDEFFNDCGGNWRM

SEQ ID NO: 153107 - protein, 378 aa, Glycine max
  Coding DNA Sequence Number=SeqID_36329
  Gene Ontology: Mol. function=nucleoside-triphosphatase activity
  Homolog annotation: Hit_ID=Q9FN77; Match level="QueryCoverage=21%, HitCoverage=15%, E-value=3e-16, Identity=52%"; Hit description=AAA -type ATPase-like protein
MSYCSYQGFKILASNYLETSSDHPLFGEVEGLIEDIQITPAQVAEELMKNEDPEATLEGFVKLLKRKKMEGDVCENSTPDKAEPTRQQSKRRKVGCKQKRGKSNSGVHVTQIRTRRMRGCSRNNGHRSAYSNTRCLLPSIPDTLGLNVELKQVIVDDLERFLRRKELYKKVGNPWKRASPNRKIKPPSSNELFVAAQEYLSAKITRLLNTCLDKTLASWTVFAVKNQRGKIYDLTHLAASTARCRTTAGSGGGPIRQWQVPAKSLVLINSIALSTTDKGLKLTSITFLPPLDMYSTTSNLLSFGSVLKPMRLTRQGLGIWERILISFLAGTGAVAAVGAFGGVVFRGAGDDKFGRSDSGEELVDVQGDSLDSVVAASA

SEQ ID NO: 153108 - protein, 83 aa, Glycine max
  Coding DNA Sequence Number=SeqID_36330
MVGVLSKEEYRCDMGSRRRTGTQRRTPPHLATTTFSQRYTSKFKHHHPEISRTIKVNFSCIMWQLPTMHMHLKLLRMRLHNYT

SEQ ID NO: 153109 - protein, 261 aa, Glycine max
  Coding DNA Sequence Number=SeqID_36331
  Gene Ontology: Mol. function=transporter activity; Cellular component= intracellular; Biological process=transport
  Homolog annotation: Hit_ID=Q94FN0; Match level="QueryCoverage=92%, HitCoverage=50%, E-value=1e-129, Identity=90%"; Hit description =Phosphatidylinositol transfer-like protein IV
  Pfam annotation: Domain name=CRAL_TRIO; Domain location=34-220; Score= 148.2; E_value=2.2e-41; Accession=PF00650.10; Description=CRALTRIO domain
MWSEMLKWRKEFGADTITEDFEFKELDEVLQYYPQGHHGVDKDGRPVYIERLGQVDATKMMQVTTMDRYIKYHVKEFERTFDVKFAACSIAAKKHIDQSTTILDVQGVGLKSFSKHARELVTRLQKIDGDNYPETLNRMFIINAGSGFRILWNTVKSFLDPKTTAKINVLGNKYDTKLLEIIDASELPEFLGGTCTCADQGGCMRSDKGPWKDAEVMRMVQNGDHKCSKKSASQGEEEKENSELFAYHIDFLETISAFCHS

SEQ ID NO: 153110 - protein, 466 aa, Glycine max
  Coding DNA Sequence Number=SeqID_36332
  Gene Ontology: Mol. function=nucleoside-triphosphatase activity; Cellular component=membrane; Biological process=cell division
  Homolog annotation: Hit_ID=Q683K1; Match level="QueryCoverage=93%, HitCoverage=87%, E-value=1e-110, Identity=47%"; Hit description=AAA -type ATPase like protein
  Pfam annotation: Domain name=AAA; Domain location=246-442; Score =46.7; E_value=8.1e-11; Accession=PF00004.19; Description=ATPase family associated with various cellular activities (AAA)
  Pfam annotation: Domain name=AAA_5; Domain location=246-387; Score= -17.4; E_value=0.038; Accession=PF07728.4; Description=ATPase family associated with various
  Pfam module annotation: Pfam domain module=AAA::AAA_5; Domain location=246-442::246-387
  Subcellular localization annotation: CTP_CleavageSite=45; ConfidenceScore=5.45e-01
MGFYTQNLFSSFTSASSWFEVYAAFSTFTMLLRTAFIQLIPQQFRSFIVSKLESFFSKYQANSEIRLKINKFWDKNSGDRNELFDAAQEYLPTRIIHTYKSLKVGKLQGEKHIELAVYGSEDVVDEFEGTKFTWKLDEEGSKQDSNNHNKKYSFELTFNEKHREKALDLYIPHVIKTYEVMKAERRIVRIYSWLDDDWNDSELSHPATFDSLALSPELKKDIIDDLERFLRRKEHYKKVGKPWKRGYLLYGPPGTGKSSLIAAMANYLKFDVYDLELTSVYSNSDLMQSMKEASNRSIVVIEDIDCNEELHARSIGLSDDQDSDADNEAAKVKTSRFSLSGLLNYMDGLWSSGGEERIIIFTTNHKEKIDPALLRPGRMDMYIHLSYLKGKAFRVLASNYLDIEGDHPLFEEIDELLEKLQVTPAVVAEQLMRNEDPDDALEALVTFLKEMDKDSNCDLELRGTSE

SEQ ID NO: 153111 - protein, 146 aa, Glycine max
  Coding DNA Sequence Number=SeqID_36333
MKTWQYHQKNKYIEYHHATYEEEETGGSLTLKKKRHQQQRSHNGGRQAMLTPRTQTLLTGSGTSSNKHRAHKKTKKQMQSGRETAPTKEEKMKQMSTYEKLAFYIIKVKDIYALSPHLLGAPAKTLGAPSNTPKKIHMLAEAHLMV

SEQ ID NO: 153112 - protein, 206 aa, Glycine max
  Coding DNA Sequence Number=SeqID_36334
  Gene Ontology: Mol. function=protein disulfide oxidoreductase activity; Biological process=cell redox homeostasis
  Homolog annotation: Hit_ID=Q5QLR2; Match level="QueryCoverage=52%, HitCoverage=66%, E-value=1e-25, Identity=58%"; Hit description =Glutaredoxin-like
  Pfam annotation: Domain name=Glutaredoxin; Domain location=109-179; Score=33.8; E_value=5.8e-07; Accession=PF00462.14; Description =Glutaredoxin
MSHGCSFWEYVDRVRDANLVTTVTVTQEIAQQPLTLESLPFIYYFYISRLLPSFHTPKKTLFSFSPLPHTMHQTSPNGTRHAPPPAGASGGPSGADHANVVKMVSENPVIVVGARGCCMCHVVQKLLQGQGVNPPVYEVDEGDQADLARELSRNIIGGSDDNSGETMQFPAVFVGGKFFGGLERLMATHISGELVPILKDAGALWL

SEQ ID NO: 153113 - protein, 107 aa, Glycine max
  Coding DNA Sequence Number=SeqID_36335
MAINSWGFGLNGGGLMNGNELMGLRIRFDGGGCTNSARQSICGAPDLMDARTAQGNQFVGLRIIFDGGGCVNGNEFMGLRIIFDGGGCTNSARQSICGAPDSMVEDA

SEQ ID NO: 153114 - protein, 912 aa, Glycine max
  Coding DNA Sequence Number=SeqID_36336
  Gene Ontology: Mol. function=nucleoside-triphosphatase activity; Cellular component=membrane; Biological process=defense response
  Homolog annotation: Hit_ID=Q19PL1; Match level="QueryCoverage=93%, HitCoverage=88%, E-value=1e-105, Identity=30%"; Hit description=NBS -NBS-LRR type disease resistance protein
  Pfam annotation: Domain name=LRR_1; Domain location=581-602; Score =5.5; E_value=27; Accession=PF00560.23; Description=Leucine Rich Repeat
  Pfam annotation: Domain name=LRR_1; Domain location=604-626; Score =10.1; E_value=3.7; Accession=PF00560.23; Description=Leucine Rich Repeat
  Pfam annotation: Domain name=LRR_1; Domain location=628-650; Score =13.6; E_value=0.71; Accession=PF00560.23; Description=Leucine Rich Repeat
  Pfam annotation: Domain name=LRR_1; Domain location=726-747; Score =0.3; E_value=2.4e+02; Accession=PF00560.23; Description=Leucine Rich Repeat
  Pfam annotation: Domain name=LRR_1; Domain location=774-796; Score =5.8; E_value=24; Accession=PF00560.23; Description=Leucine Rich Repeat
  Pfam annotation: Domain name=LRR_1; Domain location=847-869; Score =5.2; E_value=31; Accession=PF00560.23; Description=Leucine Rich Repeat
  Pfam annotation: Domain name=NACHT; Domain location=183-338; Score= -36.2; E_value=0.038; Accession=PF05729.3; Description=NACHT domain
  Pfam annotation: Domain name=NB-ARC; Domain location=145-452; Score =351.2; E_value=1.7e-102; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=581-602::604 -626::628-650::726-747::774-796::847-869::183-338::145-452
MAEVAVSTVVTKLTGLLVEQAAVAAVSVSQLAGVREQVENLKNELGWMQSFLRDADAKQEGNDRVRMWVSEIRDVAFEAEELIETYVYKTTMQGSLDKVFRPFHLYKVRTRIDKILSKIKSISDRRETYGVVVMTRDDGNNSNERLRHWRQPSPYSEEEYVIELEDDMGLLFTQLLAVEPTPHVVSIVGMGGLGKTTLAKKLYNHARITNHFECKAWVYVSKEYRRRDVLQGILKDVDALTRDGMERRIPEEELVNKLRNVLSEKRYLVVLDDIWGMEVWDGLKSAFPRGKMGSKILLTTRNWDVALHVDACSNPHQLRPLTEDESFRLLCNKAFPGAKGIPLELVQLESLAKEIVVKCGGLPLAVVVVGGLLSRKLKSSGEWKRVLQNISWHLLEEQEKIARILALSYNDLPPHLKSCFLYLGLFPEGVNIQTKKLIRLWVAEGFLLQEGEETAEGVAQKYLNELIGRCMIQVGTVSSLGRVKTIRIHHLLRDLSLSKGKEGYFLKIYQGDVAGPSTKARRHSMHFCHDRYDSLKHNSDHSRSLLFFNREYNADIVRKLWLPLNLQQEKKLNFIFRKFKLLRVLELDGVRVVSLPSTIGNLIQLRYLGLRKTNLEEELPPSIGNLQNLQTLDLRYCCFLKKIPNIIWKMVNLRHLLLYTPFDSPDSSHLRLDTLTNLQTLPHIEAGNWIGDGGLANMINLRQLGICELSGQMVNSVLSTVQGLHNLHSLSLSLQSEEDEFPIFMQLSQCTHLQKLSLNGKIKKLPDPHEFPPNLLKLTLHNSHLRKESIAKLERLPNLKMLILGKGAYNWPELNFNAEGFPQLHILRLVLLKELEEWTVEESAMPRLENMVIDRCEKLKKIPEGLKAITSLKKLKIIGMPVEFEHKLRIKDLFEFTNTPVIESTTDILAID

SEQ ID NO: 153115 - protein, 116 aa, Glycine max
  Coding DNA Sequence Number=SeqID_36337
MAVKNRIMHYARGRVSLSASQQSFELVIRHSFMGEKLFNHRSGKSQYCSQIPRLTAFTIIGSHSQRVEGSKILRAWKWKNLSMLDTSSSSMYIVNNKLKQVCCTMECQNLKMLPIP

SEQ ID NO: 153116 - protein, 493 aa, Glycine max
  Coding DNA Sequence Number=SeqID_36338
  Gene Ontology: Mol. function=zinc ion binding
  Homolog annotation: Hit_ID=Q9FMJ2; Match level="QueryCoverage=94%, HitCoverage=60%, E-value=1e-135, Identity=50%"; Hit description =Ankyrin-like protein
  Pfam annotation: Domain name=DUF248; Domain location=256-492; Score =226.3; E_value=6.7e-65; Accession=PF03141.7; Description=Putative methyltransferase
  Pfam annotation: Domain name=Methyltransf_11; Domain location=375 -470; Score=40.4; E_value=6.2e-09; Accession=PF08241.2; Description =Methyltransferase domain
  Pfam module annotation: Pfam domain module=DUF248::Methyltransf_11; Domain location=256-492::375-470
  Subcellular localization annotation: CTP_CleavageSite=68; ConfidenceScore=5.61e-01
MALFQTRKRSSSPSYVSTSTILVFIALCVFGVWMLTSNPVVSPQTQSDAYTSTRTAIDTSATTNDELSSSEETATKSERKGKVNPAAVYGDNPGHLPDDAIKADDKNSNNEQQKQHIAISDSQLSEESSLTQKEQITAVIHESGSDSDVRISEPEKKDEEIAAEQQDVQSFDTRGGGSKPEEDEANKEQPNTSQQDSDTASKGPKPEKKGGKSKKPWSTQVDQSQQENKRQTVESNSDDKLEGHTWYLCNVTTGADYIPCLDNEKALKKLRSTKHYEHRERHCPEDPPTCLVPIPKGYKTPIEWPSSRDKIWYHNVPHKLLAEVKGHQNWVKVTGEFLTFPGGGTQFIHGALHYIDFVQEAEPNIAWGKRTRVILDVGCGVGSFGGFLFERDVISMSFAPKDEHEAQVQFALERGIPAISAVMGSQRLPFPSRVFDLVHCARCRVPWHLDGGMLLLELNRVLRPGGYFVWSATPVYQKLEEDVEIWKGRITYL

SEQ ID NO: 153117 - protein, 120 aa, Glycine max
  Coding DNA Sequence Number=SeqID_36339
  Homolog annotation: Hit_ID=Q9FNL5; Match level="QueryCoverage=45%, HitCoverage=5%, E-value=6e-24, Identity=98%"; Hit description =Similarity to guanylate binding protein
  Subcellular localization annotation: CTP_CleavageSite=47; ConfidenceScore=5.44e-01
MLKYFNRGRDSPAADASPPSPAAATPSYSSSSASPVTGPARPIRLVYCDEKGKFRMDPEAVATLQLVKEPIGVVSVCGRARQGKSFILNQGFVTWMVCSVVIISVYATVWLSVINVSGFD

SEQ ID NO: 153118 - protein, 36 aa, Glycine max
  Coding DNA Sequence Number=SeqID_36340
MASERERSVGIARYRKGGMAHIQLFIIIQLEPKKHL

SEQ ID NO: 153119 - protein, 203 aa, Glycine max
  Coding DNA Sequence Number=SeqID_36341
VYEDNDGVIFEGSKKAIQIKRGISFNALKKKIGDKDVAGGSMFHSANSLTSCGNYLSNDDTQPATNMSNLHIDEDDDDDDDDYLVSNSYVEESLDEDDSVDGISDTDDEVTNIPQPVRIVHPAEGAQRIENPFWNDASHYNNINWSYPDEEDICGLEMPSTFNVGQELYVGMEFDSKDAVKNAVKQYVMKVHQSFKVVESKSN

SEQ ID NO: 153120 - protein, 637 aa, Glycine max
  Coding DNA Sequence Number=SeqID_36342
  Gene Ontology: Mol. function=GTPase activity; Cellular component =apical junction complex; Biological process=immune response
  Homolog annotation: Hit_ID=Q9FNL5; Match level="QueryCoverage=99%, HitCoverage=60%, E-value=1e-172, Identity=51%"; Hit description =Similarity to guanylate binding protein
  Pfam annotation: Domain name=GBP_C; Domain location=3-191; Score= -99.1; E_value=5e-05; Accession=PF02841.5; Description=Guanylate -binding protein, C-terminal domain
  Pfam annotation: Domain name=KID; Domain location=103-113; Score=0.5; E_value=3.7e+02; Accession=PF02524.5; Description=KID repeat
  Pfam annotation: Domain name=KID; Domain location=17-27; Score=0.7; E_ value=3.3e+02; Accession=PF02524.5; Description=KID repeat
  Pfam annotation: Domain name=KID; Domain location=284-294; Score=2.6; E_value=1.4e+02; Accession=PF02524.5; Description=KID repeat
  Pfam annotation: Domain name=KID; Domain location=319-329; Score=0.3; E_value=4e+02; Accession=PF02524.5; Description=KID repeat
  Pfam annotation: Domain name=KID; Domain location=35-45; Score=9.5; E_ value=4.7; Accession=PF02524.5; Description=KID repeat
  Pfam annotation: Domain name=KID; Domain location=452-462; Score=0.5; E_value=3.7e+02; Accession=PF02524.5; Description=KID repeat
  Pfam annotation: Domain name=KID; Domain location=509-519; Score=6.9; E_value=17; Accession=PF02524.5; Description=KID repeat
  Pfam annotation: Domain name=Tropomyosin; Domain location=162-379; Score=-112.0; E_value=0.031; Accession=PF00261.10; Description =Tropomyosin
  Pfam module annotation: Pfam domain module=GBP_C::KID::KID::KID::KID:: KID::KID::KID::Tropomyosin; Domain location=3-191::103-113::17 -27::284-294::319-329::35-45::452-462::509-519::162-379
DYRKDAFMEADLQCSNAIQSMEKRLRAACNASDAKIDNVAKVLDALLSEYEKTIQGPGKWQRLAVFLQQSFEGPVLDLVKRLIATIESEKRSHALQYRSIEEKVDLLTKRLEATEGEKSNYIKRYEDAINDKKKLMDEYKNRITDLQANRRSLDERYSSLLKTLDSTKQDSMDWKRKYEQVLSRQKAEEDQASSEIAALKSRSGAAEARLAAAKEQAQSAQEEAEEWKRKYDIARREAQSALQKAANVQERTNKQTQLREDALREEFSGTLAEKEDEIKEKTAKIEHAEKCLTTLNLELKAAESKIRSYDTEISSLRIEIKELTEKLKAENAKAQSYEREAIVFQQEKNHLEQKYHTEFKRFDEVQERCKTAEKEAARATEVADKARAEAGMAQKERSEMQRLAMERLAQIERAERRIENLGREKDNLEAELRRVRDSEKDALTRAVKLEEKVQQREKDLEALLDKDKTHRRNSAQILEQLLETEREAHAQANNRAEALSLQLQSAQAKIDSLHQELTKFRLNETALDSKLNTASHGKRMRVDDNIGDDMDVSPRIVKGTKRTRSTYSQPEDGGSIFEGAEENLSQRTSEEDYRKFTVQRLKQELTKLNYGDQLLRLKNPNKKEIIALYEKCVLQKS

SEQ ID NO: 153121 - protein, 59 aa, Glycine max
  Coding DNA Sequence Number=SeqID_36343
MTRVIKLLVINKGTLKSVEDDKDGGFGAGDAPLAPDHDVRCAAADEDEPLHFLDDSTIW

SEQ ID NO: 153122 - protein, 136 aa, Glycine max
  Coding DNA Sequence Number=SeqID_36344
MCNNEKEVDLDYCLTLFISMDPRMDIGTFSPNRIIDIKFGVGICLCGTHGTFTQARTFIFPGLLEPREAEAWELLEALKRTNSMNLANVTYELECKSVVDEIRHNSIGSLDFHCILSKCRAVLLTTTNSLVSLSRR

SEQ ID NO: 153123 - protein, 477 aa, Glycine max
  Coding DNA Sequence Number=SeqID_36345
  Gene Ontology: Mol. function=nucleotide binding
  Homolog annotation: Hit_ID=Q5VNG4; Match level="QueryCoverage=91%, HitCoverage=87%, E-value=0.0, Identity=79%"; Hit description =Putative auxin-independent growth promoter
  Pfam annotation: Domain name=DUF246; Domain location=47-395; Score =722.4; E_value=3.1e-214; Accession=PF03138.5; Description=Plant protein family
MWGPRVLKGWPSCFTHGESAVLIELPSATTPRVLPPKRVYKNNGYLMVSCNGGLNQMRAAICDMVAIARYLNVTLIVPELDKASFWADPSEFQDIFDVDHFITSLRDEVRILKELPPRLKTRVENGFLYSMPPISWSDISYYKNQILPLIQKYKVVHLNRTDARLANNDQPLEIQRLRCRVNFSALRFTSQIEELGKRVIKLLRQNGPFLVLHLRYEMDMLAFSGCTQGCNNDEVEELTRMRYAYPWWKEKIINSDLKRKDGLCPLTPEETALTLRALDIDQNIQIYIAAGEIYGGDRRMASLAKNYPKLVRKETLLEPSDLQFFQNHSSQMAALDYLVSLESDIFVPTYDGNMAKVVEGHRRYLGFKKTILLNRKLLVDLIDQYHDGILNWNEFSSAVKEVHADRMGGATKRLVMPDRPKEEDYFYANPEECLELSDDMLRSTCLRWVSTQFSEEDDSYLYHRGSHIVTVRMGRGE

SEQ ID NO: 153124 - protein, 63 aa, Glycine max
  Coding DNA Sequence Number=SeqID_36346
MPKWQTRQYETNIYDHRISRLSIEGLLSSNQAKFGDRRQLASNTIQRNKPIPTHNLFPYAVGI

SEQ ID NO: 153125 - protein, 199 aa, Glycine max
  Coding DNA Sequence Number=SeqID_36347
  Gene Ontology: Mol. function=RNA-directed DNA polymerase activity; Biological process=RNA-dependent DNA replication
  Homolog annotation: Hit_ID=Q1T0R3; Match level="QueryCoverage=63%, HitCoverage=75%, E-value=6e-20, Identity=35%"; Hit description =Hypothetical mitochondrial protein atmg00310
MSNVAAIKTMLRSLELVSVPKKVVSKLEGLQQRFLWGGDVKHKKIPWITWETICLPKERGGLGIRELKKFNYALLGKWRWNLFHYQEGRWFNENIKWSIGCRSNVRFWEDGWLDTGICMMDKYQCLYCISEQRQQFNYQMGRLVDGTWEWNLLWRRDQLESELALASNFMVDVEALGVVGIRSFVGGIYHALHHSVLAL

SEQ ID NO: 153126 - protein, 34 aa, Glycine max
  Coding DNA Sequence Number=SeqID_36348
MDFSEVSEGKLTAYHVAGETDGGQCCGDDGEERV

SEQ ID NO: 153127 - protein, 852 aa, Glycine max
  Coding DNA Sequence Number=SeqID_36349
  Homolog annotation: Hit_ID=Q2HVL8; Match level="QueryCoverage=99%, HitCoverage=86%, E-value=0.0, Identity=57%"; Hit description =Regulator of chromosome condensation, RCC1; Ankyrin
  Pfam annotation: Domain name=RCC1; Domain location=36-84; Score=24.6; E_value=0.00035; Accession=PF00415.9; Description=Regulator of chromosome condensation (RCC1)
  Pfam annotation: Domain name=RCC1; Domain location=88-138; Score =23.6; E_value=0.00069; Accession=PF00415.9; Description=Regulator of chromosome condensation (RCC1)
  Pfam module annotation: Pfam domain module=RCC1::RCC1; Domain location=36-84::88-138
GQAAVITPRQVTSGLGSRRVMAIAAAKHHTVISTQGGEVFTWGSNREGQLGYPSVDTQPTPRRVSSLRSRIVAVAAANKHTAVVSDLGEVFTWGCNREGQLGYGTSNSASNYTPHVVESLKGKTLTRVSAAKYHTIVLGSDGEVFTWGHRLVTPKRVVVSRNLKKSGSTPLKFHRKERLNVVSIAAGMVHSMALTDDGALFYWVSSDPDLRCQQLYAMCGRNMVSISAGKYWTAAVTATGDVYMWDGKKGKDKPLVATRLHGVKKATSVSVGETHLLIVASLYHPVYPPNMIENSQKSKLNNKDDVEELNEDILFEDIDSSNIISNVQNDTLSQRSIPSLKSLCEKVAAECLVEPRNAVQLLEIADSLGADDLKKYCEEIVMRNLDFIFAVSSHTVASASLDILANLERLFDQRSSEPWSHRRLPTPTATFPAIINSEEDDSEIEFQRTRDKPMKLEKVLRLDSFLQPKDDPNKEISKVVRAIRKKLQQIEMLEDKQSNGHLLDDQQIAKLQSKSALESSLAELGVPVETSRYKESSSMLPEGKGSKKGKLSKKQRRKSGNSNIEQTEIESVYSKSEAIPKSEDLLDIDIMGVPDSKVEEDAVCEQISADEGGKDLAFVVQKKDALELLKAKGPSPKASKKKRSKKGGLSMFLSGALDEAPKEVAPPPPTPTPKHEGPAWGGAKFTKGSASLREIQDEQSKIKVNKPAGSKDKVEDLSDFGSGGKIKLSSFLPSSPIPVTSSRSSQVSDGEISTPPWAASGTPPQPSRPSLRHIQMQQGKKQQSLSHSPKTTTAGFSIPTCQGSPSETTGVSRWFKPEVETPSSIRSIQIEEKAMKDLKRFYSSVKIVRKQS

SEQ ID NO: 153128 - protein, 61 aa, Glycine max
  Coding DNA Sequence Number=SeqID_36350
MTSGFADSGDLNNEITTKKREQLTKTMTGKWWQTEETLTVLSYTHSESMMSRVDPTGSDSL

SEQ ID NO: 153129 - protein, 305 aa, Glycine max
  Coding DNA Sequence Number=SeqID_36351
MQKLVSVSMKNFPASSSISKVFPQKNSHTEVVIHDMGPIGKTTHGRICMYPPPEERERNTCKRNSNAQWKTHCPFHVTEPFWTSLGYEAGEIIEAQGHARGIWVLVEKSKLFQVEVLDTFPQAVTLKILKGTSCWVCTAIYANPHLTHHDDLWPYLIALRRCILQPWLLLGDFNEIVSPLEVLLVINIPGIGDKLMVVWPSDFIRLWEINHELDLYYSQLPRVVTEHWSFPNHPFMMLNVDGSWLADDVMGGRRGSFVVHKISRTTYTTILITKMLFMTSRIYYNTLGRSFPTYSSYIVLMKLQI

SEQ ID NO: 153130 - protein, 66 aa, Glycine max
  Coding DNA Sequence Number=SeqID_36352
MELDRAIQIALSFASLTPVPFDLCPSCVIEDSCRCTFSKGKSMWYLGLVLEMYEPLAVMMTLTMLQ

SEQ ID NO: 153131 - protein, 98 aa, Glycine max
  Coding DNA Sequence Number=SeqID_36353
MPNGQCASELIKQFESQTKFYQSMHLCSGKTTTRDIDQQATTLGGQVGANGYANQVFPAKIGLAKRPQNVIGHIGLLNATPFIPLSRGEGKLGPKCGS

SEQ ID NO: 153132 - protein, 226 aa, Glycine max
  Coding DNA Sequence Number=SeqID_36354
  Gene Ontology: Mol. function=identical protein binding; Cellular component=cytoplasm; Biological process=negative regulation of enzyme activity
  Homolog annotation: Hit_ID=Q1S4Q1; Match level="QueryCoverage=99%, HitCoverage=41%, E-value=2e-64, Identity=50%"; Hit description =Protease-associated PA; Proteinase inhibitor I9, subtilisin propeptide
MEAFEDAISDRVDVISCSLGQPTPTEFFEDGISIGASHAIVNDRIMLTGGGNAGPEPGTGASLSTGLPYKKFYSLINSIDAKVANATIEDAQLCKAGTIDPKKAKGKILVCLLKKEVDGLSYAEGSPMAYMTRAKTLLGLKPAPVIASLSSKGPNPIQLSILKPDITAPGVDILYAWSKVFSPTGFASDNRRILYNKGRELLHLSLMFLASLAFSKDSIAIGVLLP

SEQ ID NO: 153133 - protein, 235 aa, Glycine max
  Coding DNA Sequence Number=SeqID_36355
  Gene Ontology: Mol. function=protein binding; Cellular component =membrane; Biological process=protein modification process
  Homolog annotation: Hit_ID=Q2HVL8; Match level="QueryCoverage=96%, HitCoverage=20%, E-value=1e-110, Identity=86%"; Hit description =Regulator of chromosome condensation, RCC1; Ankyrin
  Pfam annotation: Domain name=Ank; Domain location=62-94; Score=38.5; E_value=2.4e-08; Accession=PF00023.20; Description=Ankyrin repeat
  Pfam annotation: Domain name=Ank; Domain location=96-128; Score=24.6; E_value=0.00036; Accession=PF00023.20; Description=Ankyrin repeat
  Pfam annotation: Domain name=RCC1; Domain location=155-202; Score =11.8; E_value=0.038; Accession=PF00415.9; Description=Regulator of chromosome condensation (RCC1)
  Pfam module annotation: Pfam domain module=Ank::Ank::RCC1; Domain location=62-94::96-128::155-202
MEVALSPQVQKPNLQTTGRKISCTGSQKDLWHVVREGSLSDVELALASLKKSGGNINLRNTFGLTPLHIATWRNHIPIVGRLLAAGADPDARDGESGWSSLHRALHFGYLAAASILLQHGASITLEDSKSRIPVDLLSGSVFQVLRDEHSSVATEVFSWGSGANYQLGTGNAHIQKLPCKVDSLGGSFIKLISAGKFHSVALTARGEVYTWGFGRGGRLGHPDFDIHRLNIENLV

SEQ ID NO: 153134 - protein, 170 aa, Glycine max
  Coding DNA Sequence Number=SeqID_36356
  Gene Ontology: Mol. function=peptidase activity; Biological process =regulation of DNA repair
  Homolog annotation: Hit_ID=UPI00005F7410; Match level="QueryCoverage =99%, HitCoverage=100%, E-value=2e-60, Identity=68%"; Hit description= COG2137: Uncharacterized protein conserved in bacteria
  Pfam annotation: Domain name=RecX; Domain location=50-170; Score =124.3; E_value=3.4e-34; Accession=PF02631.7; Description=RecX family
MNDLLSRAMRLLSQRDHSEAELRRKLAAQPFVAKARFGSKGPHAPASPPVVEEPVDPALIEQVIAYCYQHNWLDDKRFAHSYIGSRSRKGYGAQRIRSELMQKGVDKALVQDALADCDIDWCEQAKQVAQRKFGDALPTDWKEKAKVQRYLLYRGFFQEEIQSIYRDFAQ

SEQ ID NO: 153135 - protein, 63 aa, Glycine max
  Coding DNA Sequence Number=SeqID_36357
MEETQMAKHRVKSRTETEVKKKRYKRMQREKGRQGERRTKKRSHLGGVVSELRVVFTLGQKGP

SEQ ID NO: 153136 - protein, 82 aa, Glycine max
  Coding DNA Sequence Number=SeqID_36358
  Subcellular localization annotation: CTP_CleavageSite=59; ConfidenceScore=5.20e-01
MQKSRKPQRKKKECQSSMMITLSTTMRRSEQPQRLHATAMTTTSARRTKELDEFLKVLSASQDSSPQPEVLASAPSTQAPAY

SEQ ID NO: 153137 - protein, 609 aa, Glycine max
  Coding DNA Sequence Number=SeqID_36359
  Gene Ontology: Mol. function=phenylalanine-tRNA ligase activity; Biological process=phenylalanyl-tRNA aminoacylation
  Homolog annotation: Hit_ID=Q9FKU1; Match level="QueryCoverage=32%, HitCoverage=84%, E-value=4e-19, Identity=35%"; Hit description =Genomic DNA, chromosome 5, P1 clone:MDA7
MEEETKKNQYHTIQQQEREDNAKWVTHYSSYHQILLVGEGDFSFSLSLAKSFGSASNMVASSLNSYGLSLSLLPFSFVIVILACAARFVLKVSTLVHGVAKIGSKSLTWFCLPEFVEDSHVIFCTLLVFTELLVCIFYYVKFLCLSYSRKHKALVLGFFKNASGMLRANGEIHVSHKTTAPFNNWNIEKLAAQCFLKLIECADFKREDYPGYNNKRGDSYRCDEPFPLGKCCTFKFIYNPKAKRQNHVKRNQMVVSRQQTCLPLQEIEVAVEQLPTSAHLNYYPQTSHFPKIEEVTSIFGLTNRCTSITGCPLSTMAEVHGRVTPSGGYSAPGMSLGPTRTFQPMEPLQSLQPWPTSTNVRYSLTDYVRTIDNTVPISLEARNEGYQVYGGRSKYLQEEFGRTMHTVPLSLGARNEGYQVYGGRSKYLQEELGGTMRTVPLSLGVRNEGYLVYGGRSNCFQEELARTTTHRASYPFEEGHNLRDTLLKWSTSTNAGYPMRDHVRSMDTAPSSLGARNEGYFSNVYGGSSNYWQEELGRTTALRARARASYSFEGVRSDFERYIAQVPGRLFVQMPLYPPTSLLRVPLPLPSSSSSSGFTVVVVRLPLDH

SEQ ID NO: 153138 - protein, 258 aa, Glycine max
  Coding DNA Sequence Number=SeqID_36360
  Homolog annotation: Hit_ID=Q9FKU2; Match level="QueryCoverage=93%, HitCoverage=83%, E-value=4e-49, Identity=42%"; Hit description =Genomic DNA, chromosome 5, P1 clone:MDA7
  Pfam annotation: Domain name=Hin1; Domain location=101-237; Score =106.7; E_value=6.7e-29; Accession=PF07320.4; Description=Harpin -induced protein 1 (Hin1)
MLTLPPPPPPRLLTTRQTKQVSPDQIVISKLPIKQHSQESDAPNYVTTKSIRPPPPPPPPPPILRQPPFQRTNPIIWFAAVLCLIFSLLLIFFGVVTLIIFLGIKPRNPYFDIPNANLNAVYFDSPEYFNGDFTLVANITNPNKKIDVRFESFDVELFFSDRIISTQSIEPFTQRRRESRLESLHFISSLVFLPKDLGVNLKGQVQGNRVKYNVRGTFKVRVSMGFFHLSYWLHSRCQIEMTGPPTGVLVARKCITKR

SEQ ID NO: 153139 - protein, 63 aa, Glycine max
  Coding DNA Sequence Number=SeqID_36361
  Gene Ontology: Mol. function=hydrolase activity; Cellular component =cytoplasm
  Homolog annotation: Hit_ID=Q9LUH1; Match level="QueryCoverage=93%, HitCoverage=25%, E-value=9e-17, Identity=60%"; Hit description =Similarity to endo-1
MVDKVVAVGYYVIVPDFFHGDPYNPENASRSTPIWLKDHGRDKGSEATESIIEALKSKGMDGY

SEQ ID NO: 153140 - protein, 101 aa, Glycine max
  Coding DNA Sequence Number=SeqID_36362
MDFFKIDVNDAMLTSLQTANPCLLALALSLSQTLPHKPPILSGLPFATVKTPYSKSRKATVRPWSRFGCVYWDIHRRLPCSIAIALGLVLAISFIHRRSIA

SEQ ID NO: 153141 - protein, 52 aa, Glycine max
  Coding DNA Sequence Number=SeqID_36363
MVQSVDGGGAGALLIPPTTINGNGVVNNSGDSVGGNNNVSDVIVITVSGVQC

SEQ ID NO: 153142 - protein, 707 aa, Glycine max
  Coding DNA Sequence Number=SeqID_36364
  Gene Ontology: Mol. function=cellulose synthase (UDP-forming) activity; Cellular component=membrane; Biological process=cellulose biosynthetic process
  Homolog annotation: Hit_ID=Q3Y6V1; Match level="QueryCoverage=98%, HitCoverage=97%, E-value=1e-139, Identity=38%"; Hit description =Cellulose synthase-like protein CslG
  Pfam annotation: Domain name=Cellulose_synt; Domain location=5-707; Score=217.5; E_value=3e-62; Accession=PF03552.5; Description =Cellulose synthase
METLPLNTIYVQNLLVIINRLHMLLHSTALAFLFYYRLCFFFQPSETRESHLLLPWLLVFASEIILSFIWILDQAFRWRPVSRSVFPERLPEDHKLPAIDVFICTADATKEPTLDVMNTVLSAMALDYPPQKLHVYVSDDGGSPLILHGVREAWKFARWWLPFCRRHKIKNRCPKAYFSALKDNDDGDFARSSVYMEDKQKIKEKYEAFKEEIKTFRKDRTFSRDYPSVIEVMQETIIDDVDDVKMPLLVYVSREKKPSHPHHFKAGALNVLLRVSSVMSNSPYILVLDCDMFCNDPTSARYAMCFHLDPKISSSLAFVQFPQKFHNISKNDIYDSQLRSIFTLQWQGMDGLMGPVISGTDLLQLKEYFGSSNEFIRSLNQNYTSDLVSGQKYALLEEPHFLASCNYEIGTKWGQEVGFSYVSVVEDYLTGFILNCNGWTSVFCEPSRPQFLGSATTNLNDVLIQGTRWFCPLTYGLSKMPLLQSLCLAWLTYFPLYCFPLWCFATIPQLCLLNGIPLYPKVSDPFFIIFSFIFLSALLKHLLEVFLTGGTLKKWINEQRIWMMKSVTCHLYGCLDALLKKVGIREASFLPTNKLGNDEQTVLYQMDKYDFQASNIFVVPMLALITINISCFFGGVYRVLLVGDCDKMFVQLFLAVFIITVNYPIIEGLMIRKDKGRISKLVAIPVILATVVLLAFFKLLGMHSMLY

SEQ ID NO: 153143 - protein, 300 aa, Glycine max
  Coding DNA Sequence Number=SeqID_36365
  Homolog annotation: Hit_ID=Q1SP02; Match level="QueryCoverage=84%, HitCoverage=78%, E-value=7e-14, Identity=35%"; Hit description=IMP dehydrogenase/GMP reductase
  Pfam annotation: Domain name=DUF1723; Domain location=38-87; Score =54.7; E_value=3e-13; Accession=PF08330.1; Description=Protein of unknown function (DUF1723)
MLSSHGRKVQKFGKPVAKIEGLVASTGLSPLIACFLNTGDRGLISAFAERWHKERSSFHLPVGEVTITLDDVASLLHLPITCASIALRLFMLTKVVTCWIYKHFSSVAEAIIAEDYHERKPRAYRWTFGKTLPVSMYQKCLDRLTSDGICWMPYSDHRVVKEFELISLFFGHIRWDPVVVIHRPERVVQQFGYIQTILLHSLGSRLCLENIENRWMHFFEYLAPVGQICVVPGQCASEYIDWFYMISHPFMRLAQPRDPVRHPLVVQDETYMELDISQYLVAATVMEEAPTHEPFHVEQL

SEQ ID NO: 153144 - protein, 258 aa, Glycine max
  Coding DNA Sequence Number=SeqID_36366
  Gene Ontology: Mol. function=protein binding; Cellular component =integral to membrane; Biological process=xylan catabolic process
  Homolog annotation: Hit_ID=Q1SWI7; Match level="QueryCoverage=89%, HitCoverage=85%, E-value=5e-65, Identity=34%"; Hit description =Leucine-rich repeat
  Pfam annotation: Domain name=LRR_1; Domain location=104-126; Score =7.0; E_value=14; Accession=PF00560.23; Description=Leucine Rich Repeat
  Pfam annotation: Domain name=LRR_1; Domain location=128-150; Score =10.5; E_value=3.1; Accession=PF00560.23; Description=Leucine Rich Repeat
  Pfam annotation: Domain name=LRR_1; Domain location=152-175; Score =13.2; E_value=0.93; Accession=PF00560.23; Description=Leucine Rich Repeat
  Pfam annotation: Domain name=LRR_1; Domain location=177-199; Score =11.1; E_value=2.3; Accession=PF00560.23; Description=Leucine Rich Repeat
  Pfam annotation: Domain name=LRR_1; Domain location=201-223; Score =13.7; E_value=0.68; Accession=PF00560.23; Description=Leucine Rich Repeat
  Pfam annotation: Domain name=LRR_1; Domain location=52-73; Score=4.3; E_value=45; Accession=PF00560.23; Description=Leucine Rich Repeat
  Pfam annotation: Domain name=LRR_1; Domain location=7-40; Score=5.2; E_value=30; Accession=PF00560.23; Description=Leucine Rich Repeat
  Pfam annotation: Domain name=LRR_1; Domain location=80-101; Score =12.2; E_value=1.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=104-126::128-150::152- 175::177-199::201-223::52-73::7-40::80-101
MWETLPQVLYLNLSHNHIHGESGTTLKNPISIPVIDLSSNHLCGKLPYLSSDVSQLDLSSNSISESMNDFLCNDQDEPMQLQFLNLASNNLSGEIPDCWMNWTFLVNVNLQSNHFVGNLPQSMGSLAELQSLQIRNNTLSGIFPTSLKKNNQLISLDLRENNLSGSIPTWVGEKLLNVKILLLRSNSFTGHIPNEICQMSLLQVLDLAQNNLSGNIPSCFSNLSAMTLKNQSTDPHIYSQAQFFMLYTSEYSIVSVLL

SEQ ID NO: 153145 - protein, 73 aa, Glycine max
  Coding DNA Sequence Number=SeqID_36367
MQHVTSQQAPNHRGQSQDPGPFPWPTPKQFKATMACIGDETNFETRAGPTRAHGGDEGAQEDYNMADVLDFFT

SEQ ID NO: 153146 - protein, 334 aa, Glycine max
  Coding DNA Sequence Number=SeqID_36368
  Homolog annotation: Hit_ID=Q9XGX0; Match level="QueryCoverage=99%, HitCoverage=100%, E-value=4e-45, Identity=38%"; Hit description =Putative zinc finger protein SHI
  Pfam annotation: Domain name=DUF702; Domain location=107-271; Score =308.7; E_value=1.1e-89; Accession=PF05142.3; Description=Domain of unknown function (DUF702)
MAGLFSLGGSRGNTNPQEEIPPPDTLFWCNKNDDVSSYHRGSSGFELWNQQQLQHQQQQLMGHDPPPQPRPLFHQDLYSALGVGPSRPISDDQSSSRSSFLLGASGGGSAGGGISCQDCGNQAKKDCPHMRCRTCCKSRGFDCQTHVKSTWVPASRRRERLQQLSALQQHQQQQQTLEPASSAGGDLPKRHRARDHHHSPLACTRFPSNPSSSGLEEVNFPAVVRSAAEFRCVRVSSMDEEAEEEYAYSTAVNIAGHVFKGILYDYGPEGMNTNYMDAVAAAGESSSTGVGALNLTTGAIVSEPLGVDPSSLYPAPLNSFMPGSGTQFFPHPRS

SEQ ID NO: 153147 - protein, 95 aa, Glycine max
  Coding DNA Sequence Number=SeqID_36369
GVVKTEKKSSVMHGAVNGWHSQWHFSEYKLHRTARSLCHKAHAHALEDKRDNVSRKAAGFPVGKDERRRKLFCLTRGGMWNVGWGWELVWAVEMR

SEQ ID NO: 153148 - protein, 128 aa, Glycine max
  Coding DNA Sequence Number=SeqID_36370
  Subcellular localization annotation: CTP_CleavageSite=5; ConfidenceScore=5.14e-01
MQTVCCFTGLNASNRLKTNWLIKTFSIKFDKTLTHSAAHTKPFLSHSLGKREASTVCTRWVLHRRQRPVAEDRVPFALGVRIGQRSFSALRWDAKPLQQSAPRHNNQSLELKVLLRLRVVNSFRSPFD

SEQ ID NO: 153149 - protein, 683 aa, Glycine max
  Coding DNA Sequence Number=SeqID_36371
  Homolog annotation: Hit_ID=Q00SS9; Match level="QueryCoverage=25%, HitCoverage=79%, E-value=2e-15, Identity=30%"; Hit description =Homology to unknown gene
  Pfam annotation: Domain name=FG-GAP; Domain location=406-440; Score =8.8; E_value=0.56; Accession=PF01839.13; Description=FG-GAP repeat
  Pfam annotation: Domain name=FG-GAP; Domain location=47-76; Score =23.9; E_value=0.00058; Accession=PF01839.13; Description=FG-GAP repeat
  Pfam annotation: Domain name=FG-GAP; Domain location=609-638; Score =15.6; E_value=0.068; Accession=PF01839.13; Description=FG-GAP repeat
  Pfam module annotation: Pfam domain module=FG-GAP::FG-GAP::FG-GAP; Domain location=406-440::47-76::609-638
MRKRDLAILMLSAFAIFFTLQQDGGISFKDAWMHLTDEYPIKYEAERLPPPLVADLNGDGKKEVLVATHDAKIQVLEPHSRRVDEGFSEARVLAEVSLLPDKVRVMTGRRPVAMATGYIDRYKIGQPQKQVLVVVTSGWSVMCFDSNLQKLWENNLQEDFPHNAHHREVAISISNYTLKHGDTGLIIVGGRMEMQPHLLIAFYFQIFMDPFEEMGMGARFAEQHQRSAAEKEASGTVDLRHFAFYAFAGRSGDERWSRKNENIEAHSSDASQLLPQHNYKLDVHALNTRQPGEARREDTLFKLAHFRRHKRKALKKTPGKAISYPFHKPEENHPPGKDSTKKISNIIGKAASYAGSAKSKKHLPYVPTITNYTQVWWVPNVVVSHQKEGIEALHLATGRTICKFHLQEGGLHADVNGDGVLDHVQAVGGNGAEQTVVSGSMEVLRPCWAVATSGVPVREQLFNVSICHYTHFNLFQHGELYRSYSQGSDTASLEVATPILIPRSDGHRHRKGSHGDVIFLTNRGEITSYSPGLHGHDAIWQWQQSTGVTWSNLPSPSGMMEGGLVIPTLKPLSLRLHDNQEMILAAGEQEAVIISPGGSILATIELPGPPTHVLITEDFSNDGLTDLILVTSHGVYGFVQTRQPGALFFSMLVGCLIVVMGVIFVTQHLNSTKGKPRPSSGPR

SEQ ID NO: 153150 - protein, 204 aa, Glycine max
  Coding DNA Sequence Number=SeqID_36372
  Homolog annotation: Hit_ID=Q2HSC7; Match level="QueryCoverage=30%, HitCoverage=28%, E-value=3e-16, Identity=61%"; Hit description=Zinc finger, C2H2-type
  Pfam annotation: Domain name=zf-C2H2; Domain location=10-32; Score =22.6; E_value=0.0014; Accession=PF00096.16; Description=Zinc finger, C2H2 type
MGTTWPPRSYSCTFCRKEFRSAQALGGHMNVHRRDRARLHQASVPHNNPSFSPTPSFLNISHQEPFVANGGLCLLYPFPSPNNNAPFSSLGHNNNACGDSPSTAYSVSSSHSLQYPPMRVPSCSASTSFDFSVAQPAPPAVGRNNNGFSSSYSGKVEQEPPTNDSSTHHGAPGAAIWLEEMVKKRKEKGAPRTVKKRKKKTSHM

SEQ ID NO: 153151 - protein, 246 aa, Glycine max
  Coding DNA Sequence Number=SeqID_36373
  Gene Ontology: Mol. function=molecular_function; Cellular component =membrane; Biological process=auxin mediated signaling pathway
  Homolog annotation: Hit_ID=Q94AP3; Match level="QueryCoverage=85%, HitCoverage=55%, E-value=1e-55, Identity=49%"; Hit description =Putative nodulin protein
  Pfam annotation: Domain name=DUF6; Domain location=76-205; Score =64.3; E_value=4e-16; Accession=PF00892.11; Description=Integral membrane protein DUF6
  Pfam annotation: Domain name=TPT; Domain location=61-205; Score= -34.0; E_value=0.055; Accession=PF03151.7; Description=Triose -phosphate Transporter family
  Pfam module annotation: Pfam domain module=DUF6::TPT; Domain location= 76-205::61-205
MKCRYESVHFNRIDGLAKVLGVLASVGGASIITLYKGPVIYTPRLALHQEQYLSVLGDATGKNWNLGGIYLFGHSLCWSGWIVMQAFVLKKYSAPLTVSAFTCFFGVVQFLTIAAFFETDSKAWQFNSSGEIFSALFSGLVTSGLASAIQIWTIGKGGPVLASIYLPLQTLLVSVMASFIFGEEFFLGGIIGAFLIISGLYLVVWGRSQETKYAKEVIVPIEPKNHWEEKSDSSFLIQRLITTQSS

SEQ ID NO: 153152 - protein, 156 aa, Glycine max
  Coding DNA Sequence Number=SeqID_36374
  Gene Ontology: Mol. function=protein disulfide oxidoreductase activity; Cellular component=mitochondrion; Biological process=cell redox homeostasis
  Homolog annotation: Hit_ID=Q43636; Match level="QueryCoverage=96%, HitCoverage=98%, E-value=2e-42, Identity=57%"; Hit description =Thioredoxin H-type
  Pfam annotation: Domain name=AhpC-TSA; Domain location=51-134; Score=- 22.7; E_value=0.066; Accession=PF00578.11; Description=AhpCTSA family
  Pfam annotation: Domain name=Thioredoxin; Domain location=50-150; Score=122.9; E_value=9e-34; Accession=PF00085.10; Description =Thioredoxin
  Pfam module annotation: Pfam domain module=AhpC-TSA::Thioredoxin; Domain location=51-134::50-150
MAGSSEEGQVISCHTVDAWNDQLQKGNQSKKLRDMIFSQPQGSVRVHVMGAEKRATKRGKKEERKMRDIVVDFTASWCGPCRFIAPFLAELAKKFTSVVFLKVDVDELKSVSQDWAIEAMPTFVFVKEGTLLSKVVGAKKDELQQTIEKYVASASA

SEQ ID NO: 153153 - protein, 132 aa, Glycine max
  Coding DNA Sequence Number=SeqID_36375
  Subcellular localization annotation: CTP_CleavageSite=22; ConfidenceScore=5.12e-01
MGRSLIISAFMATSLAFSCFSTAALVARRREYLYLGGLLSFGLSILQLHSSSLRFVVAFREEFYKLYLPTLGDIKEMLLHFGNLFIFPYGSFFSNFQQIYSREMKHRKAHRVIKYLKLKRSDPSIELRELAY

SEQ ID NO: 153154 - protein, 217 aa, Glycine max
  Coding DNA Sequence Number=SeqID_36376
  Homolog annotation: Hit_ID=Q1T0V8; Match level="QueryCoverage=62%, HitCoverage=67%, E-value=4e-23, Identity=43%"; Hit description=Heat shock protein Hsp20
MKTKNWHRDSEVDNLVPCSTTIEIIKYLQRTQHSAANPAGGRGSFVSSFSPYFIGTFTFLRSGNFVVVSASPGTATLRAMDRQRHFEGNRWKRFKKEFEIPSHCNDDAIHGNMMQSILSVVMPKKSPQINQEDQQEHKKEKRANKKEEAETSTKEAIAEEDMAHAEEYQQFEENYNHVGPLPQETTREVALKFMLVMVLILVIASYLADVSKSLMAQ

SEQ ID NO: 153155 - protein, 214 aa, Glycine max
  Coding DNA Sequence Number=SeqID_36377
  Gene Ontology: Mol. function=protein binding; Cellular component =membrane; Biological process=meiosis
  Homolog annotation: Hit_ID=Q655Y4; Match level="QueryCoverage=88%, HitCoverage=60%, E-value=8e-48, Identity=46%"; Hit description=LEM3 -like
  Pfam annotation: Domain name=CDC50; Domain location=26-213; Score =16.5; E_value=1.4e-12; Accession=PF03381.6; Description=LEM3 (ligand- effect modulator 3) family  CDC50 family
MSVEPPSNSVAVADGRSKNAMKPKYSRFSQQELHAWQPILTPSWVVEVPFRYDDECLPPDHKNDAVAYIKDFGSNKTCTMKLTVVKNELKAPVYVYYQLKNFYQNHRRYVKSRDDRQLRSKASENDVGTCSPEDYTPNDKGHKPIVPCGLIAWSLFNDTYKLSSNNKDLMINKKNIAWTSDQKGNLGPKNFQAGGLIGGARLNQSLPRGSSLRY

SEQ ID NO: 153156 - protein, 99 aa, Glycine max
  Coding DNA Sequence Number=SeqID_36378
  Gene Ontology: Mol. function=electron carrier activity; Cellular component=membrane; Biological process=electron transport
  Homolog annotation: Hit_ID=Q1SR60; Match level="QueryCoverage=65%, HitCoverage=41%, E-value=4e-23, Identity=71%"; Hit description=Blue (Type 1) copper domain
  Pfam annotation: Domain name=Cu_bind_like; Domain location=1-59; Score=26.9; E_value=9.3e-08; Accession=PF02298.8; Description =Plastocyanin-like domain
FNYDKTKHNVVKVNGTEFQECSFTANNEVLSSGKDSIVLKTEGKKWYVCGVGNHCAAHQMKFVINVEAQGPAPAPTSSAPSLVSSLFGLLFLAIAAIFA

SEQ ID NO: 153157 - protein, 76 aa, Glycine max
  Coding DNA Sequence Number=SeqID_36379
MKVKQKYYATDTLDSSLHAMWYHFSVKNLVGRLGVHDKTCLIMERPVRATLFCKNPPTMWDQHKLKGALQTGCIYL

SEQ ID NO: 153158 - protein, 334 aa, Glycine max
  Coding DNA Sequence Number=SeqID_36380
  Gene Ontology: Mol. function=transferase activity, transferring glycosyl groups; Cellular component=cytoplasm; Biological process =nucleoside metabolic process
  Homolog annotation: Hit_ID=Q1S4Q9; Match level="QueryCoverage=78%, HitCoverage=55%, E-value=1e-135, Identity=90%"; Hit description =Phosphoribosyltransferase; AAA ATPase; Phosphoribulokinase/uridine kinase
  Pfam annotation: Domain name=CoaE; Domain location=99-271; Score= -94.3; E_value=0.043; Accession=PF01121.11; Description=Dephospho-CoA kinase
  Pfam annotation: Domain name=PRK; Domain location=100-283; Score =194.0; E_value=3.6e-55; Accession=PF00485.8; Description =Phosphoribulokinase  Uridine kinase family
  Pfam module annotation: Pfam domain module=CoaE::PRK; Domain location= 99-271::100-283
MVPGKFEKESFVFPQYGLNSLGWIRGALLESIQQVIQARTKSNLVNARSLPMDTKSAVELMESSAEVHFSGFHMDGFEQRKASIEQPTTSETDMYKQPFVIGVAGGAASGKTTVCDMIIQQLHDQRVVLDSFYNNLTEEELTRVQDYNFDHPDAFDTEQLLRVMDKLKHGEAVDIPKYDFKSYKSDDMLRRVNPSDVIILEGILVFHDPRVRELMNMKIFVDTDADVRLARRIRRDTTEKGRDIGAVLDQYSKFVKPAFDDFILPTKKYADIIIPRGGDNHVAIDLIVQHIRTKLGQHDLCKIYPNLYVIQSTFQLSHLDNCYYADTGYAYPDT

SEQ ID NO: 153159 - protein, 55 aa, Glycine max
  Coding DNA Sequence Number=SeqID_36381
  Gene Ontology: Mol. function=electron carrier activity; Biological process=electron transport
  Homolog annotation: Hit_ID=Q1SR60; Match level="QueryCoverage=90%, HitCoverage=31%, E-value=4e-12, Identity=66%"; Hit description=Blue (Type 1) copper domain
MASAARLTFFAVSMVLLSSVAIATDFTVGDGTGWTLDFNYTAWAQAKLFRVGDTL

SEQ ID NO: 153160 - protein, 54 aa, Glycine max
  Coding DNA Sequence Number=SeqID_36382
MQVAGVIGAFGDEVTPGTGLVSGVSAFRQGGNFKQLKTPVLLAICAAVGVASST

SEQ ID NO: 153161 - protein, 319 aa, Glycine max
  Coding DNA Sequence Number=SeqID_36383
  Gene Ontology: Mol. function=translation initiation factor activity; Cellular component=cell outer membrane; Biological process =osmoregulation
  Homolog annotation: Hit_ID=Q1SR54; Match level="QueryCoverage=83%, HitCoverage=28%, E-value=3e-96, Identity=69%"; Hit description =Initiation factor eIF-4 gamma, middle; Initiation factor eIF-4 gamma, MA3
  Pfam annotation: Domain name=MA3; Domain location=221-314; Score =20.7; E_value=0.00015; Accession=PF02847.7; Description=MA3 domain
MDYGVNQMLDSHIIRCRTRRPRKLAQPSGKKALVVVVVNLCCGMKIRADDPAAMKDFILSIQNTSNKLKASSGDDNEKQNSKRMEFMLEIVCDIKNNKRKPNEDSAHHTRIKKWLQKGVSLTVEILGLLKDSVEFHSYDASSFRTDDLVKFSKLRVDDILIRGFKWSKLLDPDKKGQWWLSGDVASSTGNVEEVANRIDKDVHETQRMLQLAAAQKMNTDARRAIFCIIMSGEDYLDAFEKLLRLELPGKQDRDIMRVLVECCLQEKVFNKYYTVLASKLCEHDKNHKFTLQMHLMQGFACPVPKEKALFSLLPKQQNL

SEQ ID NO: 153162 - protein, 104 aa, Glycine max
  Coding DNA Sequence Number=SeqID_36384
MSFSIVIHSMGSWVNEPQLYYKGGEVHVIHGLDANKWSYFEAMRLLTELGDKGDGDLEVWWKGKGTDFHSLKDLVLDQDAMDLTNYVLTHNCEVEIYVQMGWVF

SEQ ID NO: 153163 - protein, 63 aa, Glycine max
  Coding DNA Sequence Number=SeqID_36385
MGNKEVIEENPFKSHHRDAEYENRLWTLFSRCHGISKNVGVSISATITVADGNMSSFTVVEIT

SEQ ID NO: 153164 - protein, 111 aa, Glycine max
  Coding DNA Sequence Number=SeqID_36386
MDLWKACYAWLQVSTVLPNSPKLHFAQHMQLLKSKQEQEWWMVVWVAVVWNLWKLRNECIFKGEVYLMHSVVDSPREQLFSSLLSLNSTNLITELSSLFIIAYVSKHNVRL

SEQ ID NO: 153165 - protein, 358 aa, Glycine max
  Coding DNA Sequence Number=SeqID_36387
  Gene Ontology: Mol. function=cation transporter activity; Cellular component=integral to membrane; Biological process=calcium ion transport
  Homolog annotation: Hit_ID=Q8L783; Match level="QueryCoverage=90%, HitCoverage=73%, E-value=1e-128, Identity=71%"; Hit description =H+/Ca2+ antiporter, putative
  Pfam annotation: Domain name=Na_Ca_ex; Domain location=287-358; Score= 6.7; E_value=0.0047; Accession=PF01699.14; Description=Sodiumcalcium exchanger protein
  Pfam annotation: Domain name=Na_Ca_ex; Domain location=96-243; Score =117.2; E_value=4.6e-32; Accession=PF01699.14; Description =Sodiumcalcium exchanger protein
  Pfam module annotation: Pfam domain module=Na_Ca_ex::Na_Ca_ex; Domain location=287-358::96-243
MGTPNGRAMCKSDDEVPFDSEINFHLSESILVDVRGSHSGESQTARHETLAGIIYKSIRVVVFSNKLNLLMPFGPLAILVQKLTGHLGWVFGPSLLGIVPLAERLGYATEQLAFYTGDTVGGLLNATFGNATELIISIYALKSGMTRVVQLSLLGSILSNMLLVLGCAFLCGGIVNHKKEQVFNKAAASVNSGLLLMAVMGILFPAVLHYTHTEVRVGKSELSLSRLSSCIMLVAYVAYLFFQLKSQRSLYVSVNEDESQNGNNSNDDESPDISKWETLIWLSVMTAWISILSEYLVGAMEGASMAWEIPVAFISVILLPLVGNAAEHASAIMFAMKDKLDISLGVAIGSSTQISMFV

SEQ ID NO: 153166 - protein, 246 aa, Glycine max
  Coding DNA Sequence Number=SeqID_36388
  Gene Ontology: Mol. function=isomerase activity; Biological process =cell redox homeostasis
  Homolog annotation: Hit_ID=Q1RTP5; Match level="QueryCoverage=89%, HitCoverage=77%, E-value=3e-79, Identity=64%"; Hit description =Thioredoxin domain 2; Thioredoxin fold
  Pfam annotation: Domain name=Thioredoxin; Domain location=11-114; Score=-5.4; E_value=0.00046; Accession=PF00085.10; Description =Thioredoxin
MQDNAQIVSGSVMVDGNFIEGVLSGRKRVGYISILFYASWCPLSCRMLPEFEILSSMFPQVQHVALEQSSALPSLYSKYGIHSLPAILLVNQTSRVRYHGPKILNFLVEFYERNTGLEAKDNAVVGQLSNLMSDEHSTMKGFSLKEIFNREPYLALSILFFCLRIILFVLPTIMSRLKEFWTSYASHLNMQIFGEVMERVLNVIDVKRIWTKLRLYKTRNFHERVRSARVWASSLASVSLGDSSAR

SEQ ID NO: 153167 - protein, 63 aa, Glycine max
  Coding DNA Sequence Number=SeqID_36389
MTRETWKIVVRIVNIWSRRNTSRLILDMIFMDKDMQKAVEIELLTKFPYGGMYLVCYIAFEEV

SEQ ID NO: 153168 - protein, 243 aa, Glycine max
  Coding DNA Sequence Number=SeqID_36390
MSHRNYINLEEKLLDRPIYRIMPITRLLQLLDEKKLTLVKPKKWDDPFENALLSCEFEISGEEVASFSAKDGVYGQCWTFHRETDAMWRIYSPDKTGVRVTTTPRKLLTALQNSQPTHHHFTCFIGKVSYLYKGDLLEKLQSIDVFNTDGSGIAESLLYKRIEFRHEREIRLIYSSSENENPNDVYQFDIEPMELLDRILFDPRMDKNLVEAYKLAIAAKGCNTEIRRSTLYDAPKGLKFKLA

SEQ ID NO: 153169 - protein, 91 aa, Glycine max
  Coding DNA Sequence Number=SeqID_36391
  Subcellular localization annotation: CTP_CleavageSite=31; ConfidenceScore=5.18e-01
MQTQFYTGSAMPYAYVQSPSNPLEISTNFVNSFTTSEPPKEKKESHEDSTSGGFNLFSVSLTFGNSIGAVGGITGGSQEPLEMLLSLAEDT

SEQ ID NO: 153170 - protein, 100 aa, Glycine max
  Coding DNA Sequence Number=SeqID_36392
  Homolog annotation: Hit_ID=Q5CCP8; Match level="QueryCoverage=61%, HitCoverage=6%, E-value=3e-14, Identity=69%"; Hit description=Beta-D- galactosidase
MEEEEEEEEEYIWGASGVMYRARKKDSPLAIDEDGFSVVGNATVNLLKLKTQPQRQTKECCKLHFGNQGGFHVFPTTLEENGEWRERERERKEKRVLLLL

SEQ ID NO: 153171 - protein, 359 aa, Glycine max
  Coding DNA Sequence Number=SeqID_36393
  Gene Ontology: Mol. function=rRNA (adenine-N6,N6-)-dimethyltransferase activity; Cellular component=nucleus; Biological process=rRNA modification
  Homolog annotation: Hit_ID=Q9FK02; Match level="QueryCoverage=80%, HitCoverage=80%, E-value=6e-90, Identity=57%"; Hit description =Dimethyladenosine transferase-like protein
  Pfam annotation: Domain name=MTS; Domain location=45-195; Score= -81.5; E_value=0.011; Accession=PF05175.4; Description=Methyltransfera se small domain
  Pfam annotation: Domain name=Methyltransf_11; Domain location=79-184; Score=17.4; E_value=0.0011; Accession=PF08241.2; Description =Methyltransferase domain
  Pfam annotation: Domain name=Methyltransf_12; Domain location=79-188; Score=18.6; E_value=0.011; Accession=PF08242.2; Description =Methyltransferase domain
  Pfam annotation: Domain name=RrnaAD; Domain location=45-303; Score =196.0; E_value=9.2e-56; Accession=PF00398.10; Description=Ribosomal RNA adenine dimethylase
  Pfam annotation: Domain name=UPF0020; Domain location=47-215; Score= -65.2; E_value=0.1; Accession=PF01170.9; Description=Putative RNA methylase family UPF0020
  Pfam module annotation: Pfam domain module=MTS::Methyltransf _11::Methyltransf_12::RrnaAD::UPF0020; Domain location=45-195::79 -184::79-188::45-303::47-215
MFAKRIKHVHESGSMLGATRRVVGFIPRRLRSVRQVHGDGDGEEALRFHKSRGQHILINPRILDTIVRRSAINPTDTVLEIGPGTGNLTLKLLEAAHKVVAIEIDHRMVQVLEKRVLQRGLKDKLRVIERDAMRAPFPRFDLVVANIPYRISSPLVIKLVYGATPFRSATLLLQKEFARRLLACPGDSGGFNRLSANVKLVADVELVMDVSKRDFLPSPKVDSSVVIIRPKHQIPNVDLHEWRSFTRTCFSSNRNKTLGALFKLKGKVFELFKISNGNDECSLHKGDEVQDEGGLTSFKEKIIGVVRTGGFEDKRPAKLSLQELLHLLSLFNQAGIYFNHRGRHKIEDMLDDMMNSAPC

SEQ ID NO: 153172 - protein, 420 aa, Glycine max
  Coding DNA Sequence Number=SeqID_36394
  Gene Ontology: Mol. function=oxidoreductase activity; Cellular component=endoplasmic reticulum; Biological process=electron transport
  Homolog annotation: Hit_ID=Q9M066; Match level="QueryCoverage=99%, HitCoverage=78%, E-value=1e-147, Identity=60%"; Hit description =Cytochrome P450 90C1
  Pfam annotation: Domain name=p450; Domain location=1-417; Score=37.6; E_value=1.1e-12; Accession=PF00067.12; Description=Cytochrome P450
YGNVFKTCILGSNVIVSTDPDVNKVVLQNQANNFVPAYPKSIRELMGEQSILKMNGTMHKKVHTLIAGFLRSPQLKARITRDIEHTVKQCFASWTPHQPIYVQDQVKKITFPVLIKVLMSVGPGEDLDFLYREFAEFIKGLICLPLKFPGTRLYKSLKAKDRMVKMVRNIVEERKKLQKDNNADDHGDTVAVAVNDVVDVLLRDKVDSNSSSRLTPEMISQNIIEMMVPGEETLPTAMTIALKFLSDSPLALSKLQEENMELKRLKTNCSDDYAWTDYMSLPFTQNVISETLRMANIVNGIWRKSVNDIEIKGYLIPKHWCVMASLTSVHMDGKNYENPFKFDPWRWEKIGVVAGNNCFTPFGGGHRLCPGLELSRLELSIFLHHLVTTYRWVAERDEIIYFPTVKMKRKLPISVQPINA

SEQ ID NO: 153173 - protein, 49 aa, Glycine max
  Coding DNA Sequence Number=SeqID_36395
MARVRGPKLLMLRQPLRKVPIETPQDRLGIEQSSAFRLSRARLRTTTYR

SEQ ID NO: 153174 - protein, 416 aa, Glycine max
  Coding DNA Sequence Number=SeqID_36396
  Gene Ontology: Mol. function=4 iron, 4 sulfur cluster binding; Cellular component=cellular_component; Biological process=regulation of cyclin-dependent protein kinase activity
  Homolog annotation: Hit_ID=Q75WU8; Match level="QueryCoverage=99%, HitCoverage=66%, E-value=0.0, Identity=78%"; Hit description=Similar to CDK5 regulatory subunit-associated protein
  Pfam annotation: Domain name=Radical_SAM; Domain location=69-266; Score=109.9; E_value=7.1e-30; Accession=PF04055.11; Description =Radical SAM superfamily
  Pfam annotation: Domain name=TRAM; Domain location=320-396; Score =53.3; E_value=7.9e-13; Accession=PF01938.10; Description=TRAM domain
  Pfam module annotation: Pfam domain module=Radical_SAM::TRAM; Domain location=69-266::320-396
MAERLKEKILDSDKMVDVVCGPDAYRDLPRLLEEVDYGQKGINTLLSLEETYADINPVRISKNSVTAFVSVMRGCNNMCSFCIVPFTRGRERSRPVESIVREVAELWKEGVKEVTLLGQNVNSYNDASEIERKVESGSNWKLSEGFSSMAKVKNMGLRFSDLLDRLSSEFPEMRFRFTSPHPKDFPDELLYLMRERHNICKLIHLPAQTGSSPVLERMRRGYTREAYLDLVQKIRSIIPDVALSSDFICGFCGETEEEHSETLTLVKAVGYDMAFMFAYSMREKTHAHRNYVDDVPEEIKQRRLAELIETFRGSTGQCFDSQIGTTQLVLVEGPNKRAPDTELMGKSDKGHRVLFVNMPIPDREDINTKRNPVVGDYVEVRITRSTRASLFGEALAITKLTSFYNNLDKEAVAFSM

SEQ ID NO: 153175 - protein, 73 aa, Glycine max
  Coding DNA Sequence Number=SeqID_36397
  Gene Ontology: Mol. function=monooxygenase activity; Biological process=electron transport
  Homolog annotation: Hit_ID=Q9M066; Match level="QueryCoverage=64%, HitCoverage=9%, E-value=1e-09, Identity=54%"; Hit description =Cytochrome P450 90C1
MEWIIGVCVSMGMLFLMSWWILLCGKNDDEKTVAKGKVPKGNSGWPLLGETLDFIASGYTSTPVSFLEKRKSL

SEQ ID NO: 153176 - protein, 91 aa, Glycine max
  Coding DNA Sequence Number=SeqID_36398
  Subcellular localization annotation: CTP_CleavageSite=85; ConfidenceScore=5.13e-01
MASSLSSVINQPHLAQRLKLHRPSSLTTFTIFHHKHKHQHRHNASFPHPYTSLPRSRPLNLIIASRTFSPSNTLHLHFIPQATLTASEAQP

SEQ ID NO: 153177 - protein, 177 aa, Glycine max
  Coding DNA Sequence Number=SeqID_36399
  Gene Ontology: Mol. function=oxidoreductase activity; Cellular component=mitochondrial matrix; Biological process=electron transport
  Homolog annotation: Hit_ID=Q4LAW2; Match level="QueryCoverage=58%, HitCoverage=43%, E-value=2e-32, Identity=63%"; Hit description =Putative FAD linked oxidase family protein
  Pfam annotation: Domain name=FAD-oxidase_C; Domain location=8-170; Score=-24.5; E_value=3.3e-05; Accession=PF02913.9; Description=FAD linked oxidases, C-terminal domain
MAGSVQRNPRFSKLNDDDVRYFEGILGTKNVVQDEGKLVTSNTDWMHKYKGSSKLLLQPRTADQVSQILKYCNSRNLAVVPQGGNTGLVGVIVCLSSMNKIIYFDKILSQIEPYVYEWTSERRGSISAEHGLGLMKANEIFYSKSRETVQVMASIKNMLDPNHILNPYKVLPHSLIS

SEQ ID NO: 153178 - protein, 49 aa, Glycine max
  Coding DNA Sequence Number=SeqID_36400
MKLDDQQQYIDGSPEWGNVYLLRKVVAGDSFFGAMCRLKMTKVGLSHHN

SEQ ID NO: 153179 - protein, 154 aa, Glycine max
  Coding DNA Sequence Number=SeqID_36401
  Gene Ontology: Mol. function=small conjugating protein ligase activity; Biological process=protein modification process
  Homolog annotation: Hit_ID=Q7Y014; Match level="QueryCoverage=99%, HitCoverage=89%, E-value=3e-35, Identity=65%"; Hit description =Putative ubiquitin-conjugating enzyme, 3'-partial
  Pfam annotation: Domain name=UQ_con; Domain location=19-153; Score= -26.4; E_value=0.0028; Accession=PF00179.16; Description=Ubiquitin -conjugating enzyme
MTSSSAAARKNLSKIACNRLQKELVEWQVNPPTGFKHKVTDNLQRYQILLNPHPKYYRFRSSIIPLHSFALFLSGRWVVEVTGAPGTLYANETYQLQVDFPENYPMEAPQVPLLSLSYTKLTFDLYHVLVFTDVIDGFTGDILASGSAASPYLQ

SEQ ID NO: 153180 - protein, 246 aa, Glycine max
  Coding DNA Sequence Number=SeqID_36402
  Gene Ontology: Mol. function=sequence-specific DNA binding; Cellular component=nucleus; Biological process=regulation of transcription, DNA-dependent
  Homolog annotation: Hit_ID=Q533S2; Match level="QueryCoverage=88%, HitCoverage=89%, E-value=1e-102, Identity=87%"; Hit description=MADS box protein AP3-like
  Pfam annotation: Domain name=K-box; Domain location=71-186; Score =51.3; E_value=3.3e-12; Accession=PF01486.8; Description=K-box region
  Pfam annotation: Domain name=SRF-TF; Domain location=9-59; Score =113.7; E_value=5.4e-31; Accession=PF00319.9; Description=SRF-type transcription factor (DNA-binding and dimerisation domain)
  Pfam module annotation: Pfam domain module=K-box::SRF-TF; Domain location=71-186::9-59
MGRGKIEIKLIENPTNRQVTYSKRRNGIFKKAHELSVLCDAKVSLIMFSKNNKMHEYISPGLTTKRIIDQYQKTLGDIDLWRSHYEKMLENLKKLIDINNKLRRQIRKLIGGVVLCELERHRIGEGLDMDDMSFQQLRTLEEDLVSSIGKIRERKFHVIKTRTDTCRKKVKSLEQMNRDLLFELEKCAIHPQFILHDEGDEESAVALANGASTLYAFCHQHHSHLNLPSHHSHGEEPFKTDDLRLA

SEQ ID NO: 153181 - protein, 422 aa, Glycine max
  Coding DNA Sequence Number=SeqID_36403
  Gene Ontology: Mol. function=receptor activity; Cellular component =integral to membrane; Biological process=protein amino acid phosphorylation
  Homolog annotation: Hit_ID=Q9FH56; Match level="QueryCoverage=97%, HitCoverage=98%, E-value=1e-112, Identity=52%"; Hit description =Similarity to elicitor-inducible receptor-like protein
  Pfam annotation: Domain name=LRR_1; Domain location=109-131; Score =18.8; E_value=0.019; Accession=PF00560.23; Description=Leucine Rich Repeat
  Pfam annotation: Domain name=LRR_1; Domain location=133-155; Score =15.5; E_value=0.19; Accession=PF00560.23; Description=Leucine Rich Repeat
  Pfam annotation: Domain name=LRR_1; Domain location=157-179; Score =16.2; E_value=0.12; Accession=PF00560.23; Description=Leucine Rich Repeat
  Pfam annotation: Domain name=LRR_1; Domain location=181-202; Score =10.9; E_value=2.7; Accession=PF00560.23; Description=Leucine Rich Repeat
  Pfam annotation: Domain name=LRR_1; Domain location=204-223; Score =10.0; E_value=3.8; Accession=PF00560.23; Description=Leucine Rich Repeat
  Pfam annotation: Domain name=LRR_1; Domain location=226-249; Score =9.3; E_value=5.2; Accession=PF00560.23; Description=Leucine Rich Repeat
  Pfam annotation: Domain name=LRR_1; Domain location=251-273; Score =12.9; E_value=1.1; Accession=PF00560.23; Description=Leucine Rich Repeat
  Pfam annotation: Domain name=LRR_1; Domain location=275-296; Score =9.0; E_value=5.8; Accession=PF00560.23; Description=Leucine Rich Repeat
  Pfam annotation: Domain name=LRR_1; Domain location=301-322; Score =6.2; E_value=20; Accession=PF00560.23; Description=Leucine Rich Repeat
  Pfam annotation: Domain name=LRR_1; Domain location=325-347; Score =10.2; E_value=3.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=109 -131::133-155::157-179::181-202::204-223::226-249::251-273::275 -296::301-322::325-347
MGTLCFPLFAIIAIFWGVLLGAASKTHVGDAEVLKELKQGLDPASVKPGSCVSSWDFTVDPCDNLFGEKFTCGFRCDVVVSGLSRVTELTLDQAGYSGSLSSFTWNLPYLQTLDLSNNYFSGQIPYSFSNLTRLSRLSLSFNSFSGEIPSSLGTLSDLQELYLDNNNLRGAIPESFNHLANLKRLELQSNKLNTHLPNLESLRNLKFLYLSDNFIAGALSASLPVSLVQISIRNNNLSGVLLGESFKSLRRLQVVDFSSNQLSGSVPSVFFELPSLQQLTLSFNKFTNLEAPFKGVESQSGLIAVDLSNNRLRGFLPSFMAVMPKLSSLSLENNEFTGRIPTQFGVKTVFPEKGVSSFGRLLLGGNYLLGGIPRPLLALKRDSANVSLVGNCLYRCPHSFFFCQGGQQKSLAQCNRFSPPST

SEQ ID NO: 153182 - protein, 74 aa, Glycine max
  Coding DNA Sequence Number=SeqID_36404
  Homolog annotation: Hit_ID=Q1S9R2; Match level="QueryCoverage=41%, HitCoverage=19%, E-value=2e-13, Identity=100%"; Hit description =Ubiquitin-conjugating enzyme, E2
MTVSSICISILSMLSSSTTKQRPEDNDRYVKNCRNGRSPKETRWWFHDDKKSYEFGMVNPYSCPKEKEWETVIR

SEQ ID NO: 153183 - protein, 550 aa, Glycine max
  Coding DNA Sequence Number=SeqID_36405
  Gene Ontology: Mol. function=motor activity; Cellular component =myosin complex; Biological process=signal transduction
  Homolog annotation: Hit_ID=Q1SXC2; Match level="QueryCoverage=94%, HitCoverage=34%, E-value=0.0, Identity=76%"; Hit description=IQ calmodulin-binding region; Myosin head, motor region; Dilute; AAA ATPase; Myosin, N-terminal, SH3-like
  Pfam annotation: Domain name=DIL; Domain location=482-550; Score =10.3; E_value=0.0004; Accession=PF01843.9; Description=DIL domain
VKSDYISQQSSIVAYIAWVNWLHCHMKREAARETGALQAAKNKLEKQVEDLTLRLQLEKRLRVDIEEAKAQENQRLQSALQEMQLQFKETKFLLEKEKEATKRAAERVPVIQEVPVVDNALLEKLRSENEKLKNMVSSLEKKIDETEKRYEEANKVGEERLKQALDAESKVIQLKTAMQRLEEKFIDMESANHILQKQSLLNSSVKTIAEHLSSPLDEKLENGHHAAEEKKAVDTFVTPVKQFGTESDSKLRRSYIERQHESVDSLVNCVMKNIGFNHGKPIAAFTIYKCLLHWKSFEAERTSVFDRLIQMIGSEIENQDDNDHMAYWLSNTSALLFLLEQSLKSGSSANATPARKPPNPTSLFGRMTMSFLSSPSSANLAAPPADVVRKVEAKYPALLFKQQLTAYFEKIYGIIRDNLKKDLTPILALCIQAPRTSKGGLRSNRSLAKDSPMVHWQSIIESLNMLLCTLKENFVPPVLIQKIFSQTFSYINVQLFNSNGEYVKAGLAELELWCCQAKEELQLIALSTNLQYAGSSWDELKHIRQAVGFL

SEQ ID NO: 153184 - protein, 117 aa, Glycine max
  Coding DNA Sequence Number=SeqID_36406
  Gene Ontology: Mol. function=phosphopantetheinyltransferase activity; Biological process=macromolecule biosynthetic process
  Homolog annotation: Hit_ID=Q7CPE8; Match level="QueryCoverage=88%, HitCoverage=42%, E-value=9e-17, Identity=42%"; Hit description =Putative cytoplasmic protein
MEAVTQIWTLRQSILKLTGEANSGIDALRLHPAAGRLRSSVYPDIQAVCDAEPTLVWSCALSPGTERLRLWEIDAQQQWQSLRDVEMSKPNIGPRTLRLTSLPGERVASQPEVRHPG

SEQ ID NO: 153185 - protein, 946 aa, Glycine max
  Coding DNA Sequence Number=SeqID_36407
  Gene Ontology: Mol. function=motor activity; Cellular component =myosin complex; Biological process=protein amino acid phosphorylation
  Homolog annotation: Hit_ID=Q1SXC2; Match level="QueryCoverage=93%, HitCoverage=58%, E-value=0.0, Identity=88%"; Hit description=IQ calmodulin-binding region; Myosin head, motor region; Dilute; AAA ATPase; Myosin, N-terminal, SH3-like
  Pfam annotation: Domain name=IQ; Domain location=795-815; Score=21.6; E_value=0.0027; Accession=PF00612.17; Description=IQ calmodulin -binding motif
  Pfam annotation: Domain name=IQ; Domain location=818-838; Score=23.5; E_value=0.00077; Accession=PF00612.17; Description=IQ calmodulin -binding motif
  Pfam annotation: Domain name=IQ; Domain location=843-863; Score=28.2; E_value=2.9e-05; Accession=PF00612.17; Description=IQ calmodulin -binding motif
  Pfam annotation: Domain name=IQ; Domain location=866-886; Score=3.3; E_value=18; Accession=PF00612.17; Description=IQ calmodulin-binding motif
  Pfam annotation: Domain name=IQ; Domain location=891-911; Score=21.6; E_value=0.0029; Accession=PF00612.17; Description=IQ calmodulin -binding motif
  Pfam annotation: Domain name=IQ; Domain location=914-934; Score=21.9; E_value=0.0023; Accession=PF00612.17; Description=IQ calmodulin -binding motif
  Pfam annotation: Domain name=Myosin_N; Domain location=68-109; Score =36.8; E_value=7.7e-08; Accession=PF02736.9; Description=Myosin N -terminal SH3-like domain
  Pfam annotation: Domain name=Myosin_head; Domain location=122-779; Score=1045.5; E_value=0; Accession=PF00063.11; Description=Myosin head (motor domain)
  Pfam module annotation: Pfam domain module=IQ::IQ::IQ::IQ::IQ::IQ::Myo sin_N::Myosin_head; Domain location=795-815::818-838::843-863::866 -886::891-911::914-934::68-109::122-779
MTMGTILMSFSKPVAPPTTNLTVVVVDTQEATRSISLIGGDREGVAKGIGGELRRRRCEAVVANPVVGSHIWVEDPDVAWIDSEVLEVKGEEIKVLCTSGKTVVVKASSIYHKDTEVPPSGVDDMTKLAYLHEPGVLDNLRSRYDINEIYTYTGNILIAVNPFIKLPHLYDSHMMAQYKGAAFGELNPHPFAVADAAYRLMINEGISQSILVSGESGAGKTESTKLLMRYLAYMGGRAAVAEGRTVEQKVLESNPVLEAFGNAKTVRNNNSRWEIIFVEIQFDQSGRISGAAIRTYLLERSRVCQVSDPERNYHCFYMLCAAPPEDIKKYKLGDPRMFHYLNQSNCFELEGFDESKEYRDTRRAMDIVGISSEEQDAIFKVVAAILHLGNIEFAKGKEIDSSVPKDEKSWFHLQTAAELFMCDAKALEDSLCKRVIVTRDETITKWLDPEAAALSRDALAKIVYTRLFDWLVDKINNSIGQDPESKSLIGVLDIYGFESFKTNSFEQFCINLTNEKLQQHFNQHVFKMEQEEYKKEEIDWSYIEFVDNQDILDLIEKKPGGIIALLDEACMFPRSTHETFAQKLYQTFKNHKRFSKPKLSRSDFTICHYAGDVTYQTELFLDKNKDYVVAEHQALLYASKCPFVSGLFPPSPEESSKQSKFSSIGSRFKQQLQSLLETLSATEPHYIRCVKPNNLLKPSIFENKNVLLQLRCGGVMEAIRISCAGYPTRKTFDEFVDRFSLLSPEALTGSSDEVTACKRILKNVGLEGYQIGKTKVFLRAGQMAELDTRRSEILGRSASIIQRKVRSYLARQSFILLRLSTVQIQAACRGQLARQVYEGMRQEASSLVIQRCFRMHIARKAYKDLYTSAVSIQTGMQGMAARSELHFRRQTKAAIAIQSHCRKYLAELHFAKLKKAAIATQCAWRGKVAQRELRKLKMVSSFNVTP

SEQ ID NO: 153186 - protein, 137 aa, Glycine max
  Coding DNA Sequence Number=SeqID_36408
MERTWRRNDLMCYNDIQPKAKNETIERVYDRGTHAARGKRCSFVNGFLGAALLNLSRCIEEGGGGGFGVGADLQSGMRGVSLVDTSSDEEEVGSSLFPVKENAYSLSPIFGLALVALVLTRRGIDEGRMDARGSATG

SEQ ID NO: 153187 - protein, 176 aa, Glycine max
  Coding DNA Sequence Number=SeqID_36409
MPLLKQQGVCMRTVPTKKVGEKNYDSHNLPFDLPHMIYINILRNLKGLGGLDDIYYATLINKLLWDQGVYHVFNKMDEDSKHTLIVKGLVVAKQQKFRKTNLKAMKVALEKTLKEALEVDVHAINKPNKRDSPSPFLLKALVWIALAWQEKLRRSMLGRKRRRKPENNPKGMKKKM

SEQ ID NO: 153188 - protein, 148 aa, Glycine max
  Coding DNA Sequence Number=SeqID_36410
  Gene Ontology: Mol. function=nucleic acid binding; Cellular component= endoplasmic reticulum membrane; Biological process=DNA integration
MKVMQELDQFQQNDVWKLVELPKGNKVVVAKWIFHNKLDENGEVVRNKAILVSKASYGLKQAPRAWYEKLSSFFLENGFEQGKVDTTLFQKNYKSQFILVQVYVDNIIFGATNEMLCEDLSKLIWTEFKMSMMGELKFRSKLHDDESS

SEQ ID NO: 153189 - protein, 478 aa, Glycine max
  Coding DNA Sequence Number=SeqID_36411
  Gene Ontology: Mol. function=structural molecule activity; Cellular component=actin cytoskeleton; Biological process=signal transduction
  Homolog annotation: Hit_ID=Q6AT64; Match level="QueryCoverage=100%, HitCoverage=90%, E-value=1e-117, Identity=41%"; Hit description =Putative ankyrin
  Pfam annotation: Domain name=Ank; Domain location=173-205; Score =31.8; E_value=2.4e-06; Accession=PF00023.20; Description=Ankyrin repeat
  Pfam annotation: Domain name=Ank; Domain location=206-238; Score =17.5; E_value=0.05; Accession=PF00023.20; Description=Ankyrin repeat
  Pfam annotation: Domain name=Ank; Domain location=239-271; Score =19.1; E_value=0.016; Accession=PF00023.20; Description=Ankyrin repeat
  Pfam annotation: Domain name=Ank; Domain location=272-304; Score =32.5; E_value=1.4e-06; Accession=PF00023.20; Description=Ankyrin repeat
  Pfam annotation: Domain name=Ank; Domain location=306-338; Score =37.6; E_value=4.3e-08; Accession=PF00023.20; Description=Ankyrin repeat
  Pfam annotation: Domain name=Ank; Domain location=339-392; Score=6.1; E_value=4.1; Accession=PF00023.20; Description=Ankyrin repeat
  Pfam annotation: Domain name=Ank; Domain location=393-426; Score =35.1; E_value=2.4e-07; Accession=PF00023.20; Description=Ankyrin repeat
  Pfam annotation: Domain name=Ank; Domain location=427-459; Score =37.8; E_value=3.8e-08; Accession=PF00023.20; Description=Ankyrin repeat
  Pfam annotation: Domain name=Motile_Sperm; Domain location=4-114; Score=19.7; E_value=0.00025; Accession=PF00635.16; Description=MSP (Major sperm protein) domain
  Pfam module annotation: Pfam domain module=Ank::Ank::Ank::Ank::Ank::An k::Ank::Ank::Motile_Sperm; Domain location=173-205::206-238::239 -271::272-304::306-338::339-392::393-426::427-459::4-114
MDRLIKVDPTNTVTIRMEPGQKCHGQITLRNVMYTMPVAFRLQPLIKTRYTVKPQSGIISPLATVTIEILYNLPQGSTLPHSFPQSEDSFLIHSVVVPGATVKEPSSMFESVPSDWFTTKKKQVFIDSGIKIIFVGSLILAQLVHDGSIDEIRQVLEHSEHTWKKAVDSVDQNGDTLLHVAISKRRPDLVQLLLEFNADVESKNRSGETALESACSSGEELIVELLLAHKANTERTESSSLGAIHLSAREGHVEVLRLLLMKGARVDSLTKDGYTALHLAVREGLRDCVRLLLANEGRTDIRDSRDGDTCLHVAAGVGDESMVKLLLNKGANKEVRNFKGETAYDVAVEKGKASVFDALRLGDGLCVAARKGEVRSIKRLIEGGAAVDGRDQHGWTALHRACFKGRVEAVRALLLERGVEVDARDEEGYTALHCAVEAGHGDVAEVLVKRGVDVEARTSKGVSALQIAEALGYGGIAR

SEQ ID NO: 153190 - protein, 258 aa, Glycine max
  Coding DNA Sequence Number=SeqID_36412
MQVGGCSIYGGTHESGACMTQDYSSKEVNYMANSNRQGQGWRSHPGNHFNKDQGGPSNQPPNQGPNLYEWTTKLEDTLTQFMPVSMSNHKSTESAIKNLEMQVGQLAKQLDEKSSRNFGANTEKNPKEECKVVITRSQGRMLVERGSKKGEGELEDDEKQEEKEEQMKEEEISKKKEVEGEEKNKKRDTKGVERQERREKENQSPLQPRKPYIPWYLQGRTRSDTLLTSRIKNQVSRFKVPRVKIKIQDTRFKNQEKT

SEQ ID NO: 153191 - protein, 540 aa, Glycine max
  Coding DNA Sequence Number=SeqID_36413
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=82%, HitCoverage=33%, E-value=1e-58, Identity=33%"; Hit description=Chromo
MADSTHSKTTLDRIEEVVAKLASSHLHFSEKLDDLINRVVALENTPHHSSSLSSSSANPAPQPQTLNPHRLKLDVPRFDGSDPSAIEARFAQSPYEDPTGQLFKLTQRGSVREYLAQFEALANRITGLSPSSLLSYFIPGLEPDIRREVQALQPMMLVHATGLARLQEEKLQEHCKGPWSRSTFNPSPSSSTPLSVALPTPPLPLLPSPAKPLPLPIKRLSPDELANKDTGDDNSNPNIVSLPLTPDPTQPEITNNPSPTQTQPKSFQAQISLHALSGQTASETMHKTGQNSHQPMVILVDDGSTHNFVQARLVKSLGLTPQPTPTLWVLVSNGNEVEWVQWLKSLDPVLTNYNDLTMKFIHGGKLIELKGNSDMTSLVISPPQLRRLLQTDSASELFHIQVCSQAPPPSTPHPTILTIIDQFSALFQPPTTLPPSRTTNHSIHLLPNTVPVNIRLYRYPHFQKQQIKSQVFVMLQNGIIHPSTSPFSFSVLSRRGMAHSASAWIIACSMRSPLRTDFQFPPLMNCWMNWVVDRGRTRIK

SEQ ID NO: 153192 - protein, 185 aa, Glycine max
  Coding DNA Sequence Number=SeqID_36414
  Homolog annotation: Hit_ID=Q1RUD8; Match level="QueryCoverage=84%, HitCoverage=32%, E-value=6e-11, Identity=31%"; Hit description=IMP dehydrogenase/GMP reductase
MGTNQNGKRFYQVKVKSLDFTSLKELGRLMGPLQRHAFRKVYRKILDLTAAGVFTEAVVFLAQYYDQPLRCFTFGDFQMVSTIEEFEEILGCPLGGRKPYLFSGFLPSLSKIAAVVGDSAKELDRMKQTRNGVVGLPRKYLEGKARDMWTVWWDLAAIDAFLAYHHSKESPVVAILADLFDTFDR

SEQ ID NO: 153193 - protein, 136 aa, Glycine max
  Coding DNA Sequence Number=SeqID_36415
MDDPRKMKHMVSPLWIIQLWVNAILANNITLKRNILDDIELKIEGAQNKLTKFRDSMQDTSKMSNDLKILPLLKELLFPKFTMVPIKIPHQRDTNNWEDNDGKGTSKKVSSRKRKTPSSISTGNKSFDPENFQERR

SEQ ID NO: 153194 - protein, 154 aa, Glycine max
  Coding DNA Sequence Number=SeqID_36416
  Gene Ontology: Mol. function=chromatin binding; Cellular component =chromatin; Biological process=chromatin assembly or disassembly
MGGPLPGLHCGPSLISRQLSYFSHGRPFLEGTSPGYTSTTSHCRQRCKTIHGNLRQAPQNAKEPSLRQGIVVYESFLAGIIQTKRHQAPYELVVSPTVRWANRGHEPRHRAIFMSLHASETIHMGSYNTSTQGQKGEAIGHDTWKITWKNEMSS

SEQ ID NO: 153195 - protein, 84 aa, Glycine max
  Coding DNA Sequence Number=SeqID_36417
  Pfam annotation: Domain name=Dehydrin; Domain location=2-84; Score =35.0; E_value=2.7e-07; Accession=PF00257.10; Description=Dehydrin
MSGIIHKIEETLHVGGHKKEEEHKGEHHGGEHKGEQHGEEHKEGFADKIKDKIHGEGEKKKKEKKKREHGHEDGHDSSSGSDSD

SEQ ID NO: 153196 - protein, 124 aa, Glycine max
  Coding DNA Sequence Number=SeqID_36418
  Gene Ontology: Mol. function=RNA-directed DNA polymerase activity; Cellular component=chromatin; Biological process=RNA-dependent DNA replication
MALQTLTDNSFVLKLSKCSFATQQVEYLGHLVSAKGVEPVPAKVAVVQQWPTPQSTRALRGFLGYATIAAPFTPLLAKDQFHRTSEAGQAFSKLKEALCQAPVLGLPDFNSLCKPINNKFILQD

SEQ ID NO: 153197 - protein, 133 aa, Glycine max
  Coding DNA Sequence Number=SeqID_36419
WCRCNGDGDDDNGDEGGIVAAMMVAIVVECPKVWASQVAYLIDHALNRYDLVGFVVKLMAHCPRLGHVQRRKRARSCESIKNNGNDNNNNDGGNEMVVVVTVEWWCWGMWWTRQRCWCGDGDRSGGDGASGGG

SEQ ID NO: 153198 - protein, 186 aa, Glycine max
  Coding DNA Sequence Number=SeqID_36420
  Gene Ontology: Mol. function=nucleic acid binding; Cellular component= membrane; Biological process=DNA integration
MSVNGVWELVEFLENYKEIGCKWVFKTNKDSDGNIERFKAKLVVKGFIQKEGHFDLELHLMVMKTNFLNCDLSETIYMQQLEGFHTGGSENLLSRLSKGQCPKNDVEQAEMKDRPFGSALGCLTYAQVDTKKVMRYLNKTKEYMLRYRRVGNLKVLGYIDSDLGGCPDDRKSTSRFIFIMDGGVIS

SEQ ID NO: 153199 - protein, 37 aa, Glycine max
  Coding DNA Sequence Number=SeqID_36421
MEALDTDQVKFPSGSKSAFIILKIGKDFVLDGSSWKH

SEQ ID NO: 153200 - protein, 488 aa, Glycine max
  Coding DNA Sequence Number=SeqID_36422
  Gene Ontology: Mol. function=nucleic acid binding; Biological process= DNA integration
  Pfam annotation: Domain name=rve; Domain location=276-410; Score =14.1; E_value=0.0004; Accession=PF00665.16; Description=Integrase core domain
MKQLMDMRYDNVGGVREFIMKMVNIRTKLKSHKIDFNKKFIVEHALNCLFADFTQIKIAYNTIGQKWTMNDLITKCVAEEEKLKKEKSDIALLSVHSKPTSGKGHWKNTKSTSNASNKYQDYGKPGKKKGHKKADCRMFKAWLEKKQESKDSWWLDSGSTTHIVVSLQRFRNMREPSLRESKLRVGNDLEVFMEKVGDILIMFVHPWLLKVLSLKGLKLKKNLVLWHKRLCHISMERVERLTKTNILPSLNFDGLGTCVDCIRGMFTKTKKKGATRSLDLLGIIYTNISGPLTPTICEKFEALEKFKIFKTEVEKQLGKIIKVVRSNRGGEYYGKYGATGQHMGPFALYLQDCGIVSQYTMPETPEHNGVAERCNKTLKDMMRSMKKTDPKTSCFFFIGYPDHAKGYRFFCPGSRSKIVESMNANDVDTESPEIVSLPLPIPDVGIYNAIPVETIVATKDIVGPQANDVIDPPSVDENNQLSRFNRFL

SEQ ID NO: 153201 - protein, 242 aa, Glycine max
  Coding DNA Sequence Number=SeqID_36423
  Gene Ontology: Mol. function=structural constituent of cell wall; Cellular component=extracellular region; Biological process =cellulose and pectin-containing cell wall organization and biogenesis
  Homolog annotation: Hit_ID=Q9M1H0; Match level="QueryCoverage=63%, HitCoverage=70%, E-value=2e-09, Identity=34%"; Hit description =Extensin-like protein
MTGSLDESIPCFLIMMDPWVLVTLTVRGLHVLALRGLHVLTTRGLHALTSRGLYVLALRGLHALTYGTSYPHRQRTTRPHLERTTRPHHQRAARPHLQRTTCPRLERATRPHLGLHVLTTRGLHALTSRGLYVLSLRGLHALTLGTSYLHLQRTTRPRLQRVMYLQLQRTTRPRRQADAGRNTTATLGWPVAGNRHTATTSKVHLSSSIKRLECCLRHMADQQATKSKAKGKQSIRSVTDKS

SEQ ID NO: 153202 - protein, 93 aa, Glycine max
  Coding DNA Sequence Number=SeqID_36424
MKNCFAVFSSFSCDWLASVKVKVKVLVFIVAVVGSSSTTYELISKRLTDQLEEEEDTTTCTKSTGLKKNGARARRRRVAEEERAKEGESTITA

SEQ ID NO: 153203 - protein, 274 aa, Glycine max
  Coding DNA Sequence Number=SeqID_36425
  Homolog annotation: Hit_ID=Q5R170; Match level="QueryCoverage=33%, HitCoverage=89%, E-value=2e-25, Identity=61%"; Hit description=DSBH domain containing protein
MGDGRGDDGIRRHALTGEKDASDDGGDYGLISAEAFYPASDRSGWLSIGVYTFACQQDVNRALESEQTKRVMADVVHFTDATTASRQQKRDALVPNQDKPIPESENLRVPKPGNLSILPALITSALNCTGPINPTNGISMTKQEVFAVMDGCVDMFYKQAGEVRTQRLTAGDIFYASEGTEHVAHPQGVARVLVIEQAGSSAGSSRSPRAEYTASSDNALPTGASPRRLGRRLVPVRSANIPYRRCHLTPDNSQARRLRPAVLAVTPGYFLPAQ

SEQ ID NO: 153204 - protein, 202 aa, Glycine max
  Coding DNA Sequence Number=SeqID_36426
MASRKRKSATSRPQAQYDTKRFQSLEAWNRYTDNILDWRILPEKNVKIYHTEFDEFKAEMERRNLHKRLANLQDGSIDVAVVKEFYANLYSPEDQTPKQVRVRRHLIKIDADSLNTFLETPVVLEEGETQPTYSRFTRMRIDPQEFSTCLYIPGRGFVLNVEGHPWKLLRKDLTTLAQTWSVFSYNNLTPTSHTSDLNMDRA

SEQ ID NO: 153205 - protein, 56 aa, Glycine max
  Coding DNA Sequence Number=SeqID_36427
MSCTGSLRALLHLTKRTASVHRLSEKGALSQKSLTCAKRSIHLQRPELETRAGLRA

SEQ ID NO: 153206 - protein, 138 aa, Glycine max
  Coding DNA Sequence Number=SeqID_36428
  Gene Ontology: Mol. function=DNA binding
  Homolog annotation: Hit_ID=Q1SFS3; Match level="QueryCoverage=92%, HitCoverage=27%, E-value=7e-14, Identity=34%"; Hit description =Lambda repressor-like, DNA-binding
MANQEEWVPFIDVLALLIFGVVLFPNVDGLVDLAAIDAFLAYHHSKESPMVAILADLFDTFDEDVKRVVHGSSVVYPLFIVDWDQHLAGIGGRTVNWFPRWKEGKEGVLFSCGSYPNIPLIGMRGCINYNPALSIRQL

SEQ ID NO: 153207 - protein, 104 aa, Glycine max
  Coding DNA Sequence Number=SeqID_36429
HISKYCRLKTKLRNLNLEPAIEEQINNLLIETSEEETKTSSFVLSDENLNIIQQDDQLSSTDDDGQINTLTRDKISCLKQSILYLTPGKEDFSGKTQENIRGKT

SEQ ID NO: 153208 - protein, 247 aa, Glycine max
  Coding DNA Sequence Number=SeqID_36430
  Gene Ontology: Mol. function=ribokinase activity; Biological process =D-ribose metabolic process
  Homolog annotation: Hit_ID=Q1SXC3; Match level="QueryCoverage=99%, HitCoverage=71%, E-value=1e-108, Identity=75%"; Hit description =Carbohydrate kinase, PfkB
IYTPGDPPMMPDDLSQSTLLSAFDGARLVYFDGMFPETALFVAQEAARNNIPILVEAESLREGLDELLKLADFVTCSAKFPQAWTQAPSIPSALVSMLLRLPNINFVVVTLGEGGCLMLERSANGKGTADSDIEERDVESFLEFLYKGKDDSLAIPTCIPSAVTKFRANGIGTICGRFYIGTAEKIPDSELIDTTGAGDAFIGAIMYAICANMVPEKMLPLAAQVAAAKCRALGARTGLPRRTDPHV

SEQ ID NO: 153209 - protein, 242 aa, Glycine max
  Coding DNA Sequence Number=SeqID_36431
  Gene Ontology: Mol. function=ribokinase activity; Biological process =D-ribose metabolic process
  Homolog annotation: Hit_ID=Q1SXC4; Match level="QueryCoverage=99%, HitCoverage=65%, E-value=3e-96, Identity=74%"; Hit description =Carbohydrate kinase, PfkB
MKPDDLPESNLLTALNGARIVYLDGRLHETALVVAHEAVKKNIPILIDAERLREGLDDLIKLADYVAWTEASTVSKALVCMLLRLPNIKFVIATLGKDGCIMLERCVNEDPSAEEVVVDKLLESLEMRKNGSTHIPTCISSTFHLYPFLFQPVTKLHAEGIGTVCSRLYIGTAKNIPPSELIDTTGAGDAFIGAVLYAICANFEPEKMLCFAATVAASKCRALGARSGLPYRIDPCLASFMQ

SEQ ID NO: 153210 - protein, 68 aa, Glycine max
  Coding DNA Sequence Number=SeqID_36432
MRWKIYTTQPACMGKARERKLERESERDLERERERGRGEEGRGELRDFNAGGSVVDSDTVDHSSTVGA

SEQ ID NO: 153211 - protein, 81 aa, Glycine max
  Coding DNA Sequence Number=SeqID_36433
  Subcellular localization annotation: CTP_CleavageSite=30; ConfidenceScore=5.46e-01
MTAGGCSAGISPPAGHSFKPLLSPDDALRRCRVRRERMPVSVVFLLALLNLLFSCQVTCQVQGQSLRLGMYMSASASSVAW

SEQ ID NO: 153212 - protein, 691 aa, Glycine max
  Coding DNA Sequence Number=SeqID_36434
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=77%, HitCoverage=98%, E-value=0.0, Identity=71%"; Hit description=CMV 1a interacting protein 2
  Pfam annotation: Domain name=APH; Domain location=312-489; Score= -16.1; E_value=0.081; Accession=PF01636.13; Description =Phosphotransferase enzyme family
  Pfam annotation: Domain name=Pkinase; Domain location=309-582; Score =148.9; E_value=1.4e-41; Accession=PF00069.15; Description=Protein kinase domain
  Pfam annotation: Domain name=Pkinase_Tyr; Domain location=309-582; Score=146.5; E_value=7e-41; Accession=PF07714.7; Description=Protein tyrosine kinase
  Pfam module annotation: Pfam domain module=APH::Pkinase::Pkinase_Tyr; Domain location=312-489::309-582::309-582
MWFVKPSSGPSSAPVPSPSYHGPHVTPRPRHHYHHRHHHSTRPYVAAPPPSKDQACDQICTDPLTSTPFGSPCGCVFPMKIRLTLDIAPYAVFPVMTELENEIALGTYLEQSQVKIMGATADSQNQGRTIVDINLVPLGEKFDNTTASLTYERFWHKKVPLNRSLFGDYAVVYITYPGMPSSPPYGSLTGSGPSQSVDGILPVSANFVSKNQKMNLRTIIIIALSSFVLLLVLVGAFSIILKWRKTRRPSSAVGPAFTSSLNKRSGLGSMLSSSITSSTSMSLMSTMATSLLSVKTFSLSELEKATDKFSSKRVLGEGGFGRVYSGTLEDGAEVAVKLLTRDNHQNGDREFIAEVEMLSRLHHRNLVKLIGICIEGRRRCLVYELVRNGSVESHLHGDDKIKGMLDWEARMKIALGAARGLAYLHEDSNPRVIHRDFKASNVLLEDDFTPKVSDFGLAREATEGSNHISTRVMGTFGYVAPEYAMTGHLLVKSDVYSYGVVLLELLTGRKPVDMSQPQGQENLVTWARPMLTSREGVEQLVDPSLAGSYNFDDMAKVAAIASMCVHPEVTQRPFMGEVVQALKLIYNDTDETCGDYCSQKDSSAQESDFRGDLAPSDSSWWNAGGLTPRLTYGQASSFITMEYSSGPLEEMENRPFSTSSLIGDEISLPEVGVSMEDLLPSVIGMMATGFN

SEQ ID NO: 153213 - protein, 983 aa, Glycine max
  Coding DNA Sequence Number=SeqID_36435
  Homolog annotation: Hit_ID=Q10SS1; Match level="QueryCoverage=48%, HitCoverage=67%, E-value=4e-90, Identity=41%"; Hit description =Expressed protein
  Pfam annotation: Domain name=DUF726; Domain location=492-853; Score =159.2; E_value=1.1e-44; Accession=PF05277.3; Description=Protein of unknown function (DUF726)
  Pfam annotation: Domain name=GYF; Domain location=32-87; Score=30.1; E_value=7.6e-06; Accession=PF02213.6; Description=GYF domain
  Pfam module annotation: Pfam domain module=DUF726::GYF; Domain location=492-853::32-87
ARLEASGVAVDVSSLLLSPKMELPINNFVNDKPWHYQDPTGKVQGPFSLLQLYKWDAFGYFPPDLRIWSVDETQDNSIFLTDVLSGKCTNNVSLPNNSQQLSLGTNSTLENKDNGQDGGENENNLSRNENSANHQIVERCEEQKVSDTCTQSNGKDESVRSNGWNSQSPGLTIQADGNNNEGQSGNSERREESPKCEISCHDVPHVYASLPSTVFSEKLNENPSDKLTEVHKIEVKSEDNGNFDLNKISEGRSNSGQSCQKQSDSEENSGLSSGQNWRCPDVTNPVCNISTWLSIFGEPNDLDESVSDLLAEVEAMESLGGLESPTSIMKCGEELTDGSITDCLSFADALSPMLDAGKGDALSSSGDLHLPSQTTTPDDPLKQADVHHHPQKISGEHSTKSSEVETHIRDLLEVIWMRFQLRKVTVLYELLSACLSDLGENNKKFSRRRKGYDAQQRVTLRLLATWLDIKWAKMVEQEASKEEIQSNEDKWAKWKRGGIIGAPALTGGTLMAITGGLAAPAIAAGLGALAPTLGTLIPVIGANEFAAAASAAGTVAGSVAVAASFGAAGAGLSGSKMARRVGDVDEFELKAVGKNHNQGRLGIMIMVSGFVFEDDDFIRPWEVLDDNLERYALQWESKNLFSLSTAIQDWLSSRIATELMKQGATMTVLHALLTALAWPAALLAATEFIDSTWTIAIDRASPGAAVKLCLGDLLVMGSNPETASLHMQGSDKAGKLLAEVLLGGLQGNRPVTLVGSIEFLAETENSAELVERVVLLGLPIAIKDENWEAARKMVAGRFVNAYSRNDWMLGVACFPCQCRPFAPLPFFLPPNFTCRPNAAFRQHDTRRRKLRFFRSGVLERRKRLLVCSGSTVSIFSTATGSLVSSLEGHTAVVVVPSSTGLSYCWTASVDGTICHWDFSVPECVKIIDLCLPIFSMTANVIAYVSVQDINAPDNHPKPLYGQIRKCNFVLSFGTVVGYEEDEA

SEQ ID NO: 153214 - protein, 477 aa, Glycine max
  Coding DNA Sequence Number=SeqID_36436
  Gene Ontology: Mol. function=molecular_function; Cellular component =cytoplasm; Biological process=transport
  Homolog annotation: Hit_ID=Q9FND4; Match level="QueryCoverage=93%, HitCoverage=84%, E-value=1e-151, Identity=58%"; Hit description=WD -repeat protein-like
  Pfam annotation: Domain name=WD40; Domain location=157-195; Score =38.4; E_value=2.5e-08; Accession=PF00400.22; Description=WD domain, G-beta repeat
  Pfam annotation: Domain name=WD40; Domain location=216-254; Score =29.4; E_value=1.3e-05; Accession=PF00400.22; Description=WD domain, G-beta repeat
  Pfam annotation: Domain name=WD40; Domain location=258-298; Score =10.2; E_value=2.4; Accession=PF00400.22; Description=WD domain, G -beta repeat
  Pfam annotation: Domain name=WD40; Domain location=302-340; Score =2.1; E_value=21; Accession=PF00400.22; Description=WD domain, G-beta repeat
  Pfam annotation: Domain name=WD40; Domain location=342-380; Score =9.3; E_value=3; Accession=PF00400.22; Description=WD domain, G-beta repeat
  Pfam annotation: Domain name=WD40; Domain location=385-426; Score =13.3; E_value=0.89; Accession=PF00400.22; Description=WD domain, G -beta repeat
  Pfam annotation: Domain name=WD40; Domain location=430-469; Score =48.3; E_value=2.5e-11; Accession=PF00400.22; Description=WD domain, G-beta repeat
  Pfam module annotation: Pfam domain module=WD40::WD40::WD40::WD40::WD4 0::WD40::WD40; Domain location=157-195::216-254::258-298::302 -340::342-380::385-426::430-469
MRLSCLNHVFRMGIGIESIGYLNSIKNVLGETRESTLFLVFKQCVMEYLNCGEDALALGVLRKQVSALDVDKCKVHSLAKCLLSFNKDRELGAVDGGDVVVVVHDLLKKLLEDLEKLFPPPVSVPEGRLEHLVEIRRIQFPFMRNEDHHCSRDQIPTSTTQILTGHKNEVWFVQFSNNGEYLVSSSNDCTAIIWKLSKGYYGIQCVGDKVLEDGKLTLKHTLCGHQHAVSFVAWSPDDTKLLTCGNTEVLKPWDVETGTCKHTFGNQGFVVSSCAWFPNSKQFGCGSSDPEKGVCMWDCDGNVIKSWIGMRMPKVVDLAVTPDGEYLISIFMDKEIRILHMGTSAEQVISEEHPITSLSVSGDSKFFIVNLNSQEIHMWDVAGKWDKPLRFMGHKQHKYVIRSCFGGLNNTFIASGCENSQVYIWNCRNSRPIEVLSGHSITVNCVSWNPKIPQMLASASDDYTIRVWGPSLQKKEG

SEQ ID NO: 153215 - protein, 138 aa, Glycine max
  Coding DNA Sequence Number=SeqID_36437
  Gene Ontology: Mol. function=zinc ion binding; Cellular component =nucleus
  Homolog annotation: Hit_ID=Q7XCX5; Match level="QueryCoverage=54%, HitCoverage=4%, E-value=1e-22, Identity=60%"; Hit description=Plus-3 domain containing protein, expressed
  Pfam annotation: Domain name=PHD; Domain location=81-129; Score=32.3; E_value=1.7e-06; Accession=PF00628.19; Description=PHD-finger
MEPQLQPKLDPAPEVVSGGGGDSEKSHVSDVTEVRDVDMAQANGACCPSVLKRKRGRPAKGNRVPKGIIPPSRQKQEEEDVCFICFDGGSLVLCDRRGCPKAYHPSCIKRDEAFFRSKAKWNCVFCVPSDYCKLRSSD

SEQ ID NO: 153216 - protein, 53 aa, Glycine max
  Coding DNA Sequence Number=SeqID_36438
MGGIWELGFRRGRSDEVSGHTELKNGLGAYIVNEWTKATLTSVRFCVSRTARA

SEQ ID NO: 153217 - protein, 133 aa, Glycine max
  Coding DNA Sequence Number=SeqID_36439
MISTNDKELVLNGPMSVKNLCEFCIKFIRKNERVAFKWNDINQEFEVIINHKCLYKTLKNKRNLRLKDNYAIGENVVAFSMDPNVDEVVELWNMDDEEKDKEIDREGKTLIIREMEVLFIKNIIDMFLKWKIC

SEQ ID NO: 153218 - protein, 178 aa, Glycine max
  Coding DNA Sequence Number=SeqID_36440
  Homolog annotation: Hit_ID=Q69L12; Match level="QueryCoverage=80%, HitCoverage=37%, E-value=2e-40, Identity=55%"; Hit description =VirR/VirH-like protein
METKAKRVYSFIYAISIPIPIHSPCSSLSLAEINFAAYVLKRKWNHLNSKIEELEASLKSFSDNCASERQGRIRAQQALRKEVTQSQPNSQKLNLTSYPMMPIGVVHSCFSTRNGTPRQPLLVPLARACLVFNTTRVPPASLEGLEEYSHCWILYVFHLNTDLDKLWKHPSKSGFKAK

SEQ ID NO: 153219 - protein, 1272 aa, Glycine max
  Coding DNA Sequence Number=SeqID_36441
  Gene Ontology: Mol. function=nucleic acid binding; Cellular component= nucleus
  Homolog annotation: Hit_ID=Q7XCX5; Match level="QueryCoverage=52%, HitCoverage=42%, E-value=3e-94, Identity=37%"; Hit description=Plus -3 domain containing protein, expressed
  Pfam annotation: Domain name=GYF; Domain location=650-704; Score =25.2; E_value=0.00022; Accession=PF02213.6; Description=GYF domain
  Pfam annotation: Domain name=Plus-3; Domain location=376-483; Score =140.8; E_value=3.7e-39; Accession=PF03126.8; Description=Plus-3 domain
  Pfam annotation: Domain name=SWIB; Domain location=246-321; Score =91.3; E_value=3e-24; Accession=PF02201.9; Description=SWIBMDM2 domain
  Pfam module annotation: Pfam domain module=GYF::Plus-3::SWIB; Domain location=650-704::376-483::246-321
MEQPLQPQPETAAGGARDSEGSRLVGVPVAVARDADVAEREGNSCAPNLQVTVVDVGAVLKRKRGRPAKGAPKVVPPVRQQQDEEDVCFICFDGGSLVLCDRRDNKGLCGICMRTIMMIENSAQGNNEKCEVDFDDKSSWEYLFKVYWMYLKGKLSLTFDELLRAKNPWKGAAPMSYKIQSPHELYHLRDDKGSGSENSCIDIESNNLKNKKPKRQPKLLGKGDCLDRITSGGDSGVSLPECTKWASKELLEFVAHMKNGDTSLMSQFDVQTLLLEYANKNNLRDPQQKSQIVCDSRLLNLFGKARVGHIEMLKLLEPHFLLKDNGPAENTFGAGIINVVANEGEAIDNYNKQLMLVDDKRCKTHNPDAYAAIDVHNIKLIYMQRSLMENLTEDAEKIHEKVVGSFVRIRISSSDQKQDMYRLVQVVGTSKVAEPYKIGTRTTDIKLEILNLNRKEAISISEISNQEFSEDECKRLRQSIKYGLSKRLTVGEILNKAVTLQAIRVNDLLNSPEERQRRLHEIPDVHSDPNLDSMFESDEDDGESDERKQDSNIFSKYLGFDRKERGSIFPRISNGISNDMGSKTQDLPATQEPVGNTCTLKNNINSDDTAIDDSTNAVVKSEVSSVAVEVSSSLLSTGMQQSFNDFLNDRSWHYQDPTGKIQGPFSMLQLYKWNASGCFPPDLRIWRVGEKQDNSILLTNALSEKCSKNVSLPFNSQLLSLGVSVTLDDKGNSQDAGKNAKNEISTDGQIIEQTKEQKPQVDNTSTQSDGKDEPVRSNGCSSQLPVYPLLLSTAIPEKLNENTSDKLRKGHAIVGNSENRNNGSNRTSDVQSNSGQSYQKQSDSEENSGQSSGQTWRHPNVNSSSNCLVTTSAHVSSTKTSPHKLGFDLHNPPSPPACNTTSGLTWIHPNVNSSSNCLVNTSTHVSDTKPSPHKLGFDLQNPPSPPACNTSSGQTWRHPDINSSSNCLVTTSTHVSSTKTSPHKLGFDLHNPPSPPACNTSTWQAIIGEPNDFDESVSDLLAEVEAMESLGGLESPTSIMKCGEDLTEGSKNDCLSFVAELSPILDAGKGDALSSTGDLNLPSHPTAAEEPLRQADVHHHHHQRISAEDSSRSSKVEVGTKNGVSGNQWDSGSENSPIVPSPGTLGLAIDTTWRLGLENTHLGWSGIDQGNANVGWGVGQTAVQENRSSKIGVFKVMVGNQVLVEAEFHITGNRHMVLEMEDHIGLCPKGSEIWCFSSNFGTLIPVIRATGFATAGSAAAGTVAALLVHHME

SEQ ID NO: 153220 - protein, 426 aa, Glycine max
  Coding DNA Sequence Number=SeqID_36442
  Gene Ontology: Mol. function=transferase activity; Cellular component= nucleus; Biological process=alkaloid metabolic process
  Homolog annotation: Hit_ID=Q1T3Y9; Match level="QueryCoverage=99%, HitCoverage=98%, E-value=1e-122, Identity=52%"; Hit description =Transferase
  Pfam annotation: Domain name=Transferase; Domain location=3-424; Score=304.7; E_value=1.7e-88; Accession=PF02458.6; Description =Transferase family
MKVEVEVISKELVKPSSPTPNHLRHYNLSLLDHLTPQLNNSMVYFFAANNVSNQFLNTCTENASNHLKKSLSEALTHYYPLAGRLVDKAFIECNDEGALYLEAKVRCKLNDVVESPIPNEVTNLLPFGMDDIVDTPLGVQLNVFECGGIAIGACMSHKIADAMSFFVFIQTWAAIARDYNEIKTHFVSASLFPPRDIPWYDPNKTITKPNTVSRIFVFDASVIDGLKAKYAEKMALQKPPSRVEALSTFIWTRFMASTQVAASESSKFYVVAHTVNLRSRMDPPLPAHAFGNYYRAVKAFPSLDDKGECYELVEKLREEIRKIDNEYILKLQEGSEYLSSLREDLRRFENIKGEIVPFTFTALCRFPVYDADFGWGKPIWACPPAWKVKNVVVFTDTKFGGGIEAHISMMEEDMARFQNDKELLLH

SEQ ID NO: 153221 - protein, 81 aa, Glycine max
  Coding DNA Sequence Number=SeqID_36443
MRESHDATVRLLTCDLELMGSNPRKLSACILPKPRLVELGSLVHYGLEKKSLYASPGELQSLIKQVLSWDISVIEPAKSAT

SEQ ID NO: 153222 - protein, 194 aa, Glycine max
  Coding DNA Sequence Number=SeqID_36444
  Homolog annotation: Hit_ID=Q1SU57; Match level="QueryCoverage=46%, HitCoverage=70%, E-value=1e-11, Identity=30%"; Hit description=Zinc finger, CCHC-type
MRMSFQDKVWDQQVPFPRKERGLWRIIGGYNVIDIGHGFFMVKFDLAQDREKVILGEIDLSKPVVRKVWFKNHWFHVEYEGLYLLCKTCGLYHKDWPKLKKGDMLVVGKSKCGGDREDFYGDWLVVTKEEEGRYSHGRASVTVSEHHMESQWQENEGQGKMHMVEVTSNQDGRLKKEKPLDITQNEMMVEGVIG

SEQ ID NO: 153223 - protein, 316 aa, Glycine max
  Coding DNA Sequence Number=SeqID_36445
  Gene Ontology: Mol. function=hydroxymethyl-, formyl- and related transferase activity; Cellular component=chloroplast; Biological process='de novo' IMP biosynthetic process
  Homolog annotation: Hit_ID=Q7XJ86; Match level="QueryCoverage=99%, HitCoverage=99%, E-value=1e-126, Identity=75%"; Hit description =Glycinamide ribonucleotide transformylase
  Pfam annotation: Domain name=Formyl_trans_N; Domain location=106-288; Score=236.4; E_value=5.9e-68; Accession=PF00551.9; Description=Formyl transferase
  Subcellular localization annotation: CTP_CleavageSite=87; ConfidenceScore=5.44e-01
MEGRQILSRFCPKSSSVSSIPIVKQQYSLKFPLLPSSSSHLSSQSQNLDVPSRAVHPISIVHKEVCSSSWRRIWCSSSSSSSSSSSSAAEPKEGHEVTAQVTVGRKKLAVFVSGGGSNFRAIHEASKRGSLHGDVLVLVTNKSDCGGAGYARNNGIPVILYPKAKDESNPSDLVETLRKFKVDFILLAGYLKLIPVELIRAYERSIFNIHPSLLPAFGGKGFYGMKVHKAVIASGARFSGPTIHFVDEHYDTGRILAQRVVPVLANDTAEELAARVLKEEHQLYVEVVEALCEERVVWRKDGVPLIQSKENPNEFR

SEQ ID NO: 153224 - protein, 108 aa, Glycine max
  Coding DNA Sequence Number=SeqID_36446
  Gene Ontology: Mol. function=metalloendopeptidase activity; Biological process=proteolysis
  Homolog annotation: Hit_ID=Q9LHR6; Match level="QueryCoverage=98%, HitCoverage=21%, E-value=2e-35, Identity=66%"; Hit description =Arabidopsis thaliana genomic DNA, chromosome 5, TAC clone:K3D20
CGLTIQAFNMLPVGCLDGGRAVQFGIGGKGKTLKNKTLYLGGPLSLPWGLYVLLCQRAPEKPCLNDVTEVGTWRKALVAIAIFLVVLTLVPVGDELAEELGIGLVTAF

SEQ ID NO: 153225 - protein, 92 aa, Glycine max
  Coding DNA Sequence Number=SeqID_36447
MEVAVRSGVRLCKGFVRILTFEEINALPNDLVNMSIQPISNNIDGLHLDDDEHGDAQENAMEDVNQNESNVRESSDFMDGEHIRGPEFDDAT

SEQ ID NO: 153226 - protein, 356 aa, Glycine max
  Coding DNA Sequence Number=SeqID_36448
  Gene Ontology: Mol. function=metalloendopeptidase activity; Cellular component=chloroplast thylakoid membrane; Biological process =proteolysis
  Homolog annotation: Hit_ID=Q2HVB8; Match level="QueryCoverage=99%, HitCoverage=100%, E-value=1e-130, Identity=68%"; Hit description =Peptidase M, neutral zinc metallopeptidases, zinc-binding site
  Subcellular localization annotation: CTP_CleavageSite=25; ConfidenceScore=5.04e-01
MGTLTSCSFMPLNSEFRRAFRERIQCHKLTRLRGTSCFFSRARVPKWGKSKLPNFDSLRSFATKNDNSDGDKDNSNHVGAAGEESGGDDSKSNVTTTMAEEERGFTSEKSTPPSTSHRSSLSSLGPAYNTFQVDSFKLIELLGPEKVDPADVKLIKDKLFGYSTFWVTKEEPFGDLGEGILFIGNLRGKREDVFAKLQNQLVEVTGDKYNLFMVEEPNADSPDPRGGPRVSFGLLRKEVSEPGPTTLWQYVIALLLFLLTIGSSVELGIASQINRLPPEVVKYFTDPDAVEAPDMELLFPFVDSALPLAYGVLGVLLFHEVGHFLAAFPKQVKLSIPFFIPNITLGSFGAITQIYK

SEQ ID NO: 153227 - protein, 504 aa, Glycine max
  Coding DNA Sequence Number=SeqID_36449
  Homolog annotation: Hit_ID=Q84ST1; Match level="QueryCoverage=87%, HitCoverage=82%, E-value=4e-94, Identity=41%"; Hit description =Expressed protein
  Pfam annotation: Domain name=YibE_F; Domain location=162-345; Score= -150.2; E_value=0.076; Accession=PF07907.2; Description=YibEF-like protein
  Subcellular localization annotation: CTP_CleavageSite=60; ConfidenceScore=5.67e-01
MRSFSSSSLFLLFFFFFSSSLSNPHNTPLTLKGVDIQKPVLEFSPSGVSSGSQGVRDALRCERVLVSGTSRLKLGSYANSYRVTLAPSVSIPEKLHSKIQVCFHRNDTLGWCQCEKDEWRGVQKGVWNAVMSPYETRYVDVRINGEISGSVIVAIEEDFQQWRLVCLAVGLILLLLAPTVSRWVPFYYSTSMAIGIFLVIIILLFQGMKLMPTGRKNIFYLTLYTSVVGVGSFLLHQFSLILNSIFQSLGMSEEMHNPVAVFVILGIILAGAALGYWIVRRFVISKEDGCVDAGVAQFVKWAMRIIGTTFILQSTLDPLLAIGALISCGAACKLISAIKWLCGWYETSNDYYSPQWMRGRHGRAEFLSKSNPKGKHWSSPKGKSWNSPRRSAWSDSPVRGVVSPFSGISSQSSGTQAGLDYYSTFHKTRNRKKFTKQEWDEFTRESTKQALAEWAASPEFTDWIVEHADRIQVLPSESSDETMGSESDSTDRGSRSGFRLFNWQ

SEQ ID NO: 153228 - protein, 396 aa, Glycine max
  Coding DNA Sequence Number=SeqID_36450
  Gene Ontology: Mol. function=protein binding; Cellular component =nucleus; Biological process=ubiquitin cycle
  Homolog annotation: Hit_ID=Q2HVB4; Match level="QueryCoverage=94%, HitCoverage=89%, E-value=1e-139, Identity=68%"; Hit description =BTB/POZ; MATH
  Pfam annotation: Domain name=BTB; Domain location=163-285; Score =90.0; E_value=7.2e-24; Accession=PF00651.21; Description=BTBPOZ domain
  Pfam annotation: Domain name=MATH; Domain location=12-139; Score =44.6; E_value=3.3e-10; Accession=PF00917.16; Description=MATH domain
  Pfam module annotation: Pfam domain module=BTB::MATH; Domain location= 163-285::12-139
MEIVNGSHNFEIKGYSLTKGMGVGKYIRSETFTVGGYQWAIYFYPDGKYPEYKFTYVSIFIALLSKGTNVRALFDLMLLDQSGQGNHKVHFSPSLHNAPYTLKSCGSMWGYKRFYRRRKLEASTFLKDDCLKINCTVGVLVSSIDSTKLNPIQVPESDLGADFAILLENEQFSDVTFTVSGERFHANKLVLVARSTVFQTEFFKGMEKDDRGDIVVNDMEPKVFKALLHYIYRDTLIEDEELFMLHSSLLPSLSESFPAKLLAAAEKYELPRLKLMCESVLCKDISIDSVAYILPLADRYRATELKSICLKFSAQNLRAVMQSDGFKYLKQNCPWLLVELLKTVGGCEEKFSGKRKYATMRGQSSGGDDTGARSVNKTEGSPSLREDTHSESVHQQ

SEQ ID NO: 153229 - protein, 161 aa, Glycine max
  Coding DNA Sequence Number=SeqID_36451
  Gene Ontology: Mol. function=protein binding
  Homolog annotation: Hit_ID=Q10C73; Match level="QueryCoverage=43%, HitCoverage=16%, E-value=6e-15, Identity=60%"; Hit description =BTB/POZ domain containing protein, expressed
  Pfam annotation: Domain name=BTB; Domain location=57-160; Score=-5.2; E_value=0.012; Accession=PF00651.21; Description=BTBPOZ domain
MGIASETFRVGRHQCALYFYPYGKDLEDNSIYVSVFIALVSDGTNVCALIKFTLLDLREQRKHFVAVENHYDKLVLAAQSTVFETRFFDGMEKNDREIIVVTDMEPKVFKVAYVLIINSAGTPIEDEELYMSRSSLLPLLSESFPAKLLAAAENMISQDLS

SEQ ID NO: 153230 - protein, 256 aa, Glycine max
  Coding DNA Sequence Number=SeqID_36452
  Gene Ontology: Mol. function=protein binding; Cellular component =nucleus; Biological process=ubiquitin cycle
  Homolog annotation: Hit_ID=Q2HVB4; Match level="QueryCoverage=89%, HitCoverage=75%, E-value=4e-64, Identity=66%"; Hit description =BTB/POZ; MATH
  Pfam annotation: Domain name=BTB; Domain location=107-222; Score =40.3; E_value=6.8e-09; Accession=PF00651.21; Description=BTBPOZ domain
MAMYSPVAASRSVLAAQASSRLVTQMVKGSHKFEIEGYSLTKGMGVGKFIASKGFRQPYKWRHLEVSNFLKDDNLKFNFTVVVLVSSIDSSKLNTIQVPESDMGAHFGLLLENEEFTDVTFSVGGERFHAHKLVLAARSTVFGTEFINKMEKDDRGDIVVNMTWNLRFSRDTLIEDEGLFMPCTPFLPSLSESFPVKLLEPAEMYELPRLELMCESVLCKDISIDSVAYILVLADRYHAVESNFHLSKLFCSKPPW

SEQ ID NO: 153231 - protein, 120 aa, Glycine max
  Coding DNA Sequence Number=SeqID_36453
MIQVLLEEEMLINYYQDWARALQDTKPNEFLQQHHSRVSWIPPVQSRLKSNVDAAFFNEMNYTGYDNKEVADKRLLSLNPTYAVGFLRRHSMELLMLWLRHLHPSLVFKFSIKLPISLLI

SEQ ID NO: 153232 - protein, 60 aa, Glycine max
  Coding DNA Sequence Number=SeqID_36454
MGYGTSWRWCDLVQRGSIVMILRLIERFQESGKWWHEVRKILHPLFIELMEKTHLTSVQE

SEQ ID NO: 153233 - protein, 191 aa, Glycine max
  Coding DNA Sequence Number=SeqID_36455
  Gene Ontology: Mol. function=protein binding; Cellular component =nucleus; Biological process=ubiquitin cycle
  Homolog annotation: Hit_ID=Q2HVB4; Match level="QueryCoverage=87%, HitCoverage=50%, E-value=3e-46, Identity=50%"; Hit description =BTB/POZ; MATH
  Pfam annotation: Domain name=BTB; Domain location=115-188; Score= -8.5; E_value=0.024; Accession=PF00651.21; Description=BTBPOZ domain
MASRSILASRRGYSLTKRIGVGKYIASETFTVEGCIATLFELPPSRMGLTLSKAVAACGYWGYKRFYKRRQLEASTFLKDDCLKINCTVGVLVSSIDSNKLNTIQVPESDTRAQFGILLENEEFFYVTFLVGGERFHANNLVLAARSTMFQTEFFNGMEKDDHGNIIVNDMESKVFKSATAIACGHNIMIF

SEQ ID NO: 153234 - protein, 46 aa, Glycine max
  Coding DNA Sequence Number=SeqID_36456
MACEFYNQLAAVATNSWSEIHCKRGVHGGRAPVAYIHLRRWKGVER

SEQ ID NO: 153235 - protein, 71 aa, Glycine max
  Coding DNA Sequence Number=SeqID_36457
MEIVVSDIKPKVFKALLHFIYRDTLMDIEELSVPCLSLLPLLSESLPTTLLAAAENYAVMKSDSFEYLQEK

SEQ ID NO: 153236 - protein, 147 aa, Glycine max
  Coding DNA Sequence Number=SeqID_36458
MENGNVQFGDSDQEHSSGSDEFEWSVMEMVEGSNKFEKEGYSLMKGMGIRKFIMSETFTMRGSFSNEDTIKVPESDIGAHFGLLLENEEYLMLLSQLVKKGSMHICLFWVLGQLHMFETEFFNGTEKDDPGDIVVNDMEPKALLDST

SEQ ID NO: 153237 - protein, 129 aa, Glycine max
  Coding DNA Sequence Number=SeqID_36459
  Subcellular localization annotation: CTP_CleavageSite=58; ConfidenceScore=5.13e-01
MNRCCLIHKLKHQILFPRTLSFANPFSLTVVSLLHDTAFCDPSPLSPRHPRSFHVTISASELATGLVRGGFFSDCEHLGLLKTLLSILFITYLKIHSVEAVARELKDPSFRVIQNHFAILGNLGEATTK

SEQ ID NO: 153238 - protein, 128 aa, Glycine max
  Coding DNA Sequence Number=SeqID_36460
MKPHFKSLKISFGDELKDNASIEIIEARNERHIFSFRFEFIPITQSSKSPPRHASPNVGEGLPLEPSDQKTMAYFDGINDGGSLGHNAGGHIDQNTSLKIKTKKTPSERKHGKSEKSICLDVLQHYFT

SEQ ID NO: 153239 - protein, 99 aa, Glycine max
  Coding DNA Sequence Number=SeqID_36461
  Gene Ontology: Mol. function=propionyl-CoA carboxylase activity
  Homolog annotation: Hit_ID=Q9LDD8; Match level="QueryCoverage=38%, HitCoverage=6%, E-value=2e-13, Identity=86%"; Hit description =Methylcrotonoyl-CoA carboxylase beta chain, mitochondrial precursor
MKILTMKDTDRKSTCFGFVNFESPDSAVAAIERSRAWAIVYVWANDPTIKGGTYYPITIKMHLRAQEIAAQCKLPCIYFVDYVLEFFLPLGIKNFNEQK

SEQ ID NO: 153240 - protein, 173 aa, Glycine max
  Coding DNA Sequence Number=SeqID_36462
  Gene Ontology: Mol. function=oxidoreductase activity; Biological process=electron transport
  Homolog annotation: Hit_ID=Q65IT1; Match level="QueryCoverage=97%, HitCoverage=92%, E-value=5e-56, Identity=58%"; Hit description=YrkL (Putative NAD(P)H oxidoreductase)
  Pfam annotation: Domain name=Flavodoxin_2; Domain location=1-173; Score=126.7; E_value=6.4e-35; Accession=PF02525.7; Description =Flavodoxin-like fold
MANSVVNKRWLEELRRYPERYTVHELHQAYPDWQIDVAQEQRLIEAHDNIVLQFPIFWFSSPPLLKKWLDDVLTYGWAYGSRSGYKMQNKKLALAVTAGVRAEDYARDGRYRYSLEEIFRPFEVTAGYVRADYASFFAFYGREAASDGTVEPLQSHELDRSAQGYQAFLAALN

SEQ ID NO: 153241 - protein, 46 aa, Glycine max
  Coding DNA Sequence Number=SeqID_36463
MGPFDTCHSSIGFLQLFRRSAGPPNLTLSAVRVKEKEKLPSEITTV

SEQ ID NO: 153242 - protein, 328 aa, Glycine max
  Coding DNA Sequence Number=SeqID_36464
  Gene Ontology: Mol. function=receptor activity; Cellular component =outer membrane; Biological process=transport
  Homolog annotation: Hit_ID=Q1H351; Match level="QueryCoverage=87%, HitCoverage=56%, E-value=1e-100, Identity=61%"; Hit description=TonB- dependent receptor, plug
  Pfam annotation: Domain name=Plug; Domain location=29-140; Score =69.9; E_value=8.1e-18; Accession=PF07715.5; Description=TonB -dependent Receptor Plug Domain
MEVFAEEKERQDATLDVPPVVVKGILPDRLDAVPGSYQVIDEKALEARRPFSIQEALNNVPGVNVVGENTFGLGVNIGIRGLNPRRTARTLLMEDGMPLFLAPYGDPAAHYTTPLERVQRIEVVKGSGQILYGPQTVGGMINFVTRPVPTDGKVHGNVTATLGNNDFTSLYGNIGAGDERGGLMIDALHKKGDGIRDNHDFEIQEYTAKGQLNLSDRHTLIAKASYFRESSHVSETGLGLVEYHEDKYQAPTGKNDVFEHERTTFQLQHLFQVNHQVKLSTQAYYAKSERASFRQINDPGVPGWVWRLKQMQRYVAAAGALGSLSTGA

SEQ ID NO: 153243 - protein, 247 aa, Glycine max
  Coding DNA Sequence Number=SeqID_36465
  Gene Ontology: Mol. function=ionotropic glutamate receptor activity; Cellular component=membrane; Biological process=ion transport
  Homolog annotation: Hit_ID=Q84QE2; Match level="QueryCoverage=99%, HitCoverage=26%, E-value=4e-49, Identity=43%"; Hit description =Avr9/Cf-9 rapidly elicited protein 141
  Pfam annotation: Domain name=Lig_chan; Domain location=1-205; Score =35.7; E_value=3.1e-13; Accession=PF00060.17; Description=Ligand -gated ion channel
MVWLLLAFVLMQSYTANLTSILTLDQLRPSFLNVNDLRKGGYYVGYQTGSFVKDVLVHQFNFDSHKLRAYNTSSEYHDALKMGSEGGGVAAIFDELPYLKVYLREYGSNYILSGPRYRNAGFGFAFPFNSNLTADFSRAILNVTESDLMKEIEEKYFGKNDDIGGEETSTEISSATLSLNFHSFAGLFLITGISTLLALLVSETVIWQRAILIAKAYSQKFLFSTPPSPQTRVHPTQDSTHGSIEAV

SEQ ID NO: 153244 - protein, 39 aa, Glycine max
  Coding DNA Sequence Number=SeqID_36466
MILYFKKENDELLEKISTSDVQDNKPNFCNYLTWKDKLQ

SEQ ID NO: 153245 - protein, 258 aa, Glycine max
  Coding DNA Sequence Number=SeqID_36467
  Gene Ontology: Mol. function=zinc ion binding; Cellular component =intracellular; Biological process=regulation of transcription
  Homolog annotation: Hit_ID=Q9SJU5; Match level="QueryCoverage=83%, HitCoverage=91%, E-value=1e-51, Identity=51%"; Hit description =Putative CONSTANS-like B-box zinc finger protein
  Pfam annotation: Domain name=zf-B_box; Domain location=1-47; Score =35.8; E_value=1.5e-07; Accession=PF00643.14; Description=B-box zinc finger
  Pfam annotation: Domain name=zf-B_box; Domain location=51-96; Score =50.1; E_value=7.2e-12; Accession=PF00643.14; Description=B-box zinc finger
  Pfam module annotation: Pfam domain module=zf-B_box::zf-B_box; Domain location=1-47::51-96
MRTLCDACESAAAIVFCAADEAALCRACDEKVHMCNKLASRHVRVGLASPSDVPRCDICENAPAFFYCETDGSSLCLQCDMIVHVGGKRTHGRYLLFRQRVEPYPCICKEAVSGFEPMTNKSPSEKELKFAKSGSKFPGDKSSHAENPASQALEPGEAKRGQNPLPKLKMGEKQQNHRMPMVPTPGPDADGQTKMETKMIDLNMKPNRIHEQASNNQTCPNSFDWDMGLIETSCDVIVKLLGIKCPAILEGTSSDPCM

SEQ ID NO: 153246 - protein, 264 aa, Glycine max
  Coding DNA Sequence Number=SeqID_36468
  Gene Ontology: Mol. function=ionotropic glutamate receptor activity; Cellular component=membrane; Biological process=ion transport
  Homolog annotation: Hit_ID=Q84QE2; Match level="QueryCoverage=63%, HitCoverage=20%, E-value=2e-23, Identity=37%"; Hit description =Avr9/Cf-9 rapidly elicited protein 141
  Pfam annotation: Domain name=Lig_chan; Domain location=18-226; Score=- 6.8; E_value=1.9e-10; Accession=PF00060.17; Description=Ligand-gated ion channel
MEHDENIHYVGDGDGDGLGSGAAKYFIGSILLGWQGDYKDSFVKNCSRFVLMVWLLLAFVLMQSYTANLTSILTLDQLRPRFLRKGEGYYVGYQTGSFVKDVLFKQFKFDPSKLRSYSNSAEYYKALKSGSQGGGVAAIFDEAFPLNSNLTAYFSRAILKKTESDLMKEIEENYLGKNDDIGGEDPSAEISSATPSLNFHSFSGLFLITGIATLITLLVSETVIWEKPILIAKAYSQRYLFTTPPSAKTSVHPTHDSIHRIEVL

SEQ ID NO: 153247 - protein, 90 aa, Glycine max
  Coding DNA Sequence Number=SeqID_36469
  Gene Ontology: Mol. function=protein kinase activity; Biological process=protein amino acid phosphorylation
  Homolog annotation: Hit_ID=Q9LTU4; Match level="QueryCoverage=98%, HitCoverage=6%, E-value=2e-11, Identity=44%"; Hit description =Helicase-like protein
  Pfam annotation: Domain name=DUF889; Domain location=1-90; Score= -127.6; E_value=0.0077; Accession=PF05970.5; Description=Eukaryotic protein of unknown function (DUF889)
MRLQANAQSVDNQETARFAKWILDIGDGVIGNENDEYATVEIPEYLLITEYNDPIDAIVRSTFPNLYQHHSNPEFFKCRAILASTNETVK

SEQ ID NO: 153248 - protein, 106 aa, Glycine max
  Coding DNA Sequence Number=SeqID_36470
  Gene Ontology: Mol. function=RNA-directed DNA polymerase activity
  Homolog annotation: Hit_ID=Q1RX17; Match level="QueryCoverage=61%, HitCoverage=29%, E-value=2e-24, Identity=74%"; Hit description=RNA -directed DNA polymerase (EC 2.7.7.49)-fruit fly (Drosophila melanogaster) transposable element BS
MNLVLDDAEEVSIKKKSRKTLELGIVRQKLGLLPHSPPSWFHFYRRIQKQEVKEALKRMSNGKAVGPDNIPIEVWKTLGDRGLEWLTELFNEIMRSKRMPEEWRRS

SEQ ID NO: 153249 - protein, 1143 aa, Glycine max
  Coding DNA Sequence Number=SeqID_36471
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=99%, HitCoverage=99%, E-value=1e-134, Identity=67%"; Hit description =Kinesin motor domain, putative
  Pfam annotation: Domain name=Kinesin; Domain location=25-540; Score =427.7; E_value=1.6e-125; Accession=PF00225.13; Description=Kinesin motor domain
MDSVGGEEAIQEPTDHDERILVSVRLRPLNEKELARNDVSDWECINDTTIIYRSNLSATDRSLYPTAYSFDSVFRTDSSTRQVYEKAAKEVALSVVGGINSSIFAYGQTSSGKTYTMSGITEYTVADIFNYIEKHTEREFMLKFSAIEIYNESVRDLLSPDCTPLRLLDDPERGTVVERLTEETLGDWNHFTELISFCEAQRQIGETALNEASSRSHQILRLTIESSAREFLGNDKSSSLSASVNFVDLAGSERASQTHSAGTRLKEGCHINRSLLTLGTVIRKLSQKQNVCFTCKAHATVVKCVNLCMTLDCGKAFVGLGKNYPLPFVHNLNSPSRKPPLPPSPPSPPPTLTAPSSDLCHHRRLIPPPISSSPPTPAPAWRRRRRVYCSSVTGTLTRTTSPNGFRRFLAGESLVLSRSESLSPPRLPPPENRDRDKRNGIAMECERRSPNSCSMRLWTRPTKPTPSSAPEKRDKKEEEEEELGRNGHIPFRDSKLTRILQSSLGGNARTAIICTMSPARSHVEQTRNTLLFASCAKEVSTNAQVNVVVSDKALVKQLQKELARLEDELRNSGPAHLTSETAALLREKDRQIDMLKKEVRELTLQRDLAQSRISDMLRVHGEDVATIELQSMDPQYPNLHMRNSWNFENQREEPNVLSLDGEESVRSFDASQYSDGHSFSSDENLFQLPDLEKNLLVRNSPPGLPVKRTDAVPNDLDQKRIEEQHEEDNCKEVRCIELEDVITNTHKHSNTSDLRSNTYTDSNASSPSANTAISGLIVVDNRDKEKVVDLSSSGSKEDKRLNHLHQDFVLPSPKEISVCMTGNSTSSSRTLKLSRSRSCKASIMRNLSSDWFEDVDVIQNTPPIGIEKAFPGRPEGFPKNIYALNYNANAERLSCNGHGNSVQNSSVDDVQNVKSSTNKEREGTENINRLNLLAGHEVPGTGLDYAKNVKDIGLDPMQTDGESLSHSHWPSKFQRLQREIIEFWDACNVSLVHRTYFFLLFKGEPSDSIYMEVELRRLSYLKQTFSQGNQTVEDGRTLAPELSMRYLRKERQMLSKQMHKRLSKYDRQNLYLRWGLRLSSKHRSLQLAHQLWSDTKDMDHVRDSASIVAKLVGLVEPEQAFKEMFGLNFTPQPTSRKSFSWTA

SEQ ID NO: 153250 - protein, 220 aa, Glycine max
  Coding DNA Sequence Number=SeqID_36472
  Gene Ontology: Mol. function=metabotropic glutamate, GABA-B-like receptor activity; Cellular component=membrane; Biological process =ion transport
  Homolog annotation: Hit_ID=Q69NA4; Match level="QueryCoverage=74%, HitCoverage=16%, E-value=7e-31, Identity=42%"; Hit description =Putative Avr9/Cf-9 rapidly elicited protein 141
  Subcellular localization annotation: CTP_CleavageSite=54; ConfidenceScore=5.15e-01
MAKCFSFSLSRFLIFSFVLLQTQTGNGSNATPIKLRVGVPKKDGFRQFVDVVPSDSHEKKYNVSGYCMDVFNAVVTRLPFKVSLHIQQPYGIESSEISGTYDALLHQIPAKQYDVVVGDVTILANRSNFVDFTLPYTGSGVKMLVPAQHGRQQAMWIFVKPFSWELWLSIVIISTFIGFSILIMERNVNALPDHEGSPNRAKLSPATILWFPISQAILPE

SEQ ID NO: 153251 - protein, 75 aa, Glycine max
  Coding DNA Sequence Number=SeqID_36473
  Subcellular localization annotation: CTP_CleavageSite=20; ConfidenceScore=5.26e-01
LRTANSLLLYTWSRCHVLISLHMERRRRKSRRNRRKRSNRSRKKRRYSDSDEREDRESDDSDSSGRKKKKRSSWV

SEQ ID NO: 153252 - protein, 195 aa, Glycine max
  Coding DNA Sequence Number=SeqID_36474
MWQRQRSTCTKVIGSLLNWYRVEVMVNHKGEQTKFLLWDRECAELIGQLVDEVNRLKIADGDVDLNASPQALDRVLGCFLAFKVKVQSRFRNVVVLKYSDELDLINVVLDMLPDTEVVFCQPCCKIESSMLDSTDPTKLEYQFVSVTVDHDPLLRIPLTPTKRLSSDELDDEPKNFEISPAQVSSNKLPRHYQVE

SEQ ID NO: 153253 - protein, 65 aa, Glycine max
  Coding DNA Sequence Number=SeqID_36475
MRYSGMSEDKGVGPAKRFAPKQRNGIVLVPATELDDVAVNSVGSEVHTVPKGLLMQLEKTCTSIQ

SEQ ID NO: 153254 - protein, 1131 aa, Glycine max
  Coding DNA Sequence Number=SeqID_36476
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=99%, HitCoverage=99%, E-value=0.0, Identity=64%"; Hit description =Putative receptor protein kinase
  Pfam annotation: Domain name=LRRNT_2; Domain location=25-66; Score =48.0; E_value=3.3e-11; Accession=PF08263.3; Description=Leucine rich repeat N-terminal domain
  Pfam annotation: Domain name=LRR_1; Domain location=117-139; Score =9.1; E_value=5.6; Accession=PF00560.23; Description=Leucine Rich Repeat
  Pfam annotation: Domain name=LRR_1; Domain location=141-160; Score =8.5; E_value=7.2; Accession=PF00560.23; Description=Leucine Rich Repeat
  Pfam annotation: Domain name=LRR_1; Domain location=163-185; Score =18.5; E_value=0.024; Accession=PF00560.23; Description=Leucine Rich Repeat
  Pfam annotation: Domain name=LRR_1; Domain location=187-209; Score =16.6; E_value=0.089; Accession=PF00560.23; Description=Leucine Rich Repeat
  Pfam annotation: Domain name=LRR_1; Domain location=211-233; Score =12.2; E_value=1.5; Accession=PF00560.23; Description=Leucine Rich Repeat
  Pfam annotation: Domain name=LRR_1; Domain location=235-257; Score =7.4; E_value=12; Accession=PF00560.23; Description=Leucine Rich Repeat
  Pfam annotation: Domain name=LRR_1; Domain location=259-282; Score =11.7; E_value=1.8; Accession=PF00560.23; Description=Leucine Rich Repeat
  Pfam annotation: Domain name=LRR_1; Domain location=288-311; Score =4.9; E_value=34; Accession=PF00560.23; Description=Leucine Rich Repeat
  Pfam annotation: Domain name=LRR_1; Domain location=314-336; Score =8.6; E_value=7.1; Accession=PF00560.23; Description=Leucine Rich Repeat
  Pfam annotation: Domain name=LRR_1; Domain location=338-360; Score =14.4; E_value=0.41; Accession=PF00560.23; Description=Leucine Rich Repeat
  Pfam annotation: Domain name=LRR_1; Domain location=362-384; Score =12.8; E_value=1.1; Accession=PF00560.23; Description=Leucine Rich Repeat
  Pfam annotation: Domain name=LRR_1; Domain location=386-408; Score =6.6; E_value=17; Accession=PF00560.23; Description=Leucine Rich Repeat
  Pfam annotation: Domain name=LRR_1; Domain location=410-432; Score =17.6; E_value=0.044; Accession=PF00560.23; Description=Leucine Rich Repeat
  Pfam annotation: Domain name=LRR_1; Domain location=434-456; Score =11.8; E_value=1.8; Accession=PF00560.23; Description=Leucine Rich Repeat
  Pfam annotation: Domain name=LRR_1; Domain location=458-480; Score =15.5; E_value=0.2; Accession=PF00560.23; Description=Leucine Rich Repeat
  Pfam annotation: Domain name=LRR_1; Domain location=482-504; Score =15.2; E_value=0.24; Accession=PF00560.23; Description=Leucine Rich Repeat
  Pfam annotation: Domain name=LRR_1; Domain location=506-528; Score =13.7; E_value=0.67; Accession=PF00560.23; Description=Leucine Rich Repeat
  Pfam annotation: Domain name=LRR_1; Domain location=530-552; Score =10.0; E_value=3.8; Accession=PF00560.23; Description=Leucine Rich Repeat
  Pfam annotation: Domain name=LRR_1; Domain location=554-576; Score =12.3; E_value=1.4; Accession=PF00560.23; Description=Leucine Rich Repeat
  Pfam annotation: Domain name=LRR_1; Domain location=578-600; Score =17.4; E_value=0.05; Accession=PF00560.23; Description=Leucine Rich Repeat
  Pfam annotation: Domain name=LRR_1; Domain location=602-624; Score =12.0; E_value=1.6; Accession=PF00560.23; Description=Leucine Rich Repeat
  Pfam annotation: Domain name=LRR_1; Domain location=626-648; Score =14.9; E_value=0.29; Accession=PF00560.23; Description=Leucine Rich Repeat
  Pfam annotation: Domain name=LRR_1; Domain location=650-672; Score =15.6; E_value=0.18; Accession=PF00560.23; Description=Leucine Rich Repeat
  Pfam annotation: Domain name=LRR_1; Domain location=674-693; Score =15.0; E_value=0.28; Accession=PF00560.23; Description=Leucine Rich Repeat
  Pfam annotation: Domain name=LRR_1; Domain location=698-720; Score =6.7; E_value=16; Accession=PF00560.23; Description=Leucine Rich Repeat
  Pfam annotation: Domain name=LRR_1; Domain location=93-115; Score =12.3; E_value=1.4; Accession=PF00560.23; Description=Leucine Rich Repeat
  Pfam annotation: Domain name=Pkinase; Domain location=838-1109; Score= 63.5; E_value=6.6e-16; Accession=PF00069.15; Description=Protein kinase domain
  Pfam annotation: Domain name=Pkinase_Tyr; Domain location=838-1109; Score=31.7; E_value=2e-14; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::Pkinase::Pkin ase_Tyr; Domain location=25-66::117-139::141-160::163-185::187 -209::211-233::235-257::259-282::288-311::314-336::338-360::362 -384::386-408::410-432::...
  Pfam module annotation: Domain location=434-456::458-480::482 -504::506-528::530-552::554-576::578-600::602-624::626-648::650 -672::674-693::698-720::93-115::838-1109::838-1109
MPALFLLLMVLCAPLLTCADRSAVTVAEIQALTSFKLNLHDPAGALDSWDPSSPAAPCDWRGVGCTNDRVTELRLPCLQLGGRLSERISELRMLRKINLRSNSFNGTIPSSLSKCTLLRSVFLQDNLFSGNLPPEIANLTGLQILNVAQNHISGSVPGELPISLKTLDLSSNAFSGEIPSSIANLSQLQLINLSYNQFSGEIPASLGELQQLQYLWLDHNLLGGTLPSALANCSALLHLSVEGNALTGVVPSAISALPRLQVMSLSQNNLTGSIPGSVFCNGSVHAPSLRIVHLGFNGFTDFVGPETSSTCFSVLQVLDIQHNRIRGTFPLWLTNVTTLTVLDVSSNALSGEVPPEIGSLIKLEELKMAKNSFTGTIPVELKKCGSLSVVDFEGNGFGGEVPSFFGDMIGLKVLSLGGNHFSGSVPVSFGNLSFLETLSLRGNRLNGSMPETIMRLNNLTILDLSGNKFTGQVYTSIGNLNRLMVLNLSGNGFSGNIPASLGSLFRLTTLDLSKQNLSGELPLELSGLPSLQVVALQENKLSGEVPEGFSSLMSLQYVNLSSNAFSGHIPENYGFLRSLLVLSLSDNHITGTIPSEIGNCSGIEMLELGSNSLAGHIPADLSRLTLLKLLDLSGNNLTGDVPEEISKCSSLTTLFVDHNHLSGAIPGSLSDLSNLTMLDLSANNLSGVIPSNLSMISGLVYFNVSGNNLDGEIPPTLGSWFSNPSVFANNQGLCGKPLDKKCEDINGKNRKRLIVLVVVIACGAFALVLFCCFYVFSLLRWRKRLKQGVSGEKKKSPARASSGTSAARSSSTQSGGPKLVMFNTKITLAETIEATRQFDEENVLSRTRHGLVFKACYNDGMVLSIRRLQDGSLDENMFRKEAESLGKVKNRNLTVLRGYYAGPPDMRLLVYDYMPNGNLATLLQEASHQDGHVLNWPMRHLIALGIARGLAFLHQSSIVHGDVKPQNVLFDADFEAHLSDFGLDKLTRATPGEASTSTSVGTLGYVSPEAVLTGEASKESDVYSFGIVLLELLTGKRPVMFTQDEDIVKWVKKQLQRGQITELLEPGLLELDPESSEWEEFLLGVKVGLLCTAPDLLDRPTMSDIVFMLEGCRVGPDIPSSADPTSQPSPA

SEQ ID NO: 153255 - protein, 34 aa, Glycine max
  Coding DNA Sequence Number=SeqID_36477
MEGDDGALDAQRREMNNSSNAMKREKTQFSIVNK

SEQ ID NO: 153256 - protein, 118 aa, Glycine max
  Coding DNA Sequence Number=SeqID_36478
MEHLSKLEKRNKGLPARGNGGDDVQQGRRLVRLREMTRRRQRRRCMRMRTLRCPAKKYLYATCWVASDHACPTVQPCPMTAEAPDTASHRSHVRIRVRCESDAGHAAEVPRPYFLDED

SEQ ID NO: 153257 - protein, 54 aa, Glycine max
  Coding DNA Sequence Number=SeqID_36479
MIMPNFVNWNGLVDNHSMDEKTKESKLTQKAWKELNDGNDNHTYALQLSASLVS

SEQ ID NO: 153258 - protein, 297 aa, Glycine max
  Coding DNA Sequence Number=SeqID_36480
  Gene Ontology: Mol. function=protein serine/threonine kinase activity; Cellular component=membrane; Biological process=protein amino acid phosphorylation
  Homolog annotation: Hit_ID=Q1SSP5; Match level="QueryCoverage=99%, HitCoverage=79%, E-value=1e-160, Identity=92%"; Hit description =Protein kinase
  Pfam annotation: Domain name=Pkinase; Domain location=42-289; Score =100.0; E_value=7.1e-27; Accession=PF00069.15; Description=Protein kinase domain
  Pfam annotation: Domain name=Pkinase_Tyr; Domain location=42-285; Score=52.6; E_value=1.1e-15; Accession=PF07714.7; Description =Protein tyrosine kinase
  Pfam module annotation: Pfam domain module=Pkinase::Pkinase_Tyr; Domain location=42-289::42-285
MGSSFSCCGSERVEEVPTSFGVVHNSWRIFTYKELHAATNGFSDDNKLGEGGFGSVYWGRTSDGLQIAVKKLKAMNSKAEMEFAVEVEVLGRVRHNNLLGLRGYCVGDDQRLIVYDYMPNLSLLSHLHGQFAVDVQLNWQRRMKIAIGSAEGLLYLHREVTPHIIHRDIKASNVLLNSDFEPLVADFGFAKLIPEGVSHMTTRVKGTLGYLAPEYAMWGKVSESCDVYSFGILLLELVTGRKPIEKLTGGLKRTITEWAEPLITNGRFKDLVDPKLRGNFDENQVKQTVNVAALCVQ

SEQ ID NO: 153259 - protein, 85 aa, Glycine max
  Coding DNA Sequence Number=SeqID_36481
MVWHIQSVFLLQNLLPILLLHDVDNFESIVTWTRTRTHEQFNISPVTGGILLQMAPPSIPTTALNKCLRQIQSWGWGVIGAFCSL

SEQ ID NO: 153260 - protein, 74 aa, Glycine max
  Coding DNA Sequence Number=SeqID_36482
  Gene Ontology: Mol. function=protein serine/threonine kinase activity; Biological process=protein amino acid phosphorylation
  Homolog annotation: Hit_ID=Q1SSP5; Match level="QueryCoverage=89%, HitCoverage=17%, E-value=1e-13, Identity=61%"; Hit description =Protein kinase
MKQVVNLLKGYESEEKKVTTMRIDSVKYNEELLALDQSSDDDHDDATAIFGVFSAIEIQKMKDPYKQSDNKIMG

SEQ ID NO: 153261 - protein, 623 aa, Glycine max
  Coding DNA Sequence Number=SeqID_36483
  Gene Ontology: Mol. function=protein serine/threonine kinase activity; Cellular component=membrane; Biological process=protein amino acid phosphorylation
  Homolog annotation: Hit_ID=Q1SZH0; Match level="QueryCoverage=99%, HitCoverage=100%, E-value=0.0, Identity=71%"; Hit description =Protein kinase; UspA
  Pfam annotation: Domain name=Pkinase; Domain location=313-580; Score =107.4; E_value=4.2e-29; Accession=PF00069.15; Description=Protein kinase domain
  Pfam annotation: Domain name=Pkinase_Tyr; Domain location=313-580; Score=90.9; E_value=3.8e-24; Accession=PF07714.7; Description =Protein tyrosine kinase
  Pfam annotation: Domain name=Usp; Domain location=6-165; Score=29.0; E_value=1.7e-05; Accession=PF00582.16; Description=Universal stress protein family
  Pfam module annotation: Pfam domain module=Pkinase::Pkinase_Tyr::Usp; Domain location=313-580::313-580::6-165
MVLPSPAKILVGLSLDPDDNKELLSWAIRVLANPNDTIVAVHVLVVADKKKRVSVRRRQSQLRQAKAYVISVLGEFVQCCWSKQVNLEARVALNSSVGEGLVEEAKSISADYLLIRGSRNRTNKYELSDIMHDKPDFFLLLRIGTSKGITKYCFEHAHDGCTMVSVGRLTKANQSANSNSTRFQDKRQPSSRWFKKDNQYGKGTSPVLKDYISGSKAQNRSPRTVLNGLEGQSNSTEDDTFSTRVSSTTYTPSSSDSKRRSKIRKPQFSFRFIASFLASPFRSKNFSISKNEKRQPLLKCFSYEQISNATKDFHRDNLVGRGGYSEVYKGDLSDGRSIAVKRLAKDNKDPNKEKEFLMELGVIGHVCHPNTATLVGCCIENGLYLILNYSQNGNLATTLHGKAGDSLDWPIRYKIAIGVARGLHYLHKCCKHRIIHRDIKASNVLLGPDYEPQITDFGLAKWLPNKWTHHAVIPVEGTFGYLAPEYFMHGIVDEKTDVFAFGILLLEIVTGRRPVDSSKQNLLLWAKPLMESGNIAELADPRMEGKYDGEQLHRVVLTASYCVRQTATWRPPMSEVLELLTSGQESEIGKSWRIPKFISEELDDYSMVFGYDVPSDISLEDYL

SEQ ID NO: 153262 - protein, 94 aa, Glycine max
  Coding DNA Sequence Number=SeqID_36484
MEGSQQNTHYPKEKLPKIITHKWKFGNLLEAPNTLPMKGLFVTKLESNEVLLSPIALKVVGPFLLDSNSSRDGSNPPSYSLYGNPQARKQRDKQ

SEQ ID NO: 153263 - protein, 40 aa, Glycine max
  Coding DNA Sequence Number=SeqID_36485
MYVCERGLVIPSNDLGGDSPFLLAIWHVYIAIRSGDLALT

SEQ ID NO: 153264 - protein, 136 aa, Glycine max
  Coding DNA Sequence Number=SeqID_36486
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P59229; Match level="QueryCoverage=86%, HitCoverage=71%, E-value=5e-40, Identity=74%"; Hit description =Vacuolar ATP synthase 16 kDa proteolipid subunit 4
  Pfam annotation: Domain name=ATP-synt_C; Domain location=13-78; Score= 56.6; E_value=8.2e-14; Accession=PF00137.12; Description=ATP synthase subunit C
  Subcellular localization annotation: CTP_CleavageSite=25; ConfidenceScore=5.18e-01
MPGFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRFIPRCNVCFTERFQT

SEQ ID NO: 153265 - protein, 73 aa, Glycine max
  Coding DNA Sequence Number=SeqID_36487
  Subcellular localization annotation: CTP_CleavageSite=57; ConfidenceScore=5.85e-01
MQPSSRFSVPMRLTSRRSTTNTCFGSSTSTRPTLSTTFFIASKSHTFVVIVVTSFPMASHIMFCVSSSFFDDA

SEQ ID NO: 153266 - protein, 75 aa, Glycine max
  Coding DNA Sequence Number=SeqID_36488
MVTRLAKEAQCYMGEGGRNEQRGEKVGDDNNEGEKEDTYMETKSNCFRCSSFRIDVLDQNEVVTTMMEYPQSEEA

SEQ ID NO: 153267 - protein, 322 aa, Glycine max
  Coding DNA Sequence Number=SeqID_36489
  Gene Ontology: Mol. function=calcium channel activity; Cellular component=integral to membrane; Biological process=detection of mechanical stimulus during sensory perception of sound
  Homolog annotation: Hit_ID=Q9SKB8; Match level="QueryCoverage=86%, HitCoverage=54%, E-value=1e-115, Identity=51%"; Hit description =Ankyrin-like protein
  Pfam annotation: Domain name=Ank; Domain location=127-159; Score =25.7; E_value=0.00017; Accession=PF00023.20; Description=Ankyrin repeat
  Pfam annotation: Domain name=Ank; Domain location=161-193; Score =22.7; E_value=0.0013; Accession=PF00023.20; Description=Ankyrin repeat
  Pfam annotation: Domain name=Ank; Domain location=195-227; Score =33.1; E_value=9.5e-07; Accession=PF00023.20; Description=Ankyrin repeat
  Pfam annotation: Domain name=Ank; Domain location=229-262; Score =20.8; E_value=0.0048; Accession=PF00023.20; Description=Ankyrin repeat
  Pfam annotation: Domain name=Ank; Domain location=263-295; Score=7.2; E_value=2.8; Accession=PF00023.20; Description=Ankyrin repeat
  Pfam annotation: Domain name=Ank; Domain location=53-85; Score=14.3; E_value=0.27; Accession=PF00023.20; Description=Ankyrin repeat
  Pfam annotation: Domain name=Ank; Domain location=92-121; Score=20.5; E_value=0.0062; Accession=PF00023.20; Description=Ankyrin repeat
  Pfam module annotation: Pfam domain module=Ank::Ank::Ank::Ank::Ank::An k::Ank; Domain location=127-159::161-193::195-227::229-262::263 -295::53-85::92-121
MEKQSSFRASTMEKQKSFRGFMEKQKSFRIVMEKQLSFMGSERKKNKESPGKRGDLPIHLAARAGNLSRVKEIIQNYSNNETKDLLAKQNLEGETPLYVASENGHALVVSEILNYLDLQTASIAARNGYDPFHIAAKQGHLEVLRELLHSFPNLAMTTDLSNSTALHTAATQGHIDVVKLLLESDSNLAKIARNNGKTVLHSAARMGHLEVVKALLNKDPSTGFRTDKKGQTALHMAVKGQNEEILLELVKPDPAVLSLEDNKGNTALHIATKKGRTQEIDKLATFLATAQLLAAILATKLNKVLNCSCSFIAVLDIADKCG

SEQ ID NO: 153268 - protein, 376 aa, Glycine max
  Coding DNA Sequence Number=SeqID_36490
  Gene Ontology: Mol. function=RNA binding; Cellular component =ribonucleoprotein complex; Biological process=RNA processing
  Homolog annotation: Hit_ID=O80567; Match level="QueryCoverage=92%, HitCoverage=62%, E-value=3e-69, Identity=44%"; Hit description =Expressed protein
  Pfam annotation: Domain name=La; Domain location=26-81; Score=86.3; E_ value=9.3e-23; Accession=PF05383.7; Description=La domain
MVIGGFYPPKCTFLILEEQNPGDGKVEYYFSDLNLATTDHLMRFINKDPEGFVPISVVASFKKIKALIASHSQLATVLRNSSKLVVSEDGKKIKRQYPLTESDIEELQSRIVVAENLPEDHCHQNLMKVFSAVGSVKTIRTCPPQTSNSGASATSRLGKVDGMPLSNKCMHLLNMDLLSWLRELLTVDSCYNSCRQLYQLTDNFSQQSLYSEFKDRGPPIERDKNRERNGLISHYPVLALPDFPQQFVSKPAQGRGKKGLDVEVGCDEDYTSVPEPQASEKQLEDASFPDTLLLEHAGEEHGYDKESGQRKGRSRGRGKGRGRVHCHQNNRVGTPPSNNTIFTDQVIAKQPPGPRMPDGTRGFSMGRGKPVAVNIA

SEQ ID NO: 153269 - protein, 613 aa, Glycine max
  Coding DNA Sequence Number=SeqID_36491
  Gene Ontology: Mol. function=binding; Cellular component =intracellular; Biological process=metabolic process
  Homolog annotation: Hit_ID=Q5G1T1; Match level="QueryCoverage=99%, HitCoverage=96%, E-value=0.0, Identity=39%"; Hit description=Embryo -defective 2261
  Pfam annotation: Domain name=PPR; Domain location=108-142; Score =32.5; E_value=1.5e-06; Accession=PF01535.11; Description=PPR repeat
  Pfam annotation: Domain name=PPR; Domain location=178-212; Score=1.5; E_value=4.9; Accession=PF01535.11; Description=PPR repeat
  Pfam annotation: Domain name=PPR; Domain location=242-276; Score=4.7; E_value=2.1; Accession=PF01535.11; Description=PPR repeat
  Pfam annotation: Domain name=PPR; Domain location=308-342; Score =52.5; E_value=1.4e-12; Accession=PF01535.11; Description=PPR repeat
  Pfam annotation: Domain name=PPR; Domain location=343-377; Score =15.1; E_value=0.12; Accession=PF01535.11; Description=PPR repeat
  Pfam annotation: Domain name=PPR; Domain location=379-413; Score=3.0; E_value=3.3; Accession=PF01535.11; Description=PPR repeat
  Pfam annotation: Domain name=PPR; Domain location=42-76; Score=5.3; E_ value=1.7; Accession=PF01535.11; Description=PPR repeat
  Pfam annotation: Domain name=PPR; Domain location=445-479; Score =10.1; E_value=0.47; Accession=PF01535.11; Description=PPR repeat
  Pfam annotation: Domain name=PPR; Domain location=7-41; Score=36.8; E_ value=7.2e-08; Accession=PF01535.11; Description=PPR repeat
  Pfam module annotation: Pfam domain module=PPR::PPR::PPR::PPR::PPR::PP R::PPR::PPR::PPR; Domain location=108-142::178-212::242-276::308 -342::343-377::379-413::42-76::445-479::7-41
MLHKNLVTWTLMITRYVQLGLLGDAVDLFCRMIVSEYTPDVFTLTSLLSACVEMEFFSLGKQLHSCVIRSRLASDVFVGCTLVDMYAKSAAVENSRKIFNTMLRHNVMSWTALISGYVQSRQEQEAIKLFCNMLHGHVAPNSFTFSSVLKACASLPDFGIGKQLHGQTIKLGLSTINCVGNSLINMYARSGTMECARKAFNILFEKNLISYNTAVDANAKALDSDESFNHEVEHTGVGASSYTYACLLSGAACIGTIVKGEQIHALIVKSGFGTNLCINNALISMYSKCGNKEAALQVFNDMGYRNVITWTSIISGFAKHGFATKALELFYEMLEIGVKPNEVTYIAVLSACSHVGLIDEAWKHFNSMHYNHSISPRMEHYACMVDLLGRSGLLLEAIEFINSMPFDADALVWRTFLGSCRVHGNTKLGEHAAKKILEREPHDPATYILLSNLYASEGRWDDVAALRKSMKQKKLIKETGYSWIEVDNQVHKFHVGDTSHPQARKIYDELDELALKIKNLGYIPNTDFVLHDVEDEQKEQYLFQHSEKIAVAYALISTPKPKPIRVFKNLRVCGDCHTAIKYISIVTGREIVVRDANRFHHIKDGKCSCNDYW

SEQ ID NO: 153270 - protein, 170 aa, Glycine max
  Coding DNA Sequence Number=SeqID_36492
  Homolog annotation: Hit_ID=Q1SEA0; Match level="QueryCoverage=28%, HitCoverage=10%, E-value=3e-14, Identity=81%"; Hit description =Phosphofructokinase
MRVEPCLIGSVRFLGTKFVDSDSDVLVIDKSFGFDTAVEEAQGAINFAHVEAQSTENGIDIVKLMGRYSVVWILEHRTNDEFRGSPREHIVTILWFSLSTMFFAHKKTHLVHLVELCPSMSCIYILTSLTCISPPKVTDMLNWATFVVDPPHRRSTDTTLTLDVFSMQFP

SEQ ID NO: 153271 - protein, 290 aa, Glycine max
  Coding DNA Sequence Number=SeqID_36493
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=UPI000034F3B5; Match level="QueryCoverage =84%, HitCoverage=22%, E-value=5e-62, Identity=49%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
  Pfam annotation: Domain name=DEAD_2; Domain location=147-265; Score= -14.6; E_value=1.5e-05; Accession=PF06733.6; Description=DEAD_2
MSQVPNGIRKPDFPPQLIQHTSSETHITSDIVESEVKGKEKMIFASNPNPKNVYLIGGLQLEFPYERYGSQFAFMARVISTLNLTQKEGHCHALLESPSGTGKSLSLLCSSLAWQHHYKSQHHHLKPASEATNDPLALVADLFSRRRTHSQISQVVRELRKTAYRVPMVVLAWQKHYCTTKNIIGKENIYDECKLLLKDQATGCPEFKNAHKVKGHSSLQKGGCNVVHDIEDLVKVGQLVAVIMVLVLCQMMLNWYFVHITTSIIQSFGHQYNIWISDVFHKPSVVCYPM

SEQ ID NO: 153272 - protein, 74 aa, Glycine max
  Coding DNA Sequence Number=SeqID_36494
MGSDVITKCARVCRKREKGLGGKKRGTVVLDQGQRLRAMIKTKKQQRRGNWGSDFFVSLSRISMALLTPSLDGL

SEQ ID NO: 153273 - protein, 304 aa, Glycine max
  Coding DNA Sequence Number=SeqID_36495
  Gene Ontology: Cellular component=integral to membrane
  Homolog annotation: Hit_ID=Q9SKB8; Match level="QueryCoverage=92%, HitCoverage=43%, E-value=2e-88, Identity=61%"; Hit description =Ankyrin-like protein
MAAAATKLIGKGKRVVRRQAMSRKNVRCLLSMECININATNKAGETPLDVAEKFGSPELVSILRDAGAANSTDQRKPPNPSKQLKQTVSDIKHDVQSQLQQTRQTGMRVQKIAKKLKKLHISGLNNAINSATVVAVLIATVAFAAIFTVPGQYVEDKTHGFSLGQANIANNAAFLIFFVFDSLALFISLAVVVVQTSVVVIEQKAKKQLVFVINKLMWMACLFISIAFISLTYVVVGSHSRWLAIYATVIGSLIMLSTIGSMCYCVILHRMEETKLRAESRSFSMSHASDQEILNSEYKRMYAL

SEQ ID NO: 153274 - protein, 180 aa, Glycine max
  Coding DNA Sequence Number=SeqID_36496
MGVVKPEKGRLNNGELKPTALCVTVHANAERKKGKLFGVRRRQQWSPEKSLEKEKGLLEYGQQAKRSTGDKSNSKVWDLSPTLKVWDSNVGLIGLRLSKTPTTKASICGVVLPRFLLGADGASSELDSPWWHSCSYIKEFPKKRALNPLNGSTHEAILSMPGNTGRSRSASNFLSRERGG

SEQ ID NO: 153275 - protein, 286 aa, Glycine max
  Coding DNA Sequence Number=SeqID_36497
  Gene Ontology: Mol. function=polyribonucleotide nucleotidyltransferase activity; Biological process=mRNA catabolic process
  Homolog annotation: Hit_ID=O24288; Match level="QueryCoverage=85%, HitCoverage=24%, E-value=2e-21, Identity=65%"; Hit description =Polynucleotide phosphorylase
  Pfam annotation: Domain name=KH_1; Domain location=19-92; Score=23.4; E_value=0.00082; Accession=PF00013.19; Description=KH domain
MMNSSPPPAKMLSKYAPLIHVMKVRPDRINLIIGSGGKKVKSIIEESGVDTIDTEDDGTWEDGWKEDGVPLLEKYPRLYCISKQQQHYIQQMGLVSSGVWEWQLKWRRLLMEGEMDVAAHFLEDIDGMAVQVQHQDSGSWEGDPGGEYSVGSAYRALNEYAIEEDDERAFSILWKLKIPSKVNEKGQLRLSHRALLPDTEASPKDGLVEEKTEQSKDKSSTPNVTASSKRSSEDDSVLPSKKFVRRLVSSSQDKPFTNKDKRKKSSNKAVGSVSGEDESSLVSGEA

SEQ ID NO: 153276 - protein, 153 aa, Glycine max
  Coding DNA Sequence Number=SeqID_36498
  Gene Ontology: Mol. function=structural constituent of ribosome; Cellular component=large ribosomal subunit; Biological process =translation
  Homolog annotation: Hit_ID=Q2PYX6; Match level="QueryCoverage=55%, HitCoverage=38%, E-value=3e-18, Identity=55%"; Hit description =Putative 60S ribosomal protein L7-like protein
  Pfam annotation: Domain name=Ribosomal_L30_N; Domain location=80-138; Score=24.8; E_value=1.2e-05; Accession=PF08079.2; Description =Ribosomal L30 N-terminal domain
MCCFHERGNLQGRGKYFKRKGYLREYKKVAVYIIKSNINTYFRAAVSCFPAAATLPPSSPPSPPEMAEEDSKPLNYISEVILKKRKNTEAWALRKKEQFQQKKYQSIKKPEDFIHEYRNKEVDLIRMKRRVKRKVPEANSNTLIIIRIQGCVK

SEQ ID NO: 153277 - protein, 70 aa, Glycine max
  Coding DNA Sequence Number=SeqID_36499
MIGSANDVVVVIFNGEKFLRNLRSEDVELENAIEACQNETGSAAPALEPAAEVVGEKNCCLWKPFVEARI

SEQ ID NO: 153278 - protein, 133 aa, Glycine max
  Coding DNA Sequence Number=SeqID_36500
  Gene Ontology: Mol. function=polyribonucleotide nucleotidyltransferase activity; Biological process=mRNA catabolic process
  Homolog annotation: Hit_ID=Q8GZQ3; Match level="QueryCoverage=54%, HitCoverage=7%, E-value=1e-29, Identity=86%"; Hit description =Polynucleotide phosphorylase
  Pfam annotation: Domain name=RNase_PH; Domain location=19-114; Score=- 10.1; E_value=0.029; Accession=PF01138.11; Description=3' exoribonuclease family, domain 1
MIKLLTAGGKRSDGRTPDGIRPINSRCGLLPRAHGSTLFTRGETQALAVVTLGDKQMAQRIDTLDGVDEFKRFYLQFIIRVADAKSQDKHTELPFSRSKQFSVDDLALAASNAPCHHQNKCLSEEESNLVSFS

SEQ ID NO: 153279 - protein, 133 aa, Glycine max
  Coding DNA Sequence Number=SeqID_36501
NDVDGSICPYFERESRTSPIAGQGQSNGRRLLCPQGDPRTPQLLLVQSVKFRNVAEVEKRPTWAFQKAVASGGSNLARLGELGGKHLPYFAINRGGTEALPKRFRNVFREESRKGFDRSSTFFIRLHRSSIFN

SEQ ID NO: 153280 - protein, 53 aa, Glycine max
  Coding DNA Sequence Number=SeqID_36502
MERRRKCCRYPLCYLNLCMAHVNPMDQSILVRLGNLDAPSTVPSQLKVWCQIL

SEQ ID NO: 153281 - protein, 118 aa, Glycine max
  Coding DNA Sequence Number=SeqID_36503
MEVGWDLLSLTSHCSLGDRVIGMWGQMARMVKLPSTRNLLPSIKADSAKDVRCQAMLLNRHICSLFPRRQKILNHVLEAYREVVGKREINSDGSNGRSNGVDVICCIKHQLKGCLRTL

SEQ ID NO: 153282 - protein, 353 aa, Glycine max
  Coding DNA Sequence Number=SeqID_36504
  Gene Ontology: Mol. function=lithium ion binding; Cellular component =integral to membrane; Biological process=calcium ion transport
  Homolog annotation: Hit_ID=Q1SQ50; Match level="QueryCoverage=72%, HitCoverage=43%, E-value=2e-72, Identity=53%"; Hit description =Sodium/calcium exchanger membrane region
  Pfam annotation: Domain name=Na_Ca_ex; Domain location=200-343; Score= 122.6; E_value=1.1e-33; Accession=PF01699.14; Description =Sodiumcalcium exchanger protein
MVPLDSTASLEATHLIYGGDKMINERQYQYSDDESSSSSLEASIPLLGYVDEEKQSLAEIVVVVEEKDQNQNQKQDSHSSSTFFGGNNSLFDCIYLGKILQVLELPLGLPRRLTIPVVSEEKWSKPYAVISVTLAPVLLAILFNTQSENVGSRSGIVTYIVAALIGIVLGNMACVTTERCNPPRKSLFPWLAGGFAMSVTWTYIIAEELVSLLVSIGSIIGVSPSILGLTVLAWGNSLGDLIANGAMAMNGGPDGVQMAISGCYAGPMFNTLMGLGLPLVLSAWSEHPEPYVTPKDTSLYETLLFLMGGVLWALVILPKKNMRLDKSLGAGLLSVYMCFLVIRIAMAVGIVKF

SEQ ID NO: 153283 - protein, 506 aa, Glycine max
  Coding DNA Sequence Number=SeqID_36505
  Gene Ontology: Mol. function=transferase activity; Cellular component= cytoplasm; Biological process=amino acid biosynthetic process
  Homolog annotation: Hit_ID=Q1SN30; Match level="QueryCoverage=78%, HitCoverage=71%, E-value=1e-129, Identity=61%"; Hit description =Aspartate/glutamate/uridylate kinase; MADF; Homeodomain-related
  Pfam annotation: Domain name=AA_kinase; Domain location=268-478; Score=164.6; E_value=2.5e-46; Accession=PF00696.18; Description =Amino acid kinase family
  Subcellular localization annotation: CTP_CleavageSite=68; ConfidenceScore=5.42e-01
MATEDYPLLDSPSHGQPHLHASTRHHFPSSSSSSPTTLPATAASGTATADYYPHPSFSDDSAKSNSKRASAAGSPYYHNKRLKSAADPDPATDYRKDREEWSDTAIAYLLEAYTEKFNQLNRGNLRGRDWEEVAEAVLERCGGEGKHQKSVEQCKNKIDNLKKRYKVELQRIGSGGIATSHWHWFKKIEAIVGNSLSVKTVSDDDKAGSSGGGANSPSMARQTKNRSLFLIKSPVCYLTSPTETRYAPSNATVATNLKPKPASNLKWHRVLFKISGSALAGNCQNIDPKVAMQIAREVATACRLGVEVAIVVGGRNFFCGDAWVSATGLDRPTAYQIGMMATVMNSILLQSALEKLGVQARVQSTFSMPEVAEPYSRQRAIRHLEKGRVVIFGGVGAGTGNPLFTTDTAAALRASELNADAVLKGTNVNGVFDCHPRNDNITLDHISFREVVSRGVTSMDMMALAYCEENGIPVVVFNVLEPGNVSRALCGDQVGTLIDQTGRVEH

SEQ ID NO: 153284 - protein, 341 aa, Glycine max
  Coding DNA Sequence Number=SeqID_36506
  Gene Ontology: Mol. function=inositol or phosphatidylinositol phosphatase activity; Cellular component=cytoplasm; Biological process=phospholipid dephosphorylation
  Homolog annotation: Hit_ID=Q9LPP2; Match level="QueryCoverage=85%, HitCoverage=39%, E-value=6e-96, Identity=58%"; Hit description =Myotubularin related protein, putative
  Pfam annotation: Domain name=Myotub-related; Domain location=165-270; Score=152.5; E_value=1.1e-42; Accession=PF06602.5; Description =Myotubularin-related
MLLPKTEIYSEFKILDLGNGVVLVNTDDAGTLMVTNFRLIFLSEGTRKVIALGTIPLTTIEKFNKTFNLSILLVCLTCCEGSLKYSLCRQDTSTETAPGKDMRILVFSFRPRTKQRRVVYEALLRCTKPTRLWDLYAFASGPSRFKNTTPLTAEPLFVTLHGLNAASDDEVLQASSFRARCRLPVVSWCHPLTGAVVARSSQPLVGLMMNMRSNMDEKLVAALCSKLDNGSRRKLYIVDARPRKNALANGAMGGGSESSSNYFQSEIVFLGIDNIHAMRESFVRLREYMDTHGRTSSDGMSSFLFLADFKKLNVEHGVCIKVLLLFLYKSSSMVNLGLWFK

SEQ ID NO: 153285 - protein, 80 aa, Glycine max
  Coding DNA Sequence Number=SeqID_36507
  Homolog annotation: Hit_ID=Q9LPP2; Match level="QueryCoverage=96%, HitCoverage=9%, E-value=7e-09, Identity=41%"; Hit description =Myotubularin related protein, putative
MPKNRATRATSLRDASDSSKLEGTGSWDAIEWTKIEPISRFVSHANLDFLLESEQVVAESAKVRNEDRAENGRVIYQKYM

SEQ ID NO: 153286 - protein, 463 aa, Glycine max
  Coding DNA Sequence Number=SeqID_36508
  Gene Ontology: Cellular component=integral to membrane; Biological process=peroxisome organization and biogenesis
  Homolog annotation: Hit_ID=Q94DE5; Match level="QueryCoverage=93%, HitCoverage=94%, E-value=1e-139, Identity=54%"; Hit description =Putative betaine/proline transporter
  Pfam annotation: Domain name=Aa_trans; Domain location=42-448; Score =208.6; E_value=1.4e-59; Accession=PF01490.8; Description =Transmembrane amino acid transporter protein
  Pfam annotation: Domain name=MFS_1; Domain location=81-447; Score= -46.4; E_value=0.042; Accession=PF07690.6; Description=Major Facilitator Superfamily
  Pfam module annotation: Pfam domain module=Aa_trans::MFS_1; Domain location=42-448::81-447
MGTVTRSSSEVYTSDSEKGFAMNHSTSTSPELDAGAKFVLVSRGSWLHCGYHLTTSIVAPVLLTLPFSFTLLGWVGGVLWLTLAAVITFYSYNLLSVVLEYHAQLGRRQLRFRDMARDILGPGWARYYVGPLQFAICFGTVIGGPLVGGKSLKFIYQLYNPEGSMKLYQFIIICGVITLLLAQLPSFHSLRHVNMISLILSVLYATCVTIGSIYIGHSKNAPPRHYSVRGSDADQLFGVFNGISIIATTYASGIIPEIQATLAPPVKGKMLKGLCVCYSVIATTYFSVAISGYWAFGNESGASILANFIGETKPLLPKWFFLMTNIFILLQVMALTAVYLQPTNEMFEATFGDPKMGQFSMRNVVPRVVLRSLSVAAATVLAAMLPFFPDIMALFGAFGCIPLDFILPMVFYNMTFKPSKNTIMFWVNNVIAVASSILVVIGGIASIRQIVLDAKTYNLFADM

SEQ ID NO: 153287 - protein, 139 aa, Glycine max
  Coding DNA Sequence Number=SeqID_36509
MRPKLGMIAPSMMLSLSQERINGSEMDHDDLDIWESQVLLIASLRVDCAETASRDNKITEKSNPFSSLFFAGNSFLPPEAFPSSSSLLSFHSLAAPLTPPDADTNALHALMEVKIRARSRTMAVAPSSRSRMAEARSSL

SEQ ID NO: 153288 - protein, 157 aa, Glycine max
  Coding DNA Sequence Number=SeqID_36510
MICCRFPLPSLQIIWFLCIQIIQIVAAQVIHHTNLTLLPLKPRACSRSVECRSQGVVAVSLSKRNIPSKSDKRTSRRRTNGYCVFGNESSASVLANFIGETKPLLPQHCVDAKGEGPSFQHGFGLGRMRGRVEGGVPLMTGLEGRHSDDGTQSSFRG

SEQ ID NO: 153289 - protein, 113 aa, Glycine max
  Coding DNA Sequence Number=SeqID_36511
  Homolog annotation: Hit_ID=Q10FY4; Match level="QueryCoverage=74%, HitCoverage=18%, E-value=4e-07, Identity=35%"; Hit description =Expressed protein
  Subcellular localization annotation: CTP_CleavageSite=14; ConfidenceScore=5.15e-01
MNSSVSPPTRLVVRAKPRKSTMTGTRMEPMETLPVKCLIVSQTATLVSMSTPPAKCMYLTLEIVTYIAFFRNCIVHPRLSKIKKMKNSASWVLFSIALAPPIPANRKQHKGFP

SEQ ID NO: 153290 - protein, 122 aa, Glycine max
  Coding DNA Sequence Number=SeqID_36512
  Homolog annotation: Hit_ID=Q10FY4; Match level="QueryCoverage=86%, HitCoverage=28%, E-value=2e-23, Identity=42%"; Hit description =Expressed protein
MGVASLLVVRGNRWGFVHVGVYNKGFVQASCDTWEMFIRVGLEQLIDLDLTGAFCFLSGVGTGAICSLCRLAIAWVQACVSAYYVAYAENPQSTQFDSTIPIRLEQLNRSQALQIFRANNLS

SEQ ID NO: 153291 - protein, 184 aa, Glycine max
  Coding DNA Sequence Number=SeqID_36513
  Subcellular localization annotation: CTP_CleavageSite=80; ConfidenceScore=5.70e-01
MGSATVQIATSKFVLCPNASAAKVASPKKNAVINFSSNFKGSVTKIHAIPPNGSVSICSSRVFETAVIDQGIVGVEDPIMAADENKRRSNLESLFCYDKAIPEEIIEKPVGLSLEEKAIGNNTRCTDCQAKGAVLCATCAGSGLYVDSIMESQGIIVKVRCLGCGGTGNIMCAECGGRGHLGPK

SEQ ID NO: 153292 - protein, 270 aa, Glycine max
  Coding DNA Sequence Number=SeqID_36514
  Gene Ontology: Mol. function=transporter activity; Cellular component= integral to membrane; Biological process=transport
  Homolog annotation: Hit_ID=Q3K827; Match level="QueryCoverage=97%, HitCoverage=72%, E-value=4e-74, Identity=62%"; Hit description =General substrate transporter
MAFQHSAEMIILCRFLVGIVPVGADGSADVMVAGTANPAWPRRLALGRDRRGGIRTRTGVLSEMEKRCGIAPGDDFSQRDATAQLPKKGRFSEIWAPAYRQRTLMLVVMNFFQAIGFFGFGNWLPALLSGKGATPLRRPAGKQMADRFFIADDGGVRHAVRADQQPAADGGVRFPDHLQQRLADLQLSRLSDRDLPDAHSSARRRLLLFVQPAVDRFQQYSDWPDSAVCRQSGGDRIYRAEYADGDAVGRDLRAEDAGAGSGEHLNRMGA

SEQ ID NO: 153293 - protein, 219 aa, Glycine max
  Coding DNA Sequence Number=SeqID_36515
  Gene Ontology: Mol. function=binding; Cellular component =intracellular; Biological process=mRNA editing
  Homolog annotation: Hit_ID=Q9FI80; Match level="QueryCoverage=98%, HitCoverage=47%, E-value=2e-45, Identity=40%"; Hit description =Putative selenium-binding protein
  Pfam annotation: Domain name=PPR; Domain location=175-209; Score=3.2; E_value=3.1; Accession=PF01535.11; Description=PPR repeat
  Pfam annotation: Domain name=PPR; Domain location=38-72; Score=43.3; E_value=8.4e-10; Accession=PF01535.11; Description=PPR repeat
  Pfam annotation: Domain name=PPR; Domain location=73-107; Score=14.8; E_value=0.13; Accession=PF01535.11; Description=PPR repeat
  Pfam module annotation: Pfam domain module=PPR::PPR::PPR; Domain location=175-209::38-72::73-107
GLEVDLHVASSITDMYCKCGNIKDACKFFNTISDHNLVTWTAMIYGYAYHGLGREAIDLFNKAKEAGLEPDGVTFTGVLAACSHAGLVEEGCEYFRYMRSKYNSEVTINHYACMVDLLGRAAKLEEAEALIKEAPFQSKSLLWKTFLGACSKHENAEMQDRISNILADIELNEPSTYVLLSNIYASQSMWINCIELRNKMVEGSVAKQPGSSWIQLAGG

SEQ ID NO: 153294 - protein, 57 aa, Glycine max
  Coding DNA Sequence Number=SeqID_36516
MACGPARLTRGVKRAGDRPIYLIRIRMRSGLASPLSMRAYADRPYVERVGPLTHPLI

SEQ ID NO: 153295 - protein, 535 aa, Glycine max
  Coding DNA Sequence Number=SeqID_36517
  Gene Ontology: Mol. function=binding; Cellular component =intracellular; Biological process=metabolic process
  Homolog annotation: Hit_ID=Q2QNV4; Match level="QueryCoverage=99%, HitCoverage=59%, E-value=3e-70, Identity=27%"; Hit description =Pentatricopeptide, putative, expressed
  Pfam annotation: Domain name=PPR; Domain location=159-193; Score =22.8; E_value=0.0012; Accession=PF01535.11; Description=PPR repeat
  Pfam annotation: Domain name=PPR; Domain location=194-228; Score=4.7; E_value=2.1; Accession=PF01535.11; Description=PPR repeat
  Pfam annotation: Domain name=PPR; Domain location=260-294; Score =13.1; E_value=0.21; Accession=PF01535.11; Description=PPR repeat
  Pfam annotation: Domain name=PPR; Domain location=361-395; Score =16.3; E_value=0.087; Accession=PF01535.11; Description=PPR repeat
  Pfam annotation: Domain name=PPR; Domain location=464-497; Score =30.9; E_value=4.5e-06; Accession=PF01535.11; Description=PPR repeat
  Pfam annotation: Domain name=PPR; Domain location=56-90; Score=38.6; E_value=2.1e-08; Accession=PF01535.11; Description=PPR repeat
  Pfam module annotation: Pfam domain module=PPR::PPR::PPR::PPR::PPR::PP R; Domain location=159-193::194-228::260-294::361-395::464-497::56-90
DHKDLNFGTALHSLFVKTALDKDVFVQNNMIRFYGDIGQVQNAHKLFDEIPQPSLVSWTSLISCYVHVGKHEMGLSLFRGLCRSGMCPNEFGFSVVLKSCRVMCDPVMGKVIHGLILKSGFDSHSFCSASILHMYADCGDIENSRKVFDGVCFGERCEALWNTLLNAYVEESDVKGSLKLFREMGHSVVSRNHFTYTIIVKLCADVLDVELGRSVHGQTVKIGIENDVVVGGALIDCYVKLQFLDDARKVFQILDEKDNVAICALLAGFNHIGKSKEGLALYVDFLGEGNKPDPFTFATVVSLCSNMETELSGIQIHCGVIKLGFKMDSYLGSAFINMYGNLGMISDAYKCFLDICNKNEICVNVMINSLIFNSDDLKALELFCGMREVGIAQRSSSISYALRACGNLFMLKEGRSFHSYMIKNPLEDDCRLGVENALLEMYVRCRAIDDAKLILERMPIQNEFSWTTIISGYGESGHFVEALGIFRDMLRYSKPSQFTLISVIQACAEIKALDVGKQAQSYIIKVGFEHHPFVG

SEQ ID NO: 153296 - protein, 628 aa, Glycine max
  Coding DNA Sequence Number=SeqID_36518
  Homolog annotation: Hit_ID=Q1S7F8; Match level="QueryCoverage=28%, HitCoverage=56%, E-value=7e-31, Identity=40%"; Hit description =Ubiquitin; Seven in absentia protein
  Pfam annotation: Domain name=HMG_box; Domain location=28-97; Score =24.8; E_value=6.5e-05; Accession=PF00505.9; Description=HMG (high mobility group) box
  Pfam annotation: Domain name=Sina; Domain location=433-616; Score= -38.2; E_value=0.00023; Accession=PF03145.7; Description=Seven in absentia protein family
  Pfam module annotation: Pfam domain module=HMG_box::Sina; Domain location=28-97::433-616
MVNLQKVEQHVTTEGQRKKNKRKKQVLVPRPACSWVYFSKEFIKEYIASHPESPGLKAATKAASNAWKSMSLEEKEKYARHAREVWDGYLSSGAAPNPKPRKQTKLVTRCSPGRLFKVLQRLTPEQKEAVKSMGFGSLLGLRCRTLRRSLCLWLLERFDTTNCSLEICNVDVPLTPNDVEMVLGLSASGKEVVNSGPEDMISDLRNSYNAINHGISVRLLEEQLATAESGDDFKRSFVLYVLGTLLCPTARLDVSPSFLHFLTNMDLVHQYNWGKFLLDRLVREVLRFHQGKQRTVGGCLLFLQLFYYENISLEGSSAPVPTIVPYLFSWGEEEIAEREKREKELGGYGSGEILRYAFTLQLASKKKCHHMEFPEYRDHPDGPLITTEISRIGHGPLRPESNEVMMPLSFITSLLACPQKHEDIRGFPRNRTVLSGDVDLVVESIEAPCRNKEYGCNETVDCMTSNDHEVTCIYSPCVCPFQDCNYVGPFEQLALHFSSKHWDSGRQFKYNHPLAISLQMDEQFLVLQAEEDGVLFLLNKGTETNGNTVMITCIGPNSSKEGFIYEIVSCRGRSSLRLKSVAENFPGRMEDFPPVDFLLIPFNFLVSSRELNVDICIWNSTEHNVDCS

SEQ ID NO: 153297 - protein, 341 aa, Glycine max
  Coding DNA Sequence Number=SeqID_36519
  Gene Ontology: Mol. function=transferase activity; Biological process= protein metabolic process
  Homolog annotation: Hit_ID=Q944E5; Match level="QueryCoverage=89%, HitCoverage=57%, E-value=1e-144, Identity=77%"; Hit description =Cellulose synthase-like protein OsCslA9
METCRSACKFGGKTLRIIKSLQNELPHLDLEMEEAVNADECLMTRMQEMSLDYHFLVEQEVGSSTYAFFGFNGTAGVWRISALNEAGGWKDRTTVEDMDLAVRAGLKGGKFVYLSDLKVKSELPSTFKAYRYQQHRWSCGPANLFKKMAMEIMRNKKVSMWKKLYVIYSFFFVRKIVAHVVTFVFYCVIMPATVLFPEVEVPKWGAVYIPSIITLLNAVGTPRSIHLLVFWILFENVMSMHRTKATLTGLLEAGRVNEWVVTEKLGDALKTKSGGKAARKSRIRIGERLHFLELLVGAYLFFCACYDLKYGKNHYFIYLFLQSMAFFVAGVGYVGTFVPNS

SEQ ID NO: 153298 - protein, 77 aa, Glycine max
  Coding DNA Sequence Number=SeqID_36520
MTSEEPLKVTKIFNKINCRLVKLAEQEATTWIFPSRYRVMEWQPCNKVWKEKGDIGTLTLHLDMQKLELEKLNLTKL

SEQ ID NO: 153299 - protein, 77 aa, Glycine max
  Coding DNA Sequence Number=SeqID_36521
MEISGPMNKEFPPRQTVAPNPHSLIFEHYRKKVVSSYCQCLENISNRNPSSRVKIQIYPPYYPLPHYPLNAPSSYML

SEQ ID NO: 153300 - protein, 124 aa, Glycine max
  Coding DNA Sequence Number=SeqID_36522
MEKEKKRVSPSKDYLVVLDRPNSSRTYSWYYGPYALFWGTVRQNGVNIKGTVKGKEVVISAMTILLCLVVLKKMEELEKVQFAAELAAQIFSLDAAQRQLELDVVTVPNDMDPTERGSLEEAML

SEQ ID NO: 153301 - protein, 94 aa, Glycine max
  Coding DNA Sequence Number=SeqID_36523
MINQEQIQNNNCDVNQILLKNPKTGQDMPSCVRRTAAHERTMSTQEQRVSMHKIAYEEALQKSSAVVDENRDLNLSERCMTDQNPEQNSEPKIV

SEQ ID NO: 153302 - protein, 111 aa, Glycine max
  Coding DNA Sequence Number=SeqID_36524
  Gene Ontology: Mol. function=receptor activity
  Homolog annotation: Hit_ID=Q7XAC4; Match level="QueryCoverage=100%, HitCoverage=11%, E-value=9e-39, Identity=71%"; Hit description=PAUSED
MVGFLLLLNQLICKFNTLVRDILEEIFPSIAERIFSVIPRNGLPSSGSDAITEEIRELQELQRTLYTFLHVITTHDLSPVFLSPKCKAYLDPVMQLLLYSSCNHNDILVRK

SEQ ID NO: 153303 - protein, 802 aa, Glycine max
  Coding DNA Sequence Number=SeqID_36525
  Gene Ontology: Mol. function=receptor activity; Cellular component =nucleus; Biological process=transport
  Homolog annotation: Hit_ID=Q9CAH2; Match level="QueryCoverage=88%, HitCoverage=74%, E-value=0.0, Identity=62%"; Hit description =Putative exportin, tRNA (Nuclear export receptor for tRNAs); 81050- 85729
  Pfam annotation: Domain name=Xpo1; Domain location=104-257; Score =162.7; E_value=9.4e-46; Accession=PF08389.2; Description=Exportin 1 -like protein
MDDLERAILVMFDESGALDDDLKKQAKVYCNDIKEKPLICRLCIEKLCFSNLVQVQFWCLQTLHEVIRTRYLTMTPDERHMIRGSVFSIVCLEDKNLTRVLEGPAFIKNKLAQVLITLIYFEYPLVWSSVFVDFFPHLSKGNVVIDMFCRVLNALDDELISLDYPRTPEELAVAGRVKDAMRQQCVPQIVRAWYDIVSMYRNSDHELCTSVLDSMRRYISWIDIGLIVNDAFIPLLFDLILVGPLSDQLRGASVRCLLAVVSKRMEPESKLSLLQSLQISRVLRLVTEDVDVELVSDIAALLSGYAVEALDCFKRINSEDAKGISMELLSEVLPSIFYVMKNFEVDVTFNIIQFLSGYVAIFKSFVPLPEKQLLHLGQILEVILVLIRYDPVHRTNLDVMDKIGKEEEDRMVEFRKDLFVLLRNVGRVAPDVTQLFIRNSLASAVSRSSDSNVEEVEGALSLLYALGESISEEAIRTGSGLLSELVLMLLSTKFPCHSNRLVALVYLETVTRYIKFIQDNTQYIPMVLAAFLDERGIHHSNINSLQDTVAQFTIMNYTTEELSGSEDGSHIFEAIGLLIGTEDVLPEKQSDYLSSLLSPLCQQVEALLINAKLLNAEETNAKIAVIQQIIMAINSLSKGFSERLVTASRPAIGIMFKQTLDVLLQVLVIFPKVEPLRNKVTSFIHRMVDTLGASVFPYLPKALEQLLEEIEIDFADVYVLGLQGAFECDGIENNIPLTYSPVTLLLLYSIVNTFWHLRILLWLQGVSLSAIFFVVISRFYVKHATLVLGEFVSNKGYSLFRG

SEQ ID NO: 153304 - protein, 120 aa, Glycine max
  Coding DNA Sequence Number=SeqID_36526
  Gene Ontology: Mol. function=endonuclease activity
  Homolog annotation: Hit_ID=Q2HUP4; Match level="QueryCoverage=95%, HitCoverage=24%, E-value=8e-13, Identity=37%"; Hit description =Endonuclease/exonuclease/phosphatase
MDIAGFKLWYMGKVWGKNGVGIMVDKDFLPPMTGCQLGIPGPSLLCSPSSIEDVCCAFLSSGEYLSPLGLVCKESVVDVKRIGDRILALKLMMVQETMNIISAYAPQIGSEALVKEIGKT

SEQ ID NO: 153305 - protein, 344 aa, Glycine max
  Coding DNA Sequence Number=SeqID_36527
  Gene Ontology: Mol. function=DNA binding; Cellular component=nucleus; Biological process=regulation of transcription
  Homolog annotation: Hit_ID=Q9SL41; Match level="QueryCoverage=98%, HitCoverage=93%, E-value=1e-100, Identity=57%"; Hit description =Putative NAM (No apical meristem)-like protein
  Pfam annotation: Domain name=NAM; Domain location=13-142; Score =315.2; E_value=1.1e-91; Accession=PF02365.6; Description=No apical meristem (NAM) protein
PVIAIMESMESCVPPGFRFHPTDEELVGYYLRKKVASQKIDLDVIREIDLYRIEPWDLQERCRIGYEEQNEWYFFSHKDKKYPTGTRTNRATMAGFWKATGRDKAVYERAKLIGMRKTLVFYKGRAPNGQKSDWIMHEYRLESDENGPPQASILVQFEVLRSNFALDGRPAFKKKTTGQTKTINIEGWESSYFYDEASGATSTLVDPIELISRQSQSFLAQNFMCKQELEADNLTCMHQDPFVQLPQLESPSLPLVKKPSTVSLVSDNNNEGEDNQNRLLFNNNNTKKVTTDWRALDKFVASQLSQEVNTHETNVGVLSSSFEPHDDNHDMALLLLQSSRDEGN

SEQ ID NO: 153306 - protein, 113 aa, Glycine max
  Coding DNA Sequence Number=SeqID_36528
  Homolog annotation: Hit_ID=Q8H3A7; Match level="QueryCoverage=66%, HitCoverage=7%, E-value=2e-24, Identity=72%"; Hit description =Putative exportin, tRNA
MGYREHTRYYEQLSWGTWSILGALKEHAKLMISYLFVLFGEIVLAQKVMYEKFGDDFLVNFVSKGFSSAHCPPDQAEQYRQKLQGGDFKALKSFYQSLVENLRVQQNGSLVFR

SEQ ID NO: 153307 - protein, 114 aa, Glycine max
  Coding DNA Sequence Number=SeqID_36529
NLPVEDRRTTKNDEERWKTFAKSPTETEVVATQLAQASWVASTRRHRLLLGHPGRPKILRNFTDCALTFPFNSRHVAELHGLPNDGCQVPRSGQAKVASHQTDGPRTKLGYDIE

SEQ ID NO: 153308 - protein, 448 aa, Glycine max
  Coding DNA Sequence Number=SeqID_36530
  Gene Ontology: Mol. function=nucleic acid binding
  Homolog annotation: Hit_ID=Q1S0C3; Match level="QueryCoverage=97%, HitCoverage=90%, E-value=4e-29, Identity=41%"; Hit description=Zinc finger C-x8-C-x5-C-x3-H type (And similar), putative
  Pfam annotation: Domain name=zf-CCCH; Domain location=391-417; Score =21.5; E_value=0.0019; Accession=PF00642.15; Description=Zinc finger C-x8-C-x5-C-x3-H type (and similar)
MSIGSSDDFPPGFEDNHLRNQSKAKLSHIPQIKWECPSLFTLSNDWRVAAGEDSTETCDQKLREMRVPEAIYPRISAIPDGPSESEKEFYDDNESLIPLIPLIPVEEEEESAEDIEPDSSIKKLHKQNSQQQYIPPAISLVNPECSNVNSHCSGKPLGATSSEADIIAAASSAAVASIIKRNEQGTLIDMDLLVKLFTDPTMIEKLIEQNRTATTTVSVSAPSSILSIPTSYSKPAAVASETTPTTTRPSITSVPSVSLPKPVPPQTVTRHKPPSIPTPHMHRPVKKNIPHMANRVLPSLNTHSPQQGLKRAAPSLASVSSSELKTVTVSSASANMHAVEKQVQSTTTGAVKDVNYYLNLVKEHGTHKQAGNKSLKNLQGLKPSQGEVKFKSKKPCIYFRTKRGCRNGSDCPYQHDMSNRGEAGKVLMAQQNAKRLKVGPEIKGRLYT

SEQ ID NO: 153309 - protein, 66 aa, Glycine max
  Coding DNA Sequence Number=SeqID_36531
MGLGKVKSGMVKTSRKLRIEMVSGCWQILAADKLSCGSSCVKVSMPIMQIIFWHNCCFGLNGRGVT

SEQ ID NO: 153310 - protein, 124 aa, Glycine max
  Coding DNA Sequence Number=SeqID_36532
  Gene Ontology: Mol. function=nucleic acid binding
  Homolog annotation: Hit_ID=Q1S0C3; Match level="QueryCoverage=98%, HitCoverage=23%, E-value=3e-22, Identity=44%"; Hit description=Zinc finger C-x8-C-x5-C-x3-H type (And similar), putative
MDRSKNSKTVRWAQESSLREVHVFSPDKDCSSMVGKKCQEHLQAKSSSISPSTTDDNNDLPPGFRPIIDVSRIPQIKWKCPPSVVLNSGWRMAAGEESTEKDNQKQRELKKLEAVYPRDSHIPA

SEQ ID NO: 153311 - protein, 74 aa, Glycine max
  Coding DNA Sequence Number=SeqID_36533
MVRGTLLGYKSRCERVGRRIGKTTLANDYRHGSYQAQFFCGVVVGNHHSSSTATAKVRGGKSGKPCKNSTTPPS

SEQ ID NO: 153312 - protein, 104 aa, Glycine max
  Coding DNA Sequence Number=SeqID_36534
MKHEKPTIVPYTLGGSQGEWLFDFAKFWGPRDPPRVLLLAFKRRHPTIQMHMHRDVIFDIKGLLRQPWEVADKLAGLGARMQSVSEFAVSPAAALDLADLTSLD

SEQ ID NO: 153313 - protein, 358 aa, Glycine max
  Coding DNA Sequence Number=SeqID_36535
  Pfam annotation: Domain name=zf-CCCH; Domain location=194-220; Score =19.5; E_value=0.0035; Accession=PF00642.15; Description=Zinc finger C-x8-C-x5-C-x3-H type (and similar)
PFVSSDVENELGYDDSDTPLVPLESEEDVENELGYDDSDSTPLVPLESKEDIAISTVPPSNLGEADVATALATVMAIVKHNEEPGNSIIDANFILRLANDPKMLKELTDSNNNNPENASLTMPAPPQITATAQTSPPPSLKRGTKRAIPSGSERKSCSEQAWPSGGSVSSSQPRVVKKDVDYYRNQVTKNDSGKVNKQCKFYNTSKGCRNGSRCRFQHTSVWKIDANHRPKRSCSRRWIPGGALAAPAAAGTGGRPCRAAAARNVEAASCGAALPSSSSGIASASTAAAWPLAEAATSKKMMMDSWVGFVNAVVFSTVGSRVGIVSRSVSDHCVVVLREKEVAEGYKSLGMENVYVGG

SEQ ID NO: 153314 - protein, 123 aa, Glycine max
  Coding DNA Sequence Number=SeqID_36536
MASQHLPPVEAPDTHVLAACVNTKGSCAEAAENPLVEEPSAENHSCAATIHNVPYANDVVRVNVAICYDVDAPVPFPMFVDDWGTSLGHGSVCGLKNEWNMFSDGTTLDVEAITTLCKKWEAY

SEQ ID NO: 153315 - protein, 296 aa, Glycine max
  Coding DNA Sequence Number=SeqID_36537
  Homolog annotation: Hit_ID=Q10QY0; Match level="QueryCoverage=12%, HitCoverage=8%, E-value=2e-08, Identity=75%"; Hit description =Serine/threonine-protein kinase NAK, putative, expressed
MEVYDLDPKLLQEIINLGQLRHPHLVMLIGYCYEDEHRLFIHRSMTMILQCKDDSMGGGNGNHSYYEVVWEKKVNVGSWMFKHKLKTSNKYPWLMLYLRANATRGLFLELLESPNFRVRWRLDIKNGGPKSRFYLLYMSSCWKNNGAPYDGDVLIDLGAAPLVWGTVHPPFHITPEDRKIYRNDTANFPYLAYHYYCAPGNAKHLEQLVSTCDPYNNPQAQEIFQLLLDPIWGAYGYPTQKEDGWVGDPRIWELDVGGTSIRLYFYQDPSTPPTKRIWTSIDNGTKIFFSAQDEVA

SEQ ID NO: 153316 - protein, 66 aa, Glycine max
  Coding DNA Sequence Number=SeqID_36538
MVPACHWARLLWMTKVKSAGPNGSRMSSGPPPLDDKRSLREERLQTQIYTGSVTPLFIRPVPKQPA

SEQ ID NO: 153317 - protein, 101 aa, Glycine max
  Coding DNA Sequence Number=SeqID_36539
MLFGKNAEMQHPPGARKDGKLNCEQVKIFQHENRDKVMGNFRIKRRSGPHFCLLGKEQASKRSLVLELAFPGKQVSPKTLWSAPSPHTHMTLVLFFHYTNS

SEQ ID NO: 153318 - protein, 755 aa, Glycine max
  Coding DNA Sequence Number=SeqID_36540
  Homolog annotation: Hit_ID=O65649; Match level="QueryCoverage=89%, HitCoverage=91%, E-value=1e-99, Identity=41%"; Hit description =Myosin-like protein
  Pfam annotation: Domain name=DUF869; Domain location=95-682; Score =521.3; E_value=1e-153; Accession=PF05911.2; Description=Plant protein of unknown function (DUF869)
  Pfam annotation: Domain name=M; Domain location=340-360; Score=7.6; E_ value=13; Accession=PF02370.7; Description=M protein repeat
  Pfam annotation: Domain name=M; Domain location=590-610; Score=2.8; E_ value=53; Accession=PF02370.7; Description=M protein repeat
  Pfam annotation: Domain name=M; Domain location=69-89; Score=6.0; E _value=20; Accession=PF02370.7; Description=M protein repeat
  Pfam module annotation: Pfam domain module=DUF869::M::M::M; Domain location=95-682::340-360::590-610::69-89
MDRRGWLWKKKSSDKNIKVENEKPMPTSESVGPTLSSVAHAGDQQDNIKNKNYVQISMESYAHMSGLEDQVVNLEDQVKALEEKLSAVYSELNNKDNLVKQHAKVAEEAVSGWEKADAEVVSLRRQLESLSLSKLTVDEKAAHLDEALKECMKQIRTVKEESEQKLQEVILMKSHQWEKIKLELEAQIDNLDEGLRELASENAALLRSVQESSNKIVKLKEEKSEAEAEVEHLEKNIQSKEKEITSLKYELHMISKEMDIRNEEKNMIMRSAEVANKQHTEDGKNIDKLESECQRLRGLLRKKLPGPAALAQMKLEVESSHHVISAPHLRKTSSKTDGLQASEFLTKQLKVLEEETKTLKEALASSNAELQASRNLYAKTVGRLKRLEAEIHQERNSQKAMLATNYGNPFSRVYSYPPSITSISDNGHEDSESHVESCATSIPDHSDIRRIGSVGKLENHKSETISELMDDFLEVEKMACLSDNGGVPLGIISKANDDAEDKKETSCLSSNKNCFDRINQSIEPEAAEHVEHMQDLKEKKMMLLENMQLLEELKAQLASSNKSCSLGEIQLKCMTESYRSLQTRVEVLEAENKYLKEKMDELKNDLAEEKQSHHDALVRYKEIEEKMQRDKCLVCASNSAANSGKDKELAAAEKKLAECQETLSILGRQLQAMCPQIGVTMTHHSKRLQMNEKFAKPTYGWSNSYGSCNSNEIDRAEACSVVSDIQGVTDELSSHNNSGATSCLSDTEGNYWLNP

SEQ ID NO: 153319 - protein, 73 aa, Glycine max
  Coding DNA Sequence Number=SeqID_36541
MGCVGLAPEVFDLDCEEKIDRQTRKGAGVKVCIDSIFWAKNQFKISKDKSVIKYFGVLGGSEYGWLLAKVHHF

SEQ ID NO: 153320 - protein, 76 aa, Glycine max
  Coding DNA Sequence Number=SeqID_36542
MVLEKGFPLLKILMLLVYSIKNSESRFKVAKHAFLGLAGMTVITRLARRCLLHAKLGLATERGVALDLSCMLSEMF

SEQ ID NO: 153321 - protein, 196 aa, Glycine max
  Coding DNA Sequence Number=SeqID_36543
  Gene Ontology: Mol. function=hydrolase activity, acting on ester bonds; Biological process=lipid metabolic process
  Homolog annotation: Hit_ID=Q1S8F9; Match level="QueryCoverage=71%, HitCoverage=43%, E-value=8e-49, Identity=67%"; Hit description =Lipolytic enzyme, G-D-S-L
MYCTNSNASYTYKKEKLENQKDTCLLARQVTEKSANQIQNCVPCKNYRMSERPTPCAEELGIKELLPAYLDPNLQPSDLVTGVCFASGGSGYDPLTSKLASAISLTGQIDLFKEYIRKLKGLVGEDKTNFILANGIVLVVEGSNDISNTYFLSHAREVEYDIPAYTDLMVKSASNFLKEIYQLGGRRIGVFSAPPI

SEQ ID NO: 153322 - protein, 285 aa, Glycine max
  Coding DNA Sequence Number=SeqID_36544
  Gene Ontology: Mol. function=transcription factor activity; Cellular component=nucleus; Biological process=regulation of transcription, DNA-dependent
  Homolog annotation: Hit_ID=Q6ZL38; Match level="QueryCoverage=91%, HitCoverage=89%, E-value=6e-33, Identity=36%"; Hit description =Putative AP2 domain containing protein
  Pfam annotation: Domain name=AP2; Domain location=34-98; Score=138.6; E_value=1.7e-38; Accession=PF00847.10; Description=AP2 domain
  Subcellular localization annotation: CTP_CleavageSite=49; ConfidenceScore=5.40e-01
MEIQFQQPNLQQQKSGIAITKGGKLKGRSRSNNTNKFVGVRQRPSGRWVAEIKDTTQKIRMWLGTFETAEEAARAYDEAACLLRGSNTRTNFITHVSLDSPLASRIRNLLNNRKGVKKQEDTNANANNAPAPKVTTTRSASTCTSTSTSTSTSTSSNSSNGNDKNDKSLSTANTRSSNLFDDAYKPDLSNCREEFESGHQSNASWGFGTVFDRFPIAQILDIPKIDDGLLTNAADLELSEFERMKVERQISASLYAINGVQEYMETVQDSNDTLWDLPPLCSMFC

SEQ ID NO: 153323 - protein, 75 aa, Glycine max
  Coding DNA Sequence Number=SeqID_36545
MDYLIRMCYTDSKEDKATIKEGKKKPYLDDGNVLKASNGSSQRWQHNTKQRRGCKKTKKEEVAYGQRIGGKLFKI

SEQ ID NO: 153324 - protein, 140 aa, Glycine max
  Coding DNA Sequence Number=SeqID_36546
MLSGANVEYDLPIPIKDESETLSDIDDAELDVYIHNEEEKNMKKTLWERAYREYLEVQKILSAAYFIVLIVLDKVACLSHSSFIVSFRSCWQLKKQLRLQQELGQIDMASGQTTNETRRYGCHGSVFANSHRQFVKEGQL

SEQ ID NO: 153325 - protein, 139 aa, Glycine max
  Coding DNA Sequence Number=SeqID_36547
MNRRVEKELKSELLLPRVHLDDRTIIWNSNFKSLRIQNLQGLKSKVNFELLNELFDEMDTQENTDGLKKQKKVRFDSPLDKHDNLPSKIENKNEDEMGSVDEFEDEGDMGEMYQNTENMADKYFPEDDGFSYNDYNDYY

SEQ ID NO: 153326 - protein, 34 aa, Glycine max
  Coding DNA Sequence Number=SeqID_36548
RTRVTSMLFSAINMVIDVIGGQEHPSAKYAEGGS

SEQ ID NO: 153327 - protein, 50 aa, Glycine max
  Coding DNA Sequence Number=SeqID_36549
MGVANTTSILTGSIQILTDAIWGPLANGIGTSSNPKIGLSPTHNNTLLNV

SEQ ID NO: 153328 - protein, 166 aa, Glycine max
  Coding DNA Sequence Number=SeqID_36550
  Pfam annotation: Domain name=zf-CCHC; Domain location=57-71; Score =15.1; E_value=0.0032; Accession=PF00098.13; Description=Zinc knuckle
MGRNSITRTTSFRNSCDLCPTINKGEHCKEVRTDRSVGCQRCGLIHGDHLCPTVLTYKCRKVGHYARSCRSEGQSQPRPQNHGRVFTLKGEKVKESDGSIQVCEFQYVFPKEVSSLPPNRDVEFGIVMQSYPARALDGRLQEDWARDAREDPRVLMSLRVDFGPMG

SEQ ID NO: 153329 - protein, 905 aa, Glycine max
  Coding DNA Sequence Number=SeqID_36551
  Gene Ontology: Mol. function=nucleic acid binding
  Homolog annotation: Hit_ID=Q1SMW2; Match level="QueryCoverage=95%, HitCoverage=38%, E-value=0.0, Identity=63%"; Hit description=SNF2 -related; HMG-I and HMG-Y, DNA-binding; Bromodomain; ATP-requiring DNA helicase RecQ
  Pfam annotation: Domain name=QLQ; Domain location=420-457; Score =51.5; E_value=2.7e-12; Accession=PF08880.1; Description=QLQ
MVSFQQQLLRKPEGNEAFLAYQAGIQGVFGSNNFSSPSAMQLPQQPRKLHLGSNQDIQLRGQGVEQQMLNPVHQAYLQYALHAAQQRPTLGIQSQQQTKMGMLSSASLQDQEMRMGNLKMQDIMSMQAANQGQGSSSRNSSERGARGDKQMDQGQQMTPDQKSEGKPSTQGPTIGHLIPGNMIRPMQGPETQQGIQNVVNTQIAVSAQLQAMQAWARERNIDLSHPANAHLMAQLIPLMQSRMVSQSKVNESNIGAPSSPVPVSKQQVTSPAVASESSAHANSSSDMSGQSGSSKARQTAPSSHLGSITNAGIAGNSSDMATQQFNVHGRESQAPPRQPVVVGNGMPSMHSQQSSANTNLGADHPLNAKTSSSGPEPPQMQYTRQLNQSAPQAGGPTNEGGLGNPAKSQGRPAQMPQQRTNFTKQQLHVLKAQILAFRRLKKGEGTLPQELLRAIVPPPLEMQAQQPNHSARGQNQDKPAGNIAAEQISPIESSAKEPQSIPSINGQSSLKHESFARDEKSIVPPVHVQAVAPPVSKESAPTLSAGKKDQKSIGCSVKSNQDGECVNNTTVRNELALDRGKAIAPQAPVSDTMQIKKPSQTSTGPQPKDVGPTRKYHGPLFDFPFFTRKHDSFGSSMMLNNNNNLSLAYDVKDLLFEEGMEVLNKKRTENLKKIEGLLAVNLERKRIRPDLVLRLQIEEKKLRLVDLQARLRDEIDQQQQEIMAMPDRPYRKFVRLCERQRMELARQVQASQRAVREKQLKSIFQWRKKLLEAHWAIRDARTARNRGVAKYHEKMLREFSKRKDDDRNKRLEALKNNDVDRYREMLLEQQTSIPGDAAERYAVLSTFLTQTEEYLHKLGSKITAAKNQQEVEEAAKAAAAAARLQACFIKLPPPSPLLFFQCFEK

SEQ ID NO: 153330 - protein, 131 aa, Glycine max
  Coding DNA Sequence Number=SeqID_36552
  Subcellular localization annotation: CTP_CleavageSite=63; ConfidenceScore=5.61e-01
MFVLVIAYLYIPASSALPCHPTWCGVCYSSSSSSKMQRNFMRLLMFFLCFSYVLSVSAIPATRTQNLKGEEEEDFSALPSLTRVDHALGNGEVVLIDMNEGFIERRVDLETQDYEGTGANKDHDPKSPGGP

SEQ ID NO: 153331 - protein, 90 aa, Glycine max
  Coding DNA Sequence Number=SeqID_36553
  Subcellular localization annotation: CTP_CleavageSite=77; ConfidenceScore=5.71e-01
MKARTLSPLKETTLSPMKAKTLSLLKARTLSPLKASSLSPMKARTLSPLKARTLSPMKDQGRNLGSMKMLIVNAGFVCNNAMQWKVVQGS

SEQ ID NO: 153332 - protein, 632 aa, Glycine max
  Coding DNA Sequence Number=SeqID_36554
  Gene Ontology: Mol. function=nucleic acid binding; Cellular component= brahma complex; Biological process=imaginal disc-derived wing vein specification
  Homolog annotation: Hit_ID=Q6EVK6; Match level="QueryCoverage=99%, HitCoverage=28%, E-value=0.0, Identity=83%"; Hit description =Putative SNF2 subfamily ATPase
  Pfam annotation: Domain name=DEAD; Domain location=63-225; Score= -16.8; E_value=0.00015; Accession=PF00270.19; Description=DEADDEAH box helicase
  Pfam annotation: Domain name=Helicase_C; Domain location=420-499; Score=88.4; E_value=2.2e-23; Accession=PF00271.21; Description =Helicase conserved C-terminal domain
  Pfam annotation: Domain name=ResIII; Domain location=59-219; Score= -27.7; E_value=0.0097; Accession=PF04851.6; Description=Type III restriction enzyme, res subunit
  Pfam annotation: Domain name=SNF2_N; Domain location=65-368; Score =345.5; E_value=9.1e-101; Accession=PF00176.13; Description=SNF2 family N-terminal domain
  Pfam module annotation: Pfam domain module=DEAD::Helicase _C::ResIII::SNF2_N; Domain location=63-225::420-499::59-219::65-368
GLSEEEVRAAAACAGEEVMIRNRFLEMNAPRDSSSVNKYYNLAHAVNETVIRQPSMLRAGTLRDYQLVGLQWMLSLYNNKLNGILADEMGLGKTVQVMALIAYLMEFKGNYGPHLIIVPNAVLSEFYNWLPSVSCIFYVGSKDHRSKLFSQEVCAMKFNVLVTTYEFIMYDRSKLSKIDWKYIIIDEAQRMKDRDSVLARDLDRYRCQRRLLLTGTPLQNDLKELWSLLNLLLPEVFDNKKAFNDWFSKPFQKEGPTQNVEDDWLETEKKVIIIHRLHQILEPFMLRRRVEDVEGSLPPKVSIVLKCKMSAVQSAIYDWVKSTGTLRLDPEDEKHKLHRNPAYQVKQYKTLNNRCMELRKTCNHPLLNYPFFSDLSKEFIVRSCGKLWILDRILIKLQRTGHRVLLFSTMTKLLDILEEYLQWRRLVYRRIDGTTSLEDRESAIVDFNSPDSDCFIFLLSIRAAGRGLNLQSADTVVIYDPDPNPKNEEQAVARAHRIGQKREVKVIYMEAVVDKIASHQKEDELRSGGTVDMEDELAGKDRYMGSIESLIRNNIQQYKIDMADEVINAGRFDQRTTHEERRLTLETLLHDEERYQETVHDVPSLQEVNRMIARSKEEIELFDQMDDELDWI

SEQ ID NO: 153333 - protein, 78 aa, Glycine max
  Coding DNA Sequence Number=SeqID_36555
MEWEEFEMGKKLKLLGHLCSQPIRFEEPNKRRTNVNDPIATPLSQMSRVMNDPPFFHSNTDPVEAEEWLNKLEKFLES

SEQ ID NO: 153334 - protein, 295 aa, Glycine max
  Coding DNA Sequence Number=SeqID_36556
  Gene Ontology: Mol. function=endonuclease activity
  Pfam annotation: Domain name=dsDNA_bind; Domain location=155-239; Score=-37.8; E_value=0.088; Accession=PF01984.10; Description=Double- stranded DNA-binding domain
MEVIETKDLGLDFRLLILWKFLLCTIMVGWYSDQTKAKISDSLRRVWHERLKSKRLVEQFFLSWAQSIANAARKGGIGQEELDWDSYNKIKQQLELHHLLQSKKKGKEKLMAVAGAKNIIQSWKESIAKAAKKGGSGEQELDWDSYEKIQEEMVHLRQLQRTTEKAKEKEMARVKAEKEAQIKAIKRVILTQKKKDHLERAKLKRNIKSHPCGNAKEGKGSLEVTKEFKLCTEVTKIHISKNFNGEVPREQDVFNSIFPTHNKLDLELIKREKMQKEVSLAEQIQAARDKKGKLH

SEQ ID NO: 153335 - protein, 559 aa, Glycine max
  Coding DNA Sequence Number=SeqID_36557
  Gene Ontology: Mol. function=nucleic acid binding
  Homolog annotation: Hit_ID=Q1SMW2; Match level="QueryCoverage=99%, HitCoverage=25%, E-value=0.0, Identity=61%"; Hit description=SNF2 -related; HMG-I and HMG-Y, DNA-binding; Bromodomain; ATP-requiring DNA helicase RecQ
  Pfam annotation: Domain name=Bromodomain; Domain location=270-356; Score=-13.4; E_value=0.036; Accession=PF00439.15; Description =Bromodomain
MGEFDDDGYSMADGVQTIDKDQLEDGLLCDAGYEFPQSLESARNNQMVEEAGTSGSSSDSQRVRQIVSPSVSSQKFGSLSALDARPSSISKRMTDELEEGEIAVSGDSHMDHQQSGSWIHDRDEGEDEQVLQKPKIKRKRSLRVRPRHATERPEEKSGSEMASHLAVQADHKYQAQLRTDPESKLFGDSNASRHEQNTPALKNKRTLPSRRVANTSKLHGSPKSSRLNCMSVPSQDAGDHSRESWEGKPINSSGSSAHGTKMTEIIQRRCKNVISKLQRRIDKEGHEIVPLLMDLWKRIENSGSGNSLLDLRKIDQRIDKFEYNGATELVFDVQFMLKSAMHFYGFSHEVRTEARKVHDLFFEILKIAFPDTDFRDARSALSFSSQAAAGTVTSPRQAAVSQSKRHRLINEMETESYPSQRSLQRGSASSGENNRIKVHLPQRESRTGSGGGSSTREQQQEDSSLLAHPGELVVCKKRRNDREKSAVKPKTGPVSPSSMRTPGPSSVPKEARLTQQGSHAQGWAGQPSQQPNGSGGSVGWANPVKRLRTDSGKRRPSHT

SEQ ID NO: 153336 - protein, 559 aa, Glycine max
  Coding DNA Sequence Number=SeqID_36558
  Gene Ontology: Mol. function=monooxygenase activity; Cellular component=membrane; Biological process=electron transport
  Homolog annotation: Hit_ID=Q1SD78; Match level="QueryCoverage=91%, HitCoverage=98%, E-value=0.0, Identity=83%"; Hit description=E-class P450, group I
  Pfam annotation: Domain name=p450; Domain location=37-510; Score =334.7; E_value=1.6e-97; Accession=PF00067.12; Description=Cytochrome P450
MDLTTFISTLFLGTLASRIIRHWLIGRSLSSHKNKLPPGPPRWPIVGNLLQLGQLPHRDLASLCDKYGPLVYLKLGKIDAITTNDPDIIREILLSQDDVFASRPHTFAAVHLAYGCGDVALAPLGPHWKRMRRICMEHLLTTKRLESFSNHRLDEAQHLVKDVMAWAQDKKPINLREVLGAFSMNNVTRMLLGKQYFGSESSGPQEAMEFMHITHELFWLLGVIYLGDYLPIWRWVDPYGCEKKMREVEKRVDDFHSNIIEEHRKARKDRKGKRKEGDGDMDFVDVLLSLPGEDGKEHMDDVEIKALIQDMIAAATDTSAVTNEWAMAEVMKHPHVLHKIQEELDTIVGPNRMVLESDLPHLNYLRCVVRETFRMHPAGPFLIPHESLRATTINGYHIPAKTRVFINTHGLGRNTKIWDNVDEFRPERHWPSNGNGTRVEISHGVDFKILPFSAGKRKCPGAPLGVTLVLMALARLFHCFDWEPPKGLSCGDVDTREVYGMTMPKAEPLIAIAKPSNARGDGGWSGGGVVAWCGVEVALGVGVVVFGCGNGVGGSRVLW

SEQ ID NO: 153337 - protein, 80 aa, Glycine max
  Coding DNA Sequence Number=SeqID_36559
  Subcellular localization annotation: CTP_CleavageSite=46; ConfidenceScore=5.30e-01
MVSRDIIPFDLNVVAVGTTSDNISSKRKTLDEVSLSSSNLLSEVVVSSTLSARLALSQISLTRAKRAFEKTEEKLSKEAK

SEQ ID NO: 153338 - protein, 61 aa, Glycine max
  Coding DNA Sequence Number=SeqID_36560
MSVIHMYQLFTQVHTLSIEYCEKYAKPEDIGAATEENSSDEELSEDEYDSSDEQVAGKADP

SEQ ID NO: 153339 - protein, 65 aa, Glycine max
  Coding DNA Sequence Number=SeqID_36561
MRALGGLGARPGELVTSTLSHLGAQASLGEPGPRKLPEMTLLPLPLEKVLHETRSYLCNPDKRGD

SEQ ID NO: 153340 - protein, 59 aa, Glycine max
  Coding DNA Sequence Number=SeqID_36562
MVQVGDRLRRVYKCRRWPEWLAAQRAPQVYPSNLPNTNKLSVVLFQADHVATTRVQYDN

SEQ ID NO: 153341 - protein, 74 aa, Glycine max
  Coding DNA Sequence Number=SeqID_36563
GRVAFRKARECSPMMARTCNPLKVRACSPTKVKAHDPLTARTCSPLKLKVHDPLKARTCSPLKVKVTSTQGEGV

SEQ ID NO: 153342 - protein, 113 aa, Glycine max
  Coding DNA Sequence Number=SeqID_36564
MEEGYVTNNPPLFKGVKYDYWKEMMITHFESIHIDFLKPPSLVKKSQGGPKRAKLGDALQGLGEPMTRSRAKKVKEGLSKEVTNLLFFQLNLEGEAFKMVQMIQVDEGPIVGA

SEQ ID NO: 153343 - protein, 153 aa, Glycine max
  Coding DNA Sequence Number=SeqID_36565
MAKIGAGLIFDSNTSREVREVTEKHAGKEQCQNRQPKSSFSENKRQAEGVGARGRDVEGGGSMPTKRWLAEKETLENREKGRWNRGRDKGLLVEGSTGMRKKEKGRGYREAGRNVKEVARKGDRVYRKRVASKRAHQGPTVLGEGWFFLIPST

SEQ ID NO: 153344 - protein, 82 aa, Glycine max
  Coding DNA Sequence Number=SeqID_36566
MNVTDAAMKAAKKGQNEGAQNMKVPNVAINATKKSGTSNKKSEIEAAARQQSTGESFERKIQRSKIKIDQQCTLIYERQKFK

SEQ ID NO: 153345 - protein, 187 aa, Glycine max
  Coding DNA Sequence Number=SeqID_36567
  Gene Ontology: Mol. function=ubiquitin-protein ligase activity; Cellular component=ubiquitin ligase complex; Biological process =response to abscisic acid stimulus
  Homolog annotation: Hit_ID=Q7ZTZ6; Match level="QueryCoverage=59%, HitCoverage=39%, E-value=5e-24, Identity=45%"; Hit description=STIP1 homology and U-Box containing protein 1
  Pfam annotation: Domain name=U-box; Domain location=109-183; Score =136.5; E_value=7.2e-38; Accession=PF04564.6; Description=U-box domain
MSDDSPIVCDHNKALDLGRGANPKGYMVEEIWQELAKAKYLEWERSSSKRSWELQSLKEACESALKEKHFLDYSQMEGFVDDATTSHSEQLEALERVFNTAAEADIPTEVPDYLCCRITLDIFHDPVITPSGLTYERAVILEHLQKVGKFDPITREPLDPSQLVPNLAIKEAVEAFLDKHGWAYKID

SEQ ID NO: 153346 - protein, 76 aa, Glycine max
  Coding DNA Sequence Number=SeqID_36568
MGVGGVAGGHDGMIVLLPLMCTINYNADLGMKSVITAKEDKFSMSGWYLDPAYEFHPNQSEQTEVNEVQINSNNIM

SEQ ID NO: 153347 - protein, 157 aa, Glycine max
  Coding DNA Sequence Number=SeqID_36569
  Gene Ontology: Mol. function=hydrolase activity, acting on ester bonds; Cellular component=nucleus; Biological process=lipid metabolic process
  Homolog annotation: Hit_ID=Q5YLY5; Match level="QueryCoverage=88%, HitCoverage=29%, E-value=6e-52, Identity=64%"; Hit description=Zinc finger protein-like
  Pfam annotation: Domain name=FYVE; Domain location=39-105; Score =118.1; E_value=2.4e-32; Accession=PF01363.12; Description=FYVE zinc finger
MGGGRRPAEAVKTNEQSSERKKGFGDWMNLIKPANEEKDHWVPDEAVSKCTACGTDFGAFVRRHHCRNCGDIFCDKCTHGRIALTADENAQPVRVCDRCMAEVTQRLTSAKESSSKPALQSHEDLAKKLQEELERNQKASDFEFYLCSSVKWCGSGA

SEQ ID NO: 153348 - protein, 111 aa, Glycine max
  Coding DNA Sequence Number=SeqID_36570
  Gene Ontology: Mol. function=hydrolase activity, acting on ester bonds; Biological process=lipid metabolic process
  Homolog annotation: Hit_ID=Q1S8F8; Match level="QueryCoverage=68%, HitCoverage=89%, E-value=5e-26, Identity=66%"; Hit description =Lipolytic enzyme, G-D-S-L
MKLNLEVAKIITAMDSLMASPLPLGILVLRCFMLLLMVSCKAKGLVELPPNVTVPAVLVFGDSIMDTGNNNNNMQTLAKCNFPPYGRDFEGGIPTGRFGNGKVPSDLVAYA

SEQ ID NO: 153349 - protein, 217 aa, Glycine max
  Coding DNA Sequence Number=SeqID_36571
  Gene Ontology: Mol. function=ubiquitin-protein ligase activity; Cellular component=ubiquitin ligase complex; Biological process =response to abscisic acid stimulus
  Homolog annotation: Hit_ID=Q7ZTZ6; Match level="QueryCoverage=88%, HitCoverage=70%, E-value=6e-27, Identity=34%"; Hit description=STIP1 homology and U-Box containing protein 1
  Pfam annotation: Domain name=TPR_2; Domain location=18-51; Score =19.6; E_value=0.012; Accession=PF07719.7; Description=Tetratricopepti de repeat
  Pfam annotation: Domain name=U-box; Domain location=139-213; Score =136.5; E_value=7.2e-38; Accession=PF04564.6; Description=U-box domain
  Pfam module annotation: Pfam domain module=TPR_2::U-box; Domain location=18-51::139-213
MVNEIKKQDKIRTVHKGWHAHYMLGLALLQRQESAKGIKELEKALDLGRGANPKGYMVEEIWQELAKAKYLEWERSLSKRSWELQSLKEACESALKEKHFLDYSQMEGFVDDATTSHSEQLEALERVFNTAAEADTPTEVPDYLCCRITLDIFHDPVITPSGLTYERAVILEHLQKVGKFDPITREPLDPSQLVPNLAIKEAVEAFLDKHGWAYKID

SEQ ID NO: 153350 - protein, 247 aa, Glycine max
  Coding DNA Sequence Number=SeqID_36572
  Gene Ontology: Mol. function=ubiquitin-protein ligase activity; Cellular component=ubiquitin ligase complex; Biological process =response to abscisic acid stimulus
  Homolog annotation: Hit_ID=Q7ZTZ6; Match level="QueryCoverage=44%, HitCoverage=39%, E-value=4e-21, Identity=42%"; Hit description=STIP1 homology and U-Box containing protein 1
  Pfam annotation: Domain name=U-box; Domain location=169-243; Score =114.6; E_value=2.8e-31; Accession=PF04564.6; Description=U-box domain
MLINKNQNIKTTVIPPFGNKVLELKPTLLGWIGSHPFAGMDHEDPYIYLSTFMELCSTMGAFDEDVEVVYLRAFSFSLTGANPKGYMVEEIWQELAKAKHLEWERSSSKRSWELQSLKEACESALKEKHFLDYSQMEGFVDDATTSHSEQLEALEKVFNTTAEADTPTEVPDYLCCRITLDIFLDLVITRSGLTYERAVILEHLQKVGKFNPITREPLDPSQLVPNLAIKEAVEAFLDKHGWACKID

SEQ ID NO: 153351 - protein, 48 aa, Glycine max
  Coding DNA Sequence Number=SeqID_36573
MKVLERRQCEQSEKKLEESQGTARDATITVGRHMSPLRGKDVLFTIGD

SEQ ID NO: 153352 - protein, 285 aa, Glycine max
  Coding DNA Sequence Number=SeqID_36574
  Gene Ontology: Mol. function=sequence-specific DNA binding; Cellular component=nucleus; Biological process=regulation of transcription, DNA-dependent
  Homolog annotation: Hit_ID=Q8LL11; Match level="QueryCoverage=92%, HitCoverage=88%, E-value=1e-63, Identity=50%"; Hit description =Protein WUSCHEL
  Pfam annotation: Domain name=Homeobox; Domain location=28-90; Score =50.3; E_value=6.4e-12; Accession=PF00046.19; Description=Homeobox domain
QQQQGSQQQQQNEDAGGSGKGGFLSRQSSTRWTPTNDQIRILKDLYYNNGIRSPSAEQIQRISARLRQYGKIEGKNVFYWFQNHKARERQKKRFTFDHNNNNVPMQQRPPTHPNPSASAWKPDPIHTKYSNISSTAGISSASSSSVEMVTVGHMGNYGYGSAPMEKSFRDCSISAGGSSGHVGINHNLGWVGVDPYSSTYANFFDKIRPTDQEEEAENFGATKIETLPLFPMHGEDIHGYCNLKSNSYNYDGNGWYHTEEGFKNASRASLELSLNSYTRRSPDYD

SEQ ID NO: 153353 - protein, 76 aa, Glycine max
  Coding DNA Sequence Number=SeqID_36575
MEEETKWFDGRLVWRIGERKQARFWFDCWIGKNSLGDKISKIISHFNPTKSPYQGHVPVGEIGWEWCLAWRMELFS

SEQ ID NO: 153354 - protein, 127 aa, Glycine max
  Coding DNA Sequence Number=SeqID_36576
  Gene Ontology: Mol. function=nucleic acid binding
  Homolog annotation: Hit_ID=Q1SLA4; Match level="QueryCoverage=85%, HitCoverage=23%, E-value=2e-25, Identity=44%"; Hit description=Zinc finger, CCHC-type; Lipocalin
MESGENNGDGAHAHGHAKPPDGGKSPPIATRNLLQDGNMKLDYEGGNRLLPKFTIDAKVFEQLCIPWKKCLVVKLLGKSIGYLIMKEKLQSTWKPDEGFDLIDVSYGYFMVNFDLDADREKAVNGRP

SEQ ID NO: 153355 - protein, 174 aa, Glycine max
  Coding DNA Sequence Number=SeqID_36577
  Gene Ontology: Mol. function=nucleotide binding; Cellular component =intracellular; Biological process=small GTPase mediated signal transduction
  Homolog annotation: Hit_ID=Q38937; Match level="QueryCoverage=93%, HitCoverage=83%, E-value=9e-88, Identity=95%"; Hit description=Rac -like GTP-binding protein ARAC5
  Pfam annotation: Domain name=Miro; Domain location=8-121; Score=60.9; E_value=4.1e-15; Accession=PF08477.3; Description=Miro-like protein
  Pfam annotation: Domain name=Ras; Domain location=8-174; Score=217.2; E_value=3.7e-62; Accession=PF00071.12; Description=Ras family
  Pfam module annotation: Pfam domain module=Miro::Ras; Domain location= 8-121::8-174
MSASRFIKCVTVGDGAVGKTCLLISYTSNTFPTDYVPTVFDNFSANVVVDGSTVNLGLWDTAGQEDYNRLRPLSYRGADVFILAFSLISKASYENIAKKWIPELRHYAPGVPIILVGTKLDLREDKQFFIDHPGAVPITTTQGEELRKLIGAPAYIECSSKTQQVQFSLLTHMQ

SEQ ID NO: 153356 - protein, 174 aa, Glycine max
  Coding DNA Sequence Number=SeqID_36578
MTRMLLEILNRTHVGGVEVGGKSEKAQTLNLSTKSRFSTIVVDEGVAEIGKTDKPQKRSQSKLAPPSDKVDFDKDLGCEGSHFLRDRSAPQICEHIEYEGLMVLKLGATPFAVVVPIRMILIISDHNAMRLFPVTMPAQQLFRFDFVHVLDREDEDGETKVAYGFSSTIVGGGA

SEQ ID NO: 153357 - protein, 329 aa, Glycine max
  Coding DNA Sequence Number=SeqID_36579
  Gene Ontology: Mol. function=transcription coactivator activity; Cellular component=histone acetyltransferase complex; Biological process=regulation of transcription
  Homolog annotation: Hit_ID=UPI0000162BA0; Match level="QueryCoverage =71%, HitCoverage=6%, E-value=1e-102, Identity=81%"; Hit description =inositol or phosphatidylinositol kinase/ phosphotransferase, alcohol group as acceptor
MVMEVRDSLEIAHTAEYLNFLKCYFRAFSAILLQITKPQFVDNQEHKLRNIVVEILNRLPHSEVLRPFVQDLLKVAMQVLTTDNEENGLICIRIIFDLLRNFRPTLENEVQPFLDFVCKIYQNFKLTVSHFFDNMAMTGEDVKPMETSLSDQGINNTTATGSLLNPSTRSFKIVTESPLVVMFLFQLYSRLVQANIPQLLPLMVAAISVPGPERVPPHLKTHFIELKGAQVKVGAYGRSGSAPIRDGHVCSGTVLGRGGAVRVAELFFAPLLRSTGGSVLCCFVCFVLPKRKREEREGGREDEREREGSVLRRSFNIPLGDSGKKHIYH

SEQ ID NO: 153358 - protein, 214 aa, Glycine max
  Coding DNA Sequence Number=SeqID_36580
  Homolog annotation: Hit_ID=O48822; Match level="QueryCoverage=76%, HitCoverage=76%, E-value=4e-19, Identity=40%"; Hit description =Expressed protein
  Pfam annotation: Domain name=DUF827; Domain location=19-197; Score= -29.4; E_value=2.7e-08; Accession=PF05701.2; Description=Plant protein of unknown function (DUF827)
MDKKGGGMVIMERAEIDTRAPFKSVKEAVMLFGEKVLVGEIYANKLKEMQVEANGSGSAQTRGGALATELEETKQSLEGAREEASNLVQRIKSLKKELEQTQKELEDTKAREQRLLQRRDDPEIEDLKFIANATTTNMEIKTQSSDEEKAEEFQKRRYVKFASPHALAQVIPNKGELLGRPPSVKKPKRKPLMPLIGWLFSKKKGSHEVDSPRA

SEQ ID NO: 153359 - protein, 137 aa, Glycine max
  Coding DNA Sequence Number=SeqID_36581
MNAQKNTNTIISQTPEEERKRKQTKEAVPSLHSREHRCRLFRKRCRPSLHSCNPHKPIPPARKAGSSLPLSRNRQWRYRPLSPVPPAPRAGPPPLSYPAISKGGTPLHPSPSLLVSPYPAIATGGSSFPPVPMAAPT

SEQ ID NO: 153360 - protein, 406 aa, Glycine max
  Coding DNA Sequence Number=SeqID_36582
  Gene Ontology: Mol. function=catalytic activity; Cellular component =NuA4 histone acetyltransferase complex; Biological process=metabolic process
  Homolog annotation: Hit_ID=UPI0000162BA0; Match level="QueryCoverage =100%, HitCoverage=10%, E-value=1e-172, Identity=74%"; Hit description=inositol or phosphatidylinositol kinase/ phosphotransfera se, alcohol group as acceptor
  Subcellular localization annotation: CTP_CleavageSite=33; ConfidenceScore=5.21e-01
MKTIIWSITHAHSPRPQALVSPSSNLSPPQGVRGMREDEVCKASGVLKSGVHCLALFKEKDEEREMLHLFSQILAIMEPRDLMDMFSLCMPELFECMISNTQLVHIFSTLLAAQKVYRPFADVLVNFLVSSKLDVLKQPDSPAAKLVLHLFRFIFGAVAKAPSDFERILQPHAPVIMEFCMKNATEVERPLGYMQLLRTMFKALSGCKYELLLRDLVPMLQPCLNMLLAMLEGPTAEDMRDLLLELCLTLPARLSSLLPYLSRLMKPLVLCLTGSDELVSLGLRTLEFWVDSLNPDFLEPIMASVMSEVILALWSHLRPAPYPWGAKALQLLGKLGGRNRRFLKEPLALECKENPEHGLRLILTFEPATPFLVPLDRCINLAVEAVMNKNCGMDAFYRKQALKFLR

SEQ ID NO: 153361 - protein, 119 aa, Glycine max
  Coding DNA Sequence Number=SeqID_36583
  Subcellular localization annotation: CTP_CleavageSite=91; ConfidenceScore=5.66e-01
MDGATAQKQSFAPNRNIRMKTPKKNGRGLLNPPPPPPSRAMSFSYSHPLSASSLIYMQQQPPLLPLPHVVNKKKNRSREEAKKRPGTQSILSDNRWGPDPKDLPKVVLGMGNIDDVVVS

SEQ ID NO: 153362 - protein, 643 aa, Glycine max
  Coding DNA Sequence Number=SeqID_36584
  Gene Ontology: Mol. function=microtubule motor activity; Cellular component=microtubule associated complex; Biological process =microtubule-based movement
  Homolog annotation: Hit_ID=UPI0000162E28; Match level="QueryCoverage =84%, HitCoverage=55%, E-value=1e-123, Identity=48%"; Hit description= ATP binding / microtubule motor
  Pfam annotation: Domain name=Kinesin; Domain location=74-433; Score =118.5; E_value=1.9e-32; Accession=PF00225.13; Description=Kinesin motor domain
  Subcellular localization annotation: CTP_CleavageSite=49; ConfidenceScore=5.08e-01
MDPNTSPRCPGTITVRRNPPRRARATPQTTPQSFHLPEIAPFPNDDVLSAAQTPEIPPTPLPKPENKNLKVFLRIRPLPSSPVQAPRVRPKSAWPQNPVKKNAPPPGAKISKNKNPAACLTVNDSQSVTLSTPVSSKESKRIKSETYGGFSHVFSSDSSQFQVYERMMKPLVEEFLRGRSGMLAALGPSGSGKTHTVFGTPRDPGMVPLALRHIFEDTEPHAIQASRTFYMSIFEICSERGKAEKLFDLLSDGSEISMQQSTVKGLKEVIISNTELAESLIAQATLKRATAMTNTNSQSSRSQCIINIRDVPPKCKGVINPKSNGASLTIIDLAGAEREKRTGNQGTRLLESNFINNTLMVFGLCLRSLLEHQKNRKKPLQKHFQSSMLTRYLRDYLEGKKRMSLILTAKSGEEDYLDTSYLLRQASPYMQIKYNEVEPSNIVSKKRHYQASSIMDNTKLSPLSEHLKRMRLVTEHTDQNDEKNVEERKTVMEDASTLCKLESSSSVTFKPECDSQVQSERGHIIMQNFAKVIWNVLKQYNSKLKVAEMEIESLKESIGYEKKKYLELETHLNEFKACCTCCKRGKIKNDPEDCSSVDLDQPHNWEQEVEYSIPRFLLSSMKISKIFIDAPSSLIYSSRIDTL

SEQ ID NO: 153363 - protein, 95 aa, Glycine max
  Coding DNA Sequence Number=SeqID_36585
MNHKGIPSFVFNDYNQEVMLAMNPKAVSLLSLVITTKKLYPLLAMNPKAVSLLDPVINQEANPLLAMNPKAISLLSLVFNQEDLLLKNSHQEWVY

SEQ ID NO: 153364 - protein, 346 aa, Glycine max
  Coding DNA Sequence Number=SeqID_36586
  Gene Ontology: Mol. function=sugar porter activity; Cellular component=nucleus
  Homolog annotation: Hit_ID=Q1SNI6; Match level="QueryCoverage=98%, HitCoverage=98%, E-value=7e-53, Identity=43%"; Hit description=Sugar transporter superfamily
METPSSTRRVITRSQTLSASNDALITVFRNIEDSEKNTSKSKTRVQQQQDQSALIDITNDSPIAGLANGVILGTPLAKQRRSKMKNTPGSGEALLRGQVKTLLLKVEEEVELSKFSLESMELVAPMPVNTPQFQNLSGLASVTNPSVVLKNPLIPQVVNHVFDGSESEKSVISRSLLFDFSEKSQLSNASEEFFSALSYEELVQAGKEISSCCIEGDDASIWSMQVNASTHDEEEDDEVTTAYEEDCCEDVEGEEEKEEYDEGGLLLDELCEGLNNISMNERIAPKFEGKHTRFVYNSDDEIVKEEVEENFGESASSTKILRLKGLPTPKGKHLRFYEEEDGKSAL

SEQ ID NO: 153365 - protein, 144 aa, Glycine max
  Coding DNA Sequence Number=SeqID_36587
  Homolog annotation: Hit_ID=Q2HRX8; Match level="QueryCoverage=83%, HitCoverage=17%, E-value=2e-10, Identity=33%"; Hit description=IMP dehydrogenase/GMP reductase
  Pfam annotation: Domain name=DUF1723; Domain location=111-144; Score =10.8; E_value=0.027; Accession=PF08330.1; Description=Protein of unknown function (DUF1723)
MTEDVPDMTEDVPHMAEDAPEMTADVQTDDGAEGSHADDPEGFPGGLRDPSVLTSFASHVAHAIWSGQERPELKLVSDGRNVTLIGRPVPEIEGLVAAAGLSPLIGCFVVTGDPELISAFVERWHRETNTFPLPVEELTITLDD

SEQ ID NO: 153366 - protein, 217 aa, Glycine max
  Coding DNA Sequence Number=SeqID_36588
EHLPKQSRVRGHLVKIDADSLNTFLETPVVLAEGETLPAYSRYCRLPIDYREIETALCIPGRGFILNSEGHPGKILRKDLTTLAQMTSIAQSNTSRLGFPALITALCRARGVVSDSLTFERLSPVINLAYIRKNCWNPEDLTVSIRGARGARARLAELPSTSAAPTPASTSVAPSVPVQIDSQHLEAMLQSIHQGHIILLQSLQMMAPLNSSFSKAI

SEQ ID NO: 153367 - protein, 981 aa, Glycine max
  Coding DNA Sequence Number=SeqID_36589
  Gene Ontology: Mol. function=protein transporter activity; Cellular component=nuclear pore; Biological process=protein import into nucleus, docking
  Homolog annotation: Hit_ID=Q2HVN9; Match level="QueryCoverage=98%, HitCoverage=84%, E-value=0.0, Identity=81%"; Hit description =Armadillo-like helical
  Pfam annotation: Domain name=Arm; Domain location=313-356; Score=2.5; E_value=6; Accession=PF00514.13; Description=Armadillobeta-catenin -like repeat
  Pfam annotation: Domain name=Arm; Domain location=360-398; Score =14.9; E_value=0.17; Accession=PF00514.13; Description=Armadillobeta -catenin-like repeat
  Pfam annotation: Domain name=HEAT; Domain location=213-249; Score =7.4; E_value=5.3; Accession=PF02985.12; Description=HEAT repeat
  Pfam annotation: Domain name=HEAT; Domain location=280-315; Score =27.5; E_value=4.6e-05; Accession=PF02985.12; Description=HEAT repeat
  Pfam annotation: Domain name=HEAT; Domain location=321-358; Score =10.4; E_value=2.3; Accession=PF02985.12; Description=HEAT repeat
  Pfam annotation: Domain name=HEAT; Domain location=364-400; Score =14.8; E_value=0.32; Accession=PF02985.12; Description=HEAT repeat
  Pfam annotation: Domain name=HEAT; Domain location=627-664; Score =7.3; E_value=5.5; Accession=PF02985.12; Description=HEAT repeat
  Pfam annotation: Domain name=HEAT; Domain location=67-103; Score=7.9; E_value=4.7; Accession=PF02985.12; Description=HEAT repeat
  Pfam annotation: Domain name=HEAT; Domain location=783-819; Score =31.9; E_value=2.2e-06; Accession=PF02985.12; Description=HEAT repeat
  Pfam module annotation: Pfam domain module=Arm::Arm::HEAT::HEAT::HEAT: :HEAT::HEAT::HEAT::HEAT; Domain location=313-356::360-398::213 -249::280-315::321-358::364-400::627-664::67-103::783-819
QEISLLIFAQLAHYIGQTLLPQISTLHSVFLRSLHSSTPSDVRIAALAAAINFIQCLTNSSDRDRFQDLLPLMMQTLTEALNSGQEAVAQEALELLIELAGTEPRFLRRQIADVVGSMLQVAEAEALEEGTRHLAIEFVVTLAEARERAPGMMRKLPQFVRKLFGVLMNLLLDIEDDPAWHGAEDEEEDAGETSNYGFGQECLDRLSISLGGNTIVPVASELLPTYLSAPEWEKHHAALIALAQIAEGCSKVMITVCDSWRRLPLTWNAARGMVNLVMIKNLEQVLSMILNSFHDPHPRVQWAAINAIGQLSTDLGPDLQVKFHHLVLPALAGAMDDFQNPRVQAHAASAVLNFTENCTSDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEEDDSIETITLGDKRIGIKTSVLEEKATACNMLCCYADELKEGFFPWIDQVAFTLVPLLKFYFHEEVRKAAVSAMPELLSSAKSAVEKGQSQGRDKTYVKQLSDYIIPNLVEALHKEPEVEICASMLDALNECIQVSESHLDEKQVRSIVDEIKQVLTASSSRKHERAERAKEEDFDAEERELLKEENEQEEELFDQVGDCLGTLIKTFRASFLPFFDDLSSYLTPMFGKDKTSEERRIAICIFDDVAEHGREAALKYYDSFLPFLLEACNDEYPDVRQAAVYGVGVCAEFGGSVFKPLVGEALSRLDAVIRHPNALHSDNIMAYDNAVSALGKICQFHRDSINAAQVVPAWLNCLPIKGDLIEAKVVHDQLCSMVERSDRELIGPNNQYLSKIVAVFAEILCAGNNLANEQTVSRMINLLRQLQQTLPPSTLASTWSSLQPQQQLALQSILSS

SEQ ID NO: 153368 - protein, 492 aa, Glycine max
  Coding DNA Sequence Number=SeqID_36590
MTLSLETPTKLFLFVEMKTASSIFPCIRVNACVTDTSLNVALNGSGKCYKYLRHKPVVLSHQRSSSCSSVSPNPNFHDRDLSDLVKVFASSLCEDNIDMEISHDIKIKDDKLGDVKEEKIKAEAELKHKSVEKEHTKSKEEKIKVEAELKNKSVEKEHTKSKEEKKHKDEDKSKKKKKEKVEEEDEEREKKEKDLKAKGDDGEEKKEKDKKEKKKKENKDKGDKTDVEKVKGKENDGEDDEEKKEKKKKEKKDKDGKTDAEKIKKKEDDGKDDEEKKEKKKKYDKIDAEKVKGKEDDGKDEGNKEKKDKEKGDGDGEEKKEKKDKEKEKKKEKKDKDEETDTLKEKGKNDEGEDDEGNKKKKKDKKEKEKDHKKEKKDKEEGEKEDSKVEVSVRDIDIEEIKKEGEKEDKGKDGGKEVKEKKKKEDKDKKEKKKKVTGKDKTKDLSTLKQKLEKINGKIQPLLEKKADIERQIKEVEAEGHVVNEENKNEVQ

SEQ ID NO: 153369 - protein, 442 aa, Glycine max
  Coding DNA Sequence Number=SeqID_36591
  Gene Ontology: Mol. function=transferase activity; Cellular component= membrane; Biological process=metabolic process
  Homolog annotation: Hit_ID=Q2HVN7; Match level="QueryCoverage=62%, HitCoverage=55%, E-value=1e-118, Identity=75%"; Hit description =Exostosin-like
  Pfam annotation: Domain name=Exostosin; Domain location=117-377; Score=32.9; E_value=1.4e-11; Accession=PF03016.6; Description =Exostosin family
AAASSGRVAAASSETVSQSFLGPEEGVVVAREVAAEEDGGHGAALGRLNKDSAWERWWLDEDINWEIRDSSWAESGPRIRATCCIGSLAIACSLSEESEGRPKLQGEDDSFANVLLPVESKPGGNYASESYFKKVPMKSHFITKDPTEADLFFLPFSIARLRHNRRVGVGGKQDFIRDYIQNISHKYPYWNRTGGADHFYVACHSIGRSAMDKAPDVKFNAIQVVCSSSYFLTGNIAHKDTCLPQIWPRKGNPPILVSSKRKRLAFFAGGVNSPVRVKLLETWKNDSEIFVHHGRLKTPYADELLGSNVNYQQWYQKVDFPTHVKGFEVNTTRIGVIIANYYDLPFADVLNWKSFSVVVTTLDIQLGEDMKELQQWSFNNGSLPRHVVMKKVTMQGRIMSGDNGGVKKDDGSVEKDDRGVCDDNEGFAGVKSVVSDDKGGPL

SEQ ID NO: 153370 - protein, 139 aa, Glycine max
  Coding DNA Sequence Number=SeqID_36592
  Gene Ontology: Mol. function=DNA binding; Cellular component=nucleus; Biological process=regulation of transcription, DNA-dependent
  Homolog annotation: Hit_ID=Q9FNN6; Match level="QueryCoverage=79%, HitCoverage=41%, E-value=3e-19, Identity=61%"; Hit description =Similarity to I-box binding factor
  Pfam annotation: Domain name=Myb_DNA-binding; Domain location=7-56; Score=42.6; E_value=1.3e-09; Accession=PF00249.21; Description=Myb -like DNA-binding domain
MDEVGSSSEWSKEQDKAFENALAIHPEDASDRWEKIMADVPGKTLEEIKHHYELLHLIILLQRAQQAMLVMKELARREATLGIVTMNQIMELRLQDQIRNGKRVLHGQRMNTAQGRFDCTVEEAILIGSLLVTSFVHAS

SEQ ID NO: 153371 - protein, 667 aa, Glycine max
  Coding DNA Sequence Number=SeqID_36593
  Gene Ontology: Mol. function=solute:hydrogen antiporter activity; Cellular component=integral to membrane; Biological process =regulation of pH
  Homolog annotation: Hit_ID=Q2HVN4; Match level="QueryCoverage=98%, HitCoverage=80%, E-value=0.0, Identity=64%"; Hit description =Probable Na/H antiporter [imported]-Arabidopsis thaliana, putative
  Pfam annotation: Domain name=Na_H_Exchanger; Domain location=3-371; Score=114.1; E_value=4.1e-31; Accession=PF00999.11; Description =Sodiumhydrogen exchanger family
MTDDNGIGSQTGFLFGPSVLGRWNAFIKNAFPFSNMIPFETVGGMVLVYYVFFVGLEIDLKPITGFHKKAMVIVISCTIFTLPIGFGLYYMLVTDMWRKPLPLVNARPKGAILWGITLSCSSEFPEIAKILSDLKLLLTENGQLTLTASLINDLFSWTLLVLALSNFYYASGISFFITIMLVLVCFVVLHPFFKWLFNNAGTRDREFLESQVIFVLHIVLVIGLLTDGLGMHSIIGAFFLGVVIPQGALNNAVQDKAHDFVASFMMPLFFVTVGERIRIQDLALDTHFTTMVVVVLLAFVAKIVCTMAVSWFCLMPNMEGLSLALIMNTKGIMPLIVLSIGRDRRELDNQTYGVMLVACWLMTILVGPVSFALTKALKTRNILGGNRRSMQNTQPDSPLRLLACIHTKRDANVIIDLLKASCPSVRTPIQVLAVELNKMNTRPTASLIIRDAKKPSFTSKSPKLDTEDTLNSFDNLNQAIFTEKMRIISDYNSMHKDILNLARRRGVALILTTLYKQPTYDGLGAGAATARAVNIINRDQASKDEKKVVLENLVRDAPCCVAIFVDRGLSGHNKEQHVAMFYISGADDREALSYAWRMSRRQEVKLTVVRLVWENPNDEFDEKDKEFIRGFVGQAREMGRVRYLEKKVRDEKETVKVLDKIGNKGFD

SEQ ID NO: 153372 - protein, 115 aa, Glycine max
  Coding DNA Sequence Number=SeqID_36594
MLHSMLQSIHRGQSIIMQSLQGLGLPSIMSMEEFDAQVAWPGDQPSSSGGGGASTAQEPVTEEPPSPAPSPAAAEEETTPAQTLQPSPPFAPAPEETQPLPLDLNENQPQEEQDV

SEQ ID NO: 153373 - protein, 110 aa, Glycine max
  Coding DNA Sequence Number=SeqID_36595
MFEHKLQEDGDNVACPIASEYNLGLRPSHPNPQPRKTRIKANRNCLTNISMFSQFRVPKDEENTSMGSKNIKDGILTCWSEWGCSPRRANLLLFFFFEGNINHVPSFFMG

SEQ ID NO: 153374 - protein, 248 aa, Glycine max
  Coding DNA Sequence Number=SeqID_36596
MDMNLGYIISAQISLIAQHDSSRLGFLALITALCKARGVISDSLILESLGPAINVAYVKRNYWNLDNLSITFRGPRKAKGKRSEAPPSSEIPLSSAPAPTPSAPSASTSILLVPLSAGPSDFIFTPQMLHSMLESFHRGHPIIMQSLQGLGLPSIMSMEEFDAQVAWPGAQPSPSGEGRAFAAQEPAPEEPTAAATEGENEFTPSEPFYFEAGVHMAQEETSTDQIPEPSPAPIPDDAIASELEQPIS

SEQ ID NO: 153375 - protein, 95 aa, Glycine max
  Coding DNA Sequence Number=SeqID_36597
MAPKKLATKRARKTTAGEGSSTSPPADFVFYGHKFCKEITRSNWRQHAEPMPKYDPEVVLEFYANAWPTEEGVLFKRSKVWGQWIPYDRDVSNQF

SEQ ID NO: 153376 - protein, 109 aa, Glycine max
  Coding DNA Sequence Number=SeqID_36598
MALINLSMENGHLRLKIPTISHFSLAERDLNIAKLTNKGEALSACKLALAKRDLARARAFSSYRACLPWIFFINGVICFVKFDGSRMEKEKDDWRRHFKEKMSLEEAHC

SEQ ID NO: 153377 - protein, 94 aa, Glycine max
  Coding DNA Sequence Number=SeqID_36599
MAVRPGELMLSPEEIGLPRRVGSFSPKQFGGLGESEARLGEPGVVIKLPELVKLLQLEGTNSLGEKHEQGERREKKWRWSCKDVNVDHILMYLF

SEQ ID NO: 153378 - protein, 289 aa, Glycine max
  Coding DNA Sequence Number=SeqID_36600
  Homolog annotation: Hit_ID=Q67UH6; Match level="QueryCoverage=86%, HitCoverage=53%, E-value=2e-11, Identity=21%"; Hit description =Mitochondrial transcription termination factor-like
  Pfam annotation: Domain name=mTERF; Domain location=1-248; Score=4.5; E_value=2.1e-08; Accession=PF02536.5; Description=mTERF
  Subcellular localization annotation: CTP_CleavageSite=56; ConfidenceScore=5.08e-01
MQVQSKLCLLSDLGLCASVLVKIVNCRPRFFRSRINSCLEERMAHLTSLFETKEVLQKAIVRNPSLLLSAGRYNVKATVELYEKLGVKKEDLIQMLLLRPTVISRTSFDAEKLEYLSKTGLTKDSKMYKYVVTLIGVSRVETIRDKVANFVKFGFSEEEIFGLVGKSPNVLTLSTEKVQRNMTFILGTMKLDAKMVLKLPYLLYANVDTVLKPRVLLALKMQDMDAELQIMGPTIVSSLRMPEQRFLKLFIQCHDEDVANQLMEFYKRTKEVKRLGESSKKYSKSGFPF

SEQ ID NO: 153379 - protein, 45 aa, Glycine max
  Coding DNA Sequence Number=SeqID_36601
MFDSVGRNRSMRVRPLILAAKNAETGAAKETEFDLEIQQLLLASE

SEQ ID NO: 153380 - protein, 590 aa, Glycine max
  Coding DNA Sequence Number=SeqID_36602
  Gene Ontology: Mol. function=protein serine/threonine kinase activity; Cellular component=flagellin-based flagellum; Biological process=protein amino acid phosphorylation
  Homolog annotation: Hit_ID=Q5D875; Match level="QueryCoverage=99%, HitCoverage=100%, E-value=0.0, Identity=79%"; Hit description =Calcium-dependent protein kinase CDPK1444
  Pfam annotation: Domain name=Pkinase; Domain location=101-358; Score =282.6; E_value=7.7e-82; Accession=PF00069.15; Description=Protein kinase domain
  Pfam annotation: Domain name=Pkinase_Tyr; Domain location=101-359; Score=-19.1; E_value=2.7e-11; Accession=PF07714.7; Description =Protein tyrosine kinase
  Pfam annotation: Domain name=efhand; Domain location=436-464; Score =31.1; E_value=4e-06; Accession=PF00036.22; Description=EF hand
  Pfam annotation: Domain name=efhand; Domain location=473-501; Score =18.9; E_value=0.019; Accession=PF00036.22; Description=EF hand
  Pfam annotation: Domain name=efhand; Domain location=515-543; Score =23.3; E_value=0.00087; Accession=PF00036.22; Description=EF hand
  Pfam annotation: Domain name=efhand; Domain location=545-573; Score =25.2; E_value=0.00023; Accession=PF00036.22; Description=EF hand
  Pfam module annotation: Pfam domain module=Pkinase::Pkinase _Tyr::efhand::efhand::efhand::efhand; Domain location=101-358::101 -359::436-464::473-501::515-543::545-573
  Subcellular localization annotation: CTP_CleavageSite=6; ConfidenceScore=5.33e-01
MGICFSATKVSGSSSNNAAASNRNRKGLAAPAPAPPAQPELEPVTGKQKKQPSQAKRRQVPEDSQKNPRSKDKAGARRQGTHVPCGKRTDFGYEKDFENRFSLGKLLGHGQFGYTYVGIDKTNGDRVAVKRLEKSKMVLPIAVEDVKREVKILKELTGHENVVQFHNAFDDESYVYIVMELCEGGELLDRILAKKDSRYTEKDAAVVVRQMLKVAAECHLHGLVHRDMKPENFLFKSTKEDSPLKATDFGLSDFIKPGKRFQDIVGSAYYVAPEVLKRKSGPESDVWSIGVITYILLCGRRPFWDKTEDGIFKEVLRNKPDFRRKPWPTISNAAKDFVKKLLVKDPRARYTAAQALCMYPTPVTSRPIGNNPTIAGKACPFTGATHPWVREGGEALEIPIDISVLNNMRQFVKYSRLKQFALRALASTLNEGELSDLKDQFDAIDVDKNGSISLEEMRQALAKDQPWKLKESRVLEILQAIDSNTDGLVDFTEFVAATLHVHQLEEHDSDKWQQRSQAAFEKFDLDKDGFITPDELRMHTGLRGSIDPLLEEADIDKDGKISLPEFRRLLRTASMGSRPIMSPSHRHRKI

SEQ ID NO: 153381 - protein, 195 aa, Glycine max
  Coding DNA Sequence Number=SeqID_36603
  Homolog annotation: Hit_ID=Q1SWP9; Match level="QueryCoverage=44%, HitCoverage=17%, E-value=1e-34, Identity=81%"; Hit description =Chalcone and stilbene synthases, N-terminal
MSKLSQSLDENGSGSNIDLVGGSLTDLTLNAFDIDNLVLNHNVEDHILRKSLKDDGNEDDGSGCASKLPSFVPFNHPSFFDTIYDVPSPLPPPFPPLPVVQLSHVLQRGLYLEHTPKRLVIYPLVSPNHMHQLVFGSCSVRTFVREKNRDPTNAEKAIGYEHGLVVPEVPILGYVLGTNDDGIGVGVNLKHVFCE

SEQ ID NO: 153382 - protein, 271 aa, Glycine max
  Coding DNA Sequence Number=SeqID_36604
  Gene Ontology: Mol. function=zinc ion binding
  Homolog annotation: Hit_ID=Q1SHZ1; Match level="QueryCoverage=77%, HitCoverage=99%, E-value=2e-64, Identity=62%"; Hit description=DNA binding protein E4/E8BP-1-tomato-related
MCSSDSLYVCSYCLDKFHTEDDGTLIWRCEDCAPNYPKKCESKELRKSKRISHAAEAKYKRMKMKKESVAVRKLKSVRSSEGFHAECLRRNDIEKRQPILEDKNILYKEPESPKGPLNTSSDKQALEHEKYEALTTPHLKYPEFDQHSRAHPLSDPVWTGQFILNKATDFGLVAYASSKACSKVLSAVTVLPTLLDVEILSRFAIWPKSFDMFPPNSDNIGLYFFPLYERDELSFDRVLNDIIEQEFALKAVINNVELLIFSSHLLPPNDR

SEQ ID NO: 153383 - protein, 201 aa, Glycine max
  Coding DNA Sequence Number=SeqID_36605
  Gene Ontology: Cellular component=nucleus; Biological process=defense response
  Homolog annotation: Hit_ID=Q8LGD5; Match level="QueryCoverage=96%, HitCoverage=84%, E-value=3e-29, Identity=44%"; Hit description =Protein MKS1
  Pfam annotation: Domain name=VQ; Domain location=58-88; Score=38.7; E_ value=2e-08; Accession=PF05678.4; Description=VQ motif
PPPKKEVQLQGPRPPPLKVSKDSHKIKKPPPHPAHHHHNHPHAPPEQNLQQREPVIIYSVSPKVIHVTPGDFMDVVQRLTGASSGEYPPAGRGDVSPAARLASIEKTSPSERERVLHYKDDDIAWMLEEGVEVGQFPGILTPEPGTLPPIPAEVFSPPISGEDFSPSYWSASSFLASPSGFLSVAVASPQPSPNLFSLFDL

SEQ ID NO: 153384 - protein, 642 aa, Glycine max
  Coding DNA Sequence Number=SeqID_36606
  Gene Ontology: Mol. function=binding
  Homolog annotation: Hit_ID=Q1SPQ2; Match level="QueryCoverage=99%, HitCoverage=98%, E-value=0.0, Identity=73%"; Hit description=IMP dehydrogenase/GMP reductase
  Pfam annotation: Domain name=Arm; Domain location=176-216; Score =26.4; E_value=0.0001; Accession=PF00514.13; Description =Armadillobeta-catenin-like repeat
  Pfam annotation: Domain name=Arm; Domain location=217-257; Score =24.8; E_value=0.00031; Accession=PF00514.13; Description =Armadillobeta-catenin-like repeat
  Pfam annotation: Domain name=Arm; Domain location=419-459; Score=4.1; E_value=3.8; Accession=PF00514.13; Description=Armadillobeta-catenin -like repeat
  Pfam annotation: Domain name=Arm; Domain location=475-510; Score=6.9; E_value=1.7; Accession=PF00514.13; Description=Armadillobeta-catenin -like repeat
  Pfam annotation: Domain name=Arm; Domain location=553-593; Score =20.2; E_value=0.0073; Accession=PF00514.13; Description =Armadillobeta-catenin-like repeat
  Pfam module annotation: Pfam domain module=Arm::Arm::Arm::Arm::Arm; Domain location=176-216::217-257::419-459::475-510::553-593
MGDIVKQILAKPIQLADQVTKAADEASSFKQECGELKAKTEKLAALLRQAARASSDLYERPTRRIIDETEHVLDKALALALKCRGNALMKRVFTLNPGAAFRKVSLLLENSIGDVSWLLRVSAGDGGGDYIGGLPPIATNEPILCFIWEQIAVLHTGTLEDRSDAAAQLVSLASNSDRYGKLIIEEGGVGPLLKLLKEGKAEGQEHAARAIGLLGRDPESVDNMIHVGACSVFAKILKESPMKVQAVVAWAVSELAANYPKCQDLFAQHNIIRLLVGHLAFETVEEHSKYTIVSTKPTSIHAVVIANNNVKKEDHFHDNEKKARMPHPLGDNRPRNLHRVITSTIAMHAATKQGNEPNHNHQTNGNGVDNDAKQGNQNHQRNYSHSGINMKGRDHEDPQTKANMKEMAARALWHLAKGNSPICRSITESRALLCFSVLLEKGTEAVQYNSAMAVMEITSVAEKDAELRKSAFKPNSPACKAVVDQVVKIIEKADSDLLIPCIKTIGNLARTFKATETRMIGPLVKLLDEREAEVSREASIALTKFACTENYLHVDHSKAIISAGGAKHLIQLVYFGEEMVKIPALVLLSYTAMHVPDSEELAQAEVLGVIDWASKQSSIANDPAIEALLLESKSRLELYQSR

SEQ ID NO: 153385 - protein, 118 aa, Glycine max
  Coding DNA Sequence Number=SeqID_36607
MSEIEEVQEQMKAHMEAMKEQMDTMMEAMMSMKRMVEVNTAIVIAASTATEVDQTHPSRINQASRPVPDMNKHYFPPYGLPPNYTPPDVAHALDENVNNSTLILIESQQPQFDHAHVS

SEQ ID NO: 153386 - protein, 566 aa, Glycine max
  Coding DNA Sequence Number=SeqID_36608
  Gene Ontology: Mol. function=transferase activity, transferring hexosyl groups; Biological process=carbohydrate biosynthetic process
  Homolog annotation: Hit_ID=Q5BMA3; Match level="QueryCoverage=96%, HitCoverage=85%, E-value=0.0, Identity=77%"; Hit description =Secondary cell wall-related glycosyltransferase family 8
  Pfam annotation: Domain name=Glyco_transf_8; Domain location=237-449; Score=209.5; E_value=7.5e-60; Accession=PF01501.10; Description =Glycosyl transferase family 8
MSMGTSPLAVEARHRLPASMWIWGGSDPRYMSNVATDWDDILKITEKLTGEDELEGIGLVNFNKTELAQWEHLIPDATHVVLPLEYAARNVTWESLYPEWIDEEEETEVPVCPSLPSLRSPGIRLNLISVKLPCRNGGNWSRDVARLHLQLAAAALATSFKGNYPVYVLFITNCFPIPNLFSCKELVAREGNVWLYKPNLSVLREKVQLPVGSCELALPMRGKELVYNGNAPREAYATILHSAHVYVCGAIAAAQSIRMSGSTRDLVILVDETISSYHRSGLEAAGWKVRTIQRIRNPKAEKDAYNEWNYSKFRLWQLTDYDKIIFIDADLLILRNIDFLFGMPEITATGNNATLFNSGVMVVEPSNCTFQLLMDHINEIESYNGGDQGYLNEIFTWWHRIPRHMNFLKHFWIGDEEEKKQMKTLLFGAEPPILYVLHYLGVKPWLCFRDYDCNWNDDIFHEFASDVAHAKWWKVHDAMPELLQQFCLLKSKQKAQLEWDRKQAEIANYTDGHWRIKVKDRRLKKCIDNLCNWKSMLRHWGETNWTDDEFYTPTPPTVITASLSAL

SEQ ID NO: 153387 - protein, 836 aa, Glycine max
  Coding DNA Sequence Number=SeqID_36609
  Gene Ontology: Mol. function=nucleic acid binding
  Homolog annotation: Hit_ID=Q9LIH5; Match level="QueryCoverage=99%, HitCoverage=99%, E-value=1e-48, Identity=26%"; Hit description =Arabidopsis thaliana genomic DNA, chromosome 3, TAC clone:K24M9
  Pfam annotation: Domain name=zf-CCCH; Domain location=139-164; Score =26.8; E_value=7.8e-05; Accession=PF00642.15; Description=Zinc finger C-x8-C-x5-C-x3-H type (and similar)
  Pfam annotation: Domain name=zf-CCCH; Domain location=198-223; Score =18.4; E_value=0.0048; Accession=PF00642.15; Description=Zinc finger C-x8-C-x5-C-x3-H type (and similar)
  Pfam annotation: Domain name=zf-CCCH; Domain location=262-287; Score =24.9; E_value=0.00029; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=139-164::198-223::262-287
MSGSGKKRSSKWDLRDDPDFSPDDSQQLRSGWSSAGDKLKPGMGFSSKEPFSGGRGSNKDDIMNKDYRVLDATMEWDEDGSYNNEMSPGLEGWKHNKRHSQSPKNGWSRSVRSSRSRSPPHGFRWDSGVNDRNRMRAGGSTQPCRDFAAGKCRRGSHCHFLHDNQNHEDSWEDKYREDGAPRYSAPHEGRDYSLKSGRSNEACINFPKGRCRMGASCKFVHHNNSDGHSKVSVDELAREREIDRRHRDSSFEQGGGHGPNRSGDTLCKFFANGHCRNGKYCRFSHDRQACRSPNRRSRDDRWASNPGGDYHMLDRPKLSDSVSPNRRPRDDRWGSDGNRADADKVWDSPKRNDTVAVSDTAKLVEDKSENVVAAEQGFTPLATRDGWGHSLDKSRVHGEQPFSSDKKEADSWITGNNAANMHGSQSIGTDIWLGDDAKMSPDWDYRVRSSSCIEEKHEQNKHGITQGFMYLDTSEHDRIQIAPGQGFNQNAVSFNSLHSSSCQAVGQSQVAVPILPSKGGIVDGMLKQEVSTEKKYTAEPNIMDAGLSQVSSRNPPPTANVVGKEQLAQLTNLSASLAHILGTGQQLPQLYAALNSHDAKDISSLAKTEVPAMPVSNTFIRPDPTVGLLKQYDPMCDSVEPKGAVASGVPPAIPPSQKVADVVEIPSQSNTGRQNCGDSSKAAGSEELVKSDPLIQLQPGQNTGVNKDNNKEMLPEETLKSKDDPKSTKESGPFENMEQTDGPDEAKKIKGMKGNRAFKFALVEFVKELLKPTWKDGQITKEDYKTIVKKVVDKVTGSMQGVNIPQTQEKIDHYLSFSKPKLNKLVQAYVEKVQKA

SEQ ID NO: 153388 - protein, 118 aa, Glycine max
  Coding DNA Sequence Number=SeqID_36610
MGKDVPPYVLSFTRYTCAQFTSRTSIEENQCNTHCRFDLLFGWPIVECFLEKFMRCVESYKCYDEESILFEACRPVALLKGRPDSISKQYQALLGVWHIKVTGMHASPNSPTGSYNVL

SEQ ID NO: 153389 - protein, 243 aa, Glycine max
  Coding DNA Sequence Number=SeqID_36611
  Gene Ontology: Mol. function=transcription regulator activity; Cellular component=nucleus; Biological process=regulation of transcription
  Homolog annotation: Hit_ID=O81313; Match level="QueryCoverage=37%, HitCoverage=53%, E-value=8e-35, Identity=81%"; Hit description =Protein INDEHISCENT
  Pfam annotation: Domain name=HLH; Domain location=127-174; Score =27.9; E_value=3.6e-05; Accession=PF00010.16; Description=Helix-loop -helix DNA-binding domain
MDINESITSTFSNVVNSTWNHEKMGTEEHNIILHDHHQIPKGVGIWPHYNYPLHNIQPSSSSNVAPSSSNFLTDILGVHFEEEEDEEEEELGAMKEMMYKMAVMQPVDIDPASVRKPKRRNVRISDDPQSVAARHRRERISEKIRILQRLVPGGTKMDTASMLDEAIRYVKFLKRQIRFLQSTPPPPINCNVGAAPNSEYYWPFAPNMLHSSTTTFIDMPVIGMEFNTRSHGHAGDSIHLRQS

SEQ ID NO: 153390 - protein, 114 aa, Glycine max
  Coding DNA Sequence Number=SeqID_36612
MDEKRVKDSLDLEIVEDSMDVERVEDSFDLKDFVDVKRVEDSLDLKRVEDSIDAERVENSLDLERVDDSLDLNIVEDMDAERVKDSLNLERVKDSLDEIANALYCSTILFISNF

SEQ ID NO: 153391 - protein, 304 aa, Glycine max
  Coding DNA Sequence Number=SeqID_36613
  Homolog annotation: Hit_ID=Q47522; Match level="QueryCoverage=21%, HitCoverage=87%, E-value=9e-22, Identity=73%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSITHRKEPGLWSYAGSWGGPPSDLPVLLGSSRHSTERESPDSYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 153392 - protein, 113 aa, Glycine max
  Coding DNA Sequence Number=SeqID_36614
  Gene Ontology: Mol. function=magnesium ion binding; Biological process=metabolic process
  Homolog annotation: Hit_ID=Q5UB06; Match level="QueryCoverage=48%, HitCoverage=9%, E-value=4e-10, Identity=60%"; Hit description=Wound -inducible putative chloroplast terpene synthase 3
MVQLIIGMPHVPTLASEERVELTKPISLVYITDNIFDIYGNLDELILFTAAVSRKGQVSLTAPPSVCVKVKQRNTVVFYFKVRPQADDFTIFKGLDKYKNEELIKYGFLEDIW

SEQ ID NO: 153393 - protein, 84 aa, Glycine max
  Coding DNA Sequence Number=SeqID_36615
  Gene Ontology: Mol. function=prephenate dehydratase activity; Biological process=L-phenylalanine biosynthetic process
  Homolog annotation: Hit_ID=Q1RXT6; Match level="QueryCoverage=81%, HitCoverage=17%, E-value=8e-23, Identity=71%"; Hit description =Prephenate dehydratase with ACT region
  Pfam annotation: Domain name=PDT; Domain location=1-84; Score=-95.3; E_value=0.043; Accession=PF00800.9; Description=Prephenate dehydratase
MGNEFPSSDGSKLCVAYKAVESWLVDKVVLPIQSSVGWSIHRNYDLLLGHKLHIIGEVQLLINHYLLGLPGVRKKDLRAVMSHP

SEQ ID NO: 153394 - protein, 88 aa, Glycine max
  Coding DNA Sequence Number=SeqID_36616
MVSGAMQNLLDLKVVPEGKSHHQLIQQALQVLQEGLTTRCNSGTQRPLDRLIQATKFWTTPLPDREDKSGRCHKNYLDKSEIGSARNP

SEQ ID NO: 153395 - protein, 90 aa, Glycine max
  Coding DNA Sequence Number=SeqID_36617
  Gene Ontology: Mol. function=RNA-directed DNA polymerase activity; Biological process=DNA integration
MEDAPVSPRVALPPKGIFPWLTNEANKQRIYIHQTKYVKELLKKFNMDNAKEMKTPMHLTTYLTLNEELKKVDNTQYKAMIGSLCECMYT

SEQ ID NO: 153396 - protein, 241 aa, Glycine max
  Coding DNA Sequence Number=SeqID_36618
  Gene Ontology: Mol. function=DNA binding; Cellular component=beta -galactosidase complex; Biological process=DNA integration
  Homolog annotation: Hit_ID=Q1SS72; Match level="QueryCoverage=89%, HitCoverage=14%, E-value=1e-62, Identity=52%"; Hit description =Integrase, catalytic region
MIHVILWHHQNIQLDPLSTLIYLMNTRPNIAHAVQQLSQYMANPTTAHSQASFCVLRYLKGTPSFGILFAAHGTPQLKAFSDSDWAGCRDSRCSITRFSVYLGTSLISWQSKKQSIVSRSSSEAEYRALASTMCELQWLTYLIHDFRVPFIQPATLYCDNQSTIQIASNPVFHERTKHIEIDCHIVRDKVNSYIIKLLPVSSSMQLADIFTKPLSPTIFQGLCSKLGMMNIHSQLAGGSQQ

SEQ ID NO: 153397 - protein, 42 aa, Glycine max
  Coding DNA Sequence Number=SeqID_36619
MEAPSLGKTMLFTCEEMGIDEIKTKWRAFQVPFTVFPLLFLS

SEQ ID NO: 153398 - protein, 53 aa, Glycine max
  Coding DNA Sequence Number=SeqID_36620
MKNTKRGNIVECLYTYDGGFPPVFECDTSKMVMTPKSSLNDANFKMILALKLS

SEQ ID NO: 153399 - protein, 95 aa, Glycine max
  Coding DNA Sequence Number=SeqID_36621
MEGLWSKRRQKEKKQGQNQREGSHRTEGEQGRKSTLYVEKKEWLYQSLVGTLKDLSNFDKLQNICVHGGGEVIKLNYLEMTGFFLEDWIWRRHNS

SEQ ID NO: 153400 - protein, 108 aa, Glycine max
  Coding DNA Sequence Number=SeqID_36622
MLESFKQQDQMSVLELYIEKDVAGGSMFHSANSLTSCGNYLSNDETQLPTNMSNLHIDEVDDDDDDYLMSNSYVEESLDEDDSVDGIFDTDNEVTDIPQPVRIVYPAE

SEQ ID NO: 153401 - protein, 163 aa, Glycine max
  Coding DNA Sequence Number=SeqID_36623
MNSLSYTRFLNRNLARLLIWGFGGRMVRGGIGNGDVGSFVWEDLRLTRLVNMDHEELEVFIKNVYILSLYNWCGFRVVQHYMQQHGGMSWERSSDGFGILFGMLRVCASGKVFEQPLRFPRELLDGLAKLSCEAHLFCQDIHMKTVFEQQPPQFNEFVTSVLE

SEQ ID NO: 153402 - protein, 281 aa, Glycine max
  Coding DNA Sequence Number=SeqID_36624
  Gene Ontology: Mol. function=transporter activity; Cellular component= integral to membrane; Biological process=transport
  Homolog annotation: Hit_ID=P25794; Match level="QueryCoverage=91%, HitCoverage=89%, E-value=1e-132, Identity=88%"; Hit description =Probable aquaporin PIP-type 7a
  Pfam annotation: Domain name=MIP; Domain location=47-261; Score =354.8; E_value=1.4e-103; Accession=PF00230.10; Description=Major intrinsic protein
MEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGTLNGGANFVAPGYTKGDGLGAEIVGTFVLVYTVFSATDAKRNARDSHVPILAPLPIGFAVFLVHLATIPITGTGINPARSLGAAIIFNKDLGWDDHIFRENESGPSDSDAYCLSFSVQ

SEQ ID NO: 153403 - protein, 482 aa, Glycine max
  Coding DNA Sequence Number=SeqID_36625
  Gene Ontology: Mol. function=binding; Cellular component=membrane
  Homolog annotation: Hit_ID=O82388; Match level="QueryCoverage=87%, HitCoverage=82%, E-value=1e-38, Identity=33%"; Hit description =Expressed protein
  Subcellular localization annotation: CTP_CleavageSite=30; ConfidenceScore=5.17e-01
MASRVSPSLKCWQFRTPYYCDSWKTPRAVPSSILRHVTERNNVMPPCGLLVHRSRKNLRVQRGKRVYSSLFDDFRQEERMNLVQDGCWDENGNEIACAVSDNEFENDSSAKGCSSEEFGTMKPEVLEPSLLGIQPEPPSWPERDEILRLTFERKVNSVGIPLSIRMIKKKLQLEEGLKEAGELNELTNCSVNKTFSSMMFIMHELQSRALQTRESLFGEDLQSVMTKLEREMDASFVWLFQQVFWKTPALMVFVMVLLANFLVFSMNDNTVKAITPSSMITKALTLTGNESKVRHSQVDTDVDQGEYVNKELNEEEEMLWNSFLEEASMLQKELSGEVLDHETRQRLVAPVSVELEGDQYEEYVKTELYYKKHLLRTPHCSLLLSNYAQFLFLVLHDIDGAEEYYKRSVLAESPEAEAFSRYADFLLMVRKDVWAAELRYLQALEADPGNTYYLSKYASFLWNTGGQDANSFPIEELDNLQL

SEQ ID NO: 153404 - protein, 59 aa, Glycine max
  Coding DNA Sequence Number=SeqID_36626
  Gene Ontology: Mol. function=receptor activity
  Homolog annotation: Hit_ID=Q5Z8V4; Match level="QueryCoverage=93%, HitCoverage=15%, E-value=1e-14, Identity=62%"; Hit description =Putative Reg receptor
MTAIAESKIFEIGSTGISSLGGHSERRTECVNRFAAVYGRMPLVSTSVKAVDSRNIWFW

SEQ ID NO: 153405 - protein, 112 aa, Glycine max
  Coding DNA Sequence Number=SeqID_36627
MIANKHLDLESGKRGGGGGVWLLIHRTKEEALVENARSVKATQQQRRSLILSDLTVEIASRRKRCSVRRFHQQLPLMTAAMRVSEGSAGSHPEPNENLNDNGFVSLTCESES

SEQ ID NO: 153406 - protein, 116 aa, Glycine max
  Coding DNA Sequence Number=SeqID_36628
MAGLNPEMKQLSTNACTTNPWDPHMLTKQNGNVTNGETLTTRRAAHCVVLKELRDLEGPTSWIRTIKPWDVELHTMHWIVRWAASVLSMKMVAFAVVAGSLRVATYDEGDHQSSNS

SEQ ID NO: 153407 - protein, 56 aa, Glycine max
  Coding DNA Sequence Number=SeqID_36629
MRKLAGKRSVFFLDLDDEMQVGIHQVEEDAMDGGAASISTWNQKRKRLGDSKPNIP

SEQ ID NO: 153408 - protein, 139 aa, Glycine max
  Coding DNA Sequence Number=SeqID_36630
MIQGHDTRETSGKSFGVVLKGQHGYSLKRDKREINFLGLEDIPNGDWFCPSCRCRICGQRKINGDESLASEAQVTSLERIDESENRGNAYSSSFLFTEAFHTFIVATPQLLIAIRIIPAGFKRHFVLKVTKERAALPFA

SEQ ID NO: 153409 - protein, 532 aa, Glycine max
  Coding DNA Sequence Number=SeqID_36631
  Gene Ontology: Mol. function=protein transporter activity; Cellular component=mitochondrial inner membrane; Biological process=protein transport
  Homolog annotation: Hit_ID=Q84Q17; Match level="QueryCoverage=96%, HitCoverage=70%, E-value=8e-86, Identity=33%"; Hit description =Putative pentatricopeptide (PPR) repeat-containing protein
  Pfam annotation: Domain name=PPR; Domain location=151-185; Score =25.4; E_value=0.00021; Accession=PF01535.11; Description=PPR repeat
  Pfam annotation: Domain name=PPR; Domain location=255-289; Score =37.9; E_value=3.4e-08; Accession=PF01535.11; Description=PPR repeat
  Pfam annotation: Domain name=PPR; Domain location=352-386; Score =41.5; E_value=2.8e-09; Accession=PF01535.11; Description=PPR repeat
  Pfam annotation: Domain name=PPR; Domain location=387-421; Score =14.7; E_value=0.14; Accession=PF01535.11; Description=PPR repeat
  Pfam annotation: Domain name=PPR; Domain location=423-457; Score=6.9; E_value=1.1; Accession=PF01535.11; Description=PPR repeat
  Pfam annotation: Domain name=PPR; Domain location=489-523; Score =12.9; E_value=0.22; Accession=PF01535.11; Description=PPR repeat
  Pfam annotation: Domain name=PPR; Domain location=83-117; Score=34.8; E_value=2.9e-07; Accession=PF01535.11; Description=PPR repeat
  Pfam module annotation: Pfam domain module=PPR::PPR::PPR::PPR::PPR::PP R::PPR; Domain location=151-185::255-289::352-386::387-421::423 -457::489-523::83-117
  Subcellular localization annotation: CTP_CleavageSite=58; ConfidenceScore=5.23e-01
MTMKHQTKPSNNKKKKNALIHVLKACAQLSRFGSGRGVHKDVVVFGEESNLQVRNSVLDMYSKCGDVGSARQVFDEMSERDVFSWNSMMSGYVWNGLPHKAVEVLGVMKKDGCGCEPDVVTWNTVMDAYCRMGQCCEASRVFGEIEDPNVISWTILISGYAGVGRHDVSLGIFRQMVNVGMVSPDVDALSGVLVSCRHLGALASGKEIHGYGLKIMCGDVFYRSAGAALLMLYAGWGRLDCADNVFWRMDKSDVVTWNAMIFGLVDVGLVDLALDCFREMQGRGVGIDGRTISSILPVCDLRCGKEIHAYVRKCNFSGVIPVYNALIHMYSIRGCIAYAYSVFSTMVARDLVSWNTIIGGFGTHGLGQTALELLQEMSGSGVRPDLVTFSCALSACSHSGLVNEGIELFYRMTKDFSMTPAREHFSCVVDMLARAGRLEDAFHFINQMPQEPNNHVWGALLAACQEHQNISVGKLAAEKLISLEPHEAGHYVTLSNIYSRAGRWDDAARVRKMMDGHGLLKPSGHSLVGTGS

SEQ ID NO: 153410 - protein, 110 aa, Glycine max
  Coding DNA Sequence Number=SeqID_36632
MARHMEWSNLPFEFKGYSDYSPIIQNYMHLLFPPLNLDVLKTFSLIGFNYCQRSQGVRYCDVAGESVVVVATTVYSTAAISQAHAQLGVEWLVLPVVPSVLETWTLLCKD

SEQ ID NO: 153411 - protein, 140 aa, Glycine max
  Coding DNA Sequence Number=SeqID_36633
  Gene Ontology: Mol. function=N-acetyltransferase activity; Biological process=metabolic process
  Homolog annotation: Hit_ID=UPI00001628AD; Match level="QueryCoverage =65%, HitCoverage=8%, E-value=3e-18, Identity=56%"; Hit description =DNA binding / N-acetyltransferase/ RNA binding / protein binding / zinc ion binding
MHECFEPLKVSCTSRDLMEDVIFSKWLEIVILQDVVKAKPIEFLGFLYVLLERNAELISVATDRKKVAEVPLIGTGLQYCRHGMCRILIKELENGDQSGSCCFARMLQRCEIDTDLKKHSNRVTPKAYTQKGPSGLLPPD

SEQ ID NO: 153412 - protein, 121 aa, Glycine max
  Coding DNA Sequence Number=SeqID_36634
  Gene Ontology: Mol. function=chromatin binding; Cellular component =chromatin; Biological process=chromatin assembly or disassembly
  Homolog annotation: Hit_ID=Q1SAV4; Match level="QueryCoverage=77%, HitCoverage=24%, E-value=3e-19, Identity=52%"; Hit description =Integrase, catalytic region
  Pfam annotation: Domain name=Chromo; Domain location=44-92; Score =12.5; E_value=0.032; Accession=PF00385.14; Description='chromo' (CHRromatin Organisation MOdifier
  Subcellular localization annotation: CTP_CleavageSite=61; ConfidenceScore=5.07e-01
MPQGSKIQLVFHCLLLKLHQGHQGPLPVPPTSFPPLATNNHPLVAPLSILDSKMNDSTKPRTKLVSVQWLGLSPEDTSWEEWDDTYHLEDKMSFPTEGDYSNVTHNTRPMRTTPTTFKDYV

SEQ ID NO: 153413 - protein, 55 aa, Glycine max
  Coding DNA Sequence Number=SeqID_36635
MTVVIVVVTTTGDSDDDNHVVVAPTIIMVAATLVMLVVIDNGGASGNYGDGCSGG

SEQ ID NO: 153414 - protein, 90 aa, Glycine max
  Coding DNA Sequence Number=SeqID_36636
MYWHESYECDALTKVKRIEERIYTVIYWVKRFKNLEKLASGNYPTFGALIWHGSKLGDWCTLYPYVAITPDYYPHKCIRPSRLGKIGGIG

SEQ ID NO: 153415 - protein, 168 aa, Glycine max
  Coding DNA Sequence Number=SeqID_36637
  Homolog annotation: Hit_ID=Q9LTA2; Match level="QueryCoverage=45%, HitCoverage=43%, E-value=8e-10, Identity=52%"; Hit description =Similarity to AT-hook DNA-binding protein
MTVATTVTTITMIIAIMTTSIVSSTIVSGDGYGNNDSHGNNNGDVVTTVMATTMVITTIMMVVVVKLLHLKEGDSCTYITQPKRASSPRRHRKLVETEPPGEESTDDLPLRSGKGHDKGVWDHLRRTVVEEGGRHGKDIEVVMESDSGAGKSERRLMESDVGDNFKID

SEQ ID NO: 153416 - protein, 84 aa, Glycine max
  Coding DNA Sequence Number=SeqID_36638
MTIFASVCQSIVIESSKGEDLESNEGEDFESFEGEDVESSKGDDFESSEGEDVEFSKGEDFESSEGLDFESYECEDYESSERCQ

SEQ ID NO: 153417 - protein, 58 aa, Glycine max
  Coding DNA Sequence Number=SeqID_36639
RNLDQLEDLLNKVKLKTIRTEPPSASIAGTSWCIFGVSVDSVVAALQFVAPSAKGFFL

SEQ ID NO: 153418 - protein, 132 aa, Glycine max
  Coding DNA Sequence Number=SeqID_36640
  Gene Ontology: Mol. function=nucleic acid binding
YIYLGLTKNKRGYISCGSVLVEGTSTRFKENKGGYIPCGYLLVKGFLQDPYAHLATYIEICNTVRLAGNSLKTWDEVVEKFLKKYFPESKTAEGKAAISSFHQFVDESLSEALERFHGLLRKTPNHGFSELI

SEQ ID NO: 153419 - protein, 81 aa, Glycine max
  Coding DNA Sequence Number=SeqID_36641
MFLVLSKAPPPVALLGFPNVREKEKRLKPLFHGPTCDASLFFRRHYFANPNGLVVCGKREGFGKMRGENEIERKRRRRRYR

SEQ ID NO: 153420 - protein, 62 aa, Glycine max
  Coding DNA Sequence Number=SeqID_36642
MNERITCGANEGKKIRSEPTKRMFDTRTVSKFGPLPSTTTMGARLGCFSSFWITNLVVWFFS

SEQ ID NO: 153421 - protein, 59 aa, Glycine max
  Coding DNA Sequence Number=SeqID_36643
MTKGKYVGEDIKEVPRKNQKLVIDLLYLLFGQVTQFESLNPLSVRDEMEEKNNLVIDCL

SEQ ID NO: 153422 - protein, 92 aa, Glycine max
  Coding DNA Sequence Number=SeqID_36644
MDKFFNRLHIAYCWKLSGENASTAYVTYRDAYALETALLLNEMCLTDTMTMCSMQIKNTHIQSCSFHPPYPLLPETELVDVILADGDDNNGG

SEQ ID NO: 153423 - protein, 464 aa, Glycine max
  Coding DNA Sequence Number=SeqID_36645
  Gene Ontology: Mol. function=protein disulfide oxidoreductase activity; Biological process=cell redox homeostasis
  Homolog annotation: Hit_ID=Q2HVR5; Match level="QueryCoverage=99%, HitCoverage=99%, E-value=1e-140, Identity=59%"; Hit description =Glutaredoxin
  Pfam annotation: Domain name=Glutaredoxin; Domain location=297-365; Score=59.5; E_value=1.1e-14; Accession=PF00462.14; Description =Glutaredoxin
MGCASSKQKKCRRCNAPYSPAPRSYSMHVHHPPLAEGDSYHVVALTSTTLGTLKLNSPAPTQNFANCDHDFKLSNGKVGNAESFRFDSESFVQRLEEKEKEKKSEVLEKDKKEEFSMGLIEAKTWSNMIEQKLPKVFPKTPIRTPPGEPETINTWELMEGLEDTTTPFRSPSHFRSFSFDFNGGDDVGVGDGGVDVDVDVDPPKMSVVASPKPMWLLMTEEESRLNPEISDFDPEVISSFRKSLQQLSPDSPFHLQPAPPGDEEDKHGTKKGSPFEENEFVVDDVKVDDPCGKDKVVLYFTSLRGVRKTYEACCQVRMILKGLGVRVDERDVSMHSGFKEELKELLGDGYGSLGLPRVFLGGNYIGGAEEIQRLHEDGKLEKLLVCCEKIEDSVGGDGGGGVCEACGDIRFVPCETCCGSCKIYYTGDEEDEEEYVDGEVGECGFQRCPDCNENGLIRCPMCCC

SEQ ID NO: 153424 - protein, 581 aa, Glycine max
  Coding DNA Sequence Number=SeqID_36646
  Gene Ontology: Mol. function=protein kinase activity; Cellular component=integral to membrane; Biological process=protein amino acid phosphorylation
  Homolog annotation: Hit_ID=Q1SEN0; Match level="QueryCoverage=74%, HitCoverage=86%, E-value=4e-65, Identity=35%"; Hit description =Protein kinase
  Pfam annotation: Domain name=LRR_1; Domain location=114-136; Score =1.7; E_value=1.4e+02; Accession=PF00560.23; Description=Leucine Rich Repeat
  Pfam annotation: Domain name=LRR_1; Domain location=138-160; Score =10.7; E_value=2.8; Accession=PF00560.23; Description=Leucine Rich Repeat
  Pfam annotation: Domain name=LRR_1; Domain location=184-206; Score =6.3; E_value=19; Accession=PF00560.23; Description=Leucine Rich Repeat
  Pfam annotation: Domain name=LRR_1; Domain location=208-230; Score =11.6; E_value=1.9; Accession=PF00560.23; Description=Leucine Rich Repeat
  Pfam annotation: Domain name=LRR_1; Domain location=235-258; Score =6.1; E_value=20; Accession=PF00560.23; Description=Leucine Rich Repeat
  Pfam annotation: Domain name=LRR_1; Domain location=266-288; Score =7.6; E_value=11; Accession=PF00560.23; Description=Leucine Rich Repeat
  Pfam annotation: Domain name=LRR_1; Domain location=290-312; Score =8.1; E_value=8.5; Accession=PF00560.23; Description=Leucine Rich Repeat
  Pfam annotation: Domain name=LRR_1; Domain location=314-337; Score =8.6; E_value=7; Accession=PF00560.23; Description=Leucine Rich Repeat
  Pfam annotation: Domain name=LRR_1; Domain location=64-86; Score=9.3; E_value=5.3; Accession=PF00560.23; Description=Leucine Rich Repeat
  Pfam annotation: Domain name=LRR_1; Domain location=88-110; Score =3.0; E_value=79; Accession=PF00560.23; Description=Leucine Rich Repeat
  Pfam annotation: Domain name=Pkinase_Tyr; Domain location=320-487; Score=-174.4; E_value=0.09; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase_Tyr; Domain location=114-136::138-160::184-206::208-230::235-258::266-288::290 -312::314-337::64-86::88-110::320-487
MALTLIILLHSVVSQTLSSESDKVALLALKQKLTNGEPNALPSWNESLHLTLVLFNIHLHGEILPQVLDLSHNNLHGQIPIQLTNCSKLEVVNFLCNKLTGKVPSWFGTGSMTKLSKLLLGAKDLVGTIPPSLGSLTSLHNFTLARNHLEGSIPHALAQLSNFKELYLGLNGTLPSNMALAFPNLRNFLVGGNYFNGTFPSSISNITGLQKFDISSNGFNGPIPPTLGSLNKLQIFQSFSVSDNYLSGDIPNQTFGNLKELSACTALTELVVERNFFHGSIPSFLGSLMSLEILDPSNNNLSGVIPGELQNLSFLNTLNLSFNHLYGEVPIGSVFNNITEISLIGNKTLRKNLNIWTFCSSVDCNGDDFKAIVFEFMPHGSLDSLLHSSKELESGNFNLTLQLVLNIALDVANALDYLHHGHSSRDQISSSAIKGTIGYVPPALGGVVVAIVIDDLGIGDGSGVLDDGAANRVDPILLLLLGIGDEVHGVGARGELEGVGLVEDVFGAFDCETRGDGDDAAWARRARDGGFLEPEELALLEDEPAAAPGLDVLALLGEPAGALGVGPELDAVVIGGVFRHA

SEQ ID NO: 153425 - protein, 382 aa, Glycine max
  Coding DNA Sequence Number=SeqID_36647
MPLLEHPLEGEHDCRLGLPLEVGSTDEDRGLDAPGLPLVVDSGLSGSDVLKLGGASSEKPGISDGFHDLDFTVGEVPRDGTGCLDITGADLETEEVLTEGEDTVGTLDGVDGCRAGVDALVVGLDAGKVGLAVGVEDLAVDLDNGVEDLDVIVVLAADTVVVLVTETAVLGAETMGLAEEPEVWVEATVVLVEAVVVREVGVEGLDDFETVVGVEGLDDFETVVGVEGLHDFETVVAVEGLDDFETVVNVDRRAGVADRDPIFPDDECLLVIPPEEVNPGEEADCLDTKLLLPLCSDRFPDDEGLLIPPPEEVHPGEEAGCLITELLLPVSSDRFPADEGLLIPPPEEVNPGEEAGCLDTKLLLPACSDGELANYNHKKTNT

SEQ ID NO: 153426 - protein, 463 aa, Glycine max
  Coding DNA Sequence Number=SeqID_36648
  Gene Ontology: Mol. function=pepsin A activity; Cellular component =cellulose and pectin-containing cell wall; Biological process =proteolysis
  Homolog annotation: Hit_ID=Q9LEW3; Match level="QueryCoverage=90%, HitCoverage=87%, E-value=6e-80, Identity=41%"; Hit description =Nucleoid DNA-binding protein cnd41-like protein
  Pfam annotation: Domain name=Asp; Domain location=113-460; Score= -81.9; E_value=9e-09; Accession=PF00026.14; Description=Eukaryotic aspartyl protease
  Subcellular localization annotation: CTP_CleavageSite=36; ConfidenceScore=5.15e-01
MSTSFTFTCITVFFSFFLSFNNYAKGDLIPSPTCKRTSIQGGVNRKASLELVHIDGPCSHIKRDNVDNENNFTRDYERVKYIQSRISKNNSFNDLDSFTTIPTNPGPPLSTLNYIIDIRLGTPEKTLQMVFDTGSHLTWTQCYQCKSCYKQANARFNPLNSSTYEASDCLDDTCEELISSGQGLSCSKNVHLCHYRIYYGDRSSSRGFFGKDRLALYSNLYPTKPGITDEFYFGCGILMKGNFGRTAGIFGLGRGELSFMSQTSSQYMETFSYCIPNIDNVGYITFGPDPDADRDERIQYTPLVNPQAGLSHYALNITGIAIDGDILMGLDFNQIDHGGFIIDSGCVLTRLPPSIYAKLRSVYQQRMSYYPSAPKYIPFDTCYDLSGFHYPIPEMSFVFPGVTVDLPREATFHEIKPKQYCLAFMPNEYDSQTSIFGNLQQKTLEIVHDNLGNKVGFRPNGCG

SEQ ID NO: 153427 - protein, 70 aa, Glycine max
  Coding DNA Sequence Number=SeqID_36649
  Subcellular localization annotation: CTP_CleavageSite=8; ConfidenceScore=5.04e-01
MDVSVIPYCFMGACRLLTPPGTPLFPSLEMETSKTVMSQLGAPTVRPTPLKARMSFASGFHSLMKFYISL

SEQ ID NO: 153428 - protein, 163 aa, Glycine max
  Coding DNA Sequence Number=SeqID_36650
MPAVNRAYSKANDNVSPVVMGTKMVERVINMRKLAPPRMDDKNSFHNLSGKSSSSPDSSGFGRSLSKKSLDMAIRHMDIRRRAPGNLRPSLMTKIPASSMYSVRSGPQRSRTASISGSPHASGSNASSEVSVNENGLCIDNSEIDDDIVSVRSGQSSATVQGR

SEQ ID NO: 153429 - protein, 36 aa, Glycine max
  Coding DNA Sequence Number=SeqID_36651
GRGKNLLLVTVSSASELWNLFDGLDRLVSEIFPTNL

SEQ ID NO: 153430 - protein, 246 aa, Glycine max
  Coding DNA Sequence Number=SeqID_36652
  Pfam annotation: Domain name=zf-CCHC; Domain location=159-176; Score =21.7; E_value=0.00026; Accession=PF00098.13; Description=Zinc knuckle
MASSNFLFLEGKSINRPPIFDGVGYHYWKISMQIFIEVMDLNIKEAIEIGPYIPTMVVGNTTIEKPREQWDEERRREHKIELMRLNQHEENGKKKKGIALKALSSILEESDKEDLNEIEEDDDFSFFVKRFNKFLRNKGNQRRSNFKPKKRGEDSSSIPKCYECNQPGHLRVDYPSFKKRMEKSDTKTFNDKKEMKAYITWEDNDMDSFRDSKNEVMNLSLMAKNYESEEEMHSMTCIKNQSNLQN

SEQ ID NO: 153431 - protein, 58 aa, Glycine max
  Coding DNA Sequence Number=SeqID_36653
TRLTTLLPQPQKRTTCDETLVRNDDALLLCDIVDSKREQNGAIFEGYVKEEEEEEEDI

SEQ ID NO: 153432 - protein, 140 aa, Glycine max
  Coding DNA Sequence Number=SeqID_36654
  Homolog annotation: Hit_ID=Q1S5Q3; Match level="QueryCoverage=92%, HitCoverage=93%, E-value=3e-08, Identity=28%"; Hit description=Zinc finger, GRF-type
  Pfam annotation: Domain name=zf-GRF; Domain location=20-68; Score =34.1; E_value=4.8e-07; Accession=PF06839.3; Description=GRF zinc finger
  Subcellular localization annotation: CTP_CleavageSite=30; ConfidenceScore=5.43e-01
MSQRSNASSFRTRVSSQVVLFCGCGRRVVRRVAGTNINRGRAFFTCSINKAFQDEVGYCGYFIWVDQLIEALGVDDSLGTFSMEQRRQFGREEDKTMWKAQVNSKLDCMGIEMKMFRTIVYGMFLIQLLSMVVFVCIHKY

SEQ ID NO: 153433 - protein, 94 aa, Glycine max
  Coding DNA Sequence Number=SeqID_36655
MEKVDVLHVPTITSSPTLGAIASGGTAFFMLDRKGMPCLPKLQLIPFKGTKPLDLIFQGEQYIDLYRIPSRSTFTYGFLLHEKGGIVIVQVVAL

SEQ ID NO: 153434 - protein, 130 aa, Glycine max
  Coding DNA Sequence Number=SeqID_36656
MRGNHLPAIGSLGRHYQYRCNISVWTIPPHPVAPSLCIEDIDDRWIQFSKYLASVGQICVALGQCAADYMKDPPRHPHVVHNDTFVELDLPQQSMAAAAMDEAPVDVEQPRHAVRNVYVRSRRRWRMEDA

SEQ ID NO: 153435 - protein, 644 aa, Glycine max
  Coding DNA Sequence Number=SeqID_36657
  Gene Ontology: Mol. function=RNA-directed DNA polymerase activity; Cellular component=exocyst; Biological process=exocytosis
  Homolog annotation: Hit_ID=Q5Z4V4; Match level="QueryCoverage=95%, HitCoverage=91%, E-value=0.0, Identity=55%"; Hit description =Putative Exo70 exocyst complex subunit
  Pfam annotation: Domain name=Exo70; Domain location=22-611; Score =631.1; E_value=9.6e-187; Accession=PF03081.6; Description=Exo70 exocyst complex subunit
MEASRIENLIRAKKSLKISLEKSKSAVRPIRAEKDALAAVGGHINRAVGPAAAVLKVVDAVHGLEKSLLSDPRTDLAGYLSVLKRLQEALRFLGDNCGLAIQWLEDIVEYLEDNSVADKVYLANLKKELKILRESQHGELDGGLLDAALGKLEDEFRLLLSENSVPLPMASASGDQACIAPSPLPVSVVHKLQAILGRLIANDRLDRCVGIYVEVRSSNVRASLQALNLDYLEISLSEFNDVQSIEGYIAQWGKHLEFAVKHLFEAEYKLCNDVFERIGLDVWMGCFSKIAAQAGILAFLQFGKTVTESKKDPIKLLKLLDIFASLNKLRLDFNRLFGGAPCVEIQNLTRDLIKSVIDGAAEIFWELLVQVELQRPNPPPMDGNVPRLVSFITDYCNKLLGDDYKPILTQVLIIHRSWKRQSFQEKLLVNEILNIVKAVEQNVETWIKAYDDPILSNFFAMNNHWHLCKHLKGTKLGELLGDSWLREHEQYKDYYSTIFLRDSWGKLPGHLSREGLILFSGGRATARDLVKKRLKKFNEVFDEMYAKQTSWIMPERDLREKTCQLIVQAVVPVYRSYMQNYGPLVEQDASSTKYAKYTVQKLEEMLLCLYRPRPVRHGSLRSSTFSAKYGNGVPDLRRTASAVV

SEQ ID NO: 153436 - protein, 36 aa, Glycine max
  Coding DNA Sequence Number=SeqID_36658
KRDAYGNGERVTTVAAPGLTARMNANDNNGTVGSKK

SEQ ID NO: 153437 - protein, 217 aa, Glycine max
  Coding DNA Sequence Number=SeqID_36659
  Gene Ontology: Mol. function=metal ion binding; Cellular component =integral to membrane
  Homolog annotation: Hit_ID=Q7EYM0; Match level="QueryCoverage=79%, HitCoverage=71%, E-value=2e-67, Identity=68%"; Hit description=Zinc finger protein family-like
MGKEVGRGMGMRSHRWCVEGKLSKPKNKLGLESSILFGREMYIASMGRSFKDSLKLLEADIHHANTLASDFPREYDGACLQMRMSYSPAAHLFLFLVQWTDCNLAGALGLLRILIYKVYADGTTTMSTHERKASIREFYAVIYPSLLQLQKGVTDTEDTKQKAVCMERYRKRDDEEHRQPSDIDIEREEECGICMEMNSKIVLPDCNHVMCLKCYHE

SEQ ID NO: 153438 - protein, 521 aa, Glycine max
  Coding DNA Sequence Number=SeqID_36660
  Gene Ontology: Mol. function=allantoinase activity; Cellular component=mitochondrion; Biological process=purine base metabolic process
  Homolog annotation: Hit_ID=Q6S4R9; Match level="QueryCoverage=99%, HitCoverage=100%, E-value=0.0, Identity=80%"; Hit description =Allantoinase
  Pfam annotation: Domain name=Amidohydro_1; Domain location=101-461; Score=47.2; E_value=5.6e-11; Accession=PF01979.10; Description =Amidohydrolase family
  Pfam annotation: Domain name=Amidohydro_3; Domain location=101-459; Score=-73.0; E_value=0.0058; Accession=PF07969.2; Description =Amidohydrolase family
  Pfam module annotation: Pfam domain module=Amidohydro_1::Amidohydro _3; Domain location=101-461::101-459
MDQLLWRVLPLLTILVSFGVFFYLQDSYTAQFYALIKLPRDKCSLLPHRHFWISSKRIVTPQGIISGSVEINDGKIISVVEGHANQGKPKQEEVIDYGDAVIMPGLIDVHVHLDEPGRTEWEGFDTGTRAAAAGGVTTVVDMPLNNYPTTVSKEKLKLKLDAAEDKIYVDVGFWGGLIPENALNTSILEGLLSAGVLGMKSFMCPSGINDFPMTTIDHIKAGLPVLAKYKRPIVVHAEVQQDFENHLELNEDNLDPRAYLTYLNARPPSWEEAAIKQLVGVTKDTRKGGPLEGAHVHIVHLSDSSASLDLIKVFCALSCLEAKSRGDSISVETCPHYLAFSSEEIPNGDTRFKCSPPIRDAYNREKLWGAVLEGHIDLLSSDHSPTVPELKLMEEGDFLKAWGGISSLQFNLPVTWSYGKKYGLTLEQLSLLWSKKPATLAGLESKGAIAVGNHADIVVWQPELEFDLDDDYPVFIKHSELSAYMGRRLSGKVLETFVRGNLVFKDGKHAPAPCGVQILAK

SEQ ID NO: 153439 - protein, 443 aa, Glycine max
  Coding DNA Sequence Number=SeqID_36661
  Gene Ontology: Mol. function=allantoinase activity; Cellular component=mitochondrion; Biological process=purine base metabolic process
  Homolog annotation: Hit_ID=Q6S4R9; Match level="QueryCoverage=99%, HitCoverage=86%, E-value=0.0, Identity=88%"; Hit description =Allantoinase
  Pfam annotation: Domain name=Amidohydro_1; Domain location=32-383; Score=59.7; E_value=9.7e-15; Accession=PF01979.10; Description =Amidohydrolase family
  Pfam annotation: Domain name=Amidohydro_3; Domain location=32-381; Score=-51.9; E_value=0.00035; Accession=PF07969.2; Description =Amidohydrolase family
  Pfam module annotation: Pfam domain module=Amidohydro_1::Amidohydro _3; Domain location=32-383::32-381
EINEGKIISVIEGYSKQGKSKQEKIIDYGDAVVMPGLIDVHVHLDEPGRTAWEGFDTGTRAASAGGVTTVVDMPLNNHPTTVSKETLKLKLEAAENKIYVDVGFWGGLIPENAHNTSILEGLLSAGVLGLKSFMCSSGISDFPLTTIHHIKEGLSVLAKYRRPLLVHSEIQQHSKKHLELNDKGGPRAYLTYLHTRPPSWEEAAIKELVGVTKDTRKGGPLEGAHVHIVHLSDSSASLDLIKEAKSRGDSISVETCPHYLAFSSEEIPNGDTRFKCSPPIRDAYNREKLWGAVLEGHIDLLSSDHSPTVPQLKLLEEGDFLKAWGGVTSLQFDLPVTWSYGKKHGLTLEQLSLLWSKKPATLAGLESKGAIAVGNHADIVVWKPEVEFDLNEDYPVFLKHPSLSAYMGRRLSGKVLETFVRGNLVFKKGKHAHAACGVPILAK

SEQ ID NO: 153440 - protein, 42 aa, Glycine max
  Coding DNA Sequence Number=SeqID_36662
MSWSRTIAMIIAGESLMQVVDAPVPRDDCNSTGTDKEKQKQD

SEQ ID NO: 153441 - protein, 278 aa, Glycine max
  Coding DNA Sequence Number=SeqID_36663
  Gene Ontology: Mol. function=translation elongation factor activity
  Homolog annotation: Hit_ID=Q41112; Match level="QueryCoverage=59%, HitCoverage=100%, E-value=8e-83, Identity=92%"; Hit description =Stress-related protein
  Pfam annotation: Domain name=REF; Domain location=88-278; Score =350.5; E_value=2.8e-102; Accession=PF05755.3; Description=Rubber elongation factor protein (REF)
MASGKRTAVLGDSAGREPPERIVKDLNKKSRYEHVVFEPPKDFPEEIEFGMDFSRPENIDDPEDEEEYKNVRRAVKEFRVAMNEYYKAEERTEEQELKYLEFVQFATIQALMRCAILYSYAKERAGPLKPGVDTVEEAVKTVVAPVYDRFHLVPGEVLKYADRKVAELDSHVPSNVKKVSSQACSVVSEVRRDGVSAYAKTVYSKYEPTAEQCAVSAWRKLNQLPLFPQVANVVLPKAAYCTEKYNEAVVSSAEKGYRVSAYLPLVPTEKIAKVFGGN

SEQ ID NO: 153442 - protein, 486 aa, Glycine max
  Coding DNA Sequence Number=SeqID_36664
  Gene Ontology: Mol. function=DNA binding; Cellular component =mitochondrion; Biological process=positive regulation of transcription, DNA-dependent
  Homolog annotation: Hit_ID=Q2HUF5; Match level="QueryCoverage=95%, HitCoverage=93%, E-value=0.0, Identity=68%"; Hit description =Tetratricopeptide-like helical
  Pfam annotation: Domain name=PPR; Domain location=123-157; Score =25.3; E_value=0.00022; Accession=PF01535.11; Description=PPR repeat
  Pfam annotation: Domain name=PPR; Domain location=158-192; Score =27.0; E_value=6.7e-05; Accession=PF01535.11; Description=PPR repeat
  Pfam annotation: Domain name=PPR; Domain location=193-227; Score=6.8; E_value=1.2; Accession=PF01535.11; Description=PPR repeat
  Pfam annotation: Domain name=PPR; Domain location=299-333; Score =18.7; E_value=0.021; Accession=PF01535.11; Description=PPR repeat
  Pfam annotation: Domain name=PPR; Domain location=334-367; Score=9.3; E_value=0.6; Accession=PF01535.11; Description=PPR repeat
  Pfam annotation: Domain name=PPR; Domain location=369-402; Score=4.8; E_value=2; Accession=PF01535.11; Description=PPR repeat
  Pfam module annotation: Pfam domain module=PPR::PPR::PPR::PPR::PPR::PP R; Domain location=123-157::158-192::193-227::299-333::334-367::369 -402
  Subcellular localization annotation: CTP_CleavageSite=52; ConfidenceScore=5.00e-01
MIRRIIAVVSRSYYTSRSKKPSLYSKISPLGNPNTSVVPVLDDWVFKGNKLRVAELQRIIRDLRKRSRFSQALQISEWMHNKGVCIFSPTEYAVHLDLIGKVHGFSSAETYFDALKDQHKTNKTYGALLNCYVRQRQTDKALSHLQKMKDLGFASSPLTYNDIMCLYTNIGQHEKVPDVLREMKQNQVLPDNFSYRICINSYGVRSDFGGVERVLKEMETQPNIVMDWNTYSIAANFYIKAGLTRDAVCALRKSEERLDNKDGQGYNHLISLYAQLGLKNEVMRIWDLEKNACKRCINRDFTTLLESLVKLGELDEAEKILKEWESSDNCYDFGIPSIVIIGYSQKGLHEKALAMLEELQNKEKVTTPNCWSIVAGGYIHKGEMEKAFKCFKTALSLYVENKGWKPNAKVIAELLRWIGDNGSVEDAEVLVSLLRNAVPVNRQMYHTLIKTYIRGGKEVDDLLGRMEKDGIDENKETKKIINKKNA

SEQ ID NO: 153443 - protein, 196 aa, Glycine max
  Coding DNA Sequence Number=SeqID_36665
  Gene Ontology: Mol. function=phosphoinositide phospholipase C activity; Cellular component=plasma membrane; Biological process =intracellular signaling cascade
  Homolog annotation: Hit_ID=Q43442; Match level="QueryCoverage=92%, HitCoverage=33%, E-value=2e-68, Identity=69%"; Hit description =Phosphoinositide-specific phospholipase C P12
  Pfam annotation: Domain name=C2; Domain location=70-161; Score=80.9; E_value=3.9e-21; Accession=PF00168.20; Description=C2 domain
MSLPGILIFYNFTICLPQQGLGKSLWLMQGMFRANGGCGYVKKPQFLMQKYHCDNEFDPTRIQSVKKKTFKVKVYMGHGWSSDLSPTHFDKCSPPDFYTKVCIVGMPDDVAKKKTKVMMDNWFPVWDEEFEFSLIVPELALLLIQVKDKDPGKDDFAGQTCLPVSELKHGFHSVPLYNKKGEKFKSVKPLMQFQFE

SEQ ID NO: 153444 - protein, 174 aa, Glycine max
  Coding DNA Sequence Number=SeqID_36666
  Gene Ontology: Mol. function=phosphoinositide phospholipase C activity; Biological process=intracellular signaling cascade
  Homolog annotation: Hit_ID=Q43442; Match level="QueryCoverage=60%, HitCoverage=21%, E-value=3e-28, Identity=61%"; Hit description =Phosphoinositide-specific phospholipase C P12
FNYPHTSLQSLYDWHITANAAQLIPSQGKQERDLGFEGIVEIEKEQETEELVEGEPILVVVGVVVAFGVGVVGLFARLNDAVEDAVGILCGAVGFTLVVVQEAEELVGGHGGGGAVGEGGEGLLDVRRRGLLGDVEFSVEVLEHFVAVGDGAHCYWTQRNEEEEESDGYEINNI

SEQ ID NO: 153445 - protein, 53 aa, Glycine max
  Coding DNA Sequence Number=SeqID_36667
  Homolog annotation: Hit_ID=Q43442; Match level="QueryCoverage=92%, HitCoverage=9%, E-value=2e-21, Identity=98%"; Hit description =Phosphoinositide-specific phospholipase C P12
MPGHNSYLTGNQLSSVCSDVPIIKALQRGVRVIELDLWPNSTKDDIDVVHGRC

SEQ ID NO: 153446 - protein, 238 aa, Glycine max
  Coding DNA Sequence Number=SeqID_36668
  Gene Ontology: Mol. function=methyltransferase activity; Cellular component=cytosol; Biological process=cell division
  Homolog annotation: Hit_ID=Q9LFB3; Match level="QueryCoverage=95%, HitCoverage=99%, E-value=1e-108, Identity=71%"; Hit description=Cell division-like protein
  Pfam annotation: Domain name=FtsJ; Domain location=21-183; Score =88.7; E_value=1.8e-23; Accession=PF01728.9; Description=FtsJ-like methyltransferase
MGRASRDKRDIYYRKAKEEGWRARSAFKLLQIDEEFNLFDGVKRVVDLCAAPGSWSQVLSRKLYLPAKLAPDAKDENLPLIVAIDLQPMAPIEGVIQVQGDITNARTAEVVIRHFDGCKADLVVCDGAPDEAFAVCENYSPPEGFNPKDLHRLLEKVGSPSGVDDTGPNKVYIPFLACGDLSGYDSDRSYPLPKVAGGTYQSLDPVQPPIAPPYKRALELKKASSQGFRELENLSLDS

SEQ ID NO: 153447 - protein, 521 aa, Glycine max
  Coding DNA Sequence Number=SeqID_36669
  Gene Ontology: Mol. function=methyltransferase activity; Cellular component=intracellular; Biological process=mRNA editing
  Homolog annotation: Hit_ID=Q2HUG1; Match level="QueryCoverage=99%, HitCoverage=100%, E-value=0.0, Identity=64%"; Hit description =Tetratricopeptide-like helical
  Pfam annotation: Domain name=PPR; Domain location=123-157; Score=8.9; E_value=0.65; Accession=PF01535.11; Description=PPR repeat
  Pfam annotation: Domain name=PPR; Domain location=227-260; Score =25.8; E_value=0.00016; Accession=PF01535.11; Description=PPR repeat
  Pfam annotation: Domain name=PPR; Domain location=330-364; Score =29.0; E_value=1.6e-05; Accession=PF01535.11; Description=PPR repeat
  Pfam annotation: Domain name=PPR; Domain location=365-399; Score =11.5; E_value=0.32; Accession=PF01535.11; Description=PPR repeat
  Pfam annotation: Domain name=PPR; Domain location=401-435; Score =19.0; E_value=0.017; Accession=PF01535.11; Description=PPR repeat
  Pfam annotation: Domain name=PPR; Domain location=57-91; Score=5.0; E_ value=1.9; Accession=PF01535.11; Description=PPR repeat
  Pfam module annotation: Pfam domain module=PPR::PPR::PPR::PPR::PPR::PP R; Domain location=123-157::227-260::330-364::365-399::401-435::57-91
MKVQNLNQIAIRAQQQLITNPNPQFLNPLLSQLTNSQNAFFDLYNQILSHPFSHNHYTFTHALRACYSHHSRSKALEIHAHLVKSGHYLDLFLQNSLLHFYLAHNDVVSASNLFRSIPSPDVVSWTSLVSGLAKSGFEAQALHHFTNMNAKPKIVRPNAATLVAALCACSSLGALGLGKSAHAYGLRMLIFDGNVIFDNAVLELYAKCGALKNAQNLFDKVFARDVVSWTTLLMGYARGGYCEEAFAVFKRMVLNAEAEPNEATVVTVLSASASIGALSLGQWVHSYIDSRYDLVVDGNIENALLNMYVKCGDMQMGLRVFDMIVHKDAISWGTVICGLAMNGYEKKTLELFSRMLVEVVEPDDVTFIGVLSACSHAGLVNEGVMFFKAMRDFYGIVPQMRHYGCMVDMYGRAGLLEEAEAFLRSMPVEAEGPIWGALLQACKIHGNEKMSEWIMGHLKGKSVGVGTLALLSNMYASSERWDDANKVRKSMRGTRLKKVAGCSWVELEMFNNRLDSNLCAA

SEQ ID NO: 153448 - protein, 249 aa, Glycine max
  Coding DNA Sequence Number=SeqID_36670
MANRGGEGNRPPRRTLGDYAYQQGPKHYNSIVIPPFSNKVVGLKPTMLSLIGSHPFAGMDHEDPYTRLSTFMELCNTMELLTKMLKLSTLVLSHSPWRDSKRYCGGAQTIILMMLNNYSSLKPQTKMIIDASAGGTMTPKSPEEAIVIIDSIAASDYQSHHDRTLIQKKSSEQTLDSTNRGLNHVDRPTSSTISPSWTPETTPSSSSSTNTVQHLVIVNKKMRPIICRIKLDLNKTSKETTKATEVAQV

SEQ ID NO: 153449 - protein, 316 aa, Glycine max
  Coding DNA Sequence Number=SeqID_36671
  Gene Ontology: Mol. function=binding; Cellular component =intracellular; Biological process=metabolic process
  Homolog annotation: Hit_ID=Q6ZIP5; Match level="QueryCoverage=66%, HitCoverage=26%, E-value=2e-36, Identity=34%"; Hit description =Pentatricopeptide (PPR) repeat-containing protein-like protein
  Pfam annotation: Domain name=PPR; Domain location=164-197; Score=6.7; E_value=1.2; Accession=PF01535.11; Description=PPR repeat
  Pfam annotation: Domain name=PPR; Domain location=214-248; Score =11.8; E_value=0.3; Accession=PF01535.11; Description=PPR repeat
  Pfam module annotation: Pfam domain module=PPR::PPR; Domain location =164-197::214-248
KFDLEIKDKKGSENIVVDHLSKLTIDEVTTQGLEIREEFPDEKLFNIVIRPWFAEMANFKETDNLLRRCVTRGEARSILWHCHSSSCGGHYNGERTDVKVLQYSFYWPTLCKDAHEYVQSVGLKPDYVMFIGVLTACNHVGMVDLGFYYFMLMTNVYWISPSKEHYGCLIDLLCRAERLTEVEHIIRTCRVHGDVDRGRWTIEQLLQLDPNSAGTHITLANIYAAKGRWKEAAHIRKSMKSKGVIKERGWSWVNVNDQLNAFVAGDQAHPQSEHITTILELLSANIGDAQQEIRALHEDVEDLAYGYIPSHGNARK

SEQ ID NO: 153450 - protein, 403 aa, Glycine max
  Coding DNA Sequence Number=SeqID_36672
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=95%, HitCoverage=47%, E-value=1e-138, Identity=64%"; Hit description =Receptor kinase-like protein
  Pfam annotation: Domain name=Pkinase; Domain location=94-379; Score =151.0; E_value=3.1e-42; Accession=PF00069.15; Description=Protein kinase domain
  Pfam annotation: Domain name=Pkinase_Tyr; Domain location=94-379; Score=91.0; E_value=3.7e-24; Accession=PF07714.7; Description =Protein tyrosine kinase
  Pfam module annotation: Pfam domain module=Pkinase::Pkinase_Tyr; Domain location=94-379::94-379
  Subcellular localization annotation: CTP_CleavageSite=84; ConfidenceScore=5.53e-01
VAGICTAIYCLWTGVCFGKKKVHNSVQPTITRGGSVNGVGGSNNSISPPSRSSTIRRQGSRIMRRQRSGTSSTKHPERAEEFTLAELVAATNNFALENKIGAGSYGVVYKGKLLDGREVAIKRGDTSTKMKKFQEKETAFESELAFLSRLHHKHLVRLVGFCEEKDERLLVYEYMKNGALYDHLHDKNNVDKSSSVLNSWRMRIKVALDASRGIEYLHNYAVPSIIHRDIKSSNILIDATWTARVSDFGLSLMSPESNHDFRPMKAAGTVGYIDPEYYGLNVLTAKSDVYGLGVVLLELLTGKRAIFKNDENGGTPVSVVDFAVPLIMAGELAKILDPRVEPPEMNETEAVELVGYTAMHCVNLEGKDRPTMADIVANLERALALCDSSHGSISSGTISIVSD

SEQ ID NO: 153451 - protein, 77 aa, Glycine max
  Coding DNA Sequence Number=SeqID_36673
MQLIGRISRPFNRGQRPLLNTFKGPQTLTRQDEGVEKKALDAKALDELNKEEVARLEVVLATTEKERNAEEERLQIE

SEQ ID NO: 153452 - protein, 146 aa, Glycine max
  Coding DNA Sequence Number=SeqID_36674
MGGVLQHVHFVHSFLKFLSRKGFSFTSSGELSDFSAFLNQLPKRVADIIGKVPNIGVTAADKTQRPPSLATDSLDASVEVGIMDQVGANMVAFHLANKNCVPPAASNAALMAPINQTPSLRDPPVDTPQDAKEPKEKTITRTRNGA

SEQ ID NO: 153453 - protein, 87 aa, Glycine max
  Coding DNA Sequence Number=SeqID_36675
MELQMHTYMHHLVDQQATNHKCQLQLNDNFYYYTLHQHRQDPNPYPWPTPEQFRAVAAWSRDRLIFSGGGRSCRCLGSCPMRWRKSR

SEQ ID NO: 153454 - protein, 166 aa, Glycine max
  Coding DNA Sequence Number=SeqID_36676
MRGYLMVARTFRQPGANEPVDAQRLTSSSVPSIILTREVWDSESGGRQRYLMVTRTFSQPGANEPVDAQRLTLSSAPFAIQGQRVRWQVEIPYGHLHLSSTEGNEFDGFYPRRPETFKPDDARDSSLLGGGDRVRWRGEVSWLSNFIALKTLKFVDASDAFSFLSK

SEQ ID NO: 153455 - protein, 88 aa, Glycine max
  Coding DNA Sequence Number=SeqID_36677
MVQEYAEVQNQSQNRTEEQNRTGVAGVGVSRSAEHWSRATTTALGTDSGRKAEQQRRRNGRWMERRAATTVLGFSQCFPAQQWSPDKS

SEQ ID NO: 153456 - protein, 78 aa, Glycine max
  Coding DNA Sequence Number=SeqID_36678
MQNQLLHKRVTRLYFIYIASCETNTKDEENGNDSSPVRLRKEERLQMVVVVRGCNADGDGVSVPQDVANESAKAFECE

SEQ ID NO: 153457 - protein, 318 aa, Glycine max
  Coding DNA Sequence Number=SeqID_36679
  Gene Ontology: Mol. function=transition metal ion binding; Cellular component=nucleus; Biological process=proteolysis
  Pfam annotation: Domain name=Transposase_21; Domain location=136-318; Score=268.8; E_value=1.1e-77; Accession=PF02992.5; Description =Transposase family tnp2
MYDTLESDSKKPLYRGCKKYLTPLLVALSLFNVKARYGWSDKSFPSLLQIMQDMLLEENTLPKKLLSSEEDIVSNKQEYEEMHKCPRCGVSWYKVKDGDECSSDESIMKDPPAKVLWYLSIIPRFKHLFANVDDTKDLTWHANERNCDGMLRHPADFSQWKKIDRLYPNFGKEARNLRLGLATYGMNPYGNLSNQHSLWPVLLVIYNLPPWLYMKRKYIMFSIMISGLRQPGNDIDVYLNPLIEDLTNLWDEGVVVFDGYRNEAFKLHAMLFCTINDFPTYENLNGYSVKGHRACPIFEEYTSYVQLKHGRKIVYTRH

SEQ ID NO: 153458 - protein, 318 aa, Glycine max
  Coding DNA Sequence Number=SeqID_36680
  Gene Ontology: Mol. function=transition metal ion binding; Cellular component=nucleus; Biological process=proteolysis
  Pfam annotation: Domain name=Transposase_21; Domain location=136-317; Score=264.8; E_value=1.8e-76; Accession=PF02992.5; Description =Transposase family tnp2
MYDTLESDSKKPLYRGCKKYLTPLLVALSLFNVKARYGWSDKSFPSLLQIMQDMLLEENTLPKKLLSSEEDIVSNKQEYEEMHKCPRCGVSWYKVKDGDECSSDESIMKDPPAKVLWYLSIIPRFKHLFANVDDTKDLTWHANERNCDGMLRHPADFSQWKKIDRLYPNFGKEARNLRLGLATYGMNPYGNLSNQHSLWPVLLVIYNLPPWLYMKRKYIMFSIMISGLRQPGNDIDVYLNPLIEDLTNLWDEGVVVFDGYRNEAFKLHAMLFCTINDFPTYENLNGYSVKGHRACPIFEEYTSYVQLKHGRNIVYTRH

SEQ ID NO: 153459 - protein, 125 aa, Glycine max
  Coding DNA Sequence Number=SeqID_36681
MKKDTNEYSKDGGTYEESLKLIKMVSHLSASEVCEPPIDHAHYDEEAMAFVLGKRDLGSLLQDVVLLNMLGNKHCGMTTEILTVALMQSYPPRALDRRLQEDWAKDAREGPRVLMNLRVDFEPKG

SEQ ID NO: 153460 - protein, 475 aa, Glycine max
  Coding DNA Sequence Number=SeqID_36682
  Gene Ontology: Mol. function=protein binding; Cellular component =cellulose and pectin-containing cell wall; Biological process =protein amino acid phosphorylation
  Homolog annotation: Hit_ID=Q9LHF1; Match level="QueryCoverage=79%, HitCoverage=75%, E-value=1e-159, Identity=71%"; Hit description =Extensin-like protein
  Pfam annotation: Domain name=LRRNT_2; Domain location=76-115; Score =13.8; E_value=0.031; Accession=PF08263.3; Description=Leucine rich repeat N-terminal domain
  Pfam annotation: Domain name=LRR_1; Domain location=149-171; Score =6.7; E_value=16; Accession=PF00560.23; Description=Leucine Rich Repeat
  Pfam annotation: Domain name=LRR_1; Domain location=173-195; Score =7.4; E_value=12; Accession=PF00560.23; Description=Leucine Rich Repeat
  Pfam annotation: Domain name=LRR_1; Domain location=197-216; Score =10.6; E_value=2.9; Accession=PF00560.23; Description=Leucine Rich Repeat
  Pfam annotation: Domain name=LRR_1; Domain location=220-242; Score =4.1; E_value=49; Accession=PF00560.23; Description=Leucine Rich Repeat
  Pfam annotation: Domain name=LRR_1; Domain location=243-265; Score =2.9; E_value=83; Accession=PF00560.23; Description=Leucine Rich Repeat
  Pfam annotation: Domain name=LRR_1; Domain location=267-289; Score =3.2; E_value=72; Accession=PF00560.23; Description=Leucine Rich Repeat
  Pfam annotation: Domain name=LRR_1; Domain location=291-313; Score =8.7; E_value=6.9; Accession=PF00560.23; Description=Leucine Rich Repeat
  Pfam annotation: Domain name=LRR_1; Domain location=315-337; Score =14.1; E_value=0.52; Accession=PF00560.23; Description=Leucine Rich Repeat
  Pfam annotation: Domain name=LRR_1; Domain location=339-360; Score =1.8; E_value=1.3e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=76 -115::149-171::173-195::197-216::220-242::243-265::267-289::291 -313::315-337::339-360
MRKKTYSDLSLFFFPLLLILVSHSLCASAFSHNGPLTDSQVSFIKQRQLLYYKDYFGDRGEKVTLDPSFVFENDRLRNAYIALQAWKEAILSDPKNLTQDWVGPNVCNYSYVFCAPAPDNHKIRTVAGIDLNHGDIAGYLPEELGLLTDLALLHINTNRFCGTLPHKFDRLKLLFELDLSNNRFAGKFPDVVLRLPQLKFLDLRFNEFEGTVPKELFDKDLDAIFINDNRFVFDLPENFGNSPVSVIVLANNRFHGCVPAGIGNMKRLNEIILMNNAFRSCFPAEIGLLQNLTVFDVSFNQLLGPLPDAIGGAVSLEQLNVAHNLLSGKIPESICKLPNLQNFTYSYNFFTGEPPRCLALPAFDDRRNCLPARPAQRSAGQCKSFLSHPVDCNSFRCKPFVPSLPPPPPPSPPLPSPPPPPSPVYIPHSPPPPPPPVYSPPPPPPPPPVYSPPPPPPVYSPPPPPPVYSPPPPPP

SEQ ID NO: 153461 - protein, 74 aa, Glycine max
  Coding DNA Sequence Number=SeqID_36683
  Subcellular localization annotation: CTP_CleavageSite=55; ConfidenceScore=5.00e-01
MRLNLEVLKVRSSIAKHSFSALSAAEEFGRASISRSRAKREISALSATVVFSQAQCMTGAKLKSTYSPLARGWR

SEQ ID NO: 153462 - protein, 141 aa, Glycine max
  Coding DNA Sequence Number=SeqID_36684
MAMGRVKVRFCLPYPRPRLPIPLPAPAPETQRGCIFTPHPHPHPRRAEQVRDKLNPNPDQLKFFHQNRDKFRVDSTGSDKREERKGKDATSADDPGGQDVTRRAQLGCGFLHQLLCFAGPTPSAASMLIRTRNMEMSVVAS

SEQ ID NO: 153463 - protein, 86 aa, Glycine max
  Coding DNA Sequence Number=SeqID_36685
MKDQEGGIDCFQIKPAQARYSTAHARESHKHMQKKEVLRWVGLILAISETIPSNPIPPKGNCNTTTKLPFSIFLQIKPAMPDPRPN

SEQ ID NO: 153464 - protein, 105 aa, Glycine max
  Coding DNA Sequence Number=SeqID_36686
MVSSIEEFFILKLFKIDENARKAHVIKPVIWCTPQIGRIKIFVALMAIEIARDKQWLSLLVGDKLNFGGRSFQDSFFGTLEPFTTDEKCYFLHKIYAFLDISCLS

SEQ ID NO: 153465 - protein, 85 aa, Glycine max
  Coding DNA Sequence Number=SeqID_36687
  Homolog annotation: Hit_ID=Q1SDN3; Match level="QueryCoverage=46%, HitCoverage=3%, E-value=8e-10, Identity=70%"; Hit description =Polynucleotidyl transferase, Ribonuclease H fold
MAYECIKQYKPRWRSCTSEPFDVRPKGKMKSASEDDLGTMDCFLLFQDIKEVPKKKHKLVMDLRVSRQALQSESLKPVKEVEDEE

SEQ ID NO: 153466 - protein, 84 aa, Glycine max
  Coding DNA Sequence Number=SeqID_36688
  Gene Ontology: Mol. function=nucleic acid binding
  Homolog annotation: Hit_ID=Q1SS72; Match level="QueryCoverage=75%, HitCoverage=4%, E-value=9e-12, Identity=50%"; Hit description =Integrase, catalytic region
MTQNADPIENNAIVNNAALTNLLNPYYTPPNENPGVVTVAQVLNGENYHSLSRAMLLALKTKKKVKFVDGSLPRPTLNDPNFTL

SEQ ID NO: 153467 - protein, 63 aa, Glycine max
  Coding DNA Sequence Number=SeqID_36689
  Homolog annotation: Hit_ID=Q1SS89; Match level="QueryCoverage=79%, HitCoverage=5%, E-value=8e-09, Identity=64%"; Hit description =Integrase, catalytic region
MAMNLPCKISMIPKAIQSELSSLIKANTWQLTPLPPNKKLIGCKWVSKSSSKLMDPLTSTRLD

SEQ ID NO: 153468 - protein, 113 aa, Glycine max
  Coding DNA Sequence Number=SeqID_36690
  Gene Ontology: Mol. function=nucleic acid binding
  Pfam annotation: Domain name=zf-CCHC; Domain location=64-81; Score =10.8; E_value=0.017; Accession=PF00098.13; Description=Zinc knuckle
MMMDPLPDLDKVFSILIQQERQLVFQFDDSRVFSQLDTNNGTYGRGRGCGGHTSGGRGKGKSTKMCNYCNKSGHMVDTCYKKHGYPPHLHRGGAINQYSIDDQEIQDDLQSLG

SEQ ID NO: 153469 - protein, 53 aa, Glycine max
  Coding DNA Sequence Number=SeqID_36691
MDWAGGAEFVECSNFLARLEGIDGVDTEHAVSDVGHMHVQYVAEIHVMHENKE

SEQ ID NO: 153470 - protein, 128 aa, Glycine max
  Coding DNA Sequence Number=SeqID_36692
MDYNIACNLFVIGKEIMMEKKDVPTVIPRTQVKQMPKAPTQAHETMSELVEIANSGICPPRHPHATIVQRIMEFRNRDWHISFSYVARDANCIAHSLVGIGVRQLYSICIWDSPLPSLNNILRRDSVN

SEQ ID NO: 153471 - protein, 245 aa, Glycine max
  Coding DNA Sequence Number=SeqID_36693
  Gene Ontology: Mol. function=phosphoric monoester hydrolase activity; Cellular component=nucleus; Biological process=biological_process
  Homolog annotation: Hit_ID=Q5QLC5; Match level="QueryCoverage=83%, HitCoverage=66%, E-value=6e-88, Identity=72%"; Hit description=NLI interacting factor (NIF) family protein-like
  Pfam annotation: Domain name=NIF; Domain location=25-225; Score=81.7; E_value=2.2e-21; Accession=PF03031.8; Description=NLI interacting factor-like phosphatase
MSLHLPLAHTCKCANLACKTYRFEMFFVSQKRRKEKWYKVVLDLDETLVCAYETSSLPAALRTQAIEGGLNWFELECVSIDKEGEGKPKINYVTVFERPGLKEFLKQLSEFADMVLFTAGLEGYARPLVDRIDVENRFCLRLYRPSTISTEYREHVKDLTCISKDLCRIVIVDNNPFSFVLQPVNGIPCIPFSAGQPHDTQLLDVILPLLKQLSERNDIRPLLYEKFHMPDWFQKQGIPASSWAL

SEQ ID NO: 153472 - protein, 763 aa, Glycine max
  Coding DNA Sequence Number=SeqID_36694
  Gene Ontology: Mol. function=inorganic anion exchanger activity; Cellular component=integral to membrane; Biological process=anion transport
  Homolog annotation: Hit_ID=Q8VYR7; Match level="QueryCoverage=99%, HitCoverage=99%, E-value=0.0, Identity=73%"; Hit description=Boron transporter 1
  Pfam annotation: Domain name=HCO3_cotransp; Domain location=1-593; Score=-151.5; E_value=9.2e-11; Accession=PF00955.11; Description =HCO3- transporter family
MEETFVPFEGIKNDLRGRLMCYKQDWSGGIKAGLRIWAPTTYIFFASAIPVISFGEQLERDTDGVLTAVQTLASTSICGIIHSILGGQPLLILGVAEPTVIMYTFMFNFAKERPELGRDLFLAWTGWVCVWTALLLFLFAILGACSIINRFTRIAGELFGMLIAMLFMQQAIKGLVDEFRIPERQNSKSIEFIPSWRFANGMFALVLSFGLLLTALRSRKARSWRYGTGWLRSLIADYGVPLMVLVWTGVSYIPAGSVPHGIPRRLFSPNPWSPGAYENWTVIKACKLQDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVTARKSMGKNASLGQLYGNMLEAYNQMQTPLVYQDPSARNNSCLGQSEPYYLYLKSSAYDFLLFMPHIIMTIVQAQGLRELKESTIQAATSMGNVDAPVDETIFDVEKEIDDLLPVEVKEQRLSNLLQSTMVGGCVAAMPLLKKIPTSVLWGYFAFMAIESLPGNQFWERILLLFTAPSRRYKVLEDYHATFVETVPFKTIATFTIFQTIYLLICFGLTWVPIAGVMFPMMIMLLVPVRQYFLPKFFKGVHLQDLDAAAYEEQTALPFNLATHSEFGAGASQVGEGEILDEVITRSRGEFRHTSSPKITSSTPTPRTDPKSHLSPRLSFSARVGEFKTEQSPRSGARGPLSPKAGEVRLSNLGRSPLNPDSKQQDQN

SEQ ID NO: 153473 - protein, 679 aa, Glycine max
  Coding DNA Sequence Number=SeqID_36695
  Gene Ontology: Mol. function=protein serine/threonine kinase activity; Cellular component=site of polarized growth; Biological process=protein amino acid phosphorylation
  Homolog annotation: Hit_ID=Q5QLC6; Match level="QueryCoverage=97%, HitCoverage=92%, E-value=1e-143, Identity=45%"; Hit description =Putative dual-specificity tyrosine-(Y)-phosphorylation regulated kinase TbPK4
  Pfam annotation: Domain name=APH; Domain location=418-604; Score= -11.1; E_value=0.035; Accession=PF01636.13; Description =Phosphotransferase enzyme family
  Pfam annotation: Domain name=Pkinase; Domain location=416-670; Score =131.1; E_value=3.2e-36; Accession=PF00069.15; Description=Protein kinase domain
  Pfam annotation: Domain name=Pkinase_Tyr; Domain location=416-654; Score=-82.3; E_value=2e-07; Accession=PF07714.7; Description=Protein tyrosine kinase
  Pfam module annotation: Pfam domain module=APH::Pkinase::Pkinase_Tyr; Domain location=418-604::416-670::416-654
MAVSNGVEAVLEFLRKNGLSEAESALREDIIENTDLGTFDYEKFFFPMVPPPPPVRVRSFSRPSGLSAAGNCSISSSDEFVSIGGSPTSRVSSSEFINPYGIHSSSQTQNDSESSSSERLSQFGTARDYHDFDMQNEPYWYNEKDDDYFMTPSFEGPDFFACQSEDKFVMTAEKDNQHDNSRDLDYNHKEFQSEENSNGGFMDKACLYNSNPSSVEDGTVTYSKGYCHVDNNNQFEGELEGKVEKQTVACSCEVPFCKSSPGSGGSCSLDPTNFGYPNLKEIHLNGFPLKVVGDINSFDSTSELTVNQSFDYYTKNDSSKEYNGPYDLTIKVTEKDLPNGLDTYKARDGGELAEECLDPEITADGEDTTDDELLKYTQEEEYEVFDLRIIHRKNRTGFEENKELPIVLNTVLAGRYYVTEYLGSAAFSRVVQAHDLQTGIDFCLKIIKNDKDFFDQSLDEIKLLKLVNKHDPADKHHILRLYDYFYHQEHLFIVTELLRANLYEFQKFNQESGGEAYFTLNRLQLITRQCLEALQYLHSLGIVHCDLKPENILIKSYRRCEIKVIDLGSSCFQTDNLCLYVQSRSYRAPEVMLGLQYDEKIDLWSLGCILAELCSGEVLFPNDAVVMILARMIGMLGSIDMEMLVKGQETHKYFTKEYDIYYVNEVKKHFLLTSEYRLY

SEQ ID NO: 153474 - protein, 220 aa, Glycine max
  Coding DNA Sequence Number=SeqID_36696
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=83%, HitCoverage=98%, E-value=1e-100, Identity=97%"; Hit description=ADP -ribosylation factor-like protein
  Pfam annotation: Domain name=Arf; Domain location=4-177; Score=433.2; E_value=3.5e-127; Accession=PF00025.11; Description=ADP-ribosylation factor family
  Pfam annotation: Domain name=MMR_HSR1; Domain location=18-129; Score =7.4; E_value=0.00021; Accession=PF01926.13; Description=GTPase of unknown function
  Pfam annotation: Domain name=Miro; Domain location=19-129; Score =19.0; E_value=7.7e-05; Accession=PF08477.3; Description=Miro-like protein
  Pfam annotation: Domain name=Ras; Domain location=19-179; Score= -47.1; E_value=9.6e-06; Accession=PF00071.12; Description=Ras family
  Pfam module annotation: Pfam domain module=Arf::MMR_HSR1::Miro::Ras; Domain location=4-177::18-129::19-129::19-179
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKPTNLNSSIDDKPNNAKKDKLQCTNYGGELLGAPSIGASNT

SEQ ID NO: 153475 - protein, 123 aa, Glycine max
  Coding DNA Sequence Number=SeqID_36697
  Homolog annotation: Hit_ID=Q10I53; Match level="QueryCoverage=93%, HitCoverage=88%, E-value=3e-28, Identity=57%"; Hit description =Expressed protein
  Pfam annotation: Domain name=DUF952; Domain location=5-118; Score =175.3; E_value=1.5e-49; Accession=PF06108.3; Description=Protein of unknown function (DUF952)
MSELVYRISTTNEWEELQSNGSSLGGDLDKSSGFIHLSKLDQVRSTLENFFLNCKEELYLLRIDAKKLGDGLVYEIVDGSNSFPHFYGPSRSFIPLPLDAVTKAEKLTLSDGRFSCSLLDLFC

SEQ ID NO: 153476 - protein, 82 aa, Glycine max
  Coding DNA Sequence Number=SeqID_36698
MCFYAQTHAKKVYLSQRTRRQINKVAGKNGKGSEVGDEGVKKIEKEKENKMAACEKRRGRGGGVGKLLTGVPSSFKLNLKVG

SEQ ID NO: 153477 - protein, 123 aa, Glycine max
  Coding DNA Sequence Number=SeqID_36699
MENKKRKGKDDGVLEEEEEEMMNKFYTLLRRFRDARDGRRKELEELQKSERKKKRSKVGTEQHHVWVPSFELEDFINEAEFRGQQPLRFPTSSASPSPRGGGTDKQRKNDDQHSHSLDLNLSL

SEQ ID NO: 153478 - protein, 63 aa, Glycine max
  Coding DNA Sequence Number=SeqID_36700
MEDGNLEHASTENQNLWLQDLYDQVDETVILKPSNFVTLVDSGESDHKRALKPYIIINNVNKM

SEQ ID NO: 153479 - protein, 598 aa, Glycine max
  Coding DNA Sequence Number=SeqID_36701
  Gene Ontology: Mol. function=oxidoreductase activity; Biological process=metabolic process
  Homolog annotation: Hit_ID=Q94K41; Match level="QueryCoverage=92%, HitCoverage=97%, E-value=2e-91, Identity=57%"; Hit description =Putative alcohol dehydrogenase
  Pfam annotation: Domain name=3Beta_HSD; Domain location=355-598; Score=-142.1; E_value=0.017; Accession=PF01073.9; Description=3-beta hydroxysteroid dehydrogenaseisomerase family
  Pfam annotation: Domain name=Epimerase; Domain location=354-593; Score=-60.8; E_value=0.036; Accession=PF01370.11; Description=NAD dependent epimerasedehydratase family
  Pfam annotation: Domain name=KR; Domain location=353-527; Score= -52.8; E_value=0.00027; Accession=PF08659.1; Description=KR domain
  Pfam annotation: Domain name=adh_short; Domain location=352-519; Score=91.7; E_value=2.3e-24; Accession=PF00106.15; Description=short chain dehydrogenase
  Pfam module annotation: Pfam domain module=3Beta_HSD::Epimerase::KR::a dh_short; Domain location=355-598::354-593::353-527::352-519
MVGIHRLPSQSTNHFLKPNIALKLHIRDKAKILSVKVDTHEAKKENVQAKVAIVTGGATRIGAEAVKIFVENGASADHSRHQGRIGSQLGYFIWLEKVSYRHCDAREEKQVEETVSFTLEKYGSLDIQGPLSSILDFDNAMAVNLRGMRRQCMITPHPNTALLALFDMEPGEVEAMEYALANLIAWNHRLIQRALDREQDLAIDEVRVEVVEMEGEVRERRGDDAAKLSAAVHGGDEVEHDVLRTRHMLQHGEHASEGDAEVGHVIAMWITESLSHAVATFSSIAECQYLVERWKLVGRRKMRIHNSEKQHHHTLVSGYFQPFTQILLVQILLDATVIRRSWYIPSLRLEGKVALITGAASGIGEETVRLFAEHGALIVATDIQDEQGHRVAASIGSERVTYHHCDVRDENQVEETINFTLEKHGRIDVLFSNAGVIGSLSGILDLDLNEFDNTMATNVRGVAATIKHTARAMVAKSTRGSIICTTSVAATIGGTGPHGYTTSKHALLGLVKSACSELGAYGIRVNSISPFGVATPLACKAFNFEPEQVEANSCSQANLKGVVLKARHIAEAALFLASDDAAVYISGHNLVVDGGFSV

SEQ ID NO: 153480 - protein, 775 aa, Glycine max
  Coding DNA Sequence Number=SeqID_36702
  Gene Ontology: Mol. function=nucleic acid binding; Cellular component= intracellular; Biological process=regulation of transcription, DNA -dependent
  Homolog annotation: Hit_ID=Q75IH8; Match level="QueryCoverage=93%, HitCoverage=95%, E-value=1e-123, Identity=37%"; Hit description =Putative zinc-finger protein
MDDCCAVCAEPLEWVAYGPCLHREVCSTCVARLRFICDDRLCCICKTECNLVFATKALGDYTRMINDFSTLPSEVREGKVGSYWYHEDTNTFFDDMDHYRMIKAMCRLSCSVCDKIEDQPQDAASRRRAKFRNIGQLKGHLFHRHKLHMCNLCLEGRKIHFRQEHFLCEDEACLTKKFVVFQSEAEMKRHNAIEHGGRMSRSKRNAALQATFIPPLQIPTSFRYRHGNEHEQRRGRGRTFRRDTENQLSMAIEASLETANAERTFRDQSTSSIGQIAVDDGNDDIDSLIQPFESLAAGGSESSARYLQALGHSSRNGPLEDSSFPPLPITSSNGQQRSKHELEGSSSNTMAARLRRHGNRTVSVVNSGNAWPAAGRGLVQTSSNPSQSKPSTNNVLGLSRNTGQMKTVINSGPSSSTYAGSIQATQRTTHGQLPAGSSRNTRDNVRIVHSASAPNLMENNSVEISISDFPPVSAAQVSKLPASSQSKLNVENFQSANKSLVEKIRGALDFDEERYSIFKDISAQYRQGTIDTGTYVDYVQQFGLSHLVLELARLCPDTQKQKELIEAHNASLQRDAFPEINLVRGTASTHHKDGNLNKKGKGKSVDSRGSNSTEKLADSFLSTVHQLQANYKSSEEKVEVLSRGDYRTDRGKLKIKQQIDSNPGSQPTMKLGGQTETSNGSLSDQSKEDGGGGNKQRKKTSKFLRVRLGDGSVSSLLDQSDPGTTDSSEGNNDDVGGGPPVRGVWRKGGAMVELQYKHEFGFRLREWYWIISDLS

SEQ ID NO: 153481 - protein, 614 aa, Glycine max
  Coding DNA Sequence Number=SeqID_36703
  Gene Ontology: Cellular component=integral to membrane; Biological process=vesicle-mediated transport
  Homolog annotation: Hit_ID=Q9FFF8; Match level="QueryCoverage=89%, HitCoverage=49%, E-value=2e-95, Identity=37%"; Hit description =Arabidopsis thaliana genomic DNA, chromosome 5, P1 clone:MOP10
  Pfam annotation: Domain name=PQQ; Domain location=333-370; Score=5.8; E_value=2.5; Accession=PF01011.11; Description=PQQ enzyme repeat
  Pfam annotation: Domain name=PQQ; Domain location=397-434; Score =14.0; E_value=0.18; Accession=PF01011.11; Description=PQQ enzyme repeat
  Pfam annotation: Domain name=WD40; Domain location=244-281; Score =8.3; E_value=3.9; Accession=PF00400.22; Description=WD domain, G -beta repeat
  Pfam annotation: Domain name=WD40; Domain location=310-348; Score =9.6; E_value=2.8; Accession=PF00400.22; Description=WD domain, G -beta repeat
  Pfam module annotation: Pfam domain module=PQQ::PQQ::WD40::WD40; Domain location=333-370::397-434::244-281::310-348
MYPSVQRPLAMRSMVNGHCMQPCHCICKETVFGFEPTTKCTQHTSNHPDKVVLPIEKKRRKQVLSIDWSCGIENLKCTDCIDVTLHGSFADMTLLSTDCHTEGACNMLFILTSPGQLDLYDNDCLSSTISQQEKKASVPPVLYPILIPTLEPHMTTARLDVVCQDVKSFRALFEILVAAKHRSIQNKKSIGIKWPLTGGVLGQPFKENHPIIQVYIAGYQDGSVRIWDATYPAFSLVYDIKSEVNDINIGNASAPVSALGFCPDTLHLAVGDESGVVRLYGLIRSSDDSTLHFVTENGTEVHNTHKGDGPHCKAVFSLQNSAVYSLQFANFGGKLVVGYEHGQVAMLDISSSSVLFVTKTESNTSSAVVSMHANFSDSSLNKPLESVSDISENPGMGLVYVMTRDEHFVAIDTMTGNMACSRTMSPSVKSNVISMHIIGNTSDLSAEKLTSTSPQKSDSGMQANIQSENAQVEDESAVTVENSYFGQIISNSLILLCYENELSLHSLNFVIEGSSKYIRKVNLVQRCCWTTTFKKDEKECVLVLLYQSGDIELSSTIQFMSGATFTLYSAEEIMSLPALEVLGESSLMSILRWNLETNMVKTICSSSNGKIILV

SEQ ID NO: 153482 - protein, 166 aa, Glycine max
  Coding DNA Sequence Number=SeqID_36704
  Gene Ontology: Mol. function=2-C-methyl-D-erythritol 2,4 -cyclodiphosphate synthase activity; Biological process=terpenoid biosynthetic process
MKFHLDDFYSKRRAKLGTIVSAHGCWRCFNKPLIHNGAKAEFLRRDVEETMSTNLIASNKLESQYVEEDFQQRAGFWGFIMQTIYQTCAGAAILTDIVFWVWGVIVPFLQNPHLRLSPLTGCMHALNAFFLLLDTSLNNLITEVKRWRTESKVLKETASKVFSKVV

SEQ ID NO: 153483 - protein, 1331 aa, Glycine max
  Coding DNA Sequence Number=SeqID_36705
  Gene Ontology: Mol. function=molecular_function; Cellular component =cellular_component; Biological process=biological_process
  Homolog annotation: Hit_ID=Q10ST1; Match level="QueryCoverage=97%, HitCoverage=98%, E-value=0.0, Identity=41%"; Hit description =Expressed protein
  Pfam annotation: Domain name=WD40; Domain location=112-158; Score =23.3; E_value=0.00087; Accession=PF00400.22; Description=WD domain, G-beta repeat
  Pfam annotation: Domain name=WD40; Domain location=1240-1276; Score =10.6; E_value=2.1; Accession=PF00400.22; Description=WD domain, G -beta repeat
  Pfam annotation: Domain name=WD40; Domain location=213-251; Score =30.7; E_value=5.2e-06; Accession=PF00400.22; Description=WD domain, G-beta repeat
  Pfam annotation: Domain name=WD40; Domain location=263-299; Score =25.8; E_value=0.00016; Accession=PF00400.22; Description=WD domain, G-beta repeat
  Pfam annotation: Domain name=WD40; Domain location=302-339; Score =19.6; E_value=0.011; Accession=PF00400.22; Description=WD domain, G -beta repeat
  Pfam annotation: Domain name=WD40; Domain location=737-790; Score =5.2; E_value=9; Accession=PF00400.22; Description=WD domain, G-beta repeat
  Pfam annotation: Domain name=WD40; Domain location=801-865; Score =0.6; E_value=31; Accession=PF00400.22; Description=WD domain, G-beta repeat
  Pfam module annotation: Pfam domain module=WD40::WD40::WD40::WD40::WD4 0::WD40::WD40; Domain location=112-158::1240-1276::213-251::263 -299::302-339::737-790::801-865
MDSANGTTAVEEQRLTERSMHRGPYLGDISALCFLRIPNLSLPFLLAGLGSEITLYDLELSKRVRSFSVFEGVRVHGIASSFPQENVIAVFGETRVKLFSFAFDSASRSPELTFVHLLPKFGHWVLDVSFLKGSLPHSNVESEFLAVGCSDNSVHVWDISNSKMVLKVQSPGCVCRWIIVRCLLYSMRLWGHNLEVFRIASGTIFNEDQLYEAIHVCKLIGHEGSIFRIAWSSCGSKLISVSDDRSARVWAVATEREHSLCHDPVALVLFGHYARVWDCCMYDNLIVTVSEDCTCRIWGVDGKQLQVIKEHMGIWRCLYDPNSSLLITAGFDSAIKVHQPRASLPRGLEAAQGSPGRTEMFSICIPNVLNHSGFMDSKSEYVRCLRFSCQDSLYVATNHGYLYLAKLCDTGGAQWNQLVQVSNGAPIICMDLLSKDSFELDCGAEDWIAIGDGKGNMTVIGVSNDDCTPTVRLCFTWPAEMERQLLGTYWCKSLGCRYVFTADPRGTLKLWRLPDPSQSDLPSSMRSNNVSCIAEFTSNYGMRIMCLDACMEEEVLACGDVRGNMVLFPLLKNLVLGISAAQEMKIPPVNHFKGVHGISSVSSVSVTKLGYNQIEICSTGADGCICYLEFDKEMQNLQFTGMKQVKGLSLIEYVSVDNNSGDKLSSSYAAGFASVDFIVWNLANENKVVNIPCGGWRRPHSYYLGDIPEMKNCFAFIKDEMINIHRHWIHNRDGKVYPQSLHMQFHGREIHSLCFISDDVLVGDNYKCALFSKSSWIATGCEDGTVRLTWYSPGIENWSTSKLLGEHVGGSAVRSICCVSKVYTISSDTGNVPDGRIELNAAVENNDNPTLLISVGAKRVLTSWILKNRRLDNKNDFVTDHQCNSEGVDDQFLSNFSSSMTFQWLSTDMPAKYSITHNTPENNVEKIVGIAENVSNTNSDARMGSLVSESRTANLIRDKHEDDWRYLAVTAFLVKCSGSRFGVALLVPLLAPVLSLQHIIFPMCRPHKENIQVGNVYIVISGSTDGSVAFWDLTDSVEAFMQQVSVCNVENFFDCQKRPRTGRGSQGGRQWRSLSRDLSKKRQDGKLVTLKAEDRTQSISYATQGTSYMPSSSADCEMVCSQSTHMVPPELESKTDNLSVEICEIRPLCRLQNIHQSGVNCLHVSEIKGGQITDNCHVYSIVTGGDDQALHHLMVELSPKSINSSEGILIPDIIHFVSVPEHGKDINLQSQSKNYKIKFLNYQKLPSAHSSSVKGVWTDGSWVFSTGLDQRIRCWHLLQSKLIEHSYLIVSVPEPEALSARACGRNHYQIAVAGRGMQIIEFSESLKKIGD

SEQ ID NO: 153484 - protein, 97 aa, Glycine max
  Coding DNA Sequence Number=SeqID_36706
MPIVLRHKCANNSNRYKALQRRGRGFIGKRDVPGPPLVDVPDRLPLVVAPRAPPLLVAPDRPPLVVASGRPPLPPLSHRPVKSRHVSRSAGTRLSGS

SEQ ID NO: 153485 - protein, 167 aa, Glycine max
  Coding DNA Sequence Number=SeqID_36707
MGTMKGRKNNNLSIFVVVFSIFLFGLFMYNEDVKSIAEFPFSSPKAHETQEGGEPNKHVDSVQDSVVVQRESEKKDVEDTATVKVSSKRSTSRAQLEKSGAEDEDSDERVDLKTVVEKEKKIEMPRAEEEEEVEEEEEEKEEEEEEEKVELPPEDCDLFTGEWVLDN

SEQ ID NO: 153486 - protein, 97 aa, Glycine max
  Coding DNA Sequence Number=SeqID_36708
MSQPTSRRDGEGKIDKPKHSSPREKTSGVATNIYSRKTLEKPKRGLQILKRRIRKLFTHGEGSQLFKQNNCVIDYTNSVIDYQRGFQGISPTVTSFH

SEQ ID NO: 153487 - protein, 89 aa, Glycine max
  Coding DNA Sequence Number=SeqID_36709
RSLYTPPKTEVRSGGAFGHCIRGGRHLGIVATCPSAGGRRVTRGMRVPRKEYARSRHQHLFEENVGKTGKDPIYELFSERFGSCIYARG

SEQ ID NO: 153488 - protein, 113 aa, Glycine max
  Coding DNA Sequence Number=SeqID_36710
MFLRSTPSPSSSPSLQLLFQLHDLLTLLPTTISLFLVPTHGRINAIEDHLKFEFKSTWMGLKRRRWSCSYRAMMATRALPMLESESWVERRIETKGFSSLSLSLWVVRRESHN

SEQ ID NO: 153489 - protein, 386 aa, Glycine max
  Coding DNA Sequence Number=SeqID_36711
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=39%, HitCoverage=11%, E-value=4e-19, Identity=41%"; Hit description =Putative retroelement
MVSCGLWTVARLGGLEPLDTQNHIGTTQGQDMKVHHKLDALDSNGDCFTELVTMKMLTIPDHDAKRRSGASSEAQFLHQWFLNKVVGAAPIKQVNQLVSGDVAQQTQVGLVASSGSGGSSNWVGSSRFASSSSAIKRNIRETHLCPRWNCLSQLKHRPRSLRKANSSGERHFRGIGGGVFGGAGSNGVTTAGKGGRGGAVRGGGRARLKEPNLQSQPRYKATQKEQCRQADNTIRKIFEFRKAFASTLTIIGHPLEPGQCTPLHVEGGDDQPLVLWRGTVGIGGVELDANKDGEEVSGWANFWINSSSFRVIVCTVSIKERAPKLIDYSGIEDQKPPKKRRRGNSRHHPNGKYRIQGNDRQAKENVDSVAGREDFDAYSAISTLSQ

SEQ ID NO: 153490 - protein, 525 aa, Glycine max
  Coding DNA Sequence Number=SeqID_36712
  Gene Ontology: Mol. function=RNA-directed DNA polymerase activity; Cellular component=chromatin; Biological process=chromatin assembly or disassembly
  Pfam annotation: Domain name=rve; Domain location=199-357; Score= -12.1; E_value=0.061; Accession=PF00665.16; Description=Integrase core domain
MNSIFRPYLRRFVIVFFDDILIYSRTLEGNLSHLATVFQVLVEGQFILKRAKCSFKQTQVEYLGHVVLVMGVVPVSLKVQAIQDWPVPQSIRAIRNFLGLAGFYRRFARGYASIVAPLIKATTMDSFKLKDALMTAPVLSLPDFEVPFTIETDASGSGMGAVLSQKGHPIAFFRHRFTILTDHHSLKELLTQVIQTPEQQMYLAHLMGYDYCIKYHSDSSNTVTDALSRASERCGKLCHSALAVATLFIEIVKKIHGMHRSLVSDRDPLFLSHFWQELFRLSGTRLRISFSYHPQSDGQIEAGSTPFEITFGRKPFNFPEYLAGTSKIYAVDDLLCHRTETFTKFRKKLLKAQETMKLVADSKCRDVEFKVGVMVRLRPSRQSTVTGIKGAHSKLEKKFYGSFVIVERIGPVAYKLRLPEGACVHPIFHCSLLKPCHGAQGDDQQPLPTTAINNQPIITPLVIVDSRCLPDSSPPKWEDKVFPQVAGNVSNQGEQTEGNRQGVQTVRNKPRRISTIPTYLEDFIH

SEQ ID NO: 153491 - protein, 459 aa, Glycine max
  Coding DNA Sequence Number=SeqID_36713
  Gene Ontology: Mol. function=binding; Cellular component=chloroplast thylakoid membrane; Biological process=metabolic process
  Homolog annotation: Hit_ID=Q69MJ7; Match level="QueryCoverage=94%, HitCoverage=75%, E-value=1e-122, Identity=52%"; Hit description =Pentatricopeptide (PPR) repeat-containing protein / CBS domain- containing protein-like
  Pfam annotation: Domain name=PPR; Domain location=130-164; Score =32.5; E_value=1.5e-06; Accession=PF01535.11; Description=PPR repeat
  Pfam annotation: Domain name=PPR; Domain location=165-199; Score =25.2; E_value=0.00023; Accession=PF01535.11; Description=PPR repeat
  Pfam annotation: Domain name=PPR; Domain location=207-241; Score =20.7; E_value=0.0053; Accession=PF01535.11; Description=PPR repeat
  Pfam annotation: Domain name=PPR; Domain location=25-59; Score=15.1; E_value=0.12; Accession=PF01535.11; Description=PPR repeat
  Pfam module annotation: Pfam domain module=PPR::PPR::PPR::PPR; Domain location=130-164::165-199::207-241::25-59
MWLVLVQILDEVEVANKHFGKLNTIVMNAVVEACVRCGDIDSAIRIFDGMKKRDGCGVDTGLGEARRVDEAFELLETVENGTVMGSPNLSAPLIFGLLNALIKTGDLRRANGLLACYGFVLREGDNFPVSVYNILMKGYINSGCPHTAINMLNEILRQGIMPDRLTYNTLILACVESGKLDAAMQFFGEMKGEAQKFVNDDLFPDIVTYTTMLKGFGRMKDLASVLKIVLEMKSCRELYIDRTAYTEIVDVFLKCGSVKEILKQAGLNPELRPKPHLYLSMMRAFAFLGDYDLVKKLHKRIWPDSAGTILLVAQEEADHLLMEAALNAGQVNVAIKTLTEIVSRWKGISWTSRGGMVAYCIEAMLGFSKSLFSPHLLPQVSPSEPVENYMIQFEATRPLQGTIKLRKVVMRFFHEAVVPIVDEWESCTGLFHREDCNQLTAALIQESESQFCIALIVAE

SEQ ID NO: 153492 - protein, 139 aa, Glycine max
  Coding DNA Sequence Number=SeqID_36714
MLINLIRNNEIYMRIKLICKLLLDQLDPHDLSYTRTHLTLRTSYAMPTTTVTPITNTFTFTAPNKTNRKKMNKQGSTDRREKRKRQCARKHIVPFKTVEQSTIHGNTIHGKERKQEGAAGVLWVFLKVAGCTNNNVGCN

SEQ ID NO: 153493 - protein, 246 aa, Glycine max
  Coding DNA Sequence Number=SeqID_36715
MSDIPFRGLKSARKRAVFSAFSGKCDELAKRACCAKRVHQYSLYMTSRKRKSGDSRPTTQYDTRRFYSFEAWTRYTNNVLGRHILVERKVEIYHTKLDEFKGELERHNFHKRLTNLADSSIGLPLVKKFYTNHYSSKGPAPKQLKIRGHLIRIDADNLNAFLETLVVLVEGESLPDYSRYCRMPTNTKEIKAALCIPDQGFILNAKGHPGKILVKDLTTLAQVWSVLSYSNLAPTSHTSDLTVDRA

SEQ ID NO: 153494 - protein, 1960 aa, Glycine max
  Coding DNA Sequence Number=SeqID_36716
  Gene Ontology: Mol. function=RNA-directed DNA polymerase activity; Cellular component=chromatin; Biological process=chromatin assembly or disassembly
  Pfam annotation: Domain name=Chromo; Domain location=1416-1470; Score= 51.3; E_value=3.2e-12; Accession=PF00385.14; Description='chromo' (CHRromatin Organisation MOdifier
  Pfam annotation: Domain name=RVP_2; Domain location=394-527; Score= -26.1; E_value=0.00011; Accession=PF08284.2; Description=Retroviral aspartyl protease
  Pfam annotation: Domain name=RnaseH; Domain location=898-1019; Score=- 20.4; E_value=0.0046; Accession=PF00075.14; Description=RNase H
  Pfam annotation: Domain name=rve; Domain location=1120-1276; Score =120.4; E_value=5.3e-33; Accession=PF00665.16; Description=Integrase core domain
  Pfam module annotation: Pfam domain module=Chromo::RVP_2::RVT _1::Retrotrans_gag::RnaseH::rve; Domain location=1416-1470::394 -527::640-809::126-216::898-1019::1120-1276
MEAKVTTLESEVSEVRTTLMEVQNNVKENHATLIALLEKCFGKSVQQDEGASGVKQKTPEGKGYPEKEGSSGNSSGESGGAVLSEFRHAVKKVELPMFNGEDPAGWISRAEIYFRVQETTPEVKIRLAQLCMEGSTIHFFNSLWSENEGLTWEGLKEALLGRYGGYGEGDVYEQLTELRQGGTVDEYITEFEYLIAQIPKLLDKQFLGYFLHGLKPEICGKVRSLATMGEMNRSKLLQVTRAVEREVKGGGSNFYRGPKSGNGSHRPNSYGSSKSGSDWVMVKGREVEATGGARSNANGPNADKPAHSDRRRTGPRDRGFTHLSYQELMDRKQKGLCFKCKGPYHPNHQCPDKQLRILVVDDDAEAEQEANVLAVEVDESEEEEGGEMCILNLNHIAFENHQTVKFQGQVQGVPVLVMVDSGATHNFISQKLVHKMEWPIEETPVMNIKLGDGCYRSSRGVCCGMELGIGSFTISPKLHLFELGGIDVVLGMEWLKTLGDMIVNWRQQTMSFWSDKRWVTLQGIDGHEKKLVALQSILSKPKLSDQEVLWGLETQERSEVQCLTKHQQVELDHLLVQFEDIFREPSGLPPRRNKEHAINLVEGHGAVNVRPYRYPHHHKNEIERQVQEMLTAGIIRHNTSSFSSPVILVKKKDSTWRMCVDYRALNKVTIPDKFPIPVIEELLDELHGANFFSKLDLKSGYHQVRVKDSDVCKTAFRTHEGHYEFLVMPFGLMNAPSTFQSLMNEVFRSLLRKCVLVFFDDILIYSRGWEDHMKHLETVLKMLAQHSLVVNKKKCQFVQKSVEYLGHVISEAGVAVDPNKVKSVIQWPVPKNVKGVRGFLGLTGYYRKFIRDYGKVARPLTELTKKDNFKWGVESQQAFEELKRRLTTAPVLALPDFTKQFVIESDASGGGIGAILMQDKRPIAYFSKALGRRNLTKSAYEKEMMAVVLAIQHWRPYLLGRKFTVYTDQKSLRQLMQQRIVTAEQQNWAAKLLGYDFEIVYKQGRLNKGADALSRMYERTELNTITSYAQWDQKQQVTMEIQKDEKLQSIIKALQQDPKAKPGYVYKQGVLMYNGRRIAANVYWMGMKGTVQEYVRSCDICQRQKYMATAPGGLLQPLPIPEQIWDDISMDFITGLPKSRGYEAILVVVDRLSKYSHFIPLKHPYTARSIADVFCKEIVKLHGIPVSIVSDRDPVFVSGFWKELFRMQGTQLKMSSAYHPESDGQTEVVNRCLETYLRCFVADQPKTWVLWVHWAEYWFNTNFHASTDKTPFEIVYGRPPPKLIRWLQGEVRIEAVQRDLIDRDEALRQLRSQLLRAQERMKRQADKKRIDRSFVVGEAHRQQSVVTRINAKLAARYYGPYPILERIGAVAYKLKLPTGSKVHPVFHVSLLKKAIGEYHEEEALPELLSDEQTEIFEPEAVLGTRKIKQQGEEIKQVLIQWKGKTTDEATWEDVIMMKSQFPTFNLEDKVLIEEGGVDRGHAVDSVPHEELAHHETRGPRTWLGEIGRRSGGDNVLEREGHAVSAGFALGLVALGRGEDALGFIDTFVNRLFLYIGDKERSHFSTVSMDESRGSAQMMDGTTVNIDVTAPGAIIAIALMFMKTESEAIVSRLSIPNTGFDLQYVRPDFIMLRVIARNLIMWSRVNPSKDWVWSQIPEIVRCAVEGIGGDDNDIDDMDAEAFIQAYMKPVSPTCGKVFPKGLSRYIDRGTLETCLHLIVLSLSVEQKLCRWAVKLWYSDGRGWGLNCPTLKWLEVSLAIGFLFLGGGMRTFSTNNHSIAALLITLYPRLPTGPNDNRCHLQAFRHLYVLATEARWIQTVDVDTGLPVYAPLEVTVKETEHYAESSFCELKRIRVCGPRYWPQVIDFTPEDKNSPFNSGILFIKRKVGACSYVDDPIGCQSLLSRAMHKVFGLTSLKASDTITDIRSGSGSITVDQLVGTFSSDPSLIAFAQLCCDPSWYNR

SEQ ID NO: 153495 - protein, 88 aa, Glycine max
  Coding DNA Sequence Number=SeqID_36717
MSRTWILYNKPEEPNSVHAGLLLALGLHGYLRVLAVTDIYQYFSQCCIVAVPSYRNCIAECSCVSSVVPTMQLQLVRSKKTIFVAEGK

SEQ ID NO: 153496 - protein, 73 aa, Glycine max
  Coding DNA Sequence Number=SeqID_36718
MGGPVPQLLGEQASNFGLEDITVVYCNGRRFGGSFGSGDSKRMKRRQEKKRNCVESKAQVTNLSMVVNVSTLL

SEQ ID NO: 153497 - protein, 715 aa, Glycine max
  Coding DNA Sequence Number=SeqID_36719
  Gene Ontology: Mol. function=pancreatic ribonuclease activity; Cellular component=nucleus; Biological process=regulation of progression through cell cycle
  Homolog annotation: Hit_ID=Q9FFF9; Match level="QueryCoverage=99%, HitCoverage=41%, E-value=0.0, Identity=53%"; Hit description=Meiotic check point regulator-like protein
MQHSLWVAEIVNSNIDEDLATSLLHIDPMSVLPKHLSFRKIWQGKGAQTAACKVFLATDDDAAPVVCFFHQEQRKLLSVSLQIVEINNEIVFDVKPDMSWNISAIAASPVMVTRPRVKVGLLPYSDIMVLAPENVLLLYLSEESPLPNDLKITGLADAVEGRVNVIVNHRQIFRCALRQSPSSALANDCITALAEGLHSSFYRHLLGLLWKDGDPAHLSDAESIVDSEWDSFCHVIMQICRKYKIICQKHSDSVPHSAWDFLVSSQFHYNFCKVNSMFGIPYAVSLDQRGLNFQRSSVDGAQNSGKPFYTDLLRESLESLHGLYESLKLDNLRKRDLELLSILLCNIAEFLAEDNYLDHYIRDFPGLCKKFLKSGGITILPKICPSLFRWFENCLQYGCSYANINDLPALVCKEGNSVVSIARKVVCFYSILSGAKLLGKKLSTGVYCNITVGSHSSKEELTVLAMVGERFGLQQLDSLPSGVSLPLRHALDKCRDSPPNDWPAAAYVLLGRQDLAMSTLARECKYRGIETPTNVNVISMSTPYMLNLHPVTISSTISDAIGLEGTKFEDTDSVDGSMTDGMEHIFNSSTQLRYGRDLRLNEVRRLLCSSRPVAIQTSANHSASDQDLQQAQLWHLAQRTTSLPLGRGAFTLATIYTLLTEAFTVPKLVLAGRLPAQQNATVNLDPNIRNIQELRSWPEFHNAVAAGLRLAPLQV

SEQ ID NO: 153498 - protein, 141 aa, Glycine max
  Coding DNA Sequence Number=SeqID_36720
  Subcellular localization annotation: CTP_CleavageSite=50; ConfidenceScore=5.29e-01
MQQQCRFRQSNNNEKQMHRHISKRTQPNFKTKVQIQLRFPFSFFSFNFISALSEATEQISEGFSVLLQENEKLPIASDEKLVIATIARSRSDVGAIVVGVSVSSDFGIEEEVIVLVGDGVGGLAIEGFGNEAKWLELTQQC

SEQ ID NO: 153499 - protein, 96 aa, Glycine max
  Coding DNA Sequence Number=SeqID_36721
MFECRRFAEKGDDRKTENQKKTKKGAFMRRENEVGDGEGINGARWHYSGAGVARFRLPRSFSRSEKKVCIQTISASTLPPPPHLKQGNNLGSMNRK

SEQ ID NO: 153500 - protein, 55 aa, Glycine max
  Coding DNA Sequence Number=SeqID_36722
MNEDQWMYDSIMSEEVDMDDENEQEYGVNKQHVDCLDAFNTSQVFAIRDDVLQWA

SEQ ID NO: 153501 - protein, 50 aa, Glycine max
  Coding DNA Sequence Number=SeqID_36723
  Homolog annotation: Hit_ID=Q2RBN7; Match level="QueryCoverage=100%, HitCoverage=2%, E-value=2e-16, Identity=82%"; Hit description =Clathrin heavy chain, putative, expressed
MAAANAPITMKEALTLPSIGINSQFITFTHVTMESDKYICVRETAPQNSV

SEQ ID NO: 153502 - protein, 299 aa, Glycine max
  Coding DNA Sequence Number=SeqID_36724
  Gene Ontology: Mol. function=protein serine/threonine kinase activity; Cellular component=nucleus; Biological process=protein amino acid phosphorylation
  Homolog annotation: Hit_ID=Q9FF31; Match level="QueryCoverage=77%, HitCoverage=37%, E-value=2e-21, Identity=27%"; Hit description =Receptor serine/threonine kinase
MALPLLPPLSSIINTLFFFTLFFPKYVSSDVEGYSACEPFSCGEIDIRYPFWSSDHQQSYCGHPKFKLDCQQDNVTIDMMSQRFHVIDIDQTSKVLKMARLDLWDDPCTDEYSNVKLDSDFFNYNSNDDDYTLLYDCGPPVTYTSSVNIKGTISFSCPIDGGFRDAFFVSSTDVGNLKDLGCKHSINVSVLREAVKDALQVENVLEKGFEVGWIGVDEGQCDGCIKSGGRCGHNVSKDAFTCLCPNQQSYDEVCSKSQTSSPLAAPTPKPTPEQALSPPFGPKFQEKSPHAPSMYSSFS

SEQ ID NO: 153503 - protein, 156 aa, Glycine max
  Coding DNA Sequence Number=SeqID_36725
  Pfam annotation: Domain name=GRP; Domain location=1-122; Score=-29.9; E_value=0.087; Accession=PF07172.2; Description=Glycine rich protein family
MASKIQILPILGVLAMLLLISSEVLATGLHGVGVGIGGGLPGVGVSAGLPGVGAGLHGVGGAGLPGVGAGLHGVGGAGLPGVGAGLPGVGAGLSANAGLSGAGGAGLPGVGAGAGGGRRGRAGSPSYHASSPSGGDSSPSYSYHASSPSGGVDYYG

SEQ ID NO: 153504 - protein, 56 aa, Glycine max
  Coding DNA Sequence Number=SeqID_36726
MKKGFVLDWMRAQECAVCEESNGHCIFDPATKQSRCLCSDGRTEVNSCEKGRPRIV

SEQ ID NO: 153505 - protein, 393 aa, Glycine max
  Coding DNA Sequence Number=SeqID_36727
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=98%, HitCoverage=46%, E-value=1e-44, Identity=43%"; Hit description=Wall -associated kinase, putative
  Pfam annotation: Domain name=Pkinase; Domain location=2-248; Score= -3.8; E_value=2.5e-08; Accession=PF00069.15; Description=Protein kinase domain
  Pfam annotation: Domain name=Pkinase_Tyr; Domain location=2-248; Score=-17.6; E_value=2.2e-11; Accession=PF07714.7; Description =Protein tyrosine kinase
  Pfam module annotation: Pfam domain module=Pkinase::Pkinase_Tyr; Domain location=2-248::2-248
KLEDGREITIQCFNEDKHHTLQQFINETVILNYLPHKNIVSIYGCASHHKESLLVHEYLSNGNLSAHLQSEIAGNSTQPWLTRLDIAIDIANALDYLHYYGIIHRNVKSSNILLDVNFCAKLANLHLSQKLPGEVPVYATTHVTGDIIGTCAYMDPELAYGWLSVKNDVYSFGVLAKCWVLNEEDNLATLLSRKIENQALVELLDPRFGFETNLKIKWMMTAITELALLCMKCPQELRPNMEQVLETLNDIKQGRYETNSIKALKIFHHAELEEATNNFDTCLGKGGYGTVHHAIVLGKLKDGQEVAIKCFHDESETEKTIKQFMKETEILILLHHQNLVSLYGRTSPHSNKHMIVYEYISNGTLSKHLHESSRGKLPWHTRLNIAIVIRGSR

SEQ ID NO: 153506 - protein, 1396 aa, Glycine max
  Coding DNA Sequence Number=SeqID_36728
  Gene Ontology: Mol. function=RNA-directed DNA polymerase activity; Cellular component=chromatin; Biological process=chromatin assembly or disassembly
  Pfam annotation: Domain name=Chromo; Domain location=1336-1381; Score= 28.9; E_value=1.8e-05; Accession=PF00385.14; Description='chromo' (CHRromatin Organisation MOdifier
  Pfam annotation: Domain name=RVP_2; Domain location=314-445; Score= -38.1; E_value=0.00092; Accession=PF08284.2; Description=Retroviral aspartyl protease
  Pfam annotation: Domain name=RnaseH; Domain location=825-946; Score= -29.8; E_value=0.034; Accession=PF00075.14; Description=RNase H
  Pfam annotation: Domain name=rve; Domain location=1081-1232; Score =6.0; E_value=0.0019; Accession=PF00665.16; Description=Integrase core domain
  Pfam annotation: Domain name=zf-H2C2; Domain location=1022-1063; Score=16.5; E_value=0.0023; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1336 -1381::314-445::567-736::97-201::825-946::1081-1232::1022-1063
MANSPSSDKIEELLIRLTTQQLSLSTKIDDFISHVSPLFSNSHHIPSSLPRLFPVPAQQHRIKLDVPRFDGTDALGWIFKINQFFEYHGTPEYDRLTIASFYMEGRALAWFQWMTSNGQFTSWPTFLQALQTRFAPSQYEDPTGALCKLMQKGSVTTYLAEFEDLANRVIRREVQAHQPLTLSQAAGLARLQEEKLSDLRPPPPPICPRPPSLSSPSLSRPPSLSPLLPPPPPLTCPNPPPPPFKRLTSEEIASRHERGLCFSCDEKYHRGHRCASRVFLFIAEGEEPSDPSQIASFDPTLEPEPDPPDTQDPYPAQLSLNSMAGHLAPETLRFMASIANLDVVLLVDGGSTHNFIQHQLVTKLGLRPTSTAPLRVMVGNEQHLDCSSMCEAVPIFIQSIQFIVDLYVLPISGANVVLGVQWLKSLGPVLTDYNTLSMQFLSDGRVIKVQGELDAKLHSLTPVQLRQLSRTQDEAQFYHITLFPNLSSSQTHALPAPIRQLLLRFKALFDPPSTLPPPRATDHHIHLLPQASPVNVRPYRYPHYQKQEIEQQVDSMLQKGLIQPSTSPFSSPVLLVKKHDGSWRFCVDYRALNALTVRDRFPIPTIDELLDELGGACYFSKLDLLQGYHQIRMNPDDIPKTIFRTHHGHYEFKVMPFGLCNAPSSFQATMNSIFRPYLRRFIIVFFDDILIYSASMDDHLHHLETAFQVLLNHQFALKLSKCFFAQQQVEYLGHLVSTRGVEPLAEKVAAVRQWPIPRTTKALRSFLGLVGFYRRFIKGYATIAAPLVKATTLDPFHWTDETQVAFEQLKLALSSALVLALPDFQSPFTIETDASGVGLGAVLSQKGHPIAYFSKPFSPKLLRSSTYVRELFAITAAVKRWRQYLLGHRFVIITDHRSLKELLTQVVQTPEQHMYLARLMGYDYEIHYRAGAANQAADALSRVPEFESSLAMLLSVPNLSFMDELRRQLQQHPEFNRRHLEVINSPTAHPGFSVANNLILYRHRIWLPRDIPIISTLLHEYHAMLTGGHSGVAMTLARISENFYWTGLRDDITTFVSKCFDCQSTKYEAKRSAGLLCPLPVPHRPWEDLSLDFILGLPEYKGNTVILVVVDRFSKGVHLGMLPTAHTAFMVATLFLDMVVKIHGVPRSLVSDRDPIFLSKLLLWAEWSHNTSWTSATGVTPYELTFGRKPFNFPDYLAGASSNDAIDTMFSDRKETFLMIRKKLLKAQEAMKRKADVHRRDVTFLPGQWVLLRLRPHRQVSVRDHPHISGKLAKRFYGPFQVTEAIGKVAYRLQLPPGAKIHPVFHCSQLKQFHGDPSNTDIPPLPPQFCQDQPIIQPAAILDSRQTSDTTWEVLVQWHDLSPDETSWEDWSILRQDYHLEDKVISQGPRGIRGSR

SEQ ID NO: 153507 - protein, 203 aa, Glycine max
  Coding DNA Sequence Number=SeqID_36729
  Gene Ontology: Mol. function=protein kinase activity; Biological process=protein amino acid phosphorylation
  Homolog annotation: Hit_ID=Q1RZG3; Match level="QueryCoverage=93%, HitCoverage=38%, E-value=6e-15, Identity=29%"; Hit description =Protein kinase
MDIHIHMLLTSISCLFFITLPQSLSQPPPVFNYSACKEWPYKCGTLSDIFYPFWGENRPPQCGGGQAFRLSCNHDNITTILIASHNFTVENVDNTTRTMRVVPTDLGPNDCSLQSKNISDDIHANATHFLYPNSSLYSNNICEGFEVIYDVSENCTKCLGSEGECWKDEIDGHDVVPCYYCPDGSHSLDCSPLKRSTSSILFS

SEQ ID NO: 153508 - protein, 252 aa, Glycine max
  Coding DNA Sequence Number=SeqID_36730
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =84%, HitCoverage=36%, E-value=6e-44, Identity=44%"; Hit description =ATP binding / kinase/ protein kinase/ protein serine/threonine kinase/ protein-tyrosine kinase
  Subcellular localization annotation: CTP_CleavageSite=51; ConfidenceScore=5.32e-01
MHTLDSSQFPFFSSSFSNLQNQMILQISFHYNKPQLCIITSILFLVTTVLSSNPKFEACSPRSCGTGPPIKYPFWIPYEQEPFCGYPHFEITCMDKNPILRTSNYEFLVKDIYYSNSSFTVADIDVYEDKCPVPLYNYTFDQTPFTYSSENWNLSFFYNCSTEPIDYPTYEVDCAKNATHFSFADFHKEALEHKNYSLNECQFMVTTPLNINEAVNISSLLRMNYTEILKTGFVLNWTAPHCHYCEKSGGRC

SEQ ID NO: 153509 - protein, 502 aa, Glycine max
  Coding DNA Sequence Number=SeqID_36731
  Gene Ontology: Mol. function=calmodulin binding
  Homolog annotation: Hit_ID=Q9C9T2; Match level="QueryCoverage=95%, HitCoverage=98%, E-value=1e-113, Identity=47%"; Hit description =Putative calmodulin-binding protein; 77122-73705
  Pfam annotation: Domain name=Calmodulin_bind; Domain location=87-392; Score=570.3; E_value=1.9e-168; Accession=PF07887.2; Description =Calmodulin binding protein-like
MSAKRFFNDSDQDPENPGGKRMRNTRPSFASVIGEVVMVKNLENLFSAMEPLLKRVVGEEVDQAMRQWSRSFARSPSLRLQAMDQQQPSTLQLCFSKRLSLPIFTGSRILDVDGNPINIVLMDKSNGQGVPTSLSNAIKLEIVVVDGDFPLNDNDEDWTSEEFNRHIVKERNGKRPLLAGELNVIMRDGIAPTGDIEFTDNSSWIRCRKFRVAVRVVPGTNPGGVRIREAMTEAFVVKDHRGELYKKHHPPMLHDEVWRLEKIGKDGAFHRKLSSEGIKTVQDFLKLAVIDALKLRNILGMGMSDKMWEVTIKHAMTCDIGSKMYIYRGPEFTIFLDPVCKLIRADVNGHTFSNRDPMSHLNKAYIDKLVKEAYARWSNLEEIDEVLNDNIALLTQATVTDVDVNIITIGDQTVEQFANNQPAAASVETTYDQNQYYSDKSGSYVANNNTQMGCCEWSLNQAYSPAPFANGFPFSFSVRQSDGDITASGSSSVDVDGATRHN

SEQ ID NO: 153510 - protein, 176 aa, Glycine max
  Coding DNA Sequence Number=SeqID_36732
MAKLIIPINGLSTSAGNNIYTGIMIRNIASGMCILEVQNIESMNEVPSTNLLAMRHFLYDKLRVREGDKCTVPTAMTGTIALLVIRIKEINGTNNVSVGTRINNPIILRKLSKEANKTIPVLEDSISGVMAFELETPILSMAKSTTICIERSISGRSTNLVIRLIFGILNSKSMRL

SEQ ID NO: 153511 - protein, 243 aa, Glycine max
  Coding DNA Sequence Number=SeqID_36733
  Gene Ontology: Mol. function=DNA binding; Cellular component =cytoplasm; Biological process=DNA integration
  Homolog annotation: Hit_ID=Q1SS72; Match level="QueryCoverage=81%, HitCoverage=17%, E-value=2e-20, Identity=30%"; Hit description =Integrase, catalytic region
MNQVSPSTSVPDFHLIAQQYSQLMSLLQTHTSNAITPDIESSNTATLNYERNKFYPRAIPFVFVGYPQGIKGDLVVSLPIPESMSSTIQPGATKPNIPHATNNLPIQLSDSAVDTTISTSFALPSPSVRRSIRTSNPPPYLLDYIRPQPRKKSHLIQDHCSLVHLHSLYMDFIAQVSTIYEPQFYHQAFPFPEWRQAMTAEIKALESNNTWTLVPLPIVKFKPDGTVDRHTARLVAKGYTQQD

SEQ ID NO: 153512 - protein, 304 aa, Glycine max
  Coding DNA Sequence Number=SeqID_36734
QGGGSGGYGGGGSGGGGGSAGGGGSEGGGGSAGGSGGGEGGGSGGGGGSAGGGGSKGGGEAGGSGGSQGGSSGGYGGGGSGGGGGSAGGGGSEGGGGSAGGGGSEGGGSAGGGGGSQGGGSGGYGGGGSGGGGGSAGGGGSEGGGGSAGGGGGEGGGSAGGGGSEGGGGSAGGGGSKGGGGYGGGGSQGGGGSAGGGGSQGGSGGSAGGGEGSGSQGGGSGGGGSQGGGSGSGGGGYGGGGSGGSEGGGSSGGGGGGGGGGGGGGYGGGGDKGGGIGGDKGDYHHGKGGKGDKDGGDKGGGGGY

SEQ ID NO: 153513 - protein, 80 aa, Glycine max
  Coding DNA Sequence Number=SeqID_36735
MQEPTQNTKEKEESLGVLLSTTPRKKFCCTTTTARSRCIFRKSQVNLYLLQLIMGIRATMMGPRDQGKTEIEASLETIFH

SEQ ID NO: 153514 - protein, 254 aa, Glycine max
  Coding DNA Sequence Number=SeqID_36736
  Homolog annotation: Hit_ID=Q2QLN3; Match level="QueryCoverage=38%, HitCoverage=25%, E-value=1e-22, Identity=54%"; Hit description =Expressed protein
MKNNNKEQQGKGAASYLKLFSAQLDLLNLFSHALVFGIGLLIGVTLTFFVKNFSLINFPIQKFSFSSNSLMIKPPTSLSPSHPIISNISLLTSNNQTKNESQYLEGLVVSDSRLRHHDKTKPSSSDSSSINRKRVMNFNRVGLREFLKPPMAMHDMSDEELLWRASMVPMVHKLPFKQTTAKVAFMFLTKGPVLLAPLWERFFKGNERLYSIYVHSNPSFNETVPESSVFHGRNIPSQGVITLKTTKEDFFIMF

SEQ ID NO: 153515 - protein, 80 aa, Glycine max
  Coding DNA Sequence Number=SeqID_36737
  Subcellular localization annotation: CTP_CleavageSite=49; ConfidenceScore=5.38e-01
MMAHHSASPFPHFRFSLSPLKTLSFSRNPQNLSRKNNDLKLINHLIVVKFKHQVCNPIPSILTVGNCKNMSEIRGIPFAP

SEQ ID NO: 153516 - protein, 105 aa, Glycine max
  Coding DNA Sequence Number=SeqID_36738
  Gene Ontology: Mol. function=nucleic acid binding; Cellular component= mitochondrion; Biological process=DNA integration
MIDSKPISSPMAFSCKLSKQDFDSLQGGSFYSSIVGVLQYVIVTHLELCYSVKKVCHFMSSPLKSYWVVVKQILRYLRDHLHHGLVLHPALLYPAFSIYALCDAD

SEQ ID NO: 153517 - protein, 48 aa, Glycine max
  Coding DNA Sequence Number=SeqID_36739
MEKGTSLPMEKGFKILLFPIIDSLGNPLMFYMWYQNMCYEIYDSPRMI

SEQ ID NO: 153518 - protein, 58 aa, Glycine max
  Coding DNA Sequence Number=SeqID_36740
MKVDLCHTLISSGDHLFGGMQPSLDHFEQPGPLGPSRVFQQKAVPFGGSNPARLGELS

SEQ ID NO: 153519 - protein, 132 aa, Glycine max
  Coding DNA Sequence Number=SeqID_36741
  Pfam annotation: Domain name=GRP; Domain location=49-121; Score=2.4; E_value=3.8e-05; Accession=PF07172.2; Description=Glycine rich protein family
MNTKPFFSLCLLCALLLICVVATEPSKDATQGSVYCITSCIFLSQITPRTIVLPLILHAFFLATPIPHSITEEPKTRPDAWRSGGSGGHGGSGGHGGSGGHGGGWGHGGGWGHGGGHGGGCKCCGRKGCKCC

SEQ ID NO: 153520 - protein, 312 aa, Glycine max
  Coding DNA Sequence Number=SeqID_36742
  Gene Ontology: Mol. function=drug transporter activity; Cellular component=membrane; Biological process=multidrug transport
  Homolog annotation: Hit_ID=Q1T5H1; Match level="QueryCoverage=99%, HitCoverage=76%, E-value=2e-63, Identity=66%"; Hit description=Multi antimicrobial extrusion protein MatE
  Pfam annotation: Domain name=MatE; Domain location=7-224; Score=30.9; E_value=4.5e-06; Accession=PF01554.9; Description=MatE
ILGIAFPAALAVVADPIASLIDTTFIGHLGPVELAAAGVSIALFNQASRITIFPLVSITTSFVAEEDTIQRLINKETETDNIENETITKENVEAPKKFKGETDESNNVVAKSTFTSGDVEKLATGNMGINNENASTALLFGTILGLLQTAILTFAAKPLLYAMGLKHDSPMLIPAEKYLRLRSIGSPAVLLSLAMQGIFRGFKDTTTPLYVIASLAARLGSIPMAAFQPGLQIWLASSLLADGLAVAVQTMLACSFAEKDYNKATAAATRTLQMSFVLGVGLSFAVALGLYFGPGIFSKNANVVHLIKISMP

SEQ ID NO: 153521 - protein, 80 aa, Glycine max
  Coding DNA Sequence Number=SeqID_36743
MFTPTIMENEKLLDGGGGDEAQRVSFKEKVIGTVSMSTKPKNILKEGMMSMEYEGRNKSLTKFKMGHIAFEQLYPPGRSV

SEQ ID NO: 153522 - protein, 183 aa, Glycine max
  Coding DNA Sequence Number=SeqID_36744
MKILQLRHLEEIRGCNPSPKSSCASTPTSGSDGHVSSTDFSPKSLEKHCRPIENIMMETEAKGTMIERLNQVEDRMLKLEEELVAKKKEEGKKMNSPKKGFKQLVKQRVTNIQFPVKYRLKREHGQVFIISKSWKLRSQLLPSHRLYTCFLACKNVEKRIGSLEIENDESVEKEDDKDVTSYG

SEQ ID NO: 153523 - protein, 132 aa, Glycine max
  Coding DNA Sequence Number=SeqID_36745
  Homolog annotation: Hit_ID=Q9SW34; Match level="QueryCoverage=31%, HitCoverage=60%, E-value=8e-15, Identity=90%"; Hit description =Protein transport protein SEC61 gamma-1 subunit
  Pfam annotation: Domain name=SecE; Domain location=10-59; Score=46.8; E_value=7.3e-11; Accession=PF00584.11; Description=SecESec61-gamma subunits of protein translocation complex
MDAIDSVFDPLREFAKDSVRLVKRCHKPDRKEFSKVAVRTAIGFVVMGFVGFFVRSFSFQLTTSSSDLDEGNYNCLRIQVVKQKERKGRLKKLFDSKYEGNNLNGGKEKEEERRRGEGRANGLLNYQARVMV

SEQ ID NO: 153524 - protein, 1044 aa, Glycine max
  Coding DNA Sequence Number=SeqID_36746
  Gene Ontology: Mol. function=cellulose synthase (UDP-forming) activity; Cellular component=membrane; Biological process=cellulose biosynthetic process
  Homolog annotation: Hit_ID=Q2IB40; Match level="QueryCoverage=99%, HitCoverage=93%, E-value=0.0, Identity=82%"; Hit description =Cellulose synthase 4
  Pfam annotation: Domain name=Cellulose_synt; Domain location=221 -1039; Score=2157.0; E_value=0; Accession=PF03552.5; Description =Cellulose synthase
MIPGSPAILGDMEEDGAAAADASDFNYDSENQNQNQNQKQKISERMLSWQLTYPRGEEVGAPNYDKDVSHNHIPLLTSGQEVSGELSAASPERLSMASPAVGGGKRVHNIPYSSDINQSPNIRAGDPGLGNVAWKERVDGWKMKQEKNVVPMSTGQAASERGAGDIDASTDVLVDDSLLKIAALLVLEASLLVSPTVSTINCIFLMSLVNNMIWNDEARQPLSRKVSIPSSRINPYRMVIMLRLVILCIFLHYRITNPVPNAYPLWLVSVICEIWFAISWILDQFPKWLPVNRETYLDRLALRYDREGEPSQLAAVDIFVSTVDPLKEPPLVTANTVLSILAVDYPVDKVSCYVSDDGAAMLTFEALAETSEFARKWVPFSKKYSIEPRAPEWYFSQKIDYLKDKVHPSFVKDRRAMKREYEEFKVRINGLVSKAQKVPEEGWVMQDGTPWPGNNTRDHPGMIQVFLGQSGGLDTEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGTRKKSSKSSKKGSDKKKSSKHVDPTVPIFNLEDIEEGVEGTGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPVTAIPLLIYCILPAVCLLTNKFIIPQISNLASIWFISLFLSIFATGILEMRWSGVGIDEWWRNEQFWVIGGVSAHLFAVFQGLLKVLAGIDTNFTVTSKASDEDGDFAELYMFKWTTLLIPPTTLLIINLVGVVAGISYAINSGYQSWGPLFGKLFFAFWVIIHLYPFLKGLMGRQNRTPTIVVVWSVLLASIFSLLWVRIDPFTTRVTGPDVEECGINC

SEQ ID NO: 153525 - protein, 52 aa, Glycine max
  Coding DNA Sequence Number=SeqID_36747
MNFCLTLTITVPLEERSTPILMVDIKRRELELQKGAICESNQGFDAFLNLFF

SEQ ID NO: 153526 - protein, 75 aa, Glycine max
  Coding DNA Sequence Number=SeqID_36748
  Subcellular localization annotation: CTP_CleavageSite=43; ConfidenceScore=5.35e-01
MATPPVTTPPAATPPKGHGVPPPQFCPRFCHQENPNRPPSLPRQTPPQENPPPPHPSNPHSYNHSNGKKRGISGF

SEQ ID NO: 153527 - protein, 105 aa, Glycine max
  Coding DNA Sequence Number=SeqID_36749
MRRKTSYYIEVTRRVNESLLKDKGFAIGGDVLSGLINNDEWLNGLSFKTPQVAAEGAMNGGRALLSPGTMMETGIHAKKMEENRKVAIWVRIPDLSIELYNERFL

SEQ ID NO: 153528 - protein, 61 aa, Glycine max
  Coding DNA Sequence Number=SeqID_36750
  Homolog annotation: Hit_ID=Q2R0N2; Match level="QueryCoverage=64%, HitCoverage=17%, E-value=2e-12, Identity=82%"; Hit description =Expressed protein
MASFGSLKSTIFEKEERKQQYQSHIRGLNAYDRHKKFMDDYGLMDNKELIEFVAFDLVGSS

SEQ ID NO: 153529 - protein, 397 aa, Glycine max
  Coding DNA Sequence Number=SeqID_36751
  Gene Ontology: Mol. function=indole-3-glycerol-phosphate synthase activity; Cellular component=chloroplast; Biological process =tryptophan metabolic process
  Homolog annotation: Hit_ID=Q9LUB2; Match level="QueryCoverage=84%, HitCoverage=81%, E-value=1e-126, Identity=68%"; Hit description =Indole-3-glycerol phosphate synthase
  Pfam annotation: Domain name=IGPS; Domain location=122-397; Score =217.0; E_value=4.3e-62; Accession=PF00218.12; Description=Indole-3 -glycerol phosphate synthase
FPFRPPNSTLPDPEPLFFHPKPFFSTKEAPFHPFLLVPSWGLSDNGNGQVESNDGSATVATPGESVTEALKTKEWEVGMFQNEVAASQGIRIRRRPPSGPPLHYVGPFQFRLQNEGNTPRNILEEIVWNKDTEVSHLKERKPLGVLKKALENAPPARDFIGALKAANERTGLPGLIAEVKKASPSRGILREDFDPKLLMLEVVWSEDVVVVHRGGRILCHEDASVVEIAKAYEKGGAACLSVLTDEKYFKGSFENLEAIRMAGIKCPLLCKEFIIDAWQLYYARTKGADAVLLIAAVLPDLDIKYMIKICKLLGLTALVEVHDEREFDRVLAIEGIELIGINNRNLETFELDISITKKLLEGERGKIIRERGITMVGESGLFTPDDIAYVKEAGVKA

SEQ ID NO: 153530 - protein, 239 aa, Glycine max
  Coding DNA Sequence Number=SeqID_36752
  Homolog annotation: Hit_ID=Q43677; Match level="QueryCoverage=20%, HitCoverage=15%, E-value=1e-10, Identity=69%"; Hit description=Auxin- induced protein
MAPFPVQMSKSLSAELMPSSNNRLMEEIGNQVKKFRESKVAAAASTGKLELLRNLVADLPIGYSKNNFEYLPKKFDVVYDAVGHCSIKRKGSDHLHSIEIKVEAPSLALHHHYLDYQLHHFVPVPFPRVNSTKSDFGYCMGNGPIGFNVPTPFCKSCLGNPLCWHGARNPNHTELFRLGHLEVLETCEYKNDGLEPEALMLFMASISIAGEARAFFLFLCQFTFVLVKTGISSKSDSPA

SEQ ID NO: 153531 - protein, 112 aa, Glycine max
  Coding DNA Sequence Number=SeqID_36753
MIESFEQQQEMSVIELCVEVDVVGASAINFTNSLLSCENNMSHNESGSARVGTNSEEDFDDDDDYLIYNSYVEDSLDEDEDIDEISDTNEAARLIEPLTVVQSGEGRSQTPF

SEQ ID NO: 153532 - protein, 78 aa, Glycine max
  Coding DNA Sequence Number=SeqID_36754
MVEDARTMLGNQFVGAPDLVVEDTRTVAINSWGSGLDGGGCMNGNQFMGLRIRFDGGGCTNNARQSIRGAPDSMVEDV

SEQ ID NO: 153533 - protein, 167 aa, Glycine max
  Coding DNA Sequence Number=SeqID_36755
  Homolog annotation: Hit_ID=Q2PMM5; Match level="QueryCoverage=99%, HitCoverage=7%, E-value=2e-93, Identity=100%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTE

SEQ ID NO: 153534 - protein, 82 aa, Glycine max
  Coding DNA Sequence Number=SeqID_36756
MSKKKNLVWASSEMFGKLRFKKKEKEEEEAINMKPRYLAGIWVDHDGKVTVERRGKKGNGKERFLGKFPLFGSLERGGSGDF

SEQ ID NO: 153535 - protein, 210 aa, Glycine max
  Coding DNA Sequence Number=SeqID_36757
  Subcellular localization annotation: CTP_CleavageSite=17; ConfidenceScore=5.00e-01
MILTKKKVQKRKEKALRAKPRSVLMMVDKPTTTMRRSSGVIVLRVVGVREEKGNERGVFWEREERTRKVEVRWHWEVGAAAATECNKSIGLIRPIESQPDGWIGLSLTFVRVCSQSGVTQNNPIEFVIKLVTRQPEPEITISFLSRSRSTPPLRSPTSPSFLLLTISLSVSHSLTFYTVARQRPTYLSFLPLVMALCYCHLLCCHLQSRS

SEQ ID NO: 153536 - protein, 121 aa, Glycine max
  Coding DNA Sequence Number=SeqID_36758
VFDSPHVKILVGKNKTTRRRLDAKSVVELATVRPISQVYRRNGKKNTEGRVGEENGPRGNVGLIMAAEVEFENRKDRVVTECTDGKQGEGDQGCRCGNHGRNISWKLTECRGGIEGWWVFG

SEQ ID NO: 153537 - protein, 88 aa, Glycine max
  Coding DNA Sequence Number=SeqID_36759
MADVTIIIVVTRSRCTQKSRGCDQSWQQMHLQLARYMDDKLKIRMVNPKICLAETGEEMVDHVYLIPNPHPQSLDPVMMRNEPNKKLM

SEQ ID NO: 153538 - protein, 508 aa, Glycine max
  Coding DNA Sequence Number=SeqID_36760
  Gene Ontology: Mol. function=transporter activity; Cellular component= membrane; Biological process=oligopeptide transport
  Homolog annotation: Hit_ID=Q1RXN7; Match level="QueryCoverage=99%, HitCoverage=90%, E-value=0.0, Identity=72%"; Hit description=TGF -beta receptor, type I/II extracellular region
  Pfam annotation: Domain name=MFS_1; Domain location=5-441; Score= -17.9; E_value=0.0021; Accession=PF07690.6; Description=Major Facilitator Superfamily
  Pfam annotation: Domain name=PTR2; Domain location=39-425; Score =406.1; E_value=5e-119; Accession=PF00854.12; Description=POT family
  Pfam module annotation: Pfam domain module=MFS_1::PTR2; Domain location=5-441::39-425
MAFYGVASNLINYLTTQLHEDTVSSVRNVNNSDSYLGRFWTFALSSLIYVLGMILLTLAVSLKSLRPTCTNGICNKASTLQISFFYMALYTMAVGAGGTKPNISTFGADQFDDFNPNEKQIKASFFMRWMFTSFLGALVATLGLVYIQENFGWGLGYGIPTIGLLLSLVIFSIGTPIYRHKNRAAKSPARDLIRVPIVAFRNRKLELPINPSSDLYEHEHQHYIILVVEKGNTPALRFLDKAAIKERSNIGSSRTPLTVTQVEGFKLVFGMVLIWLVTLIPSTIWAQIYTLFLKQGITLDRKLGPNFQIPAASLGSFVTLSMLLSVPIYDRYLVPFMRRKTGNPRGITLLQSLGIGFSIQIMAIAIAYVVEVRRMHVIKAKHVVGPKDLVPMTDVFNAIGLLEFFYDQSPEDMRSLGTTFFTSGIGVGNFLNSFLVTMVDKITRSTECDEAKSWIGDNLNDCHLDYYYGFLLALSIINLGAFFWVSRRYIYKKEMGEDSLYVQGEAKV

SEQ ID NO: 153539 - protein, 43 aa, Glycine max
  Coding DNA Sequence Number=SeqID_36761
MKRNTEKVKPEEAYAGFVSEDGVALGEVTSLVNFSGCLRYIKA

SEQ ID NO: 153540 - protein, 240 aa, Glycine max
  Coding DNA Sequence Number=SeqID_36762
  Gene Ontology: Mol. function=peroxidase activity; Cellular component =vacuole; Biological process=response to oxidative stress
  Homolog annotation: Hit_ID=Q1RXM7; Match level="QueryCoverage=82%, HitCoverage=59%, E-value=2e-61, Identity=64%"; Hit description=Haem peroxidase, plant/fungal/bacterial
  Pfam annotation: Domain name=peroxidase; Domain location=40-230; Score=178.8; E_value=1.4e-50; Accession=PF00141.13; Description =Peroxidase
MASYYFLLLLVLVGATTAASEEELCTDFYSCTCPNLLPIVKKGVAKAIQKEPRMGASLLRLHFHHFFVNLVPSCFHKIVIFQGCDAPILLDDTSNFVGEQTAEANNQSARGFNVINDIKANVEKECPRVVSCADILALAARDSVLGGPTWEVGLGRRASTTACRSDANNNIPGPFLSLSALINNFANQDLSVTDLVALSENLQQLTYAPTTLLFNTSGFQIKVVVLYMWNDCDGMWSFLH

SEQ ID NO: 153541 - protein, 135 aa, Glycine max
  Coding DNA Sequence Number=SeqID_36763
  Subcellular localization annotation: CTP_CleavageSite=16; ConfidenceScore=5.11e-01
MEQPAKKSSSHCTAIQAGIGATSTTPTSVVTNTPTVFMITPTSHPDYILEDYIDSEGDVLQMKMRIHDIMQHLSKKLGDIVKPMILNEIQKVREEEYCHSQSKATTNLLPEFSLVSLGHWTYEDYIDSEGDVLVL

SEQ ID NO: 153542 - protein, 189 aa, Glycine max
  Coding DNA Sequence Number=SeqID_36764
MRIHDIMQHLSKKLGDIVKPMILHEIQKAREEECCHSQSKATTNLHPEFNLVSLGHWTYDRCLNTQNSSNAIWQIRSIVGLTWNGVFMTGRIRENLRGRRNPQTKYMVLEKDEEDFGDDLSTDQMATELIKEKPYSCPALQPFKGKEVEGKKPYLFNIFKVEQIFDYLVKDQQIRLHKGQKIPPSNQIF

SEQ ID NO: 153543 - protein, 85 aa, Glycine max
  Coding DNA Sequence Number=SeqID_36765
MATPVISLMNTSHLKIALFDITTGPPQAYFIWGNNCIFDDEKWDIQRVVQSICFYHDDLVSTNSDCALASQSPLFMARWQPPPVD

SEQ ID NO: 153544 - protein, 517 aa, Glycine max
  Coding DNA Sequence Number=SeqID_36766
  Gene Ontology: Mol. function=nucleic acid binding; Cellular component= cellular_component; Biological process=biological_process
  Homolog annotation: Hit_ID=Q7X7W8; Match level="QueryCoverage=85%, HitCoverage=96%, E-value=1e-150, Identity=57%"; Hit description =Makorin ring-zinc-finger protein
  Pfam annotation: Domain name=zf-C3HC4; Domain location=236-298; Score= 24.0; E_value=0.00052; Accession=PF00097.15; Description=Zinc finger, C3HC4 type (RING finger)
  Pfam annotation: Domain name=zf-CCCH; Domain location=55-74; Score =8.7; E_value=0.094; Accession=PF00642.15; Description=Zinc finger C -x8-C-x5-C-x3-H type (and similar)
  Pfam annotation: Domain name=zf-CCCH; Domain location=75-99; Score =26.2; E_value=0.00012; Accession=PF00642.15; Description=Zinc finger C-x8-C-x5-C-x3-H type (and similar)
  Pfam module annotation: Pfam domain module=zf-C3HC4::zf-CCCH::zf -CCCH; Domain location=236-298::55-74::75-99
MVTMPMLMVVLGVVVSDVGVSGDGDYCSSSVSGDVGNDNGGGGSAMVTVVTMLVMFYARGACLKGDQCDFAHEKKDDICSYYKKGSCAYGSRCRYKHVKASQASSSANGRHSPVLDPVVNHTIKGTSSWVPKAVKSSSSDKRARSSQQKNLPSLENDVGQSSTSSVIPSEHLFCAFAAANCPLEDKCSRIHGNQCLYCRKFCLHPTDRKEKENHLRTCEKKEKYLQALKDSQEVECNVCLERVLSKPKPADCKFGLLPECDHAFCLSCIRNWRNSAPTSGMDISNAGTANTVRTCPVCRKLSYFVIPSGIWYSTKEEKQEIIDNYKANCKLIDCKHFNFGNGNCPFGASCFYKLSPGAAVKLCLGDLLVMGSNPETASLHMQGPPPQRRQNHFDVHDMLNMLQDVDLTSAEYFSIMRDSDLYDDMDPFEMMVSDRLAGDSGPCLGPFDSDEEDLDIFQMAALSEVLASGVDDFGPEDFGDEDFNPMEAALLSMMMHSNMEDEDDDDDEEEEYSDEDY

SEQ ID NO: 153545 - protein, 342 aa, Glycine max
  Coding DNA Sequence Number=SeqID_36767
  Gene Ontology: Mol. function=nucleic acid binding; Cellular component= intracellular; Biological process=regulation of transcription
  Homolog annotation: Hit_ID=Q1SHX5; Match level="QueryCoverage=79%, HitCoverage=80%, E-value=1e-92, Identity=59%"; Hit description=Zinc finger, C2H2-type
  Pfam annotation: Domain name=zf-C2H2; Domain location=185-207; Score =20.1; E_value=0.0077; Accession=PF00096.16; Description=Zinc finger, C2H2 type
  Pfam annotation: Domain name=zf-C2H2; Domain location=269-291; Score =23.7; E_value=0.00066; Accession=PF00096.16; Description=Zinc finger, C2H2 type
  Pfam annotation: Domain name=zf-C2H2; Domain location=295-318; Score =9.2; E_value=1.1; Accession=PF00096.16; Description=Zinc finger, C2H2 type
  Pfam module annotation: Pfam domain module=zf-C2H2::zf-C2H2::zf-C2H2; Domain location=185-207::269-291::295-318
  Subcellular localization annotation: CTP_CleavageSite=57; ConfidenceScore=5.62e-01
MTDPKSNVYTETFNFMPLYSHHSSFTSQSSLLSSYPLSYSNTNTNTFSNQSDTSSSSCAAPPPSSPLREALPLINNIKQKKNEPSNGGEEVEEEGQKKRDIDETLLTSITEEGDDDETVTVALQIGLPSVATSDLNGSRKIFEACAKMDVKEDVRVISGHPLDRLNNIQYWIPTPSQILIGPTQFLCHVCSKSFNRYNNLQMHMWGHGSQYRKGPDSLKGTQPSAMLRLPCFCCAPGCKHNIDHPRTRPLKDFRTLQTHYKRKHGIKPYMCRKCDKTFAVKGDWRTHEKNCGITWYCLCGSDFKHKRSLKDHIKAFGHDHGVVDIDCMQEDEAASEIEHDGG

SEQ ID NO: 153546 - protein, 291 aa, Glycine max
  Coding DNA Sequence Number=SeqID_36768
  Gene Ontology: Cellular component=chloroplast
  Homolog annotation: Hit_ID=P82658; Match level="QueryCoverage=50%, HitCoverage=63%, E-value=3e-66, Identity=82%"; Hit description =Thylakoid lumenal 19 kDa protein, chloroplast precursor
  Pfam annotation: Domain name=PsbP; Domain location=54-237; Score= -41.1; E_value=0.0095; Accession=PF01789.7; Description=PsbP
  Subcellular localization annotation: CTP_CleavageSite=47; ConfidenceScore=5.79e-01
MATTTMFSSPSAILSSTTTPKPSSSAPPSPSCKPLLPFKQPLTTLTAAAAIATILTTAPAPSLAQESPYQVYYGTAASAANYGGYGGNSSKKDSAEYVYDVPAGWKERLVSKVEKGTNGTDSEFYNPKKKAEKEYLTFLAGFRQLAPKDVILNNLALSDVDLQDLIANADSVTSDEVKDDKGQLYYVYEIDGVGTHSLISVTCAKNKLYAHFVNAPTPEWNRDKDMLRHVHESFKTAEIRNIPLELGNDYLFYAEDGALGMASFDKFGIFTASIFGIAGFNLKLSISDVVN

SEQ ID NO: 153547 - protein, 944 aa, Glycine max
  Coding DNA Sequence Number=SeqID_36769
  Gene Ontology: Mol. function=binding; Cellular component =intracellular; Biological process=metabolic process
  Homolog annotation: Hit_ID=Q5ZDP1; Match level="QueryCoverage=89%, HitCoverage=95%, E-value=0.0, Identity=45%"; Hit description =Pentatricopeptide (PPR) repeat-containing protein-like
  Pfam annotation: Domain name=PPR; Domain location=120-154; Score =45.1; E_value=2.3e-10; Accession=PF01535.11; Description=PPR repeat
  Pfam annotation: Domain name=PPR; Domain location=221-255; Score =45.4; E_value=2e-10; Accession=PF01535.11; Description=PPR repeat
  Pfam annotation: Domain name=PPR; Domain location=256-290; Score=6.3; E_value=1.3; Accession=PF01535.11; Description=PPR repeat
  Pfam annotation: Domain name=PPR; Domain location=322-356; Score =33.3; E_value=8.4e-07; Accession=PF01535.11; Description=PPR repeat
  Pfam annotation: Domain name=PPR; Domain location=423-457; Score =35.2; E_value=2.2e-07; Accession=PF01535.11; Description=PPR repeat
  Pfam annotation: Domain name=PPR; Domain location=524-558; Score =44.9; E_value=2.7e-10; Accession=PF01535.11; Description=PPR repeat
  Pfam annotation: Domain name=PPR; Domain location=54-88; Score=7.0; E_ value=1.1; Accession=PF01535.11; Description=PPR repeat
  Pfam annotation: Domain name=PPR; Domain location=559-593; Score=6.1; E_value=1.4; Accession=PF01535.11; Description=PPR repeat
  Pfam annotation: Domain name=PPR; Domain location=625-659; Score =52.2; E_value=1.8e-12; Accession=PF01535.11; Description=PPR repeat
  Pfam annotation: Domain name=PPR; Domain location=660-694; Score=3.5; E_value=2.9; Accession=PF01535.11; Description=PPR repeat
  Pfam annotation: Domain name=PPR; Domain location=696-730; Score=3.0; E_value=3.3; Accession=PF01535.11; Description=PPR repeat
  Pfam annotation: Domain name=PPR; Domain location=762-796; Score=5.0; E_value=1.9; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=120-154::221 -255::256-290::322-356::423-457::524-558::54-88::559-593::625 -659::660-694::696-730::762-796
  Subcellular localization annotation: CTP_CleavageSite=38; ConfidenceScore=5.38e-01
MLSMNKTSPRFWYINFLPHSILQRLYFPFKRATLQTASLATVKDSQTTFTKPPISYSKLLSQCVASKSLTSGMELHAHLIKFGFSRDPSLRNHLVTLYSKCRRFGYARKLVDESSELDVVSWSSLLSGYVQNGFVEEALLVFNEMCLLGVKCNEFTFPSVLKACSMKRDLNMGRKVHGMAVVTGFESDGFVANTLVVMYAKCGLLDDSRRLFGGIVERNVVSWNALFSCYVQSELCGEAVGLFKEMVRSGIMPNEFSISIILNACAGLQEGDLGRKIHGLMLKMGLDLDQFSANALVDMYSKAGEIEGAVAVFQDIAHPDVVSWNAIIAGCVLHDCNDLALMLLDEMKGSGTRPNMFTLSSALKACAAMGFKELGRQLHSSLIKMDAHSDLFAAVGLVDMYSKCEMMDDARRAYDSMPKKDIIAWNALISGYSQCGDHLDAVSLFSKMFSEDIDFNQTTLSTVLKSVASLQAIKVCKQIHTISIKSGIYSDFYVINSLLDTYGKCNHIDEASKIFEERTWEDLVAYTSMITAYSQYGDGEEALKLYLQMQDADIKPDPFICSSLLNACANLSAYEQGKQLHVHAIKFGFMCDIFASNSLVNMYAKCGSIEDADRAFSEIPNRGIVSWSAMIGGYAQHGHGKEALRLFNQMLRDGVPPNHITLVSVLCACNHAGLVNEGKQYFEKMEVMFGIKPTQEHYACMIDLLGRSGKLNEAVELVNSIPFEADGFVWGALLGAARIHKNIELGQKAAKMLFDLEPEKSGTHVLLANIYASAGMWENVAKVRKFMKDSKVKKEPGMSWIEIKDKVYTFIVGDRSHSRSDEIYAKLDQLGDLLSKAGYSSIVEIDIHNVDKSEKEKLLYHHSEKLAVAFGLIATPPGGPIRVKKNLRICVDCHTFFKFMYYEQIMNLLNLNQRNLQAKRATVNHPYKGGWSEQDKAGPKYKNC

SEQ ID NO: 153548 - protein, 45 aa, Glycine max
  Coding DNA Sequence Number=SeqID_36770
MEKAKEEVGANYTIGDNTQLISLTSKPLKEEAMVNFKLYLRMKRR

SEQ ID NO: 153549 - protein, 271 aa, Glycine max
  Coding DNA Sequence Number=SeqID_36771
  Subcellular localization annotation: CTP_CleavageSite=57; ConfidenceScore=5.11e-01
MGKVGIGFVHFLGIVLPPGIISAPTNSSRSTFFVVKTNQIQKDIENFAHKGQESLAEASESVSSNNKTIFDVAGGGNLILKPPLEAIWIIKNMSFNPYNNSRDERILRRQVNQILAFTLPPFTCDKCGEAHAAGEFLVSDALAQALEDEQRYNILCTLPKMILNSLPWKLFCLKSYCHTSFNSQTEANAKKEEVNVMSTRNRSKDVEVLIEAQWSLVARGALGLEALNFTDERRSKIFRGNGEGVFSQYDWSQKSLLVPLNFQLYMTLHQQ

SEQ ID NO: 153550 - protein, 109 aa, Glycine max
  Coding DNA Sequence Number=SeqID_36772
  Homolog annotation: Hit_ID=Q10BI2; Match level="QueryCoverage=92%, HitCoverage=53%, E-value=3e-11, Identity=36%"; Hit description =Expressed protein
  Pfam annotation: Domain name=DUF567; Domain location=1-102; Score= -28.4; E_value=0.016; Accession=PF04525.3; Description=Protein of unknown function (DUF567)
MVHRGKSSEEKDLIFGVQRSHPVDMKPRLDVFMATNINEDISSFQLVGSHIDKSCKVYIGDTMIAEVIDVYPRSNFSNWKEGLKVKINAGVDYDFIVALLVILTVNDYI

SEQ ID NO: 153551 - protein, 94 aa, Glycine max
  Coding DNA Sequence Number=SeqID_36773
MGLLLLKVVSKHNKMPFTNKLILKVSYHIKISLRVFLCGGNDNNNDNNVNNDDRRNTSGDCNDNDDDNDGGEGSSGGGGDVDGGSSSGVGGESR

SEQ ID NO: 153552 - protein, 304 aa, Glycine max
  Coding DNA Sequence Number=SeqID_36774
  Gene Ontology: Mol. function=nucleic acid binding
  Homolog annotation: Hit_ID=Q9LTX1; Match level="QueryCoverage=88%, HitCoverage=40%, E-value=3e-27, Identity=38%"; Hit description =Similarity to poly(A)-binding protein
  Subcellular localization annotation: CTP_CleavageSite=72; ConfidenceScore=5.54e-01
RDVVSQVNIAAPRRLLQFAVRDAVATSRTATGMSVEPSLKRLRSVVSTSAGDSSFVERPQRMQLASRVSNPMATMIKAVAEAAEDVIKSKPSGSVFDRLGRGIDTSDDNRQLEDSYQHQEQHHLFHSQRTEYNGGYAANTTMAGHETGYPSDSNSDNEGFNDINVMDHRVSGASQIRPSVGNRGNDSLMVQYSVAKNVDDSLRQKRNREQEQLAASPNTSHKIVNISVNVNTWKPPQHQVSREVTELDGNITFYNERGDPRSSTRLVKENASTLKVSNGNGKIHFTSLKNSSFLTYLPEHFFYT

SEQ ID NO: 153553 - protein, 58 aa, Glycine max
  Coding DNA Sequence Number=SeqID_36775
MPGCCTAAAAGLPTEVLAGRSSDDTPRFVSHTCWPWQSQTYGTSGINCYMDQLEWFRD

SEQ ID NO: 153554 - protein, 209 aa, Glycine max
  Coding DNA Sequence Number=SeqID_36776
  Gene Ontology: Mol. function=nucleic acid binding
  Homolog annotation: Hit_ID=Q9LTX1; Match level="QueryCoverage=96%, HitCoverage=22%, E-value=8e-32, Identity=43%"; Hit description =Similarity to poly(A)-binding protein
  Pfam annotation: Domain name=RRM_1; Domain location=1-66; Score=45.9; E_value=1.4e-10; Accession=PF00076.12; Description=RNA recognition motif. (a.k.a. RRM, R
VHFAATKDGLSRHFNRFGDVLKVIIVTDAATGQPKGAAYVEFMRKEAADNALSLDNTSFMSRILKRCNANDNRHTMQSATPQESPQVLLLNANDNPSVVIPNKPRVIKKSATPQESAPAMAWPRIVKGSPFPSARFSRHPFPRGIPGVFRARPPIKLGARSMQWKRDAQGSGSDSSSSVNTGNVAAPVGRGFTYIRTESKPEGSLGTTT

SEQ ID NO: 153555 - protein, 558 aa, Glycine max
  Coding DNA Sequence Number=SeqID_36777
  Gene Ontology: Mol. function=nucleotidyltransferase activity
  Homolog annotation: Hit_ID=Q1S118; Match level="QueryCoverage=99%, HitCoverage=98%, E-value=0.0, Identity=64%"; Hit description =Uncharacterized Cys-rich domain
  Pfam annotation: Domain name=PLAC8; Domain location=324-456; Score =139.5; E_value=8.8e-39; Accession=PF04749.7; Description=PLAC8 family
MVSVDNGKDEIEESNGSKVNEFASIDISTSRRTMVGNENPQRKFQGTLSSIPNRINFFKFGSASAKFRRLATEKDQISQGVPSPGSIGLRERFSGMFAKKLDWVSLKKMCLEWFRDPMNIALFVWILCVAISGAILFLVMTGMLNAVLPRKSQRNAWFEVNNQILNALFTLMCLYQHPKRIYHLVLLCRWSPQDISRLRKVYCKNGTYKPHEWAHMMVMVILLNVNCFAQYALCGLNLGYKRSDRPAIGVGICISFAIGAPAVAGLYSILSPLGKDYHSEMDEEAQIQESVAQKQEPLRVKSFQKKYSFASKQQRRVIETRPQWSGGILDIWNDISQAYLSLFCTFCVFGWNMERLGFGNMYVHIATFMLFCMAPFWIFILAAVNIEDETVRQALVATGIILCLFGLLYGGFWRIQMRKRFNLPTYNFCFGKPSASDCTLWLCCCWCSLAQEVRTGNSYDIIEDKLCRKEVYSSDQQLMSPLPREDVASSKSGTSSPLGNNSSPSMIKPSSPLNSSGFVKGYYSPERSLSTVKEEVPERSKDGTMNPPTPPSIQRESP

SEQ ID NO: 153556 - protein, 53 aa, Glycine max
  Coding DNA Sequence Number=SeqID_36778
  Gene Ontology: Mol. function=intracellular transporter activity; Cellular component=endoplasmic reticulum; Biological process =intracellular protein transport
  Homolog annotation: Hit_ID=Q1RXL2; Match level="QueryCoverage=98%, HitCoverage=18%, E-value=2e-20, Identity=84%"; Hit description =Tetratricopeptide-like helical
DIAAAIDEEDVGKFTEVIKEFDSLTPLDSWKTTLLLRVKDKLKAKEIEEDDLT

SEQ ID NO: 153557 - protein, 94 aa, Glycine max
  Coding DNA Sequence Number=SeqID_36779
MFPFDSRHVAKLPGLLNDECQVPRCSQAEDRLMEKLKRQLEMEDRCKEERWGVKEVRDAIAPILIPTKEVKLAEQTFNTFIAWPRRLVKLVSLE

SEQ ID NO: 153558 - protein, 79 aa, Glycine max
  Coding DNA Sequence Number=SeqID_36780
MGRYHNTFARGPFFEFSSEMQSSSSLTLYCDAPLSQHALLRASEGEAHGCVLQRRKDARSRHQRLFVENVGKTEGNRSK

SEQ ID NO: 153559 - protein, 75 aa, Glycine max
  Coding DNA Sequence Number=SeqID_36781
  Gene Ontology: Mol. function=metal ion binding; Biological process =metal ion transport
  Homolog annotation: Hit_ID=Q1S121; Match level="QueryCoverage=86%, HitCoverage=92%, E-value=3e-13, Identity=59%"; Hit description=Heavy metal transport/detoxification protein
  Pfam annotation: Domain name=HMA; Domain location=5-65; Score=33.9; E_ value=5.6e-07; Accession=PF00403.16; Description=Heavy-metal -associated domain
MAVVEVKVGFHCDECIKKILKAIKKIEDIEKYNVNKQLNKVIVTGNVTTEEVIRVLQKIGKNATPWENPKPQPNC

SEQ ID NO: 153560 - protein, 69 aa, Glycine max
  Coding DNA Sequence Number=SeqID_36782
MTIKPPSCGRCDHHNPNIVIVTSIPSPQRLASGRGGGVGGGVTQRRWVGYLTGWSCGGQGCGDDDMREF

SEQ ID NO: 153561 - protein, 46 aa, Glycine max
  Coding DNA Sequence Number=SeqID_36783
GEMDDKSPLDKYELKLAVGESSKIDLYKYLGKASIYTHAHAYATCA

SEQ ID NO: 153562 - protein, 79 aa, Glycine max
  Coding DNA Sequence Number=SeqID_36784
  Gene Ontology: Mol. function=prephenate dehydrogenase (NADP+) activity; Biological process=tyrosine biosynthetic process
  Homolog annotation: Hit_ID=Q1S123; Match level="QueryCoverage=83%, HitCoverage=24%, E-value=8e-18, Identity=73%"; Hit description =Prephenate dehydrogenase
MDIKSTPIDTKAFIFHTLVQLKDTTIRDSFDLYSGLFLHNRFALQVLENLEHALHKVKETLVQRKSERSWVQKRLNADI

SEQ ID NO: 153563 - protein, 219 aa, Glycine max
  Coding DNA Sequence Number=SeqID_36785
  Pfam annotation: Domain name=B3; Domain location=5-92; Score=30.3; E _value=6.9e-06; Accession=PF02362.12; Description=B3 DNA binding domain
MAAKKYFVTLIPDAFVKCTRLQGWRIPADVILTNVGTRVWNVKTRLVRNKIYFEEGWKVFQEENFVGKEDYLVFKYDGANIFKVVILEQSSRCEKTEVEEEDEVIDITDDEEHEEAEDDDNDDDEYRDMEEESEEHSAEYTKSQTHPLRASNRENASSSSPIVEGPHLEDYEIHKCIFSREIHILKQSSSNADPTNWILKEMNYETIMACHNGHSSIPK

SEQ ID NO: 153564 - protein, 107 aa, Glycine max
  Coding DNA Sequence Number=SeqID_36786
  Homolog annotation: Hit_ID=Q01AZ1; Match level="QueryCoverage=82%, HitCoverage=28%, E-value=1e-13, Identity=39%"; Hit description=[S] KOG2983 Uncharacterized conserved protein
MEFGCYAFFNNHVRAKFESENYAFDVCITKDERVKIVDSNPWGAFTLSLLFTWDELDHIHSEGNDVEFRIVEDRCAVRPGLKTAVPFDYLDTSPGSGSISKKMQMKS

SEQ ID NO: 153565 - protein, 544 aa, Glycine max
  Coding DNA Sequence Number=SeqID_36787
  Gene Ontology: Mol. function=phosphoinositide binding; Cellular component=multivesicular body; Biological process=cell communication
  Homolog annotation: Hit_ID=Q00V04; Match level="QueryCoverage=88%, HitCoverage=74%, E-value=2e-48, Identity=29%"; Hit description=[U] KOG2273 Membrane coat complex Retromer
  Pfam annotation: Domain name=PX; Domain location=89-217; Score=76.9; E_value=6.2e-20; Accession=PF00787.14; Description=PX domain
  Pfam annotation: Domain name=Vps5; Domain location=263-535; Score= -2.2; E_value=1.2e-07; Accession=PF09325.1; Description=Vps5 C terminal like
  Pfam module annotation: Pfam domain module=PX::Vps5; Domain location =89-217::263-535
MMNHDSDDQQHHILHASQDDEIMDSLILHHDDDGSSVHHHHRPTSPQSPNSPFNSFLDPPSYADAIFTSFDSNGHDQAVESPAARFGSGDYLHISVTDPQKEQDLATSTSLVPGAATFYTYLITTLINLPEYGGVGSEFAVRRRFRDVVALSERLALAYRGFFIPVRPDKSTVESQVMQKQEFVEQRRVALEKYLRKLAAHPVIGRSEELRLFLEAKERLPLAKTTDVASRMLDGAVRLPRQLFSGEAELGEVAQPAKGGRDLLRIFKELKQSVANDWVGSKPLVVEEDKEFMERKDKLVDFEHHLSNVSQQAESLVKFQQDMGETMGELGLAFVKLTKFETEEAIFESQRVRAADMRNVATASVKASRLYRELNTQTIKHLASTHILMTYDRTFKLVYKSMDKLHEYLGTMLAVNNAFSDRSSALLTVQTLSSELASLHSRVEKLEVASSKIFGGDKSRMRKIEELREAIRVTQDAKICADREYERIKENNRSELERIDQERNSDFLSMLRGFVANQAGYAEKTATVWEKLAEETAAYLRDSS

SEQ ID NO: 153566 - protein, 76 aa, Glycine max
  Coding DNA Sequence Number=SeqID_36788
  Homolog annotation: Hit_ID=Q2R301; Match level="QueryCoverage=93%, HitCoverage=16%, E-value=1e-10, Identity=44%"; Hit description =Expressed protein
RIPKVKYAVKNIILRTLKLLFWGILLQGGYSHAPDDLSYGVDMRFIRWCGILQRIALVYCAVALIETYTTKLRPLP

SEQ ID NO: 153567 - protein, 833 aa, Glycine max
  Coding DNA Sequence Number=SeqID_36789
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=97%, HitCoverage=95%, E-value=0.0, Identity=66%"; Hit description =Receptor-like kinase RHG1
  Pfam annotation: Domain name=Kdo; Domain location=538-726; Score= -83.1; E_value=0.044; Accession=PF06293.4; Description=Lipopolysacchar ide kinase (Kdo)
  Pfam annotation: Domain name=LRRNT_2; Domain location=47-89; Score =25.4; E_value=0.00021; Accession=PF08263.3; Description=Leucine rich repeat N-terminal domain
  Pfam annotation: Domain name=LRR_1; Domain location=116-138; Score =13.2; E_value=0.93; Accession=PF00560.23; Description=Leucine Rich Repeat
  Pfam annotation: Domain name=LRR_1; Domain location=140-162; Score =10.7; E_value=2.8; Accession=PF00560.23; Description=Leucine Rich Repeat
  Pfam annotation: Domain name=LRR_1; Domain location=165-187; Score =14.8; E_value=0.32; Accession=PF00560.23; Description=Leucine Rich Repeat
  Pfam annotation: Domain name=LRR_1; Domain location=189-211; Score =15.3; E_value=0.22; Accession=PF00560.23; Description=Leucine Rich Repeat
  Pfam annotation: Domain name=LRR_1; Domain location=213-235; Score =15.9; E_value=0.15; Accession=PF00560.23; Description=Leucine Rich Repeat
  Pfam annotation: Domain name=LRR_1; Domain location=242-264; Score =16.2; E_value=0.12; Accession=PF00560.23; Description=Leucine Rich Repeat
  Pfam annotation: Domain name=LRR_1; Domain location=266-288; Score =16.1; E_value=0.12; Accession=PF00560.23; Description=Leucine Rich Repeat
  Pfam annotation: Domain name=LRR_1; Domain location=290-312; Score =11.5; E_value=2; Accession=PF00560.23; Description=Leucine Rich Repeat
  Pfam annotation: Domain name=LRR_1; Domain location=314-336; Score =12.3; E_value=1.4; Accession=PF00560.23; Description=Leucine Rich Repeat
  Pfam annotation: Domain name=LRR_1; Domain location=338-360; Score =11.7; E_value=1.9; Accession=PF00560.23; Description=Leucine Rich Repeat
  Pfam annotation: Domain name=LRR_1; Domain location=362-384; Score =18.4; E_value=0.026; Accession=PF00560.23; Description=Leucine Rich Repeat
  Pfam annotation: Domain name=LRR_1; Domain location=386-409; Score =8.5; E_value=7.4; Accession=PF00560.23; Description=Leucine Rich Repeat
  Pfam annotation: Domain name=Pkinase; Domain location=542-810; Score =114.0; E_value=4.4e-31; Accession=PF00069.15; Description=Protein kinase domain
  Pfam annotation: Domain name=Pkinase_Tyr; Domain location=541-810; Score=98.6; E_value=1.9e-26; Accession=PF07714.7; Description =Protein tyrosine kinase
  Pfam module annotation: Pfam domain module=Kdo::LRRNT_2::LRR_1::LRR _1::LRR_1::LRR_1::LRR_1::LRR_1::LRR_1::LRR_1::LRR_1::LRR_1::LRR _1::LRR_1::Pkinase::Pkinase_Tyr; Domain location=538-726::47-89::116 -138::140-162::...
  Pfam module annotation: Domain location=165-187::189-211::213 -235::242-264::266-288::290-312::314-336::338-360::362-384::386 -409::542-810::541-810
MEDKNLTSKWFFNPNPSSHFFQLFFCLWILMVPVVASEERWDGVVVAQSNFLALEALKQELVDPEGFLRSWNDTGYGACSGAWVGIKCARGQVIVIQLPWKGLKGHITERIGQLRGLRKLSLHDNQIGGSIPSALGLLLNLRGVQLFNNRFTGSIPPSLGSSFPLLQSLDLSNNLLTGTIPMSLGNATKLYWLNLSFNSLSGPIPTSLTRLTSLTYLSLQHNNLSGSIPNTWGGSLKNHFFRLRNLILDHNLLSGSIPASLGSLSELTEISLSHNQFSGAIPDEIGSLSRLKTVDFSNNDLNGSLPATLSNVSSLTLLNVENNHLGNPIPEALGRLHNLSVLILSRNQFIGHIPQSVGNISKLTQLDLSLNNLSGEIPVSFDNLRSLSFFNVSHNNLSGPVPTLLAQKFNPSSFVGNIQLCGYSPSTPCPSQAPSGSPHEISEHRHHKKLGTKDIILIVAGVLLVVLVTICCILLFCLIRKRATSNAEAGQATGRASASAAAARTEKGVPPVAGEAEAGGEAGGKLVHFDGPLAFTADDLLCATAEIMGKSTYGTVYKATLEDGSQAAVKRLREKITKGQREFESEVSVIGRIRHPNLLALRAYYLGPKGEKLLVFDYMPNGSLASFLHARGPETAIDWATRMKIAQGMARGLLYLHSNENIIHGNLTSSNVLLDENTNAKIADFGLSRLMTTAANSNVIATAGALGYRAPELSKLNKANTKTDVYSLGVILLELLTGKPPGEAMNGVDLPQWVASIVKEEWTNEVFDVELMRDASTYGDEMLNTLKLALHCVDPSPSARLEVQQVLQQLEEIRPEISAASSGDDGAIPSTSE

SEQ ID NO: 153568 - protein, 78 aa, Glycine max
  Coding DNA Sequence Number=SeqID_36790
MQVSEEVKQYFLQGHSERLKQWLLMGFLLLTLGLMLHFTEAIPINKQLYSFSYVCFTAGAAGIVFSVFYLLLNGILIK

SEQ ID NO: 153569 - protein, 48 aa, Glycine max
  Coding DNA Sequence Number=SeqID_36791
MDEAKRMEEGLKTTYNDYHKGELKHEIERTNGNGDSIEHDKDARITQE

SEQ ID NO: 153570 - protein, 237 aa, Glycine max
  Coding DNA Sequence Number=SeqID_36792
  Homolog annotation: Hit_ID=Q6CQE5; Match level="QueryCoverage=24%, HitCoverage=71%, E-value=4e-10, Identity=48%"; Hit description =Protein TAR1
  Subcellular localization annotation: CTP_CleavageSite=88; ConfidenceScore=5.55e-01
MSRVDRRTGSHRSTSDRDTSPAPIRFPPDNFKHSLTLFSKSFSSFPRGTCSLSVSRQYLALDGIYRPIGAAFPNNPTRRQRLVGTWARSATEDASPDYNSDAEGDRFSWWAFPGSLAVTKGILRACTQKGRRWGPELTGSHVIGSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 153571 - protein, 267 aa, Glycine max
  Coding DNA Sequence Number=SeqID_36793
  Gene Ontology: Mol. function=oxidoreductase activity, acting on CH-OH group of donors; Cellular component=membrane; Biological process =aromatic compound metabolic process
  Homolog annotation: Hit_ID=Q1LKE6; Match level="QueryCoverage=100%, HitCoverage=45%, E-value=1e-125, Identity=79%"; Hit description =Glucose-methanol-choline oxidoreductase
QRLAEAVLVGRVQRQVGVAVRHHRAGNADGHEALVGVLHAGLPGRAPGGRARRGGRHLDGTAAVAHVADAGPAKKAERAVVELVAVQIVHADAAGAGAHERVELGALGQQHVDRAVHLVGVVLADHAFVGLGIVGLADAGQQQQAHVVHLVGRQDHQVGGLFDLAALGVDVGHADRLLAGRIEVDLDDVRMGAQFEIGLFQQHRQDGRLRRGLRIHVAAVVLVEPAEITGAQAHAVRVGVGPRRVGRGRRIRMEAHFARGLVEQLAA

SEQ ID NO: 153572 - protein, 34 aa, Glycine max
  Coding DNA Sequence Number=SeqID_36794
MEEQPDEKLEECQGAIRDVAITARIHVSPLRGLT

SEQ ID NO: 153573 - protein, 141 aa, Glycine max
  Coding DNA Sequence Number=SeqID_36795
  Gene Ontology: Mol. function=transporter activity; Cellular component= outer membrane-bounded periplasmic space; Biological process=transport
  Homolog annotation: Hit_ID=Q26TK5; Match level="QueryCoverage=99%, HitCoverage=52%, E-value=1e-44, Identity=64%"; Hit description =Extracellular solute-binding protein, family 3 precursor
  Pfam annotation: Domain name=SBP_bac_3; Domain location=1-133; Score=- 68.9; E_value=0.0016; Accession=PF00497.10; Description=Bacterial extracellular solute-binding proteins, family 3
MDIISGKDQKFENLDSLKGKRVSVNRGSSQETALRKANVEGLEIVVYEDDSTSAQALLAGHVDAVALPSTVGEAIIKQRPEAGLQVGFTFFQQGNSMATKLEDFELRQWLNTSIYLMKMSGDLDRISVKWTGRPLPQLPSF

SEQ ID NO: 153574 - protein, 91 aa, Glycine max
  Coding DNA Sequence Number=SeqID_36796
MITSFSSEGNDEEDHHEHWNGSMSRSQSKHPNQQASPLPTKLPAGAHIPSCAWPEEGGSEYPRHMPGADHKQPNHKVDQFSRFPNLPLNPR

SEQ ID NO: 153575 - protein, 119 aa, Glycine max
  Coding DNA Sequence Number=SeqID_36797
NNNAMGQTPTSLHERAESILGFTKGLHFETPIMPIGSVKHSMAVSKLRMMQRVPLSVGFQRRTMEVCGGYWWLWVMEKELGMKRYSHARRRIEDRNGQIVDKCPVKRQTKFQEDPMVNE

SEQ ID NO: 153576 - protein, 221 aa, Glycine max
  Coding DNA Sequence Number=SeqID_36798
SLRAIRVFVLQTAQRNVYTDNHSGISARQRDSNVSMTDLVSAEDDIAKKNVYTDNHSGISARQRDSNVSMTDLVSAEDDANLLVSTGLSAAIDEGLFVLQTAKKNVYTDNHSGISARQRDSNVSMIDLVSAEDDTAKKNVYTDNYSGISARQRDSNVSMTDLVSAEDDTNLLVSTGLSAAIDEGRRRRPKKNVYTDNHSGISARQHDSNVSMTNLVSAEDD

SEQ ID NO: 153577 - protein, 125 aa, Glycine max
  Coding DNA Sequence Number=SeqID_36799
  Subcellular localization annotation: CTP_CleavageSite=55; ConfidenceScore=5.03e-01
MPISPCESIGWSVPSQHRGRTHKTPSGTGEIQQGPGVSSSGYGPLSVLQGARTPRQGVVPTGHLVNPKKSNKVLGFPALITSLCQFYGVPVTPSKVIKPPINRAFIKKYCAPQIGAGRDTTTAWG

SEQ ID NO: 153578 - protein, 88 aa, Glycine max
  Coding DNA Sequence Number=SeqID_36800
  Homolog annotation: Hit_ID=Q5N7W6; Match level="QueryCoverage=55%, HitCoverage=8%, E-value=4e-08, Identity=40%"; Hit description =Putative nitrate transporter NRT1-5
MASQMFKSIASMKICIRDNDLNTEDCVKNPWRICNIQQMEEVKCLIKVLPIRALGILCLIPITQHGVPNHHRLVPQSPLVMCVQFSQW

SEQ ID NO: 153579 - protein, 88 aa, Glycine max
  Coding DNA Sequence Number=SeqID_36801
MGVKYLEVVKRGSHPNKQMAQRTSGAKPESTYPSKGIDFKQMIDTDSRAHHSAYFRKRALEAARGEAFAEIPRFCKLIIVRVSSVMAG

SEQ ID NO: 153580 - protein, 126 aa, Glycine max
  Coding DNA Sequence Number=SeqID_36802
MSGKGLQHVRKSLCQYQRLRACLEIKCDTNWERGFLVYVKGQVNKSIITYSSITKEQLKNPKYYNILHHYQNRTQKLRHPYLQEHSKGGNATKKGTTSATWRYRWWEQQVHFGFKYFTTRNKTSGW

SEQ ID NO: 153581 - protein, 87 aa, Glycine max
  Coding DNA Sequence Number=SeqID_36803
MRRYLMVICIFCQLEASELVDTQRLTSSSAPLSSRDARGKRARQHTETNILFCTIVIQRRFYLRYPETFKSDNAQDSSLLGRDDRVR

SEQ ID NO: 153582 - protein, 109 aa, Glycine max
  Coding DNA Sequence Number=SeqID_36804
MECVLADVLRDQRNLGNKGDGGWKRSALNAAAAVLSTSFNIEPPVMEDADEAMSRQTNEVEFMGLGATAIDLEESSSNTKGKRQGSTSSGAHPHKRKMGEKKGIGSFFG

SEQ ID NO: 153583 - protein, 92 aa, Glycine max
  Coding DNA Sequence Number=SeqID_36805
  Gene Ontology: Mol. function=protein binding; Cellular component =ribonucleoprotein complex; Biological process=rRNA processing
  Homolog annotation: Hit_ID=Q9S826; Match level="QueryCoverage=64%, HitCoverage=20%, E-value=1e-16, Identity=66%"; Hit description =Putative U3 small nucleolar ribonucleoprotein protein; 73469-75667
MGNRNSIIPRTHIDDEYAYAAEKDPKILLTTSRDPSAPLQQFVKELSFVFPNVQRVNPDGQIYDHDDSSSALRFFFHANHVIVNIACLDYPN

SEQ ID NO: 153584 - protein, 101 aa, Glycine max
  Coding DNA Sequence Number=SeqID_36806
SKKYVYTDNHSGISARQRDSNVSITDLVSAEYDDAEDDVSLCVLSGFSSYRQQKNVYTDNHSGISARQRDSNDAEDDVSLCVLSGFSSYRQQKKVYTDNHS

SEQ ID NO: 153585 - protein, 220 aa, Glycine max
  Coding DNA Sequence Number=SeqID_36807
LNTFLETPVVLAEGETLAAHSRYCRLPTDYREIEAALCIPSQGFILNLEGHPGKILRKDLTTLAQVWSVLSYSNLAPTSHTSDLTVDRARLIFGLVSCLDMNIRALISGQMTSIAQSNTSRLGFPALITALCRARGIVSDSLTFERSSPVINLAYIKKNCWNPEDLTISIRGARRARARPAELPSTSVAPTPASTSAAPSIPSQTDSQCFEAMLQSIHQG

SEQ ID NO: 153586 - protein, 46 aa, Glycine max
  Coding DNA Sequence Number=SeqID_36808
MLASVLDAPKRLSKAGSKRRVIAGEVGPTPYGHLQRGVALAYSGIL

SEQ ID NO: 153587 - protein, 226 aa, Glycine max
  Coding DNA Sequence Number=SeqID_36809
  Gene Ontology: Mol. function=phosphoglycolate phosphatase activity; Cellular component=cellular_component; Biological process=metabolic process
  Homolog annotation: Hit_ID=P0A8Y1; Match level="QueryCoverage=96%, HitCoverage=97%, E-value=2e-78, Identity=64%"; Hit description=5' -nucleotidase yjjG
  Pfam annotation: Domain name=Hydrolase; Domain location=5-200; Score =117.8; E_value=3e-32; Accession=PF00702.16; Description=haloacid dehalogenase-like hydrolase
MLNDWDCILFDADDTLFHFDAFAGLQRMFASYDVHFSDQDYADYQAVNKPLWVDYQNGTISALQLQTRRFTLWGEKLRVAPEVLNSDFLNAMAEICLPLDGAARLLDTLKGKVKIAIITNGFTALQQARLERTGFRDYFDALVISEQVGVPKPDAAIFDHTLQLLGNPDRRRVLMVGDTPESDILGGMNAGVKTCWIDHGTRPLPAHITPTWQVKTLPELQSILTA

SEQ ID NO: 153588 - protein, 33 aa, Glycine max
  Coding DNA Sequence Number=SeqID_36810
MEIPSNIKQPWNSEYSGTCSEQPQLILRIPLET

SEQ ID NO: 153589 - protein, 91 aa, Glycine max
  Coding DNA Sequence Number=SeqID_36811
MPFHAFENIRRKKKRGKTKCKRQLRMLTWRWAVEEGECNIWARPTRIWACTCLPAVVMNYIDDKAPVKGLRCEPLLRQMPRQRHQESKTRT

SEQ ID NO: 153590 - protein, 72 aa, Glycine max
  Coding DNA Sequence Number=SeqID_36812
  Subcellular localization annotation: CTP_CleavageSite=42; ConfidenceScore=5.07e-01
MGPKSTLRLTRTLRPSLASLAQSSWSLLSNALAGTQALQGLRTSLDVSGYAIREIWWEMRYPTFISIFMTMP

SEQ ID NO: 153591 - protein, 290 aa, Glycine max
  Coding DNA Sequence Number=SeqID_36813
  Homolog annotation: Hit_ID=UPI0000D56D24; Match level="QueryCoverage =65%, HitCoverage=56%, E-value=9e-08, Identity=25%"; Hit description =PREDICTED: hypothetical protein isoform 4
MESKCADNQTVSLHATGVSQVEGISTCHLTHGSGSTDVVFVRITTWGISACHMTHGSGLIDVVFVRITTSGISAYDLTHGCCLVWITTWGISAWHLTHGSGSTNVVFVWITTWGISACHLTHGSGSTNVVFVWITTWGIFACHLTHGSGSTDVIFVWITTCGISAYHLTHGSGSTDVVFVRITTWGIFVGSTDVVFVRITTWGISTCHLMHGSRSIDVVFVRITTWVSSHTTGLTGHDSKRPHGSFFQGQGWKFSSFVKVYGGLRSWHKRLAEWPDTMYVRVLVWPAVQG

SEQ ID NO: 153592 - protein, 88 aa, Glycine max
  Coding DNA Sequence Number=SeqID_36814
MGKRGMSRCPLGHAPEALRGCPYRLGRPPFEDGRIGFASTAALAVAAVAALLSINLFIASMAPSWRPFDLSESRCQLSSILALPLCHP

SEQ ID NO: 153593 - protein, 91 aa, Glycine max
  Coding DNA Sequence Number=SeqID_36815
MGRKTGKHLRQAKAAAALNERSRETKMMAPKKLSIKRSRKDTPGEGSDVAQDFDNHRFQSAKHQQHFEAIIGWSFLRERRVQLREDEYPDF

SEQ ID NO: 153594 - protein, 220 aa, Glycine max
  Coding DNA Sequence Number=SeqID_36816
  Subcellular localization annotation: CTP_CleavageSite=61; ConfidenceScore=5.54e-01
MAPLPPKKPNRSAMSSSSWASFVALGAPVGPAPGRAYERGGTLTLLAKTESVEAFMQLHLSAMVGRPLANHMLTILLDKGPVDRRSDDLAGHDGQSGPVGLLRVQWVSRGSHTGKNINGVSHQLSHMNTHPRKDGIHQLTLQQEKVRVMVAREDVVEQQRHPYLGQGGQAGAHDPNPSPYSSTGEILPQCTQPLGDGLLVETISLVPLLVILALLTLFQD

SEQ ID NO: 153595 - protein, 217 aa, Glycine max
  Coding DNA Sequence Number=SeqID_36817
  Homolog annotation: Hit_ID=Q1T493; Match level="QueryCoverage=97%, HitCoverage=45%, E-value=8e-27, Identity=30%"; Hit description =Nucleic acid-binding, OB-fold, subgroup
MARIPDKIRSIDGSKEMLKLAVRITDLWFVGTPNKSEQAEMVFVDSEGDQIHDICKSDHLKSWKADLKENCTYVMHNFKVVKNDGQFRVCEHEYKLFFIGVTVVREADLHELSFKEFRFVEFCKCCCWQFCVWPVGCGEILSCTLWENYCTQFLSYLNERGDDGPMVIILTHARIKDAQGSYPASVSNSFKASKLLINDPILEIQEFKERLLDLGVE

SEQ ID NO: 153596 - protein, 73 aa, Glycine max
  Coding DNA Sequence Number=SeqID_36818
MSMKNHVGRLGVHDKTNHTLASLKEHSNRMTPKAYTPKSLSGPLPPDSALVIKLVGFPQWIASQYSSRKTRRP

SEQ ID NO: 153597 - protein, 107 aa, Glycine max
  Coding DNA Sequence Number=SeqID_36819
MQHVTSQQAANHRSQVQLNESFYRYTQQQQSQDPSPFPWPTPEEFRATIAWPEDEPDFETGARPVGAPGDDDGAQEDDYMADTLFDATQRKSLQESREQAANGWKNF

SEQ ID NO: 153598 - protein, 73 aa, Glycine max
  Coding DNA Sequence Number=SeqID_36820
  Subcellular localization annotation: CTP_CleavageSite=25; ConfidenceScore=5.05e-01
MVSPVKAAVVHLQLAVVGPLPAAIVCSLSTSAPNCTSSIKRTLESDQFPLLNDPNKACIYMIKVPTGKIQQRI

SEQ ID NO: 153599 - protein, 69 aa, Glycine max
  Coding DNA Sequence Number=SeqID_36821
MTGTSEARKPVAYHIMLATSHQQRAKIKRNGDHRSPRRLKKKGSYSEKTYQKGPKRSGYQLGLAYFGRI

SEQ ID NO: 153600 - protein, 202 aa, Glycine max
  Coding DNA Sequence Number=SeqID_36822
MASRKRKSIGSRPTMQYDIRRFSSLDAWTRYIDNVLGRNILLERKVEIYHSKLDEFKAELERRNFHKRFTNLVDGSIDLALVKEFYANLYSSRDHPPKQPRVRGHLVKIDADSLNTFLETPVVLAEGETLPAYSRYCRLPTDYREIKAALCIPGRGFILNSEGHPGKILRKDLTTLAQVWSVLSYSNLAPTSHTSDLTLDRA

SEQ ID NO: 153601 - protein, 380 aa, Glycine max
  Coding DNA Sequence Number=SeqID_36823
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=8e-40, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HALALRGMHTLTFRGLHALAFRGLHVLAFRGLHFLTFKGLHTLAFTGLHVLIFRGLHVLAFRGLHVLAFRVLHALTFKGLHELSEGCTPSPSEDYTSLPSEGYRTTRAVRGLHTLAFRGLHTLAFRGLHVLTFRGLHTLAFRGLHILAFKGLHILAFRGLHALPFRGLQVLAFRGLHALAFKGLHALAFRGLHVLAFRWIHALAFRGLHVLAFRGLHTLAFRVLRALTFRGLHVLTFWVLVPSLSEDYTTLAFRGLHVLALRGLHALTFKGLQTLSFKRLHVLTFRGLHALVFRGLHVLTFRELHALAFRGLHSSPSEGYTPSEGCTTQSPLPLMLNRDLHSRVSGFDEETIAQLLCIPRQDFTQRLQGDECGSCAPTYG

SEQ ID NO: 153602 - protein, 215 aa, Glycine max
  Coding DNA Sequence Number=SeqID_36824
AVINTFLVFHDRKESPVVAILADLYDTFGRRCEKNIARIICCTPALYVCLVSHLFRQETTWLPYERGTNTGVLQRARKAWERVQKKDEELRGSSNGPIGSYHRWLKAYAQGLDWLPNLRTTKEVEGEASEEDEKVQALKTELERAQTTKEKSKSIAVSIRKENAELRDINIATIKALEQETKRARKEEHGRNKFRGALWGSNSKLKLQREERDQS

SEQ ID NO: 153603 - protein, 150 aa, Glycine max
  Coding DNA Sequence Number=SeqID_36825
  Pfam annotation: Domain name=Transposase_23; Domain location=37-107; Score=-7.1; E_value=0.0068; Accession=PF03017.5; Description =TNP1ENSPM transposase
LQSQGLTLSPKPEVGPSSARVSTKESCVDLSGNDLDRVDFEKCGLYIEENPSRLVALRRLYERSTTVHNIPLRNDQVKVGVEEVRDADVPIPVPTQKVQLVGQTLNTFVGWLTHLVKGLLEQRAVGLAKHVDRSDHDVDDPLYLMTLTIS

SEQ ID NO: 153604 - protein, 213 aa, Glycine max
  Coding DNA Sequence Number=SeqID_36826
  Gene Ontology: Mol. function=nucleic acid binding; Cellular component= ribonucleoprotein complex; Biological process=RNA splicing
  Homolog annotation: Hit_ID=Q69IN4; Match level="QueryCoverage=95%, HitCoverage=45%, E-value=4e-63, Identity=60%"; Hit description =Ribonucleoprotein antigen-like
  Pfam annotation: Domain name=RRM_1; Domain location=103-171; Score =15.1; E_value=0.0057; Accession=PF00076.12; Description=RNA recognition motif. (a.k.a. RRM, R
MSVRSKNLNSVFYADSYHPIQAGSIDGTDVVPHDNAVYRAQLCSSIGLYDPFGDPRAAGDPYCTLFVARLSRLTNEDNLRKLTSFFQEGWELVLTSTISSNWWRMLTILLTHVMSKYGRVKNFRLVRDIVTGASRGYAFVEYETEREMRRAYMVLEHDAHHLIVDDSEIIVDYNRQQLMPGWIPRRLGGGLSGKKESGQLRFGGKEKPFRAPL

SEQ ID NO: 153605 - protein, 73 aa, Glycine max
  Coding DNA Sequence Number=SeqID_36827
MWMCKLSNLVDLTLDNGSFQKLIRREVCSYGGPFYLHLLSSSLCFCMKRVMPLLAGSLVASELEVLACILCSK

SEQ ID NO: 153606 - protein, 88 aa, Glycine max
  Coding DNA Sequence Number=SeqID_36828
MSPIEVSTVATYPSTRGQVRLKGASSKKGKDEGVATNVYSRKTLEKPRKGSTNFKNKGSGVVYVRGRSTRVLPLLLHILRCNEEIIPT

SEQ ID NO: 153607 - protein, 144 aa, Glycine max
  Coding DNA Sequence Number=SeqID_36829
  Gene Ontology: Mol. function=UDP-glucuronate decarboxylase activity; Biological process=cellular metabolic process
  Homolog annotation: Hit_ID=Q6IVK2; Match level="QueryCoverage=53%, HitCoverage=27%, E-value=1e-20, Identity=50%"; Hit description =Putative UDP-glucuronate decarboxylase 4
MHQALFSSREEIVNHDDVITASDEFVNEVALDEARAVGDDDSLPPAANPDRNAARSGLDDEEGGVDEDEQEALLAEETHVWGRCGKWSPEGPSELPLGLLKHTTRFVNSIIGIRWPMLGDGSIATTAGAGATRASSFETSMANV

SEQ ID NO: 153608 - protein, 167 aa, Glycine max
  Coding DNA Sequence Number=SeqID_36830
  Gene Ontology: Mol. function=catalytic activity; Biological process =cellular metabolic process
  Homolog annotation: Hit_ID=Q1M0P2; Match level="QueryCoverage=78%, HitCoverage=34%, E-value=1e-36, Identity=71%"; Hit description=UDP -glucuronic acid decarboxylase 1
MSLHHRREEEMLGSSESSPYSPKSIKHTRSLPQIHQLPPPRATPLVHPHRLHLLHHPAHSLLHGPTRAGPHIPPSNRACSLQRHKAHTGRVPIWIGGRRQRIIVTDGSSFIESHLIDKLIARGDDIIVIDNFFTGRKESLMHLFGNPRFELIRHDVVEPILFELIRP

SEQ ID NO: 153609 - protein, 78 aa, Glycine max
  Coding DNA Sequence Number=SeqID_36831
MVSENDLWEGESFDSEQEVLISGKVNVLISGKDLTPVQLQSALSKTFSVKKKKGKLRKAWDGSKVIYNVASWGATAIG

SEQ ID NO: 153610 - protein, 69 aa, Glycine max
  Coding DNA Sequence Number=SeqID_36832
  Gene Ontology: Mol. function=transcription factor activity; Biological process=regulation of transcription, DNA-dependent
  Homolog annotation: Hit_ID=Q5PEQ8; Match level="QueryCoverage=98%, HitCoverage=23%, E-value=3e-19, Identity=70%"; Hit description =Possible regulatory protein
  Pfam annotation: Domain name=HTH_1; Domain location=5-64; Score=73.6; E_value=6.1e-19; Accession=PF00126.17; Description=Bacterial regulatory helix-turn-helix protein, lysR family
  Subcellular localization annotation: CTP_CleavageSite=38; ConfidenceScore=5.04e-01
MKYSPESLEAFVQTVASGSFSAAARVLAKSQSTISSAVANLEDDLGFALFDRSGRQPVLTAQGQRALAQ

SEQ ID NO: 153611 - protein, 87 aa, Glycine max
  Coding DNA Sequence Number=SeqID_36833
MLIDVGNALACACCVCSWGELCIDLPGSLALAFGHVHTLDVVYVRGGHCALTFQGGLSLGREHLWALRLITYGRGAVTCTTGWSRQT

SEQ ID NO: 153612 - protein, 203 aa, Glycine max
  Coding DNA Sequence Number=SeqID_36834
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=3e-17, Identity=30%"; Hit description= UPI00006A17C9 related cluster
MAIGTSKPYTGAMRGIMHEPQVNIGADQKVDPWVLVPIAFRGLHVLPFRGLNVLAFRGLHALAFRGLHILSFRGLHVLAIRGLYVLGFRGLHVLAFRGLDVLLFRGLHVLYFRGLHVLAFRGLYVLAFRGLHVLPFRGLQSSPSEGSTPLPSKYCMSSPSEGYTPSPLESYTPLPLEDCTCSPSESYKPSPLEDYTSLPSEDC

SEQ ID NO: 153613 - protein, 86 aa, Glycine max
  Coding DNA Sequence Number=SeqID_36835
MSILEPNWMGLDDAPQPKSKAPARWIVVKCNKQKGSTKCGYYVMHWMSTIILGSFRNNWETYFNNARPLEPERLKALRIQWAQYYL

SEQ ID NO: 153614 - protein, 81 aa, Glycine max
  Coding DNA Sequence Number=SeqID_36836
MKLWEKVIEHRLREEATIAENEFVDTVTAAASVQFIRNLTEEYFLCVHIVCEYTMLFNNIASIQSVEAVRVPNRSRKTSTA

SEQ ID NO: 153615 - protein, 193 aa, Glycine max
  Coding DNA Sequence Number=SeqID_36837
MLYTTKTSISINTIDVGGLTTEERMLVYLITYILTPRSSNHAQVTDDDLHIVYCLKSGIKMKLVLLNEDIMLKSRRFINYFNVDVSNEVVDFTKASSEITERHLQQIGMRATSSRKHGYQREEEVEAKAPQEPAHQWGPFESLVINKMDVMLHLHQEHSADIHSTLENITTRLENIETRPTLGNLLNPDEDEA

SEQ ID NO: 153616 - protein, 104 aa, Glycine max
  Coding DNA Sequence Number=SeqID_36838
ESHPQRHPVDQEKSNRALGFPVLVMGLYSPTGCPFPPARSRHHRVPDTSNKGIRPPTNRAFIEKYYVSRQAQGETPQQSRDGQQRATDAPPSPLEFTSAHPQKG

SEQ ID NO: 153617 - protein, 69 aa, Glycine max
  Coding DNA Sequence Number=SeqID_36839
MAESPQEQVQMVEMAVGSKLEWSPPLLLLVMMLVAPQSQAPRLWRPHPLQRKKAGLLVRPPVRRTPPCP

SEQ ID NO: 153618 - protein, 257 aa, Glycine max
  Coding DNA Sequence Number=SeqID_36840
  Gene Ontology: Mol. function=DNA topoisomerase (ATP-hydrolyzing) activity; Cellular component=chromosome; Biological process=DNA unwinding during replication
  Homolog annotation: Hit_ID=Q3BV10; Match level="QueryCoverage=99%, HitCoverage=28%, E-value=1e-136, Identity=92%"; Hit description=DNA gyrase subunit A
  Pfam annotation: Domain name=DNA_topoisoIV; Domain location=1-257; Score=353.6; E_value=3.2e-103; Accession=PF00521.10; Description=DNA gyrasetopoisomerase IV, subunit A
MNELNAHSNKPYFKSARIVGDVIGKYHPHGDQSVYDTLVRLAQPFSLRYMLVDGQGNFGSIDGDSAAAMRYTEARMSRLAHELMADIDKETVDFQPNYDEKELEPTVMPTRFPNLLVNGSAGIAVGMATNIPPHNLSESINACIALIDNPEIDVDGLMEYIPGPDFPTAGIINGTAGIVAGYRTGRGRVRIRAKADIEVADNGRESIIVTEIPYQVNKARLIEKIAELVKEKKIEGISELRDESDKDGMRIYIEIKR

SEQ ID NO: 153619 - protein, 78 aa, Glycine max
  Coding DNA Sequence Number=SeqID_36841
MPTFNDDHFNIGSRTEVETPPEPMLNPFYVVDQLAQASWLLHPEGISSPRRVGCLRLKVFHGQGEPDAILGELGSRKF

SEQ ID NO: 153620 - protein, 48 aa, Glycine max
  Coding DNA Sequence Number=SeqID_36842
MSPTEPGNPPRHPPVVHDDTFIEPDLPQQLVSATAMSKPPTTAPAYEA

SEQ ID NO: 153621 - protein, 114 aa, Glycine max
  Coding DNA Sequence Number=SeqID_36843
MEIKHQSKEEGENSSLAPKCYECDQPVHLRFDFDVFKRRMKKSDKRNFKEKKAYITWEDNDMNSSSDSENEIINLGLMAKDYENEEEKNHSASTCYIRNNGNSIGKMMSFITQN

SEQ ID NO: 153622 - protein, 98 aa, Glycine max
  Coding DNA Sequence Number=SeqID_36844
MYEYLRRTRTLTRKHSFQNSYGYSCFVGKGKWLQRNSPRRSLEETPQEKGPVPPPSLIVIVSRSAEHQQRFEAIRGWSFHRERRVQLREDEYTDFQRR

SEQ ID NO: 153623 - protein, 465 aa, Glycine max
  Coding DNA Sequence Number=SeqID_36845
  Gene Ontology: Mol. function=transporter activity; Cellular component= outer membrane-bounded periplasmic space; Biological process=transport
  Homolog annotation: Hit_ID=Q7WHA2; Match level="QueryCoverage=54%, HitCoverage=94%, E-value=1e-105, Identity=81%"; Hit description =Probable solute-binding protein
  Pfam annotation: Domain name=Aminotran_1_2; Domain location=1-191; Score=-87.9; E_value=0.0057; Accession=PF00155.11; Description =Aminotransferase class I and II
  Pfam annotation: Domain name=SBP_bac_3; Domain location=208-398; Score=56.2; E_value=1.1e-13; Accession=PF00497.10; Description =Bacterial extracellular solute-binding proteins, family 3
  Pfam module annotation: Pfam domain module=Aminotran_1_2::SBP_bac_3; Domain location=1-191::208-398
MTDDIYARLNFTDEPTVHPLQVAPALAARTLVVNGVSKAYAMTGWRIGYGAGPDELIKAMAILQSQSTSGASSVSQAAALEALSGPQDCVTEFARVFRERRDLAVAELSGTPGLAIVVPQGAFYVFPDCSGLLGKRTPAGDVIRTDTDLTHYLLREAGVAVIDGHAYGAPGTFRLSFAASLDDIRQGCAGIREACAKLVADIKARGELICGTLGTSQPFSFQDATTRQLVGYDVDVCKLVADKLGVKISYKLLSVAARVPELNEGRVDILAANLGYSPDRAQQIAFSHAYYVSPQKLLVRKDSGLDTIESLNGRRVGATKGSSSEREIKRILDKSQLGHVSGPAAEEGGRAVRVGTGAGAPGAAKPADGAGQRDRQVGVRRAVGPGRAQVGAGHAGGGEPGAGRGGKLGRGRAAVRQVVRRADAVQARTRFQDRPHRGLNAAAGQRHGGDAAAVPGVLGDGVHDR

SEQ ID NO: 153624 - protein, 117 aa, Glycine max
  Coding DNA Sequence Number=SeqID_36846
  Homolog annotation: Hit_ID=Q1SAV3; Match level="QueryCoverage=51%, HitCoverage=10%, E-value=3e-11, Identity=52%"; Hit description =Cyclin-like F-box; F-box protein interaction domain; Galactose oxidase, central
  Pfam annotation: Domain name=F-box; Domain location=7-54; Score=37.6; E_value=4.4e-08; Accession=PF00646.23; Description=F-box domain
MRSEKKPWSPLLFDELIKEILSRLPVKPLIQFKCVCKGWNSLMSDPYFIKLHLSKSAAKDDLEHLQLMKNVCLGSIPEIHMESCDVTIWSVDVMGCTVGLAKYQKDTVFVSGTRRQG

SEQ ID NO: 153625 - protein, 150 aa, Glycine max
  Coding DNA Sequence Number=SeqID_36847
MVTDQSLFYDLTQLSSDGIPFEGALDDDWKFDFSVHNARWLVCTNQVDMTGRLLADSLALESCILHYLIVRIGAQPNDDEEQLPVEGDSSLLQSILDRFDGLQTYVGERFDALEQQVDMRFDAMDSRITKIEEDVTIIRDCLDLPPAPSV

SEQ ID NO: 153626 - protein, 79 aa, Glycine max
  Coding DNA Sequence Number=SeqID_36848
  Subcellular localization annotation: CTP_CleavageSite=60; ConfidenceScore=5.15e-01
MQLSRANESARSLPVISTWLVQTNQRALCTEKSNFQSSSNAPSNGSMIEREEKRFVYRIRCSSDENNEDEEMEERIRVS

SEQ ID NO: 153627 - protein, 577 aa, Glycine max
  Coding DNA Sequence Number=SeqID_36849
  Gene Ontology: Mol. function=RNA-directed DNA polymerase activity; Cellular component=chromatin; Biological process=chromatin assembly or disassembly
MPSNPFFKHQTPCLLHAPLIIRYTCFLTQNQSTSDHIDTRTFKNGKLELRALNAITVKDRFLIPTIDELLDELGGASWFLKLDLLQGYHQILMKEEDKQVDYLGHMVSHTGVQPVPTKVEAIPQWPTPSSARALQGFLGLLGFYKRSPEAQVAFVQLKEAIFHAPALGLPDFSLPFVVETDASGVGMGAILSQQNHPIAFFSKAFCPKLLHASAYVRELAAITVAIKKWRQYLLGHQFTILTDHRSLKELMSRDLKEKLHTHPDYVPFRAEIDEFHSTPTGGHMRVMKTLARLSDNFTWPNIKTDVLNFVLACIDCQQTKYDHCKPSGLLCPLPVPAQPWEDLSSDFIGGLSAFKGHTVVLMVVDRFSKGLEQKYLRAFVHGHSANWGRYLMWVEWSNNTSVHAGTQMTPYEITFGKRPPSIPQYITGTSNVDTVDDFLTNREALFASLRKKLLKAQQTMKNFANNHRHDVSFKVGDWVFVKLRPRRQWKGLATDDATWESWDELKTEYHLEDKVLLEGHGNVMKDQEIPQLQAIPAEASSEHTTETTDMNQRQKRIVAPEDYLVCYFTILLCPVSG

SEQ ID NO: 153628 - protein, 80 aa, Glycine max
  Coding DNA Sequence Number=SeqID_36850
MSVKNLVGRLGVHDKTNHMLASQVTLTSLTIGILKILTFGLLLSAFPTEGNCAERPKAALSPIPTERKCVERPEGALSEP

SEQ ID NO: 153629 - protein, 158 aa, Glycine max
  Coding DNA Sequence Number=SeqID_36851
  Homolog annotation: Hit_ID=Q1SN43; Match level="QueryCoverage=85%, HitCoverage=25%, E-value=4e-25, Identity=41%"; Hit description =Nucleic acid-binding, OB-fold, subgroup
MANNHNTIVEIDATRENWKICVRVVRLWLVPDFKNKKLSHSLEMGDRIHTTVKRTLVYKFRNEIKKGKCYSFSLVGVASNIGGFKTNHHPYKLIFQFSTKVILLEDGAVPNIVYDLVPISTIMDGGLDVDYLVGKMPWDCSLELQIRERTKRMARRPR

SEQ ID NO: 153630 - protein, 67 aa, Glycine max
  Coding DNA Sequence Number=SeqID_36852
MVSDLAVLLPTLTQLVVLHSAQQPILKLAHPWPEWFQLMKCLLDVIRTKFGRASELCQTVIFNWTRT

SEQ ID NO: 153631 - protein, 257 aa, Glycine max
  Coding DNA Sequence Number=SeqID_36853
  Homolog annotation: Hit_ID=Q47522; Match level="QueryCoverage=22%, HitCoverage=77%, E-value=4e-19, Identity=74%"; Hit description=LacZ protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDDISKPGLRLGLGLGLHDDHSSENCMKTNEQSQRQRQSQKKKETDPCNKAYPSLKLGPPDDEANNNNQQITNIESDEYYYFHPHASSRSPSAVSSFSNSSSIIKREREQLELEVEKISLSRDFVDVDENGNPKKKLRLTKEQSAVLEDSFKEHYTISP

SEQ ID NO: 153632 - protein, 139 aa, Glycine max
  Coding DNA Sequence Number=SeqID_36854
MATARWALKHPVYGIVILRLGIYTDRPNVSKLCSFISSMNSSILISDDVPKWKTPHDSGISKNTIDNNEVNTNVTVQTTYSIQMINDGTYEFGDPTVMWLRMPPGSWVTVTKSGVVDKSRAFAPAYPQFVMRNSDLRSS

SEQ ID NO: 153633 - protein, 75 aa, Glycine max
  Coding DNA Sequence Number=SeqID_36855
MMTFKIEFKTESRTLQGSKFDFKNQDSRIIKIKIQDYKIQESREDLIKISIKKFFKTLSSTRSFHKIITKEFYSL

SEQ ID NO: 153634 - protein, 128 aa, Glycine max
  Coding DNA Sequence Number=SeqID_36856
  Subcellular localization annotation: CTP_CleavageSite=20; ConfidenceScore=5.44e-01
MASADPAFFFSAVSHCQSPSLAAQTSPFGPSSLSTELWHILVLFKAPPGFLALFYVTNNNIITKPEGTHCVGFLKSSYSVWYGFECCQGSPSSCLRSSIVFWFLKMSTLDPVLSVPWTSSIGLLKKDW

SEQ ID NO: 153635 - protein, 302 aa, Glycine max
  Coding DNA Sequence Number=SeqID_36857
  Gene Ontology: Mol. function=two-component response regulator activity; Cellular component=membrane; Biological process=two -component signal transduction system (phosphorelay)
  Homolog annotation: Hit_ID=UPI00003CD451; Match level="QueryCoverage =83%, HitCoverage=31%, E-value=3e-28, Identity=35%"; Hit description =COG5001: Predicted signal transduction protein containing a membrane domain, an EAL and a GGDEF domain
  Pfam annotation: Domain name=EAL; Domain location=72-302; Score =110.3; E_value=5.5e-30; Accession=PF00563.11; Description=EAL domain
MRTQPQITELSSNLADQVGRDWPGFRPLFRCAVVELKPPGAADDGHLPFRAITVALSAIESGVVFFDDPIQRDSEIDAVIEVALDRWLQQGDAPLCYQPKHRLQDRQLVGAEALLRMRDGEGRLITPMRVISLLRRQGRLAELEWATLQSAIHFLQQCRRDGTQLKIAVNVSAESLRLPGFGLRLQELLALHDVPGVMLRLEIVEWTEIVERDVVDANIAQLLAAEVTLSLDDFGAGYSTLILLSQLAIAEVKIEQALIATLSDAKSQSIVRFIVEVAHRCGAIVVAEGTETLAQEQQLRAL

SEQ ID NO: 153636 - protein, 529 aa, Glycine max
  Coding DNA Sequence Number=SeqID_36858
  Gene Ontology: Mol. function=kinase activity; Cellular component =contractile ring; Biological process=plasma membrane repair
  Homolog annotation: Hit_ID=Q84VD2; Match level="QueryCoverage=47%, HitCoverage=98%, E-value=2e-48, Identity=42%"; Hit description =Myosin-like protein
MKKQVSERDGELIALRGNVACLYDACINFVIVLENEKAELVGRKVESADLGINLETPSFDDGISEECIKTLTDRLLLAAKGFASIRTEFLDANLKEMKATITNFQRELQEKDVQRDRICSELVKQIKDAEAAANSYSQDLQAFRLQEHNLKKEVEAIEAERKILENRVNELQDRQETAAELEEKKRSQTDLLAAKDQEIEALMHALDEEETQMEELTNKIVDFEMVVQQKNQEIENLESSRGKVMKKLSITVSKFDELHHLSASLLSEVEKLQSQLQERDTEISFLRQEVTRCTNDVLLASQMSNQSSDEIFEFLMWVDTIVSHDGVHDIYPDMKSNSKVHECKEILHKKLTSLLSELENLREVAESKDAMLQIERSKVEELSHKTVTLETSLHEKELQLNLLEGVEDTGKGAGTSSEIVEMNDWSPSGAFVTPQVRSLRKGNSDHVAIAVDVDPGSTSRIEDEEDDKVHGFKSLTTSTIVPRFTRPLTDLIDGLWVSCDRTLMRQPVLRLGIIIYWAIMHALLAFFVV

SEQ ID NO: 153637 - protein, 1122 aa, Glycine max
  Coding DNA Sequence Number=SeqID_36859
  Gene Ontology: Mol. function=protein transporter activity; Cellular component=cytoplasm; Biological process=intracellular protein transport
  Homolog annotation: Hit_ID=Q6FWE0; Match level="QueryCoverage=84%, HitCoverage=63%, E-value=2e-24, Identity=20%"; Hit description =Candida glabrata strain CBS138 chromosome D complete sequence
  Pfam annotation: Domain name=DHC_N1; Domain location=628-1088; Score=- 270.0; E_value=0.079; Accession=PF08385.2; Description=Dynein heavy chain, N-terminal region
  Pfam annotation: Domain name=Pox_A_type_inc; Domain location=261-280; Score=1.6; E_value=48; Accession=PF04508.3; Description=Viral A-type inclusion protein repeat
  Pfam annotation: Domain name=Pox_A_type_inc; Domain location=462-484; Score=6.8; E_value=8.2; Accession=PF04508.3; Description=Viral A-type inclusion protein repeat
  Pfam annotation: Domain name=Pox_A_type_inc; Domain location=712-731; Score=7.6; E_value=6.3; Accession=PF04508.3; Description=Viral A-type inclusion protein repeat
  Pfam annotation: Domain name=Pox_A_type_inc; Domain location=747-769; Score=4.7; E_value=17; Accession=PF04508.3; Description=Viral A-type inclusion protein repeat
  Pfam annotation: Domain name=Pox_A_type_inc; Domain location=811-833; Score=2.7; E_value=33; Accession=PF04508.3; Description=Viral A-type inclusion protein repeat
  Pfam annotation: Domain name=Pox_A_type_inc; Domain location=867-889; Score=5.1; E_value=15; Accession=PF04508.3; Description=Viral A-type inclusion protein repeat
  Pfam module annotation: Pfam domain module=DHC_N1::Pox_A_type _inc::Pox_A_type_inc::Pox_A_type_inc::Pox_A_type_inc::Pox_A_type _inc::Pox_A_type_inc; Domain location=628-1088::261-280::462-484::712- 731::747-769::811-833::867-889
MYSDLRKLVHGNGGTMDEDKIDLQSEALPDLLNYNSYQPILKHLGNILAEKLELESVTKEIKSELMHRETEMEELKMKCLGLDSVSKLIEDVAGMLNADISKIDINKSPLSCLDSLVSSLVQKTREAEIQYHTTKEGYGSKEMELAELKEKMHYLDTLCLENENEILVLKGSLHQAEEALTVARSELHKKANELEHSEQRVCSIREKLSIAVAKGKGLVVQRDGLKQSLAETSSELERCLQELQLKDTRLHEVETKLKTYAEAGERVEALESELSYIRNSSNALRESFLLKDSMLQRIEEILEDLDLPEQFHSRDIIEKIDWLASSVSGNSLPMNDWEQKEAVGGGSYSDAGYVVTDSWKDDSQLQPDSDDFRKKIEELQSKYYGLAEQNEMLEQSLMERNSLVQRWEELVNRVEMPSHLQSMETEDKIECIGSALTEANHHIDSMQLKIEKYDSYCGLLNADLQESQRTVSALQEDLSALTSEREHLSEKMESLVYEYEKLSLQTREAELENGKLHDEITSLKDKLEHKTAIEEQIFTIDYKIRKLRDLIGDALSESETENMVFGSANIDSLEELLGKLVEKLNMERKLSAQTREAELENQKLQTEISSLKDKLEQKAAIEEQIFTIDGKIRKLQDLVGDALSESETENLVSCSANIDSLEELLRKLIENHAKLSSMKPAYGVVGDGLHSQKGDATVHEERSIDVHDEEAADMDRYKRDLEESLNELIHVKEERNRSLEKQISLSGEVEALTKRIEELQGLLNQEEQKSASFSEKLSGEVETLTKRNEELQGLLSQEEQKSASVREKLSGEVETLAKRIEELQGLLNQEEQKSASVREKLNVAVRKGKSLVQQRDSLKQTIEEMTVEMEHLKSEIYNRENTLAEHEQKLRLLSTYPDRLEALESDSLLLKKHLEETEHHLQEHEYSLKLILNKLDEIEVGGEGHISDPVKKLEWVGKLCSDLHSAVASLEQESRKSKRASELLLAELNEVQERNDSFQEELAKVNAELVDLRRERDSAEAAKLEMFAHLEKLSALHEEGKKSHFSDIMELKSSLNQVCKSFDEVQNLLSNAFFLDLESYRKVEASLESCMKGNNDKNVVDSSVTKERDGILHWSSANKMLV

SEQ ID NO: 153638 - protein, 124 aa, Glycine max
  Coding DNA Sequence Number=SeqID_36860
  Gene Ontology: Mol. function=DNA binding; Cellular component=beta -galactosidase complex; Biological process=DNA integration
  Homolog annotation: Hit_ID=Q1SD84; Match level="QueryCoverage=99%, HitCoverage=12%, E-value=1e-39, Identity=47%"; Hit description =Integrase, catalytic region
MEVVCSKRGIVVSQQKYILDLLEETGMSGCRPGDTPIDPNGKLWEKGSVPVDVGRYQRYLKSNPGKGLFFKKNNDLEKSKKQGVVAKSSVEAKFRAIAQGICEGLWIYRVLEELEMAIELPLKL

SEQ ID NO: 153639 - protein, 86 aa, Glycine max
  Coding DNA Sequence Number=SeqID_36861
MELGDSSRKSRFSSYERVAAISLVVLAVASPLYIDHRPETIALSAFLDRNFTRFDRHWIHRVGGSSGGIVLILVVLFLVLKCKASV

SEQ ID NO: 153640 - protein, 365 aa, Glycine max
  Coding DNA Sequence Number=SeqID_36862
  Gene Ontology: Mol. function=protein binding
  Homolog annotation: Hit_ID=Q338L7; Match level="QueryCoverage=99%, HitCoverage=66%, E-value=9e-86, Identity=32%"; Hit description=F-box family protein, putative, expressed
  Pfam annotation: Domain name=LRR_1; Domain location=159-182; Score =1.6; E_value=1.4e+02; Accession=PF00560.23; Description=Leucine Rich Repeat
  Pfam annotation: Domain name=LRR_1; Domain location=184-206; Score =0.8; E_value=2e+02; Accession=PF00560.23; Description=Leucine Rich Repeat
  Pfam annotation: Domain name=LRR_1; Domain location=236-259; Score =1.0; E_value=1.9e+02; Accession=PF00560.23; Description=Leucine Rich Repeat
  Pfam annotation: Domain name=LRR_1; Domain location=282-299; Score =6.2; E_value=20; Accession=PF00560.23; Description=Leucine Rich Repeat
  Pfam annotation: Domain name=LRR_1; Domain location=303-326; Score =4.3; E_value=45; Accession=PF00560.23; Description=Leucine Rich Repeat
  Pfam annotation: Domain name=LRR_1; Domain location=328-351; Score =6.9; E_value=15; Accession=PF00560.23; Description=Leucine Rich Repeat
  Pfam annotation: Domain name=LRR_1; Domain location=74-95; Score =10.8; E_value=2.8; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=159-182::184-206::236 -259::282-299::303-326::328-351::74-95
MFMVSLELKGCGVLSEASLNCPLLTSLDASFCSQLTDECLSATTASCPLIESLILMSCPSIGLDGLCSLRWLPNLTLLDLSYTFLVNLQPIFESCSQLKECRCFTLDRIVASIILIRHMHSSSLKPAFGSESVLVLKLQACKYLTDSSLEPLYKGALPVLQELDLSYGTLCQSAIEELLSCCTHLTRVSLNGCANMHDLNWGCSRAHTAELPGVNVLPIASSPENVLELSEQPIRLLQNLNCVGCPNIRKVFIPSTAHCSRLLFLNLSLSANLKEVDVACLNLSWLNLSNCSSLEVLKLECPRLTSLFLQSCNINEEAVEAAISKCTMLETLDVRFCPKISSMSMGRLRAACSSLKRIFSSLSAS

SEQ ID NO: 153641 - protein, 577 aa, Glycine max
  Coding DNA Sequence Number=SeqID_36863
  Gene Ontology: Mol. function=protein binding; Cellular component =cytoplasm; Biological process=ubiquitin cycle
  Homolog annotation: Hit_ID=Q338L7; Match level="QueryCoverage=86%, HitCoverage=70%, E-value=1e-151, Identity=43%"; Hit description=F -box family protein, putative, expressed
  Pfam annotation: Domain name=F-box; Domain location=154-201; Score =35.6; E_value=1.7e-07; Accession=PF00646.23; Description=F-box domain
  Pfam annotation: Domain name=LRR_1; Domain location=244-266; Score =1.6; E_value=1.4e+02; Accession=PF00560.23; Description=Leucine Rich Repeat
  Pfam annotation: Domain name=LRR_1; Domain location=268-296; Score =2.4; E_value=1e+02; Accession=PF00560.23; Description=Leucine Rich Repeat
  Pfam annotation: Domain name=LRR_1; Domain location=358-383; Score =4.2; E_value=48; Accession=PF00560.23; Description=Leucine Rich Repeat
  Pfam annotation: Domain name=LRR_1; Domain location=384-409; Score =6.8; E_value=15; Accession=PF00560.23; Description=Leucine Rich Repeat
  Pfam annotation: Domain name=LRR_1; Domain location=430-452; Score =9.3; E_value=5.1; Accession=PF00560.23; Description=Leucine Rich Repeat
  Pfam annotation: Domain name=LRR_1; Domain location=472-497; Score =1.2; E_value=1.7e+02; Accession=PF00560.23; Description=Leucine Rich Repeat
  Pfam annotation: Domain name=LRR_1; Domain location=514-534; Score =5.5; E_value=27; Accession=PF00560.23; Description=Leucine Rich Repeat
  Pfam annotation: Domain name=LRR_1; Domain location=542-566; Score =3.7; E_value=59; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1; Domain location=154-201::244 -266::268-296::358-383::384-409::430-452::472-497::514-534::542-566
MKEGDIIFGNVVVSDDDDGDGDGNDTRGDDKQFAMVRADVLGSWPGESSSTAAAECLDIAAAGESRDLSNKRAKFYADFEEHHFSTGKCSASNEYVDYNFSIKGTLRPNGETCYDAFSLMGVVEENSSGFDSRIVKEGGEGDDSDISKVEEDVEVRMDLTDDLLHMVFSFLDHPNLCKAARVCKQWRGASAHEDFWKSLNFEDRNISVEQFEDMCSRYPNATAVSLSGSAIYLLVMKAICSLRNLEFLTLGRGQIADTFFHALADCSMLRRLNINDSILGNGIQEITINHDRLCHLQLTKCRVMRIAVRCPQLETMSLKRSNMAQVVLNCPLLHELDIGSCHKLPDAAIRAAATSCPQLVSLDMSNCSCVSDETLREIALSCANLSFLDASYCSNISLESVRLPMLTVLKLHSCEGITSASMAAIAHSYMLEVLELDNCSLLTSVSLDLPRLQTIRLVHCRKFADLNMRTMMLSSILVSNCPALHRINITSNSLQKLALQKQDSLTMLALQCQSLQEVDLSECESLTNSICDVFSDGGGCPMLKSLVLDNCELGIRSVHQHLFGQSFPWWLSGNYFS

SEQ ID NO: 153642 - protein, 71 aa, Glycine max
  Coding DNA Sequence Number=SeqID_36864
  Gene Ontology: Mol. function=binding
MALLCRGKPFKNDHCGTGPNANKALDSFIKATVCGSTLTMVDVSLICWARGKKPKAMEFYLKAAKLGNLYA

SEQ ID NO: 153643 - protein, 115 aa, Glycine max
  Coding DNA Sequence Number=SeqID_36865
MDNTKASCKLKLGCRSSAFGKGIEETLTGESGNGVWGKVKRKRWEIEEANFIEQNNVEKKHPGNMRRNLVVLPWDCRRRRKQSGFRITTLMFETSNKDDDEKSVVLCRRGIGGGE

SEQ ID NO: 153644 - protein, 59 aa, Glycine max
  Coding DNA Sequence Number=SeqID_36866
MVGGGGVACARQGDLDTYCLVFLSESVVWTHLGYFLRDGTTLHLRVDVRSRMTAVEYKK

SEQ ID NO: 153645 - protein, 292 aa, Glycine max
  Coding DNA Sequence Number=SeqID_36867
  Gene Ontology: Mol. function=RNA-directed DNA polymerase activity; Biological process=RNA-dependent DNA replication
VYGVSLERLLNNSLEVLDLFGVGQLGEHVFPGVALPGYVVHLKAFEVVDESFGDVIVLEQHYFLVQLSVGNLPLDKLRVGVSLLAMSASYSARLFEALKLNLRACSRVMLLRPSRMIPAPLTFTLDALSTSNSESSTNQATIPPANLGFHKTYLMGAKLTTLSATERYRSSGSPGLGQLTIRGVAMVLFKAEMAYFLGVCMTVHLQYGCAFVGVDFYSMACDHNAQELVSTDFEGFDHHVIDVDLNISSDMLFKDMVHQPLISGAYIFKAKGHYLVAKVDICNDECCFLLLI

SEQ ID NO: 153646 - protein, 102 aa, Glycine max
  Coding DNA Sequence Number=SeqID_36868
  Gene Ontology: Mol. function=ribokinase activity; Biological process =D-ribose metabolic process
  Homolog annotation: Hit_ID=Q5SN59; Match level="QueryCoverage=95%, HitCoverage=27%, E-value=6e-11, Identity=41%"; Hit description =Ribokinase-like
MWQRARPTAQVGTPNVDDGVLVVGLDHDSCMTYRCQSDHDKIIEANPATAEARRNESPVSVIPDLLDEVNQVRELGGACGRVGSLAGNKRLPGPRHQGLTLA

SEQ ID NO: 153647 - protein, 238 aa, Glycine max
  Coding DNA Sequence Number=SeqID_36869
NLWEKEVVQCQAPKHGWVLFDVESGNLDKCKSCRMDMLLVLQAKLDVLGVCGVRAVLLHTCHSWNGHILEAWCMGKFLLTMSFFLFDSTIGMGCSDFGFDLATPGRPRGQLHRWFLLGGDSCGASNNESSSLERLRVSRRVGRVRKSGGGDVRGSPGVRCSHSVGSLSSPPVVAGFEWVRDDILKYKSSITSMASFVALQCQVKYASPEDSCKLVIQACGSDDYVERYAYIVFMSCIF

SEQ ID NO: 153648 - protein, 108 aa, Glycine max
  Coding DNA Sequence Number=SeqID_36870
MLVATPCVFLSWNTHPRVTCYPPTEGPYCCNMFFEGDDTSRDHQERYDHLGCRNMPFGGRAKSRLTGELSTGGKMRGVATNVYLWKTSEKLKETGQNENSKFGSCIYA

SEQ ID NO: 153649 - protein, 820 aa, Glycine max
  Coding DNA Sequence Number=SeqID_36871
  Gene Ontology: Mol. function=calmodulin binding; Cellular component =myosin complex; Biological process=aromatic amino acid family biosynthetic process
  Homolog annotation: Hit_ID=Q513P3; Match level="QueryCoverage=83%, HitCoverage=85%, E-value=1e-16, Identity=18%"; Hit description=Viral A-type inclusion protein repeat, putative
MTHATTSFQQPSTKEDLSDDHDSFLVTAAVTVGSKNGVDRKMDRNKSRTDLLAAGKKKLQQFRQKKDNKGGSSHAKSSKKAGKPQLPDSDSDAASSASISTVTSQITDGNVEADSHSNMVNTESSESQSMANSLAHNNIDPSVDSSSVVTTYDTGNETVLDSNAEVAHQVHGVRENDSELSAQDQGEIAQDIGADVLEGVSLRTSDSQVSEGGATNDHASVPVAVLPSLASVTTAVGESVTDERKCQKREELLLLSEDIPNTSVMQTSEDQEADGLDMKKSYQSTDAVIDGQKQLPLSEVGESDQYLSGIALDKTRVEEASHEAEQLGKSIELLSSHELPRGTNEFDPARPLDVSYVYDANSINLLQLGEIIKGLNEEECRFLLEARGAVSDLNPLASSSVLSDNDISEAFQSLKEELFIANLMKNIFNTQLAEQLEFDDQRRQLVDEISQLRASPNQVNEKNQQLTEELANCRVELHDISSKNVELQNQFNAAMAEVEALSARVVDLQNSFDVSQKDSLELSTELADCRDLISSLQVEKKDMNETLDLTIAEKNELVEEKEFHLCESKNLATELADFKRLMEGVKVENSNLIDRISLVTEERNKIEAEIEHLRHEIDRLSLDLVENKDFVASLQSENSNLNGNLALSADKIKNLEDENQRLSSQIIVLNEQLSTEKGEQMRFEGDLKEAAERLEQISKENVFLNDTLNRHKAKIEEIGKERSQLVSQSRDLGNQVHVAREHEIAIIEDSLCMDQDPDEVFDDSHGFVSLNASLDEVEKVLVKLEKAIDELHSQSVSSSRSGEKVSSPVVSKLIQAFESK

SEQ ID NO: 153650 - protein, 211 aa, Glycine max
  Coding DNA Sequence Number=SeqID_36872
MSRYERYRLLTANHTTILEEAFNLEVPIRLPPIKPPSLGLNATTYYMYHRDRTTTKQEQDLEDTERSSRGITMQTEEEIERNIESSMSQKCHLHAIRDININFVDSPLERSLPPITFTDRDFKVINPINQDNLIVVSIVIANFMVPKVLIDQGNSIDILYWRTFQRLEVSPDTVHLHETLNELGAIVSTPHLKMKFPTLTEETVTVKANQK

SEQ ID NO: 153651 - protein, 116 aa, Glycine max
  Coding DNA Sequence Number=SeqID_36873
  Gene Ontology: Mol. function=DNA binding; Cellular component =mitochondrion; Biological process=DNA integration
MASHTPLSWTTTLKSKLICKYEGFLTRVGVKHLVTLIEHPQTNDQAKASNRVMLKVLCTRLDKSKGLWKEELPSILWAYHCSPQAATNKTSYRLTYGIEAMIPIEVEEPSKRRLLF

SEQ ID NO: 153652 - protein, 100 aa, Glycine max
  Coding DNA Sequence Number=SeqID_36874
MSLPERHVCKSMTHTRHIQGSSNPSSALSESHRFIKPEVRPWANTSPVQGSINPRFTLGIQVYQKPKVCPWYAHLQNPRSTLGKNAYKTQGPLTRNNYND

SEQ ID NO: 153653 - protein, 692 aa, Glycine max
  Coding DNA Sequence Number=SeqID_36875
MVRVSHPDKALAMEMVLIDSFVRWALGLHTSALRGAFVRRTGGGTYKTKDSDAQGSMEPDIYRSGVEIVRAPVPRLTWRVDMCLEVSCKEGDEFIKPPSMEECCSVSGVVTSTSVRTVGLPGLSNPQAKCYLGCFCQVVWDGHVFDLTRRVQKFRAPLPLPLVTEESVSLLNGANQPMMDREVNSVGESSSSKRVKASRCIGGGTSHLRGRAWISIASEEPIPVNVILPLLLLRDARSPSSPLAVVGYEWVGDDVLTYKSSLTSGDSCKIVVQACGSDDFPFLRATSDEIDGKNWLGLLEQRVQEVVRAYPTRFKSFDEDLLTLVEREAKAILEPLSASLDAWAILSLPSVIDPLSALDDKCIIGDFAWRPLVKKVGPSSGVVPPSITASVRKRDDGVRLSGHKKSRASLSLHALRQAVGLSLGSGRPSSVQDVPLAPSAIKAHAADAIVGVTLAPPLPSVVFVHEVALVAVEVSVPVGLAGSAMVPSSTVVAPLLSVDVATTSANVLPPPSFSGPRVPRSTALASTSTSSHPMFPWITSTLPMMSVKFQHAMDSAKKVTACTIWRVERSKDIVTEKDKLAKKVVDLEARLKESKSMLEESQLQAAREREASKELEEELLVYNKEVMEQHEKGFNKAIRQARFFAKDLDLGLFDPFKDVKDDVLLDEEEIVAEEEVEKEEQGAEEQGDDATV

SEQ ID NO: 153654 - protein, 325 aa, Glycine max
  Coding DNA Sequence Number=SeqID_36876
  Gene Ontology: Mol. function=RNA-directed DNA polymerase activity; Cellular component=intracellular; Biological process=RNA-dependent DNA replication
MGEEQCKAGKEEVDKLLNANFIREVKYSTWLGNIVMVKKASDKWGMCIDYTNLNKTCPKDACLLPSIDKLVNGVFGFQVLSFLDVYSGYNQIQMYTLEEEKTTFIIKDANFYYKVYADDMVVKSQSITQHVVDPKEVFGELHKYDMHLNPKKYTFGMCNPTNLQEVQKLNGRPTSLSRFLPKLVEKAKLFYRLLKKTEPFLWDKTCKQAFLAFTKTIATLLVFSQPRQEYPYSQLSEFDIQCEPHSPMKTQFMADFLGSGARIILEGPKNVTLEQALKLNFKASNNHTKYEALIAGLKLETKVKAKKLRCYTNLQLVQGHLANRF

SEQ ID NO: 153655 - protein, 137 aa, Glycine max
  Coding DNA Sequence Number=SeqID_36877
MPKPDSPKRNKTGVNILELHPSPRTTAQALINDNLINLRHTQLLPHHNTNTSSWIGDFSMFTTKEIFYEGIAQTQILPRMRFPLMNTNLTSHRFTILNLFKKAFNKLSVGSRDHLVAFLQKFKLCARLPVVSCSVRS

SEQ ID NO: 153656 - protein, 90 aa, Glycine max
  Coding DNA Sequence Number=SeqID_36878
MLPLLALQSQTTRYVKVGGDELHVEKTTLAFPCLNYSKFAHSSNAFTFSRNGPLNITGYPGLPKFLKLKTFPHLFLFLFPTTIDFYEADD

SEQ ID NO: 153657 - protein, 107 aa, Glycine max
  Coding DNA Sequence Number=SeqID_36879
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q68RV6; Match level="QueryCoverage=94%, HitCoverage=32%, E-value=4e-29, Identity=73%"; Hit description =NAD(P)H-quinone oxidoreductase chain 4, chloroplast (EC 1.6.5.-) (NAD(P)H dehydrogenase, chain 4)
MVTRHPRRGTLQHLYAFSRNIIKNGSIWVGIGSISDTGLNGAILQIISHGFIGAALFFLAGTSYDRLRLLYLDEMGGMAIPMPKIFTVSLSYRWLSALPGMSVLLQN

SEQ ID NO: 153658 - protein, 103 aa, Glycine max
  Coding DNA Sequence Number=SeqID_36880
  Gene Ontology: Mol. function=sequence-specific DNA binding; Cellular component=nucleus; Biological process=regulation of transcription, DNA-dependent
  Homolog annotation: Hit_ID=Q8S9N6; Match level="QueryCoverage=97%, HitCoverage=37%, E-value=8e-18, Identity=50%"; Hit description =Homeobox-leucine zipper protein ATHB-17
MAVLPSSSSNLELTISVPGFASSPVLLPLSSVKELDINQVPLEEDWMASNMEDEEEGSNGDPPRKKLRLTKEQSRLLEESFRQNHTLNPVNNPPISVSLSLSY

SEQ ID NO: 153659 - protein, 65 aa, Glycine max
  Coding DNA Sequence Number=SeqID_36881
MMKMKKRKRRTCVSTKRREKRRIENQREVTLEKRISRGVGFRPWSSKSKGMWPKDGDTCRWESKR

SEQ ID NO: 153660 - protein, 124 aa, Glycine max
  Coding DNA Sequence Number=SeqID_36882
  Gene Ontology: Mol. function=nucleic acid binding; Biological process= DNA integration
  Homolog annotation: Hit_ID=Q1SDG1; Match level="QueryCoverage=85%, HitCoverage=9%, E-value=2e-21, Identity=50%"; Hit description =Integrase, catalytic region; Zinc finger, CCHC-type
MEKSEKKNFSEKKMKAYITWDDNDMESPEDSENEEINLCLMAKSYESDEEVSLKKRWYIDSECSKHMTGDASKFTHISPKKSGYVTCGENNKGRILGVGKIGINSSNSIENVLLVEGLKHSLLS

SEQ ID NO: 153661 - protein, 110 aa, Glycine max
  Coding DNA Sequence Number=SeqID_36883
MRVVEERLRSIGKASGGTIGILEDLQMCESTSSRSRYKLHVVVVTPTYIFPNDAPIALRSYLVSPQWFFFDMFHFEDSPCCCCCTMLKRHVKRIRPHVGDLHGVESTYMA

SEQ ID NO: 153662 - protein, 86 aa, Glycine max
  Coding DNA Sequence Number=SeqID_36884
MRVFTRCGMQEVWLWVSYPNLVWGLLFDGMQPLVDRFEVLGTLCCTIREVPSHTGNQKGSIVAQYVKFRDMPEIKRKHRYAIREIL

SEQ ID NO: 153663 - protein, 252 aa, Glycine max
  Coding DNA Sequence Number=SeqID_36885
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=83%, HitCoverage=18%, E-value=6e-55, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MIKLQSRHFMPEPATSLEVVVAGTKEEKEDIEEIGNNNAHSKYKKNDQAHLAQEEDGSDLDQVLLMVTTRSKEDYSSWYLDTGCSNHMTGNKDRLVDFNPNVTTSVRFADNSTILANGIGKGNHIEIFDDKQRLVLKAPLSRNRTFKVNLSTTTIQCLSTVNMEEDSWLWHYRYGHLNFKSLHQLSSKQMVLGMPSIHLPQKTCEGCLIGKQPRKAFKTKAPQRAKQPLGIVHSDVYGPFDTPSLGGNRYLI

SEQ ID NO: 153664 - protein, 122 aa, Glycine max
  Coding DNA Sequence Number=SeqID_36886
  Gene Ontology: Mol. function=DNA binding; Biological process=DNA integration
  Homolog annotation: Hit_ID=Q1S325; Match level="QueryCoverage=50%, HitCoverage=13%, E-value=8e-15, Identity=60%"; Hit description =Integrase, catalytic region
MKFEAKNTLKIIASNDNVINIDNKLVKRPMLNGSHSKKEMDMSNFGHWGKGVPVVRAKNLSVSFVHQTRVTKEKTLQGPSKKLIFTWCKIMDITSAAKDTKDSVQRLFRVHDGVRDLISKNR

SEQ ID NO: 153665 - protein, 160 aa, Glycine max
  Coding DNA Sequence Number=SeqID_36887
MDIIGIDLLSLIPYLITSGKSLKLWLKVRSKRTKGHYTMKHVNKTLVKVIVEEAKTGSEEAMRKVGAKQQQAGPNGTKQSQTCNKQGRRRMRSTVMVSSKGGLSGKVPCMNGRRWRATLVGLVRMQWRSRCWPNDVGTVCGYLFTREKGMCLKKKKNLNY

SEQ ID NO: 153666 - protein, 172 aa, Glycine max
  Coding DNA Sequence Number=SeqID_36888
  Gene Ontology: Mol. function=nucleic acid binding; Cellular component= beta-galactosidase complex; Biological process=DNA integration
  Homolog annotation: Hit_ID=Q0KIN0; Match level="QueryCoverage=99%, HitCoverage=11%, E-value=7e-50, Identity=50%"; Hit description =Integrase core domain containing protein
MGLLKYFLGIDVAQSSYGIVISQWKYALDILTETGMLDCLPSNTPMDPNVKLLSVGVLSQFLKDPTDSQWNATIRILRYIKNAPGHGLLYEDKGNGKVVCYFDADWPGSPSDKSSTSGYSVFMGENLISWRSKKQKIVARFSAEAECRVMAAAASEITWLRQLLQQIKFGDV

SEQ ID NO: 153667 - protein, 125 aa, Glycine max
  Coding DNA Sequence Number=SeqID_36889
MELENMDMQTTLIRFMRNAASSLWSLPLLALHLNLRQCAIRFCQVLLFLPMTWLVNNCFASSLCMPLDHPLHLLKIPLLLSPILLIVVDEAKVVVVNHVSNVATIAAFMVILKPTVATRLAIKQS

SEQ ID NO: 153668 - protein, 87 aa, Glycine max
  Coding DNA Sequence Number=SeqID_36890
MFLNEELYTVPEFQINIIDNNDINTNATTQMSQRALRGRARARLTGALSKGGKVDKSGAFAPTYPPLERKSDLRSSSLSVNRVILFT

SEQ ID NO: 153669 - protein, 76 aa, Glycine max
  Coding DNA Sequence Number=SeqID_36891
MAKRLDWVFISRFITFSKIMASFQQIKDIVKGIKKQIGKLLALTLSIGGLNLRLPLVLNAGREEGLGKGYAKTFKG

SEQ ID NO: 153670 - protein, 228 aa, Glycine max
  Coding DNA Sequence Number=SeqID_36892
  Homolog annotation: Hit_ID=Q1SMP7; Match level="QueryCoverage=25%, HitCoverage=5%, E-value=9e-17, Identity=77%"; Hit description=IQ calmodulin-binding region; Myosin head, motor region; AAA ATPase
MARPLIIVIPSFRYQEAIFRVLAEILHLGNIEFSPGKEHDSSGVKDEKSRFHMQMAADLFIAPNPGGSASPFFQAAFIAAVDTVSVPNDCIYHWSLSAAVHCCPPSSTTFRRKTDRRTHQEKRFLQIGPSLKFHRQPPSDALPLAVFVSGVCKPRATVQAVFFDGTATEQVTSPPRFCSKETLAREGYGYRSTFFLYLVCTPTEDDKDLELASSPVHHKEDRRFENQY

SEQ ID NO: 153671 - protein, 357 aa, Glycine max
  Coding DNA Sequence Number=SeqID_36893
  Gene Ontology: Mol. function=motor activity; Cellular component =myosin complex; Biological process=regulation of transcription
  Homolog annotation: Hit_ID=Q1SMP7; Match level="QueryCoverage=58%, HitCoverage=19%, E-value=1e-56, Identity=59%"; Hit description=IQ calmodulin-binding region; Myosin head, motor region; AAA ATPase
MDLMSYLLSSVIYLVQRLWKQSLWNLLSRFCFIMQVSNEEAKKVEISKLQKMLEALNLELDAAKLAKINECNKNAVLQNQFELSVKEKSALKRELVAVDELRKENAQLKVPLDAFEKKCTTLELELMNAQKGRDETMEKLRESEQKCSQLEQNEKRLEEKLLNLEDENHVLRQKALSTPLKSNRPGFAKSISEESPTPTKLIAPFTLSLPDSRRSNKLTAERQQVDPVAPMFCLKSYTFSFGHPAISEELVEYRGCEEGHKYFLGKQNWTMIWRVETNSRNSIEKYLPPCRIETGVDSSDLAQTRASLGRLASLRRVRNCYSPLFTRIVIAGPQSRSSIVIGRRCLAGPHLRSKLCF

SEQ ID NO: 153672 - protein, 193 aa, Glycine max
  Coding DNA Sequence Number=SeqID_36894
  Gene Ontology: Mol. function=nucleoside-triphosphatase activity; Cellular component=myosin complex; Biological process=signal transduction
  Homolog annotation: Hit_ID=Q0WPU1; Match level="QueryCoverage=98%, HitCoverage=12%, E-value=1e-75, Identity=71%"; Hit description =Myosin-like protein
  Pfam annotation: Domain name=Myosin_N; Domain location=6-47; Score =13.1; E_value=0.062; Accession=PF02736.9; Description=Myosin N -terminal SH3-like domain
MNLRHGSKVWLEDRDSAWLAAEVLDSDGNRFLLVTDSGMKLFASPEKLFPRDADEEEHGGFEDMTRLAYLNEPGVLFNLRRRYALNDIYVSGSILIAVNPFTQLPHLYDSHMMEQYKGAPLGELSPHVFAIADASYRAMMNEGKSQSILVSGESGAGKTETTKLIMQYLTFVGGRAAVDDRTVEQQVLEVNYS

SEQ ID NO: 153673 - protein, 64 aa, Glycine max
  Coding DNA Sequence Number=SeqID_36895
MHYTASRGQLLTARNLGLLLDDADLAACLAHFATIPAGFQNNLVLKVVVALKGFPLLPRCVFRN

SEQ ID NO: 153674 - protein, 1430 aa, Glycine max
  Coding DNA Sequence Number=SeqID_36896
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=72%, HitCoverage=82%, E-value=1e-128, Identity=48%"; Hit description =Chromo
  Pfam annotation: Domain name=C2; Domain location=1270-1359; Score =66.5; E_value=8.5e-17; Accession=PF00168.20; Description=C2 domain
  Pfam annotation: Domain name=Chromo; Domain location=1071-1125; Score= 38.4; E_value=2.4e-08; Accession=PF00385.14; Description='chromo' (CHRromatin Organisation MOdifier
  Pfam annotation: Domain name=RVP_2; Domain location=232-381; Score= -59.9; E_value=0.047; Accession=PF08284.2; Description=Retroviral aspartyl protease
  Pfam annotation: Domain name=rve; Domain location=768-924; Score =75.2; E_value=2e-19; Accession=PF00665.16; Description=Integrase core domain
  Pfam module annotation: Pfam domain module=C2::Chromo::RVP_2::RVT _1::rve; Domain location=1270-1359::1071-1125::232-381::476-716::768 -924
MADNNNDRTRLQHMQTHINTLNSWMEEQRKRNIENQDRNSSSGGIPVTPISSFAPVKDISLGFPHFDGHTPVLEWIFKVEKFFNYHHTPDSDRVEIVAIHFEKDVISCGFNADIRRDVIAQAPTTLIRVVSLTKLYEEKYQPVNSNWTHNYSHRYSPISTHTVNFNYTPSNAAKNTTKTSLPLLLPTPNTPPLRNNFVKKISPAEMQLRHKKGQMLMLQLEDDKGEAEMSFDVGSGDNNSTAKTVIDNPHHLSLNALKGGLGVGTIRFVAHINTLPVRVLVDGGSSDNFLQPRVTKFLKLPIEPTPLFKVMVGNGNYMTVLGMIRELSIQAQGNRFQLPVFLLPISGADLILGANWLKTLGSNIADYDSLRMISTDSIAEVFNMQLIEPSNFQFPLSELPVDLEPELALFLHTYEYVFKTPTSLPPPRSHDHAIHLLEGSKPVKVKPYQYLHSQKDEIEKLVQGMLEEGIIQPSKSPFSSPIILVKKRGGSWRVCTDYRALNAITVKDTFPIPTIDELIDELFGAEFFSKLDLRSGYHQILLKPEDRQIDYLGHVLSGAGVPMETTKLFVKNYASIVGPLTDLLKKNSFQWSDSASQAFLQLKKAMTSTPMLVIPNFREPFVLETDASGSGIGALLSQSQHPIAYFFKKLSPRMQKQSTYTREFYAITAMAKFRHYLLGHKFIIRTDQKSLKELLEQTLQTLEQQQWLHKFLGYDFTIQYKPVATVTNEDKLLSELISRYAHGGTIDPKYDAKVDEAVPAGLLQPLPIPQQIWEDIAMDFITNLPSSHGYSTIMIIVDMLSKFGHFIALKVEFNSKLVADAFIKNVAKIHGFPKSIMSDHDRVFINSFWQQPFKAQGTTLAMSSSYHPQSDGLTKILNKTLEMYLRCFVFDNPKMWYPMLAWAQYWYNSSYHHSLGMSPFKVVFGREPPAIVPYQVHPKDPISLQETLVNRDNLLQKLKGNLARAQNYMKMQAYKKRRDFQLEVGDLALVKLQPYRQQSVALRKNQKLGMHFFGPFEVVERVGQVAYKLKLPEVARIHPVFHISLLKQFQGSQSHQYLPMSLTTTEFGPIIQPEHVLDTRIIKRNSIEIQQILIQWESFDASEASWEDLTAIKQSYPRFNLEDKVDFKGKGIVTSNSVGDKCVGNSIKNDGHMEGDPQNLATRRSTRAHKENVHFRGYDHGGKAYVNKILEEKEVDNKWYNLGRLRSNNWYNNPGRPEIPENTREVEFVGKINARISLDGAYHDMDEPSEYSSELRPSSKELCSSNIGMLEVGIIKATTLVPMKNGGARTDAYCVAKYGPKWVRTRTVVNSLSPKWNEQHAWKVYDPFIVITIVVFDNNQLDANSRARGEKDATMGKIRIQLSTLENEKVYALSYPLVGVNPSGVKKMGEIHLAVRRYFKRPRNPCHTDAILCGANVATLKDLQEELDMF

SEQ ID NO: 153675 - protein, 262 aa, Glycine max
  Coding DNA Sequence Number=SeqID_36897
  Gene Ontology: Mol. function=transferase activity, transferring glycosyl groups; Biological process=response to oxidative stress
  Homolog annotation: Hit_ID=Q9FL59; Match level="QueryCoverage=91%, HitCoverage=38%, E-value=5e-28, Identity=33%"; Hit description =Anthranilate phosphoribosyltransferase-like protein
  Pfam annotation: Domain name=C2; Domain location=102-190; Score=6.7; E_value=0.056; Accession=PF00168.20; Description=C2 domain
MEEFLFVRVVTINDFPTNIDYYVEVMVGDLTASTLLFISPEWNQVKFSIDDVPTRVSPESSTLALQWYKQEGPNGRLVIREIMLCLWMGTQEDESFPNAWCSNSTMVSGDDVVYTRSKGLELELVRESDFFVQVDLGSQHLRTKLSKSPNLLWNEDLVFFAQEPFSDTLFLIVKKATPVKDVTTTLGMHCVTSNLVDDKCAGNSVKNDGHVEGDPQNLAMRRSTRACKQNVHLRVMIIEERHVVGMILSLMHPSSFGAHLFL

SEQ ID NO: 153676 - protein, 64 aa, Glycine max
  Coding DNA Sequence Number=SeqID_36898
  Subcellular localization annotation: CTP_CleavageSite=29; ConfidenceScore=5.22e-01
MSLLITIPFAASRFKTTVLPLAHRIRRYRARYKASNKTKRRRRIKGKKENQQATIPGRLRVKVS

SEQ ID NO: 153677 - protein, 189 aa, Glycine max
  Coding DNA Sequence Number=SeqID_36899
  Gene Ontology: Mol. function=chromatin binding; Cellular component =chromatin; Biological process=chromatin assembly or disassembly
  Homolog annotation: Hit_ID=Q1SAV4; Match level="QueryCoverage=57%, HitCoverage=27%, E-value=1e-26, Identity=58%"; Hit description =Integrase, catalytic region
MAAVKKWRQYILGHCFVILTDHRSLKELMAQAVQTPEQQQIKYDHRRPPGLLCPLPILAQQWKDFSLDFIVGLPSYRGNSVILVIMDRFSKGLHLGALPQHHTTLSVARLFMEISGKLHGMPRSLVSDRDPLFYLEGTSKVEVVDEWLTHRDKIIASLVKKLSKAQKRMKEFADQQRRDVNYTEGDQVL

SEQ ID NO: 153678 - protein, 784 aa, Glycine max
  Coding DNA Sequence Number=SeqID_36900
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=99%, HitCoverage=92%, E-value=0.0, Identity=52%"; Hit description=ERECTA
  Pfam annotation: Domain name=LRR_1; Domain location=101-123; Score =13.9; E_value=0.59; Accession=PF00560.23; Description=Leucine Rich Repeat
  Pfam annotation: Domain name=LRR_1; Domain location=125-147; Score =18.9; E_value=0.019; Accession=PF00560.23; Description=Leucine Rich Repeat
  Pfam annotation: Domain name=LRR_1; Domain location=255-277; Score =18.1; E_value=0.032; Accession=PF00560.23; Description=Leucine Rich Repeat
  Pfam annotation: Domain name=LRR_1; Domain location=279-301; Score =13.9; E_value=0.58; Accession=PF00560.23; Description=Leucine Rich Repeat
  Pfam annotation: Domain name=LRR_1; Domain location=30-52; Score =14.2; E_value=0.49; Accession=PF00560.23; Description=Leucine Rich Repeat
  Pfam annotation: Domain name=LRR_1; Domain location=303-324; Score =11.3; E_value=2.2; Accession=PF00560.23; Description=Leucine Rich Repeat
  Pfam annotation: Domain name=LRR_1; Domain location=326-347; Score =7.9; E_value=9.6; Accession=PF00560.23; Description=Leucine Rich Repeat
  Pfam annotation: Domain name=LRR_1; Domain location=53-74; Score =10.9; E_value=2.6; Accession=PF00560.23; Description=Leucine Rich Repeat
  Pfam annotation: Domain name=LRR_1; Domain location=6-28; Score=10.6; E_value=2.9; Accession=PF00560.23; Description=Leucine Rich Repeat
  Pfam annotation: Domain name=LRR_1; Domain location=77-99; Score =16.2; E_value=0.12; Accession=PF00560.23; Description=Leucine Rich Repeat
  Pfam annotation: Domain name=Pkinase; Domain location=451-717; Score =107.3; E_value=4.4e-29; Accession=PF00069.15; Description=Protein kinase domain
  Pfam annotation: Domain name=Pkinase_Tyr; Domain location=451-717; Score=98.5; E_value=2e-26; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=101-123::125-147::255-277::279-301::30-52::303 -324::326-347::53-74::...
  Pfam module annotation: Domain location=6-28::77-99::451-717::451-717
MCQLTGLWYFDVRNNSLTGSIPENIGNCTAFQVLDLSYNQLTGEIPFNIGFLQVATLSLQGNKLSGHIPPVIGLMQALAVLDLSCNLLSGSIPPILGNLTYTEKLYLHGNKLTGFIPPELGNMSKLHYLELNDNHLSGHIPPELGKLTDLFDFLMESPIILSEMLQTTILRGQFLVILAHQCAWQQVEWINSPFFAEFGEHDLFESFFQQSSGRNSNRTVADWQFGYIVNDFLPRDISNNNLVGSIPSSLGDLEHLLKLNLSRNNLTGIIPAEFGNLRSVMEIDLSNNQLSGLIPDELSQLQNMISLRLENNKLTGDVASLSNCISLSLLNVSYNKLFGVIPTSNNFTRFPPDSFIGNPGLCGNWLNLPCHGARPSERVTLSKAAILGITLGALVILLMVLLAACRPHSPSPFPDGSFDKPVNFSPPKLVILHMNMALHVYEDIMRMTENLSEKYIIGYGASSTVYKCVLKNCKPVAIKRIYSHYPQCIKEFETELETVGSIKHRNLVSLQGYSLSPYGHLLFYDYMENGSLWDLLHGPTKKKKLDWELRLKIALGAAQGLAYLHHDCCPRIIHRDVKSSNILLDADFEPHLTDFGIAKSLCPSKSHTSTYIMGTIGYIDPEYARTSRLTEKSDVYSYGIVLLELLTGRKAVDNESNLHHLILSKAATNAVMETVDPDITATCKDLGAVKKVYQLALLCTKRQPADRPTMHEVTRVLGSLVLSNTPPKQLAALPPASNPSAKVPCYVDEYANLKTPHLVNCPSMSTSDAQLFLKFGEVISQNSE

SEQ ID NO: 153679 - protein, 187 aa, Glycine max
  Coding DNA Sequence Number=SeqID_36901
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=14%, E-value=4e-35, Identity=38%"; Hit description=Chromo
MDLLQGYHQILMVPEDVSKIAFRMHHGHYEFMTFSNHLEHLRTTLQTITDNNFVMKLSKYSFATQQVEYLGHLVSEKGVEPVPVKVAVVQQWPPPYSIRALRGFLGLSGFYHRFIKGYATIAAPFTALMTKDQFHWTLEADQAFLKLKEALCHAPVLGLPDFNSLFVVEIDASGIGMGAILHNTIIL

SEQ ID NO: 153680 - protein, 168 aa, Glycine max
  Coding DNA Sequence Number=SeqID_36902
  Gene Ontology: Mol. function=protein serine/threonine kinase activity; Cellular component=integral to membrane; Biological process=protein amino acid phosphorylation
  Homolog annotation: Hit_ID=Q42371; Match level="QueryCoverage=99%, HitCoverage=52%, E-value=2e-70, Identity=45%"; Hit description=ERECTA
  Pfam annotation: Domain name=LRRNT_2; Domain location=22-63; Score =47.5; E_value=4.4e-11; Accession=PF08263.3; Description=Leucine rich repeat N-terminal domain
  Pfam annotation: Domain name=LRR_1; Domain location=116-138; Score =14.7; E_value=0.34; Accession=PF00560.23; Description=Leucine Rich Repeat
  Pfam annotation: Domain name=LRR_1; Domain location=140-162; Score =10.0; E_value=3.8; Accession=PF00560.23; Description=Leucine Rich Repeat
  Pfam annotation: Domain name=LRR_1; Domain location=68-90; Score=4.7; E_value=38; Accession=PF00560.23; Description=Leucine Rich Repeat
  Pfam annotation: Domain name=LRR_1; Domain location=92-114; Score =13.7; E_value=0.68; Accession=PF00560.23; Description=Leucine Rich Repeat
  Pfam module annotation: Pfam domain module=LRRNT_2::LRR_1::LRR_1::LRR_ 1::LRR_1; Domain location=22-63::116-138::140-162::68-90::92-114
MAFRFGVLILALVICLNFNSVESDDGATLLEIKKSFRDVDNVLYDWTDSPSSDYCAWRGISCDNVTFNVVALNLSGLNLDGEISPAIGKLQSLVSIDLRENRLSGQIPDEIGDCSSLKNLDLSFNEIRGDIPFSISKLKQLENLILKNNQLIGPIPSTLSQIPDLKIL

SEQ ID NO: 153681 - protein, 50 aa, Glycine max
  Coding DNA Sequence Number=SeqID_36903
MAMPMPLFWGLHSNSIFETFLDKKSNADVKRTMVERSDSNVNGVRLYENR

SEQ ID NO: 153682 - protein, 59 aa, Glycine max
  Coding DNA Sequence Number=SeqID_36904
MFMTLGYAFRLFWVKKTRFREEKSSRSASVMLPRCFREQICEDFPPFFTILRSSTAKSN

SEQ ID NO: 153683 - protein, 97 aa, Glycine max
  Coding DNA Sequence Number=SeqID_36905
MGSHQRCPMPASYVLLRICILIFPELDAPLSMERPSFDGLEALLVLGAPETVAIKLGGGTGPFHCGVSPRPLRGKLFQSHFLRRQTFGKSIYKEMPF

SEQ ID NO: 153684 - protein, 165 aa, Glycine max
  Coding DNA Sequence Number=SeqID_36906
  Gene Ontology: Mol. function=DNA binding; Biological process=DNA integration
MAKSEEMKSLQKNKIWDLVELPKEVIPLCAEAISKVVVENSSHIYPLIFVDGMLKASQNLLVIQKLKSLLSSEFETNDTEKIIGMEIKRDRSRRKSFCVRRNTVRKSYLAQKISGGSRYMGNPGKEHWQATKRIFVYLKGTTNIGLIYHGDTYYALAGFSYYDYA

SEQ ID NO: 153685 - protein, 220 aa, Glycine max
  Coding DNA Sequence Number=SeqID_36907
  Homolog annotation: Hit_ID=Q5LQB5; Match level="QueryCoverage=99%, HitCoverage=69%, E-value=2e-41, Identity=45%"; Hit description =Membrane protein, putative
MSAVDRRLHGLDLARYLALAGMVLVNFRLAMAVPAEGEGWLAGVVAGQCADLAARTVPDGAGPTQPDPVPSRYPALLRGVFRVGRAVAACLAAGVAGQHRGPGGLFVLGVAALGLQPGMELAGAGIHRSVAMAGRGPQPAVQRLPSAAAVAVLLPAGDAAGTPATVAAAGPARAAGAGPAADRGWTWRAAACAGNALAGVAGNAADAAGTGLRTHGCGRG

SEQ ID NO: 153686 - protein, 107 aa, Glycine max
  Coding DNA Sequence Number=SeqID_36908
HFVSKRPYRGNTGSNKDRRKSLKVYQSHTVCGEKVASAQDFVGNQRERTTLGRGQGLTFSPWVKVYDKLGFWLKACRTGGHDICQGLASGSGIKGMSYIISMIHMQQ

SEQ ID NO: 153687 - protein, 57 aa, Glycine max
  Coding DNA Sequence Number=SeqID_36909
MIFLPSFMEKFPGAIVDIALVGPRIICWALPRSSNFTIFSFCPFIKGLWIDSYELNP

SEQ ID NO: 153688 - protein, 419 aa, Glycine max
  Coding DNA Sequence Number=SeqID_36910
  Gene Ontology: Mol. function=ligand-dependent nuclear receptor activity; Cellular component=nucleus; Biological process=regulation of transcription, DNA-dependent
  Homolog annotation: Hit_ID=P04929; Match level="QueryCoverage=78%, HitCoverage=84%, E-value=7e-18, Identity=21%"; Hit description =Histidine-rich glycoprotein precursor
  Pfam annotation: Domain name=Extensin_1; Domain location=105-114; Score=4.0; E_value=14; Accession=PF02095.6; Description=Extensin -like protein repeat
  Pfam annotation: Domain name=Extensin_1; Domain location=116-125; Score=6.9; E_value=1.6; Accession=PF02095.6; Description=Extensin -like protein repeat
  Pfam annotation: Domain name=Extensin_1; Domain location=127-136; Score=5.7; E_value=4; Accession=PF02095.6; Description=Extensin-like protein repeat
  Pfam annotation: Domain name=Extensin_1; Domain location=137-146; Score=7.3; E_value=1.2; Accession=PF02095.6; Description=Extensin -like protein repeat
  Pfam annotation: Domain name=Extensin_1; Domain location=148-157; Score=7.3; E_value=1.2; Accession=PF02095.6; Description=Extensin -like protein repeat
  Pfam annotation: Domain name=Extensin_1; Domain location=159-168; Score=7.3; E_value=1.2; Accession=PF02095.6; Description=Extensin -like protein repeat
  Pfam annotation: Domain name=Extensin_1; Domain location=170-179; Score=7.3; E_value=1.2; Accession=PF02095.6; Description=Extensin -like protein repeat
  Pfam annotation: Domain name=Extensin_1; Domain location=181-190; Score=7.3; E_value=1.2; Accession=PF02095.6; Description=Extensin -like protein repeat
  Pfam annotation: Domain name=Extensin_1; Domain location=192-201; Score=7.3; E_value=1.2; Accession=PF02095.6; Description=Extensin -like protein repeat
  Pfam annotation: Domain name=Extensin_1; Domain location=208-217; Score=7.3; E_value=1.2; Accession=PF02095.6; Description=Extensin -like protein repeat
  Pfam annotation: Domain name=Extensin_1; Domain location=224-233; Score=7.3; E_value=1.2; Accession=PF02095.6; Description=Extensin -like protein repeat
  Pfam annotation: Domain name=Extensin_1; Domain location=240-249; Score=7.3; E_value=1.2; Accession=PF02095.6; Description=Extensin -like protein repeat
  Pfam annotation: Domain name=Extensin_1; Domain location=251-260; Score=7.3; E_value=1.2; Accession=PF02095.6; Description=Extensin -like protein repeat
  Pfam annotation: Domain name=Extensin_1; Domain location=267-276; Score=7.3; E_value=1.2; Accession=PF02095.6; Description=Extensin -like protein repeat
  Pfam annotation: Domain name=Extensin_1; Domain location=283-292; Score=8.6; E_value=0.46; Accession=PF02095.6; Description=Extensin -like protein repeat
  Pfam annotation: Domain name=Extensin_1; Domain location=294-303; Score=7.7; E_value=0.89; Accession=PF02095.6; Description=Extensin -like protein repeat
  Pfam annotation: Domain name=Extensin_1; Domain location=304-313; Score=9.8; E_value=0.2; Accession=PF02095.6; Description=Extensin -like protein repeat
  Pfam annotation: Domain name=Extensin_1; Domain location=314-323; Score=9.6; E_value=0.22; Accession=PF02095.6; Description=Extensin -like protein repeat
  Pfam annotation: Domain name=Extensin_1; Domain location=324-333; Score=10.4; E_value=0.13; Accession=PF02095.6; Description=Extensin -like protein repeat
  Pfam annotation: Domain name=Extensin_1; Domain location=334-343; Score=10.4; E_value=0.13; Accession=PF02095.6; Description=Extensin -like protein repeat
  Pfam annotation: Domain name=Extensin_1; Domain location=34-43; Score= 4.3; E_value=11; Accession=PF02095.6; Description=Extensin-like protein repeat
  Pfam annotation: Domain name=Extensin_1; Domain location=344-353; Score=10.4; E_value=0.13; Accession=PF02095.6; Description=Extensin -like protein repeat
  Pfam annotation: Domain name=Extensin_1; Domain location=354-363; Score=10.4; E_value=0.13; Accession=PF02095.6; Description=Extensin -like protein repeat
  Pfam annotation: Domain name=Extensin_1; Domain location=371-380; Score=1.2; E_value=1e+02; Accession=PF02095.6; Description=Extensin -like protein repeat
  Pfam annotation: Domain name=Extensin_1; Domain location=381-390; Score=9.3; E_value=0.28; Accession=PF02095.6; Description=Extensin -like protein repeat
  Pfam annotation: Domain name=Extensin_1; Domain location=397-406; Score=4.4; E_value=9.9; Accession=PF02095.6; Description=Extensin -like protein repeat
  Pfam annotation: Domain name=Extensin_1; Domain location=45-54; Score= 0.6; E_value=1.6e+02; Accession=PF02095.6; Description=Extensin-like protein repeat
  Pfam annotation: Domain name=Extensin_1; Domain location=57-66; Score= 3.7; E_value=17; Accession=PF02095.6; Description=Extensin-like protein repeat
  Pfam annotation: Domain name=Extensin_1; Domain location=67-76; Score= 8.0; E_value=0.72; Accession=PF02095.6; Description=Extensin-like protein repeat
  Pfam annotation: Domain name=Extensin_1; Domain location=78-87; Score= 5.7; E_value=4; Accession=PF02095.6; Description=Extensin-like protein repeat
  Pfam annotation: Domain name=Extensin_1; Domain location=89-98; Score= 5.7; E_value=4; Accession=PF02095.6; Description=Extensin-like protein repeat
  Pfam module annotation: Pfam domain module=Extensin_1::Extensin _1::Extensin_1::Extensin_1::Extensin_1::Extensin_1::Extensin _1::Extensin_1::Extensin_1::Extensin_1::Extensin_1::Extensin _1::Extensin_1::Extensin_1::...
  Pfam module annotation: Pfam domain module=Extensin_1::Extensin _1::Extensin_1::Extensin_1::Extensin_1::Extensin_1::Extensin _1::Extensin_1::Extensin_1::Extensin_1::Extensin_1::Extensin _1::Extensin_1::Extensin_1::...
  Pfam module annotation: Pfam domain module=Extensin_1::Extensin _1::Extensin_1; Domain location=105-114::116-125::127-136::137 -146::148-157::159-168::170-179::181-190::192-201::208-217::224 -233::240-249::251-260::267-276:...
  Pfam module annotation: Domain location=:283-292::294-303::304 -313::314-323::324-333::334-343::34-43::344-353::354-363::371 -380::381-390::397-406::45-54::57-66::67-76::78-87::89-98
MTYVHSLMLLLLGVVVLTTTPVLANFFPPIYEPPPIEKPPIFEPPPTYEPPPTEKPPPLYKPPFYPPPLYQPPYEKPPPEYQPPHEKPPPEYQPPHEKPPPEYQPPHQKPPHEKPPPEYKPPHEKPPPEYQPPHEKPPVYEPPHEKPPPVYEPPHEKPPPVYEPPHEKPPPVYEPPHEKPPPVYEPPHEKPPPVYEPPHEKPPHEKPPPVYEPPHEKPPHGKPPPVYEPPHEKPPHGKPPPVYEPPHEKPPPVYEPPHEKPPHGKPPPVYEPPHEKPPHGKPPPVYEPPYEKPPPVYQPPHEKPPIYKPPYEKPPIHKPPFEKPPIYKPPFEKPPIYKPPFEKPPIYKPPFEKPPIYKPPFEKPPVYEPPPLVKPPPFEKPPFYKPPFEKPPLYEPPPLVKPPIYNPPPYGHYPPSKKN

SEQ ID NO: 153689 - protein, 167 aa, Glycine max
  Coding DNA Sequence Number=SeqID_36911
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=2e-18, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGPHSLAFRELHAFTFRESCTFTFRGLHVLASRGLHVLAFRGLHVLAFRGLHALTLRGLHVLTFRGLRVLTFIGLHVLAFRRLHILTFKGLHVLAFKGSHALAFRGLHVLAFRGLYVLPLRGLHALAFRGRHVLAFGGLHTPSPLEGYASLLLEGSSSAP

SEQ ID NO: 153690 - protein, 112 aa, Glycine max
  Coding DNA Sequence Number=SeqID_36912
ELSLFWKRVSSSIVNDFFSWETPLFLLPRTGMEILILGQGLWWFEVLGQKACRTTEHDVCQGVGLASGSGIKGMSHIYFHDTHTTMMIWKFYAKLVMHAPMWTLKRQVFMVM

SEQ ID NO: 153691 - protein, 543 aa, Glycine max
  Coding DNA Sequence Number=SeqID_36913
  Homolog annotation: Hit_ID=Q535K6; Match level="QueryCoverage=93%, HitCoverage=88%, E-value=0.0, Identity=59%"; Hit description=Nitrate and chloride transporter
  Pfam annotation: Domain name=MFS_1; Domain location=1-433; Score=7.6; E_value=0.00014; Accession=PF07690.6; Description=Major Facilitator Superfamily
  Pfam annotation: Domain name=Nodulin-like; Domain location=1-222; Score=334.6; E_value=1.7e-97; Accession=PF06813.4; Description =Nodulin-like
  Pfam module annotation: Pfam domain module=MFS_1::Nodulin-like; Domain location=1-433::1-222
MAVSGATYMFGLYSNEVKASLGYDQSTLNLISFFKDLGANLGIFSGLINEISPPWVILAMGATMNFIGYFMIWLSVTSRIAKPQVWQMCLYFYIGANSQSFANTGALVNCVKSFPRSRGSVIGLLKGYVGLSGAIFTQFYHAFYGDDSKALIFLIGWLPAAISFIFLPTVRVLSITPQPKEIKGFLMVLIVVQNKLSFTRVEFIVDGMVVLLVLLLPLGIVFKEEFKIWKNQNQNFTDAAASVVELSQPEEAPSHSERKNNNSCLKNVFKPPKRGEDYTIFQALFSIDMLILFIATVFGVGGTLTALDNLGQIGNSLGYPKKSLTTFVSLVSIWNYLGRASSGFVSEYLLTKYKFPRPLLLTLVMLLSCVGHILIAFGIPNSLYFSSVIIGFCFGAIWPLMFAIISEIFGLKYYSTLYNFGAVASPVGSYILNVRVTGYLYDKEALKQLGVKGLIRQKGKDLTCVGVQCYRMAFLIITASTLVGCVVSFILVLRTRNFYKGDIYEKFRVVELDTGESLPTFGSTGTTTTTTNRTEEPDKINRK

SEQ ID NO: 153692 - protein, 1098 aa, Glycine max
  Coding DNA Sequence Number=SeqID_36914
  Gene Ontology: Mol. function=RNA-directed DNA polymerase activity; Cellular component=chromatin; Biological process=chromatin assembly or disassembly
  Pfam annotation: Domain name=Chromo; Domain location=986-1040; Score =25.6; E_value=0.00017; Accession=PF00385.14; Description='chromo' (CHRromatin Organisation MOdifier
  Pfam annotation: Domain name=zf-H2C2; Domain location=702-743; Score =17.1; E_value=0.002; Accession=PF09337.1; Description=His(2)-Cys(2) zinc finger
  Pfam module annotation: Pfam domain module=Chromo::RVT_1::zf-H2C2; Domain location=986-1040::390-559::702-743
MDSRYQEYSQHRAADLARMDRLESHLSSVQMGSPSAGSHSHNAVPSSPPPFQVCNIKLDFPRFDGSDVLHWVFKAEQFFDYYSTPDAHRLTIAAVHLEKDVFGPSPYDSPRATLFKLTHTTSVNDYYLEFTALANRTQGISPDALLDFFISGLKPNIRRDVISQSPFSMSKAVSLARLFEEKYAPKPKPYFASTGLCYTCDDKFSINHKCPNQQYLLLLGDDEDTFTPELEPPDAPTNDNSLTAHEHHLSFNALKGSHGLGTLRFQGSIQGIKLQILLDSGSSDNFLQPRIAHCLKLPVLPAENFSVLVGNSNCLTAEGYIPNLQVHVQGHVLQLPVYLLPVTGADLVLGAPWLATLGPHIANYSALTLKFYLGDSFVLFLRAPTQSSTSPFSSPVLLVKKKDGTWRFCTDYRALNAITIKDSFPIPTVDELLDELGGATHFSKLDLRSGYHQILVKPEDRYKMAFKTHQGLCEWLVMPFGLTNAPASFQSLMNHVFHQQLCKSVLVFFDDILVYSPSWSAHLLHLEEVLQLLRQHCLFAKLSKCSFGLTKVDYLGHTVSGNGVEMDQSKVQAVLDWPSPTSIKQLRGFLGLTGYYRRFIQGYASIALPLTSLLKKDSFKWDAQADLAFQQLKQAITHAPVLALPDFTQPFTLETDASGSGIGAILSQGSHPIAYFSKRLTVKMLVVPQQPELITSILKEYHSSPIGGHSGISRTKARIARQFYWPSMKKDIRVLLSECLTCQQAKSSNTVPAGLLQPLPIPFQVWEDVAMDFITGLPPSNGYTVILVVVDRLSKYGHFAPLKADFSSLKVAETFMHSVVKLHGFPKSIVSDRDKIIPDPGLDCSRGQNFGIIPLFIAASEMLMERDVVIVQLKANLTKAQIFMKKFADSKRRAMDFNIGDMVLVKLQPYRQHSVALRSNQKLGLRYFGPFPIIEKIGEVVYKLMLPPSAKIHPVFHISLLKPCKGVHDTQYMPLPLLTNENGPLLIPKSILQFRILLRNNQHVPQVLVHWEGLPGSEATWKDWVPLHHAYPSLNLEDKVVFNGGSNVMTENATCEMTPGLTDSVKGRGQVAIDPDNQVVRRGNRERKHNRKYVEDYV

SEQ ID NO: 153693 - protein, 277 aa, Glycine max
  Coding DNA Sequence Number=SeqID_36915
MKQWCKALKKEQWREASKNEYNNNSDRDISDGHNDCHSDGGGSGIGGDSDKGGISGNDGSGGDDGGDSDNGGNKWWRCSGGELHSRRLGRWLKNWSSSLSASTTAQLEEPTWRSGLAHIYGLACMRAKPASDGLARICDLVHNHLCQLDCGLASMCRLSARNGGSIVSSGDSGDNDNGDSSNTDGDVNVMVADDTNAGRGDVDGGSGDDDYGGDNDDDDGDSVVVAMTKVIEVVVMEVAVVWCDNDKSCIGGSGDDSDNGDNSAIEGSGGDNKKYYY

SEQ ID NO: 153694 - protein, 1291 aa, Glycine max
  Coding DNA Sequence Number=SeqID_36916
  Gene Ontology: Mol. function=nucleic acid binding; Cellular component= nucleus; Biological process=regulation of transcription, DNA-dependent
  Homolog annotation: Hit_ID=Q1S136; Match level="QueryCoverage=99%, HitCoverage=98%, E-value=0.0, Identity=52%"; Hit description=SNF2 -related; ATP-requiring DNA helicase RecQ
  Pfam annotation: Domain name=DEAD; Domain location=711-925; Score= -46.4; E_value=0.047; Accession=PF00270.19; Description=DEADDEAH box helicase
  Pfam annotation: Domain name=Helicase_C; Domain location=1131-1210; Score=54.1; E_value=4.8e-13; Accession=PF00271.21; Description =Helicase conserved C-terminal domain
  Pfam annotation: Domain name=ResIII; Domain location=707-919; Score= -4.4; E_value=0.00011; Accession=PF04851.6; Description=Type III restriction enzyme, res subunit
  Pfam annotation: Domain name=SNF2_N; Domain location=713-1063; Score =11.6; E_value=9.6e-09; Accession=PF00176.13; Description=SNF2 family N-terminal domain
  Pfam module annotation: Pfam domain module=DEAD::Helicase _C::ResIII::SNF2_N; Domain location=711-925::1131-1210::707-919::713 -1063
FEAVAFGSWQAVEFIKIEAGTMSMHFADNHHVVMEKGPLSDIRIRSRKATLPDCSRFLRPGIDVCVLSAPQQSDDADAGINLDPVWTDAKISSVQRKPHDSECSCQFYVNFYVHQGSLGAELRTLNKEIKVVGINQISILQKLESTPCENQHYRWASSEDCSIISHTKLLLGKVLCDLSWLVVTTALKKKVSFCVRSLEDKLVYQVLERDTTVSTSLNNESHIDVVNFKTEKGTLFSIVSQVATLKTKRVEPEQESHEDKESPSYNVEGLRRSKRRNVQPERYLGCEKVSQIDVGSFRNLPPVKINTWKDDDVDHEMNIPLAGLFSLQKKFLEGDTDNHQKVKKASSCRELVVYQRKKTKSQKVKSGGDDQNEHQNHLAIIALPAQHDPVEVIHCDDLNDKVTRSYGHESSEVSSKYRHLIGTTSKKNDIKLLTFESHNHAAKSDDADKIDDLSSRYHYSYGTPKSQRMGLSDLDDMVDLGNKWEGISSSKGFQGKKQRTTYLRSRDHGEQKRYNYKDRSLNAAAYKDLINSYLKNMNTRPTNEESAIADQWKQSETPSNIGQKTETQMLDEEDAEEESEMDMLWRELEVSLASCYLEEETEDSHAAVFTETLENPNPGCPHDFRMNEEIGIYCYRCGFVSTEIKYITPPFIQHSVRHQEEKQSPEEDSKTKPDEDDDIDLLPALDSPEKLVSQENENVWALIPELKAKLHAHQKKAFEFLWQNIAGSMDPELMETASKRRGGCVISHTPGAGKTFLIIAFLVSYLKLFPGKRPLVLAPKTTLYTWYKEFIKWDIPIPVYLIHGRRTYRVFKQKSSIVIPGVPKPTDDVKHVLDCLEKIQKWHSHPSVLIMGYTSFLTLMREDSKFAHRKYMAKVLRESPGIMVLDEGHNPRSTKSRLRKVLMKVQTELRILLSGTLFQNNFCEYFNTLCLARPKFIHEVLKALDSKYKRKGKVAKKASHLLESRARKFFLDQIAKKIDSNNGRERRQGLKMLRNVTNGFIDVYEGRSSDGLPGLQIYTLLMNSTDTQHEILHELHKKMARVNGYPLELELLITLGSIHPWLVKSAVCAEKFFTPAQLMELEKCKFDLRIGSKVKFVLSLIYRVVKKEKVLIFCHNIAPVKLFVEYFEKYFGWTKGREVLVLSGELELFERGRVMDKFEEPGGVAKILLASITACAEGISLTAASRVIMLDSEWNPSKTKQAIARAFRPGQQKVVYVYQLLVTGSLEEDKYKRTTWKEWVSSMIFSEAFVEDPSQWQAEKIEDYILREMVAEDRSKSFHMIMKNEKTSTNK

SEQ ID NO: 153695 - protein, 66 aa, Glycine max
  Coding DNA Sequence Number=SeqID_36917
MAKKEKHETLKKINQISKVLTSMYRPHMIYVAWVTWPFICTEQKEAKVGIKRCHSKNKGHYLGRNY

SEQ ID NO: 153696 - protein, 285 aa, Glycine max
  Coding DNA Sequence Number=SeqID_36918
  Subcellular localization annotation: CTP_CleavageSite=47; ConfidenceScore=5.58e-01
MCHTLISSGDLCLMTCDLSLVLVRKSKPRRFRNIFVTFSVRNFAKVSTVLRRSSFVLHRSSIFNGLPSLGTDVWGANTFPVRKYNSRTFHLKVRRSRLFWFFRRFPQINVGGDSGRIPFVEHASRESRVALPPKGRLRHNLIHIGFKTPNSFPPTHSVSQTLSPSLSSPSSTTLHFEHSRSFRVTINASEPVTGPRVGVHHYYREIEVHGCLIFLDFEHSVYFPHVLRAFIEVRDCFFSNCEHLGLLKTLLSIIFITYLKIHSVEVRGWECCSARFLCEYFSPPK

SEQ ID NO: 153697 - protein, 104 aa, Glycine max
  Coding DNA Sequence Number=SeqID_36919
  Subcellular localization annotation: CTP_CleavageSite=42; ConfidenceScore=5.65e-01
MTFVSSSQQTSTIALTSFSIQRVTGSPPPMTEMRTLPLYQLSSFAIVGGKVNRNPRFSHHRGLRKGTLGCRTPLSSASRVPDFLTTVTSTSCPLVVAPCKCSPR

SEQ ID NO: 153698 - protein, 554 aa, Glycine max
  Coding DNA Sequence Number=SeqID_36920
  Gene Ontology: Cellular component=chloroplast inner membrane
  Pfam annotation: Domain name=UPF0114; Domain location=121-247; Score =52.7; E_value=1.3e-12; Accession=PF03350.6; Description =Uncharacterized protein family, UPF0114
  Subcellular localization annotation: CTP_CleavageSite=39; ConfidenceScore=5.44e-01
MATTTRLLLRSSKPIQLAPSPPSSSSNSLYMKCVRYQSMASLNENHHNIGSVKGERKPVGAVKATIATTNHITTSKPVIQQGLSDLATLIASIRNAVLVFLRTFVKRKPRNLRPQMLIEKAIIDCRFFTLFAVAGSLIGSVLCFVEGCLLVIESYAHYFHMLSQRLDQGHLVHLLIEAIDSFLMGTALLIFGVGIYVMFVGSSTTSKETQPQLCGSNLLGSGSKSGDGEHGGANCGVSSSSSVTKMSTCDLERISRCNGNTVPFFGGLRALPVRLSGYGCRGGCWRVIWWWSASIHELFFISSKQTSSTNLRYDLLKTQIQTNRRLSMNVAEAYTTNPWDLHMSMTQNGNATHGGTLTMKKATHYGASIGTMQGLVLPCRMMLSSTVPNPAWSDNSLNWTLAASVLPKKMVAFMVVDGLLLVASYAEEDRQFLYSWQVETLASRNAEKKKMKVAYILIALNTLLQAIYKAKLHAFLIGCARSLPSIASPPRWVGMQSIAQAKSKIGHAVMMILQVGLLDKFKDIPLVTGLDLACFAAAVLTSSACIFVLSKLHH

SEQ ID NO: 153699 - protein, 284 aa, Glycine max
  Coding DNA Sequence Number=SeqID_36921
  Gene Ontology: Mol. function=transcriptional repressor activity; Biological process=regulation of nitrogen utilization
  Homolog annotation: Hit_ID=O48601; Match level="QueryCoverage=42%, HitCoverage=38%, E-value=2e-49, Identity=79%"; Hit description =NADPH:isoflavone reductase
  Pfam annotation: Domain name=NmrA; Domain location=82-284; Score =83.0; E_value=9.2e-22; Accession=PF05368.3; Description=NmrA-like family
MDFTAEKKESESNTENAHPTTLDSSSQLASALDSNNKEIEERQARELKAVMFVSLYLLYCFEAVWSMDGLSDNMTMPINLKAKVVVAAHDKDINSVVVAPNDSLVCSGSQAISDGSCLKTFEGHTSSVLRALFVTCGTQIVSCGMRLSVADFVLYNILVVEKARIRRIIEAEGIPYTYLCCHAFIDYFLCNLAQIDITVPPRDKVFILGDGNVKGAFVTEADVGTLTIEAANEPNALNKTVRIRLPKNYLTINEIISLWENKIGKTLEKTYVSEEKVLKDIKGR

SEQ ID NO: 153700 - protein, 61 aa, Glycine max
  Coding DNA Sequence Number=SeqID_36922
  Homolog annotation: Hit_ID=Q1SI48; Match level="QueryCoverage=62%, HitCoverage=7%, E-value=6e-10, Identity=82%"; Hit description=AMP -dependent synthetase and ligase
MVKQGLGGRVHLILSGVAPLSAHVEGYLQVVTCALVLQGYEDIVDIFMVLVLDYGLDVLSL

SEQ ID NO: 153701 - protein, 123 aa, Glycine max
  Coding DNA Sequence Number=SeqID_36923
MTYFDGINDGGSLLGDNAGGHIDQNTSLKIKTKKKPSRRKHGKAYKSISLDVLQHYFTGSLKDAAKSHGGALGLNSLSTISLAIAAGSFSELSTSNKFNRQTSLTIRPSEPKINEKDFDASRA

SEQ ID NO: 153702 - protein, 74 aa, Glycine max
  Coding DNA Sequence Number=SeqID_36924
MAAKHQRIHHVHDVKAPHGPLVPQNIAKSYDKGIPHLTFLVMHSKPPKRRRSYCYRHMTETSMRAGNATIVYLI

SEQ ID NO: 153703 - protein, 827 aa, Glycine max
  Coding DNA Sequence Number=SeqID_36925
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=93%, HitCoverage=88%, E-value=0.0, Identity=52%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=68-187; Score =136.5; E_value=7.4e-38; Accession=PF01453.15; Description=D-mannose binding lectin
  Pfam annotation: Domain name=PAN_2; Domain location=346-414; Score =103.7; E_value=5.5e-28; Accession=PF08276.2; Description=PAN-like domain
  Pfam annotation: Domain name=Pkinase; Domain location=512-783; Score =147.8; E_value=3e-41; Accession=PF00069.15; Description=Protein kinase domain
  Pfam annotation: Domain name=Pkinase_Tyr; Domain location=512-783; Score=126.4; E_value=8.1e-35; Accession=PF07714.7; Description =Protein tyrosine kinase
  Pfam annotation: Domain name=S_locus_glycop; Domain location=201-328; Score=148.2; E_value=2.2e-41; Accession=PF00954.11; Description=S -locus glycoprotein family
  Pfam module annotation: Pfam domain module=B_lectin::PAN _2::Pkinase::Pkinase_Tyr::S_locus_glycop; Domain location=68-187::346- 414::512-783::512-783::201-328
MAILLTMLVIFILLLLSCDSTTLTITQFQPLSDGTTLVSKDGTFEVGFFSPGSSTNRYLGIWFKNIPIKTVVWVANHDNPINTTTTPTKLTITKEGNLALLNKNNSVIWSANTTTAKATNVVAQLLDTGNLVLQDEKEINSQNYLWQSFDHPSDTILPGMKIGWKVTTKGLHLNRYITAWNNWEDPSSANFTYSVSRSNIPELQQWNGSTMLYRSGPWNGIRFSATPSLKHHPLFTYNFVYDTEECYFQFYPRNSSLISRIVLNRTLYALQRFIWAEESNKWELSLTVPRDGCDGYNHCGSFGYCGSATVSSMCECLRGFEPKSPQNWGAKNWSEGCVPNSKSWRCKEKNKDGFVKFSNMKVPDTNTSWINRSMTLEECKEKCWENCSCTAYGSSDILGKGNGCILWFGDLLDLRLLPDAGQDLYVRVHITEIMANQNEKGGSRKVAIVVPCIVSSVIAMIVIFSFVYWRTKTKFGGKGIFKTKVKINESKEEEIELPLFDFDTIACATNHFSSDNKVSQGGFGPVYKGTLLDGQEIAVKRLSHTSAQGLTEFKNEVNFCSKLQHRNLVKVLGCCIDEQEKLLIYEYMSNKSLDFFLFDSSQSKLLDWPMRFSIINGIARGLLYLHQDSRLRIIHRDLKASNILLDNDMNPKISDFGLARMCRGEQIEGNTRRIVGTYGYMAPEYAIDGVFSIKSDVYSFGVLLLEVLSGKKNKGFSYSNNSYNLIAHAWRLWKECIPMEFIDTCLGDSYTQSEALQCIHIGLSCVQHQPDDRPNMRSIIAMLTSESVLPQPKEPIFLTENVSAEDDLGQMVNYSTNEVTMSGMEPR

SEQ ID NO: 153704 - protein, 185 aa, Glycine max
  Coding DNA Sequence Number=SeqID_36926
MLNPTQFQAKEEKVQVADNSLNECHPLSETYSSLSGLGNPRRGLVRDVLAQRAARPPSEVELKGPRAFKTLKLAEIKERELERAHKRKLRRHKEDRLMMVDVVGTRCVAMATCKHSNTKDINYPMPDPYHGHETYIVMEQSLKHEVKELEYMMPSGNVWRSYLVGLSIGPLLGKAILWNNFRPNE

SEQ ID NO: 153705 - protein, 70 aa, Glycine max
  Coding DNA Sequence Number=SeqID_36927
  Subcellular localization annotation: CTP_CleavageSite=47; ConfidenceScore=5.08e-01
MSSSQPYQVFLFCYFSLTPRPVPPSVDLIVMSVALSYVNLRRHYLVNCATIAAQFGGGNPTRFLRKLTKD

SEQ ID NO: 153706 - protein, 71 aa, Glycine max
  Coding DNA Sequence Number=SeqID_36928
DRTPSPPPQRDDSALMIEVLSELWGLRSYVGECFDSLDTRFAGMDIRLTQLEEDVGYIRQSFDLPPPSPPS

SEQ ID NO: 153707 - protein, 213 aa, Glycine max
  Coding DNA Sequence Number=SeqID_36929
  Gene Ontology: Mol. function=DNA-directed DNA polymerase activity; Cellular component=intracellular; Biological process=DNA replication
  Homolog annotation: Hit_ID=Q8PF75; Match level="QueryCoverage=55%, HitCoverage=13%, E-value=4e-38, Identity=73%"; Hit description=DNA polymerase I
MERMRQQARDQGYVETLFGRRLYLNDIHARNQGLRAGAERAAINAPMQGTAADIIKRAMVDVDQWLRDSGAPARMILQVHDELVFETESGGAHVASGQTARAAGGRYRHRQQLGRSTLGSRNGDSSPSARSPAPLTSPWSAGLFICAAGIADGVAFAHRAKGSDPRADHAVRRAVDRAAGQCGAERAAGHRYLAGRWPAAGRNPDPAQLWGRL

SEQ ID NO: 153708 - protein, 67 aa, Glycine max
  Coding DNA Sequence Number=SeqID_36930
MDVDEAMSKEINEVKFMGLGAIATIDIEESNSNTKGKRQEKMGDKVNNEDIQEVLCEIPLIPDLNRQ

SEQ ID NO: 153709 - protein, 77 aa, Glycine max
  Coding DNA Sequence Number=SeqID_36931
MPLQGEDELRTSSPRKEAMDKSLKVGEMSGRRRRMSCGTKFGAKISLIMISEFQLWFSPLIQDSLLSVLRCHEACKA

SEQ ID NO: 153710 - protein, 78 aa, Glycine max
  Coding DNA Sequence Number=SeqID_36932
TYSFKVDGEQREQESIDGEEDREKDKTTRRRQNIPRYGGEGEESETCDDARVRQTRCSDAHRDGFARWRLEEEESPKA

SEQ ID NO: 153711 - protein, 188 aa, Glycine max
  Coding DNA Sequence Number=SeqID_36933
MTQDSFVPHGHEDILNTAIRGPKHLGRVRVVGSGVTINQYFGQARCASNSSSTSINPLQLAELIGNLKEEWKREGNCAEIATNPSGEKHVVNVMPTIGLYVQDVDSTRLVALPKIYDGASTIHNLPYANDVVNVSVGEVYDGNAQVLFSMLEVQYVRQALDTFIAWSTYLVKPVSLKDEPVHRWTLVG

SEQ ID NO: 153712 - protein, 92 aa, Glycine max
  Coding DNA Sequence Number=SeqID_36934
AGDHDLSFPDFHKLPNDGCQAPHKDQRKVACHQAKARRLWMIQGCRMTKFGLCLSSGPPPLDDKRVRITVRYLRVSSGPPPLDDTRVQNDRK

SEQ ID NO: 153713 - protein, 99 aa, Glycine max
  Coding DNA Sequence Number=SeqID_36935
  Gene Ontology: Mol. function=DNA binding; Biological process=DNA integration
MSPYRVVFGNACHLPVEIEHKAYWAVKTCNFSMDQAGEERKLQLSELDEICLEAYENAKFYKEKTKNFSFGLLFTFLAVFPSPINPHSLLLIYARFVFD

SEQ ID NO: 153714 - protein, 1009 aa, Glycine max
  Coding DNA Sequence Number=SeqID_36936
  Homolog annotation: Hit_ID=Q2QN61; Match level="QueryCoverage=22%, HitCoverage=22%, E-value=2e-10, Identity=30%"; Hit description =Expressed protein
  Pfam annotation: Domain name=DUF863; Domain location=74-999; Score =311.0; E_value=2.2e-90; Accession=PF05904.2; Description=Plant protein of unknown function (DUF863)
VFELHRLYRIQRDLMDEVKMKDLYRNHISVEKSFSTGPLASQLTSEDGKKWHVPGFPIVGSSTCARPSISGVEGIHSPLSSNKGISKQAGLFPSPNGSSSSKDVEILGFRPSKVRRKMFDLHLPADEYIDTEENEKPGDEKISGTTNFLSDRSYKHEKGGDMDLFSGNGGKTGGQEDISRPKQSLRSRNSLADLNEPVHVEETHDVAYVPPQNHNSYQGATECSDLSAKQKLRFFGLSKEDLLNSHHGTDSWARNNGYLDNDRNGKMWISSIESGQAKSNPKTIPQLLKQDQSLLSSQTMQDELSKSHEPTSDYLTNGSKTDLLREKTASGLDISERNHESSANKLSESVASSHRHGLFAIAPSSDLARSWSHSSWDMASSTLNQKFISVQTPPSPCLNASGSLSRSSQSHQSNGMLGDSWPLNINSKLNPGFRCEASGKNGFYPGTLSGSKELSVNISSISYLNHDSDCKKFPEHFNNGPANCYKSSNLNSNCYDMKSAKNINLNEILSNASSNNLVSQSGLGIMDGEQKHEEQLAVLPWLRAKTTCKNVAQNAGGLNVFQVSSSSNKEETGKGSNGKFIHNVTTGLFSNDIELKRREVSESSSKRKILGVPIFDIPHISAKELSSFMSPSVSVPNPSDVELVGNYRKEQILDINLPCDAAVPELDVQAVATVIVCETGLSTTKANSRNQIDLNLSMNEDEAFVTNIPATNLETKAEIDLEAPAVSETEEDAIPEEKKLETPLVSLLGPQDTVEKPQDELMRYAAEAIVVLSSSCCQQVDDVISSPSEGPVVDPLSWFVDIVSSCVDDLQKKTDNSREKNIEDNEESSSDGMDYFESMTLKLTETKEEDYMPQPLVPENFKVEEIGTTSLPTRTRRGPARRGRQRRDFQRDILPGLASLSRHEVTEDLQTFGGLMKATGHAWNSGLNRRSSSRNGCGRGRRRSQAQVTPTPPPPPVATVETSTPLIQQLSNIEVVGLEDRSLAGWGKTTRRPRRQRFPAGNPPSIRLI

SEQ ID NO: 153715 - protein, 836 aa, Glycine max
  Coding DNA Sequence Number=SeqID_36937
  Gene Ontology: Mol. function=DNA binding; Cellular component=beta -galactosidase complex; Biological process=DNA integration
  Homolog annotation: Hit_ID=Q1SDN3; Match level="QueryCoverage=64%, HitCoverage=43%, E-value=1e-166, Identity=52%"; Hit description =Polynucleotidyl transferase, Ribonuclease H fold
  Pfam annotation: Domain name=zf-CCHC; Domain location=101-118; Score =12.1; E_value=0.0099; Accession=PF00098.13; Description=Zinc knuckle
  Pfam annotation: Domain name=zf-CCHC; Domain location=139-156; Score =16.4; E_value=0.002; Accession=PF00098.13; Description=Zinc knuckle
  Pfam module annotation: Pfam domain module=RVT_2::zf-CCHC::zf-CCHC; Domain location=364-620::101-118::139-156
  Subcellular localization annotation: CTP_CleavageSite=42; ConfidenceScore=5.30e-01
TVKLGKLPLPSPSENPAVALVSPALDSSNYHSWSRSMMTALSAKNKVEFVNGKAPEPLKTDRTYGAWNCCNNMERQLAGNNPLPNFNIETKEGSSINVVKSTCEFCGRIGHSESICYKKHGIPSSYDGKGKGFSARNGKTCAYCGKPGHTIDVCYKKHGYPPGFKFTNSKTMANNIVAVEGKATNDQAQHQESQESDTNTKVRIGTAEVSRDLYQLILEVTNSHTMCATIIHPQYHFPSPTQSQDHTNTDIRVSPSPFSSTTENLDTPIPLPIPSLTTPSSYSQNPTLRRSTRTRHAPTYLRDFHHALTSSADTTSTKVKYPLHFVLSYSRLSPTHKHFILSISTTTEPNSYVEAPKHDCWVKAIHSELQALQQNQTWILTQLPPHKKAIGCRWVYKIKHNTDGIIERYKARLVTKGYTQMEGLDFLDTFSPVAKLTTVRLLLALAALRNWHLRQLDVNNAFLHGDFHEEVYMKLPPGLIVDNPNLVCRLQCSLYGLKQASRKWFTRLSSFLLSQGFHQSSADHSLFLYTNNSHDLTVILVYVDDIILTGNNLDTIIHITKLLDQTFSIKDLDILKYFLGLEVARSKHGIHLCQRKYALDILSDSGMLGSRPISTPIEYSTHLSATMGTPLSETCASSYRRLVDRLIYLTNTRPDIAYVVQQLSQYMANPTSTHSQAAFQVLRYIKGSPGSGIFFAAQGSFTLKAFSDSDWSTVSQSSSKAEYRALASTTCELQWLSFLLHDFWVTLSQPATLYCDNQSAIQIASNPVFHEHTKHIEIDCHIVRDKVHKGLLKLLPISSSMQLADIFTKPLPPASFQGLYTKLGMMNIHSQLAEGS

SEQ ID NO: 153716 - protein, 105 aa, Glycine max
  Coding DNA Sequence Number=SeqID_36938
MEKSDKMNFKEKKEKKGYITWEDNVINYSSDSKKKIISLGIMMKDYENGEEQSRYIDSNFSKHMACIKLEVGSGSYWKLEVGNESYWKLKVENGGWKLEGEVTKS

SEQ ID NO: 153717 - protein, 70 aa, Glycine max
  Coding DNA Sequence Number=SeqID_36939
MVMDMADTFGEGFWKWASLYEDPIQLQCDILKEMGLSYKEEDSKVKGLLLDMENKDDLMATEKGIKSQQL

SEQ ID NO: 153718 - protein, 83 aa, Glycine max
  Coding DNA Sequence Number=SeqID_36940
MRGVDETRRAFDEIHENSDFVSWTSMIGAYVQSAREGLTLFNRMRVAFIDRNEFTVGSMKLERLLSSPLTPRDTLKQAHDELM

SEQ ID NO: 153719 - protein, 55 aa, Glycine max
  Coding DNA Sequence Number=SeqID_36941
MTEARQKGGDGNFTEALRVSRKPRNPIFQQNGGCGGHQAHPGELSSPRRARLLQP

SEQ ID NO: 153720 - protein, 300 aa, Glycine max
  Coding DNA Sequence Number=SeqID_36942
  Homolog annotation: Hit_ID=Q6AAC2; Match level="QueryCoverage=24%, HitCoverage=5%, E-value=7e-34, Identity=97%"; Hit description =Transcription-repair coupling factor
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSIEQFDRIGREPMTLVKSDDLNARLGGIRVDIVNQSGRDVVLPQQLGHAFGHALTLGAQQDRPAVVKASRQIFNSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 153721 - protein, 286 aa, Glycine max
  Coding DNA Sequence Number=SeqID_36943
  Homolog annotation: Hit_ID=Q66HX8; Match level="QueryCoverage=63%, HitCoverage=29%, E-value=1e-13, Identity=33%"; Hit description =Ganglioside induced differentiation associated protein 2
MDPVMILNFVFMGVDGTVRRFLEKQKNNIIAVVFCTVSTTDTEIYKRLLPLYFPRDKHEEQVALSKLPADVGDENGETISDERKIRIKPLPKRRVSTPPEFPVDLPVSDVGLVSRNSSHLDSFLDPAFMSMIKDPDQRRMEQWEKTAEAQRGWNCAKLIGYGDLGRPTLSAAEEYSLHSRYLSKANSLNLSEIAEMKIVEKGARKLGHEGNLENSKGNEGITTNGIRKDLVGGELDGCYNRMDRWQPLVGEGDSSMIGEMERKYRGVKGFRRRGEFWGKDIRKASA

SEQ ID NO: 153722 - protein, 88 aa, Glycine max
  Coding DNA Sequence Number=SeqID_36944
  Gene Ontology: Mol. function=DNA binding; Cellular component=nucleus; Biological process=regulation of transcription, DNA-dependent
  Homolog annotation: Hit_ID=Q9ATD4; Match level="QueryCoverage=98%, HitCoverage=28%, E-value=3e-40, Identity=79%"; Hit description =GHMYB25
  Pfam annotation: Domain name=Myb_DNA-binding; Domain location=14-61; Score=62.2; E_value=1.7e-15; Accession=PF00249.21; Description=Myb -like DNA-binding domain
MGRMPCCEKVGLKKGPWTPEEDKKLVAYVEEHGPGNWRSVPAKAGLERCGKSCRLRWINYLKPDIKRGNFSMEEDHTIIQLHALLGNK

SEQ ID NO: 153723 - protein, 57 aa, Glycine max
  Coding DNA Sequence Number=SeqID_36945
MEKWFLILEIARDEWKELLLFVMAVRRRRNKRWREGKNDWDMILDVGDSKSSVKDRV

SEQ ID NO: 153724 - protein, 115 aa, Glycine max
  Coding DNA Sequence Number=SeqID_36946
  Gene Ontology: Mol. function=nucleic acid binding; Biological process= DNA integration
  Homolog annotation: Hit_ID=Q1S0A6; Match level="QueryCoverage=99%, HitCoverage=11%, E-value=5e-24, Identity=41%"; Hit description=Zinc finger, CCHC-type; Peptidase aspartic, catalytic; Polynucleotidyl transferase, Ribonuclease H fold
MSYLETAKELWDDIKERFSVVSGPSIQQLKSDLAQCKQGDDGLYGTVRSNLLATDPMESLNKMYFIIEHEERLRTITQSKEERTEVMALVAQTGTRVKGRETRQICLHELQQIWS

SEQ ID NO: 153725 - protein, 226 aa, Glycine max
  Coding DNA Sequence Number=SeqID_36947
  Gene Ontology: Mol. function=DNA binding; Biological process=DNA integration
  Homolog annotation: Hit_ID=Q1RSZ9; Match level="QueryCoverage=76%, HitCoverage=17%, E-value=6e-61, Identity=55%"; Hit description =Polynucleotidyl transferase, Ribonuclease H fold
MTDSNKFHPALVVSNIKNHISITSEMENVQYAMWAKLFKIHARSHKVFHHIVPPEKGKERVSKTDEEKAWNRLHDIFQDNKNSWVVTLEQEFSRTNMEDFPNASVYCQRLKKLSDQLKNVGARVSNNRLVLQMVADLIEAYNGVATGRGAAMVARNTDNSHPLSKNSHQNQNTHGGKKGQNCNNNDKNNGGNRNGVKSNGGGGRSHGRNSGWQQQSEHKQWPTKQR

SEQ ID NO: 153726 - protein, 52 aa, Glycine max
  Coding DNA Sequence Number=SeqID_36948
VTGCTIRGGTHESDLCIPFEEKMQEVSYMGNQQRQGGGFLGFHQGPYNQQGQ

SEQ ID NO: 153727 - protein, 94 aa, Glycine max
  Coding DNA Sequence Number=SeqID_36949
METDDGDGTTTITHRQRRKKLHCGENINNPKSVNIFLVGLPPIGPMATPCQGELLGAPCIFAGTPRITCKISVLPFHKPNMDWKSVGPIWIVNP

SEQ ID NO: 153728 - protein, 216 aa, Glycine max
  Coding DNA Sequence Number=SeqID_36950
  Gene Ontology: Mol. function=DNA binding; Cellular component=nucleus; Biological process=regulation of transcription, DNA-dependent
  Homolog annotation: Hit_ID=Q8S423; Match level="QueryCoverage=20%, HitCoverage=50%, E-value=2e-16, Identity=79%"; Hit description=P -type R2R3 Myb protein
  Pfam annotation: Domain name=Myb_DNA-binding; Domain location=14-59; Score=30.2; E_value=7.2e-06; Accession=PF00249.21; Description=Myb -like DNA-binding domain
MGRMPCCEKVGLKKGPWTPEEDKKLMAYVEKHGHGNWRSGPAKAFVLKNEVQNFFRSLFQSHTDCQPDSLIISDLPQIDQVGYMSLLAPVSIEEVRKDVWELVAQPLTTGHINEGLAATVIVPIPKNDQPQTLKEFRSIRGLDRDNVIIAQHIVHPLHKKKDFGFPPQIIKAIMSLTTSTTLALRWNNEVLDSLSPYLFCPVYREIGNDDSGQGPP

SEQ ID NO: 153729 - protein, 53 aa, Glycine max
  Coding DNA Sequence Number=SeqID_36951
MGGVELRRHCEVVMIEEEEEEVLCSKKTHSRKRHNPAEREDCTTKSEKRVRKV

SEQ ID NO: 153730 - protein, 320 aa, Glycine max
  Coding DNA Sequence Number=SeqID_36952
  Gene Ontology: Mol. function=DNA binding; Cellular component=nucleus; Biological process=regulation of transcription, DNA-dependent
  Homolog annotation: Hit_ID=Q9ATD4; Match level="QueryCoverage=75%, HitCoverage=77%, E-value=3e-70, Identity=56%"; Hit description =GHMYB25
  Pfam annotation: Domain name=Myb_DNA-binding; Domain location=14-61; Score=61.6; E_value=2.5e-15; Accession=PF00249.21; Description=Myb -like DNA-binding domain
  Pfam annotation: Domain name=Myb_DNA-binding; Domain location=67-112; Score=46.8; E_value=7.4e-11; Accession=PF00249.21; Description=Myb -like DNA-binding domain
  Pfam module annotation: Pfam domain module=Myb_DNA-binding::Myb_DNA -binding; Domain location=14-61::67-112
MGRIPCCEKVGLKKGPWTSEEDKKLVAYVEKHGHRNWRSVPAKAGLERCGKSCRLRWINYLKPDIKRGNFTMEEDHTIIQLHALLGNKWSIIAAHLPKRTDNEIKNYWNTNVKKRLIRMGLDPITHKPIKTNTFEAYGGGHGQSEDNINMNHMAQWESARIEAEARGSVFQAGSHSSHQPQLILSKIPTQPCFSSSDSLSTKRNTVYNMYALVLATNHDPVLPVSTLSIPYWQTPSPVSTNIGRFTDTGSSLSYEENVNITETSCQTQKIIEDYMLNSQDDDIIVAVEAFRTTRCESIQELFRGSNDVEGPNNDSFERNV

SEQ ID NO: 153731 - protein, 137 aa, Glycine max
  Coding DNA Sequence Number=SeqID_36953
EELATQLAQASKVASSRCNHLLEEESGRPNYGNSRIAQQYFLLVAVALWNFTDRVTLLPFDFRRVSGLTYCATKGAEYLEAANQRLHVINEYEKSDMEPGTYRVEWEKRGGTRLTGASSKEGKLAESPPMFIRGKTK

SEQ ID NO: 153732 - protein, 161 aa, Glycine max
  Coding DNA Sequence Number=SeqID_36954
MVARVMLGHGYEPEMGLGKNNGGRAALADVRKNISERKNKGQGPQSGQQAKEIPPCHISKSFMSAGLRCEGQVATICDENSSRRSDLVQPCPPGFQLGNWRVEERPEVYTTSIISDDESREGTNIEDPVVDFEQEASRMEEEEDEDVGLPPELERIIARED

SEQ ID NO: 153733 - protein, 103 aa, Glycine max
  Coding DNA Sequence Number=SeqID_36955
MSVFLMSELRFWQREFVDLICKVISKSRVVLRCSSFRRDDDLPNASLRPVWKYKNSYILNGGTFDTWESCDEKYLSVTWAWVKSKTPSLMCSFLEFGRMTGFG

SEQ ID NO: 153734 - protein, 84 aa, Glycine max
  Coding DNA Sequence Number=SeqID_36956
  Gene Ontology: Mol. function=RNA-directed DNA polymerase activity; Cellular component=intracellular; Biological process=RNA-dependent DNA replication
MSLKIKEEVKKQFDVGFLAAAWYSEWVANIVSVPKKDGKIKMASEDMEKTTFITLWGTFCYKVMSFGLKNAGATYQRAHGGIIP

SEQ ID NO: 153735 - protein, 800 aa, Glycine max
  Coding DNA Sequence Number=SeqID_36957
  Gene Ontology: Mol. function=nucleic acid binding; Cellular component= nucleus; Biological process=response to DNA damage stimulus
  Homolog annotation: Hit_ID=Q9FIY7; Match level="QueryCoverage=98%, HitCoverage=61%, E-value=0.0, Identity=62%"; Hit description =Putative SWI/SNF-related matrix-associated actin-dependent regulator of chromatin subfamily A member 3-like 3
  Pfam annotation: Domain name=DEAD; Domain location=118-357; Score= -20.2; E_value=0.00029; Accession=PF00270.19; Description=DEADDEAH box helicase
  Pfam annotation: Domain name=Helicase_C; Domain location=669-747; Score=95.4; E_value=1.7e-25; Accession=PF00271.21; Description =Helicase conserved C-terminal domain
  Pfam annotation: Domain name=ResIII; Domain location=114-351; Score= -16.7; E_value=0.0012; Accession=PF04851.6; Description=Type III restriction enzyme, res subunit
  Pfam annotation: Domain name=SNF2_N; Domain location=120-484; Score =181.4; E_value=2.2e-51; Accession=PF00176.13; Description=SNF2 family N-terminal domain
  Pfam annotation: Domain name=zf-C3HC4; Domain location=564-603; Score= 48.8; E_value=1.9e-11; Accession=PF00097.15; Description=Zinc finger, C3HC4 type (RING finger)
  Pfam module annotation: Pfam domain module=DEAD::Helicase _C::ResIII::SNF2_N::zf-C3HC4; Domain location=118-357::669-747::114 -351::120-484::564-603
VSLIDNLFLGSFYVHHSVFAERVDTSWRLEACGKIDDTVYPLLALLKMLEIKPSQKADPDEAAALPLIKRRKGGEPLPEQNNDEQALSESALNKLVGAAEIYDLKEKEAPETLVCNLKPYQKQALHWMTEIEKGMDIESVERNLHPCWSAYTICKGRTIYLNIFTGEASKKFPKATQMARGGILADAMGLGKTVMTIALILSNPGRGNSENNDVENGDDNFITNKRKNANTLHKFEGGTLIVCPMALLSQWKDELETHSKEGSISIFVHYGGARTTDPWMISGHDVVLTTYGVLQAAYKNDGENSIYNKVKWYRVVLDEAHNIKAHRNQTAQSAFVLSSHSRWCLTGTPLQNSLEDLYSLLRFMRVEPWCNLAWWQKLIQRPYENGDPRSLKLVKAILRMLMLRRTKETKDKKGRPILFLPPIDFQLIECEQSESERDFYEALFERSKVQFDQYVAQGKVLHHYANILDLLMQLRRCCNHPFLVMCGSDTQKRADLSRLARKFFQTNTEFPDESNQNDPRQQAELNKLASRLLLKSASSLHSVQPHAYIAEVLENIQKGDIIECSICMESPEDPVFTPCAHKFCRECLFSCWGTSVGGKCPICRQLLQKDDLITYSSESPFKVDIKNNVTESSKVSKLFEFLQRILNTSSEKSIVFSQWTSFFDLLENPLRRRGIGFLRYDGKLTQKQREKVLDEFNETREKRVLLMSLKAGGVGLNLTAASNVFIMDPWWNPAVEEQAIMRIHRIGQNRRVVVRRFIVKDTVEDRLQQVQARKQRMISGTLTDDEVRTARIQDLKMLFT

SEQ ID NO: 153736 - protein, 79 aa, Glycine max
  Coding DNA Sequence Number=SeqID_36958
MASRNKNVPVIVYYDAYVADCDEGVEFKGRNNAVTISDDEDIDGMFDVYNRHQCLSGFQLLVQYEQQPSSTANVETTVQ

SEQ ID NO: 153737 - protein, 244 aa, Glycine max
  Coding DNA Sequence Number=SeqID_36959
  Homolog annotation: Hit_ID=Q9FIY7; Match level="QueryCoverage=26%, HitCoverage=4%, E-value=6e-08, Identity=50%"; Hit description =Putative SWI/SNF-related matrix-associated actin-dependent regulator of chromatin subfamily A member 3-like 3
  Subcellular localization annotation: CTP_CleavageSite=37; ConfidenceScore=5.14e-01
MAEEEPSITSPPARTLHKFLSRSGKTVIAAQPLAVVRATTSTGGARVLAAPPNSNDDPTPPQEEEGEGETGFDASHHHERILLQRELTVSFDEFLEVTNTKVATEEEALKSVMAPLEEETEEGEEAESSQAQSAQPVQPVPRGPQLFRPVQKKKAVTGDDVEVVEVRKPVEKKNIPNISNLEDGEFPEESGWFLLGRKVEVAVSTARGVNRLVDNEIVHFNFPIPSYSSKSQWIVRASTKRSGE

SEQ ID NO: 153738 - protein, 308 aa, Glycine max
  Coding DNA Sequence Number=SeqID_36960
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q85UU0; Match level="QueryCoverage=99%, HitCoverage=96%, E-value=1e-140, Identity=68%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=110-308; Score=325.1; E_value=1.2e-94; Accession=PF00346.9; Description =Respiratory-chain NADH dehydrogenase,
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 153739 - protein, 217 aa, Glycine max
  Coding DNA Sequence Number=SeqID_36961
  Gene Ontology: Mol. function=zinc ion binding; Biological process =intracellular signaling cascade
  Homolog annotation: Hit_ID=Q2HRX8; Match level="QueryCoverage=96%, HitCoverage=35%, E-value=1e-20, Identity=32%"; Hit description=IMP dehydrogenase/GMP reductase
  Pfam annotation: Domain name=DUF1723; Domain location=43-92; Score =52.3; E_value=1.6e-12; Accession=PF08330.1; Description=Protein of unknown function (DUF1723)
ERPKLKLSSHGRKVHSLGRPVPAIEGLVAGTGLSPLITCSVDTGDRGLLSSFVERWHRETSSFHLPVGEVTITLDDFLSLLHLSVVGDLHAFQPLHVDDAVQMLVDLLMVSAEAARAETGQCCGPYVRLQWVRDIYERRCQAGHWTVAARAYLLHLLGCILFANKSASNVHVVYLEALRDLSQTGSVGYTSIFPQSGNPLLIRTTMRIHRVPVGGLL

SEQ ID NO: 153740 - protein, 120 aa, Glycine max
  Coding DNA Sequence Number=SeqID_36962
  Homolog annotation: Hit_ID=Q10RP7; Match level="QueryCoverage=80%, HitCoverage=23%, E-value=3e-18, Identity=45%"; Hit description=Appr -1-p processing enzyme family protein, expressed
MYMPVATSATLRGGLPTDSGDSVVALDQVPRWNDADQALGFETSFSSSHFPDPLASPSRVDSGDGSESVSKFPVDDEVNSKIYLWRGNPWNLEVDAVVNSTNEAMSLFVLYVLVFFHLVL

SEQ ID NO: 153741 - protein, 113 aa, Glycine max
  Coding DNA Sequence Number=SeqID_36963
  Gene Ontology: Mol. function=RNA-directed RNA polymerase activity; Cellular component=mitochondrion
  Homolog annotation: Hit_ID=Q10RP7; Match level="QueryCoverage=74%, HitCoverage=18%, E-value=6e-39, Identity=85%"; Hit description=Appr -1-p processing enzyme family protein, expressed
  Pfam annotation: Domain name=A1pp; Domain location=1-106; Score =106.5; E_value=7.6e-29; Accession=PF01661.11; Description=Appr-1"-p processing enzyme family
MDEAHSSPGLHDAAGPGLAEECATLGGCRTGMAKVTKPYDLPARKIIHTVGPKYAIKYHNAAENALSHCYRSCLELLIENGLQSIAMGCIYTEAKNYPREPAAHVAISSLMGS

SEQ ID NO: 153742 - protein, 114 aa, Glycine max
  Coding DNA Sequence Number=SeqID_36964
  Gene Ontology: Mol. function=GTP binding; Cellular component =intracellular; Biological process=ATP catabolic process
  Homolog annotation: Hit_ID=Q9M7P3; Match level="QueryCoverage=83%, HitCoverage=24%, E-value=3e-44, Identity=88%"; Hit description=GTP -binding protein
  Pfam annotation: Domain name=DUF933; Domain location=70-114; Score =41.9; E_value=2.3e-09; Accession=PF06071.3; Description=Protein of unknown function (DUF933)
MWKKKFNYHWIPVIFRVQEHGGETIIPFSCALERNLADMPPDEAAKYCEENKTQSALTKIIKTGFSAINLIYFFTAGPDEVKCWQIRRQTKAPQAAGAIHTDFERGFICAEVSS

SEQ ID NO: 153743 - protein, 137 aa, Glycine max
  Coding DNA Sequence Number=SeqID_36965
MLHLQFRKNHSPLTTTRVAELGGKKRKSLCNTTVVERREGKKEKGKIGKDSSEEQVSLMKEAYSLFNTNDDGGIAPFELRILMRSYSLFNTNDDGGIAPFELRILMRSYSLFNTNIDSNIDAPISLRGCIFFHPINH

SEQ ID NO: 153744 - protein, 163 aa, Glycine max
  Coding DNA Sequence Number=SeqID_36966
  Gene Ontology: Mol. function=endonuclease activity
  Homolog annotation: Hit_ID=Q1S9P8; Match level="QueryCoverage=78%, HitCoverage=33%, E-value=9e-59, Identity=82%"; Hit description =Endonuclease/exonuclease/phosphatase
MDQLRNNVNARSLPGSNALYGSSTVSKEQGPLHRRPDVVKSKQGFPHFRERVWVKKLVHDRRIRFGTWNIDTLTGKSMEIVDVMVRRKINFMCLQETKWTGEKAKELDNSGFKLWYTGKIRSRNGVGIIVDKEWKKDVVDVGLAEHFKVKFWEDLEGVLQDIP

SEQ ID NO: 153745 - protein, 1074 aa, Glycine max
  Coding DNA Sequence Number=SeqID_36967
  Gene Ontology: Mol. function=protein-tyrosine kinase activity; Cellular component=integral to membrane; Biological process=protein amino acid phosphorylation
  Homolog annotation: Hit_ID=Q7EYF8; Match level="QueryCoverage=99%, HitCoverage=99%, E-value=0.0, Identity=60%"; Hit description =Putative phytosulfokine receptor
  Pfam annotation: Domain name=LRRNT_2; Domain location=33-79; Score =44.2; E_value=4.6e-10; Accession=PF08263.3; Description=Leucine rich repeat N-terminal domain
  Pfam annotation: Domain name=LRR_1; Domain location=107-129; Score =12.3; E_value=1.4; Accession=PF00560.23; Description=Leucine Rich Repeat
  Pfam annotation: Domain name=LRR_1; Domain location=131-153; Score =13.9; E_value=0.58; Accession=PF00560.23; Description=Leucine Rich Repeat
  Pfam annotation: Domain name=LRR_1; Domain location=155-177; Score =15.8; E_value=0.15; Accession=PF00560.23; Description=Leucine Rich Repeat
  Pfam annotation: Domain name=LRR_1; Domain location=179-201; Score =12.0; E_value=1.6; Accession=PF00560.23; Description=Leucine Rich Repeat
  Pfam annotation: Domain name=LRR_1; Domain location=203-225; Score =14.5; E_value=0.39; Accession=PF00560.23; Description=Leucine Rich Repeat
  Pfam annotation: Domain name=LRR_1; Domain location=227-248; Score =9.6; E_value=4.6; Accession=PF00560.23; Description=Leucine Rich Repeat
  Pfam annotation: Domain name=LRR_1; Domain location=278-301; Score =13.4; E_value=0.84; Accession=PF00560.23; Description=Leucine Rich Repeat
  Pfam annotation: Domain name=LRR_1; Domain location=304-325; Score =13.3; E_value=0.87; Accession=PF00560.23; Description=Leucine Rich Repeat
  Pfam annotation: Domain name=LRR_1; Domain location=327-346; Score =14.1; E_value=0.51; Accession=PF00560.23; Description=Leucine Rich Repeat
  Pfam annotation: Domain name=LRR_1; Domain location=353-374; Score =7.1; E_value=14; Accession=PF00560.23; Description=Leucine Rich Repeat
  Pfam annotation: Domain name=LRR_1; Domain location=375-394; Score =7.4; E_value=12; Accession=PF00560.23; Description=Leucine Rich Repeat
  Pfam annotation: Domain name=LRR_1; Domain location=396-415; Score =5.2; E_value=31; Accession=PF00560.23; Description=Leucine Rich Repeat
  Pfam annotation: Domain name=LRR_1; Domain location=419-442; Score =16.6; E_value=0.092; Accession=PF00560.23; Description=Leucine Rich Repeat
  Pfam annotation: Domain name=LRR_1; Domain location=443-462; Score =12.1; E_value=1.5; Accession=PF00560.23; Description=Leucine Rich Repeat
  Pfam annotation: Domain name=LRR_1; Domain location=467-489; Score =11.8; E_value=1.8; Accession=PF00560.23; Description=Leucine Rich Repeat
  Pfam annotation: Domain name=LRR_1; Domain location=491-514; Score =7.7; E_value=11; Accession=PF00560.23; Description=Leucine Rich Repeat
  Pfam annotation: Domain name=LRR_1; Domain location=516-538; Score =17.1; E_value=0.063; Accession=PF00560.23; Description=Leucine Rich Repeat
  Pfam annotation: Domain name=LRR_1; Domain location=540-562; Score =12.8; E_value=1.2; Accession=PF00560.23; Description=Leucine Rich Repeat
  Pfam annotation: Domain name=LRR_1; Domain location=564-583; Score =13.5; E_value=0.8; Accession=PF00560.23; Description=Leucine Rich Repeat
  Pfam annotation: Domain name=LRR_1; Domain location=586-608; Score =6.0; E_value=22; Accession=PF00560.23; Description=Leucine Rich Repeat
  Pfam annotation: Domain name=Pkinase; Domain location=792-1071; Score= 4.6; E_value=7.8e-09; Accession=PF00069.15; Description=Protein kinase domain
  Pfam annotation: Domain name=Pkinase_Tyr; Domain location=796-1071; Score=2.7; E_value=1.2e-12; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=33-79::107- 129::131-153::155-177::179-201::203-225::227-248::278-301::304 -325::327-346::353-374::375-394::396-415::419-442::443-462::467 -489::491-514::516-538::...
  Pfam module annotation: =540-562::564-583::586-608::792-1071::796-1071
MECQLDSESLGGCLVRTLVVLKNPSLGFCWQLPSQDILTLLEFKKGIKHDPTGYVLNSWNEESIDFDGCPSSWNGVLCNGGNVAGVVLDNLGLSADTDLSVFTNLTKLVKLSLSNNSISGTLLDSIADFKSLEFLDISYNLFSSSLPLGIGKLGSLQNLSLAGNNFSGPIPDSISEMASIKSLDLSCNAFSGMLPASLTKTISLVSLNLSHNGFNGKIPKGLELIPALEKLDLHGNMLEGNLDVVFMLSSSASYVDLSENMLSSSDSNQKFLPRISESIKHLNLSHNKLTGSLASGAAEPVFENLKVLDLSYNQLDGELPGFDFVYDLEVLKLSNNRFSGFIPNGLLKGDSLVLTELDLSANNLSGPLSIITSTTLHSLNLSSNEFTGDMPLLTGSCAVLDLSNNKLEGNLTRMLKWGNIEFLDLSRNHLTGAIPEETPQFLRLNYLNLSHNSLSSSLPKVLTQYPKLRVLDISFNQLDGLLPANLLTLPTLQELRLENNMISGGIKFSSSPDQSDLQILDLSHNQLNGYFPDEFGSLTGLKVLNIAGNNFSGSLPTTIADMSSLDSLDISENHFTGPLPSNMPKGLQNFNASQNDLSGVVPEVLRKFPSSSFFPGNTKLHFPNGPPGSISSPAESSKRKHMNTIVKVIIIVSCVVALFILILLAVFIHYIRISRSPPEYETSKDIHRHPQPIISAPVRTTDGGGALVVSAEDLVTSRKESPSEIISSDEKMAAVTGFSPSKQSHFSWSPESGDSLSGENLARLDTRSPDRLVGELHFLDDTITLTPEELSRAPAEVLGRSSHGTSYKATLENGLLLRVKWLREGVAKQRKEFVKETKKFANIRHPNVVGLRGYYWGPTQHEKLILSDYISLGSLASFLYDRPGRKGPPLTWTQRLKIAVDVARGLNYLHFDRAVPHGNLKATNVLLDTTDMNARVADYCLHRLMTQAGTIEQILDAGVLGYCAPELAASKKPMPSFKSDVYAFGVILLELLTGRCAGDVISSEEGGVDLTDWVRLRVAEGRGSECFEATLMPEMSNPVVEKGMKEVLGIAMRCIRSISERPGIKTIYEDLSSI

SEQ ID NO: 153746 - protein, 810 aa, Glycine max
  Coding DNA Sequence Number=SeqID_36968
  Gene Ontology: Mol. function=double-stranded RNA binding; Cellular component=intracellular; Biological process=RNA processing
  Homolog annotation: Hit_ID=Q1KL58; Match level="QueryCoverage=99%, HitCoverage=58%, E-value=0.0, Identity=49%"; Hit description=Dicer -like 2 spliceform 1
  Pfam annotation: Domain name=DUF283; Domain location=1-67; Score=6.5; E_value=0.00082; Accession=PF03368.5; Description=Domain of unknown function
  Pfam annotation: Domain name=PAZ; Domain location=235-375; Score =14.5; E_value=7.3e-05; Accession=PF02170.12; Description=PAZ domain
  Pfam annotation: Domain name=Ribonuclease_3; Domain location=414-531; Score=117.8; E_value=3e-32; Accession=PF00636.16; Description=RNase3 domain
  Pfam annotation: Domain name=Ribonuclease_3; Domain location=603-714; Score=132.1; E_value=1.5e-36; Accession=PF00636.16; Description =RNase3 domain
  Pfam annotation: Domain name=dsrm; Domain location=741-806; Score =33.4; E_value=7.6e-07; Accession=PF00035.15; Description=Double -stranded RNA binding motif
  Pfam module annotation: Pfam domain module=DUF283::PAZ::Ribonuclease _3::Ribonuclease_3::dsrm; Domain location=1-67::235-375::414-531::603- 714::741-806
YFKPAPRWDKETGTLYLPKSCPLQPICVEGNKKHLKNIACLEACKQLHKIGALTDNLVPDIVIEEAEVEEFGNEPYDENQPTFVPFGLVNSVSNNSHTIYHCYLMELSQNFSYDISVQDIFLAIRIELDPEIGCTQFDMGFDRGSVSLKLRYKGTINLSPNLVLLCKKFQVTLLGSIIDHSMNKLATSLDKCYLEDNVEIDYLLLPAIGKGEKSHVNWLAIKSVEPSSFTCKYHQPHIETKSGLVCTCKLQDALVCTSHPGGKIYFYITTGIMELHGNSPMELRGGEVTTYKKYYEQHHGIQLQFENQWLLKARHHFKVKNYCHGQKQGKDGEASKAFVELPPELCSIVMSPIKDSIIYTFSFIPSIMHRLESLLGAFNLKKMHLDHCTQNEIQTIKVLEAITTKRCNEAFHYESLETLGDSFLKYAASQQLFKTYKNHHEGLLSVKREKIISNAALCKLGCSSGLPGFIRNEPFDPHAWTIPGDKPESLKLEELVIKGKKIYVHGKRKLNRKIIADVVEALIGAFLSTGGEISALLFMDWVGIKVSFDKIPYERHFDIQPEKLLNVRFLESQLKYSFHDHSLLVEALTHGSYMLPEVPRCYQRLEFLGDSVLDYLITWHLYNEYPGMSPGQLTDMRAASVNNDCYAWSAIKHGLHKHVLHASQELHKHIAVTLNNFDKLSSSSTFGYESEASPPKVLGDIIESLAGAILVDSGFNKEVVWQSIRPLLEPLVTPETLKLHPIRELNELCQKRSYKIVLEDVSRKDGVTNYRMKVEADGVIHEYEYTGPALRDTAKKIACKEILNSLKEDL

SEQ ID NO: 153747 - protein, 368 aa, Glycine max
  Coding DNA Sequence Number=SeqID_36969
  Gene Ontology: Mol. function=phosphogluconate dehydrogenase (decarboxylating) activity; Cellular component=mitochondrion; Biological process=valine metabolic process
  Homolog annotation: Hit_ID=Q9SUC0; Match level="QueryCoverage=93%, HitCoverage=94%, E-value=1e-123, Identity=63%"; Hit description =Probable 3-hydroxyisobutyrate dehydrogenase, mitochondrial precursor
  Pfam annotation: Domain name=F420_oxidored; Domain location=32-232; Score=-39.1; E_value=0.0092; Accession=PF03807.7; Description=NADP oxidoreductase coenzyme F420-dependent
  Pfam annotation: Domain name=NAD_binding_2; Domain location=30-205; Score=176.7; E_value=5.8e-50; Accession=PF03446.5; Description=NAD binding domain of 6-phosphogluconate dehydrogenase
  Pfam module annotation: Pfam domain module=F420_oxidored::NAD_binding_ 2; Domain location=32-232::30-205
  Subcellular localization annotation: CTP_CleavageSite=70; ConfidenceScore=5.56e-01
MAICKLKSLLSLSKCNSALVSSSIRAFSSAQNVGFIGLGNMGSRMANNLIKAGFRLTVHDLNSDVLEMFSQMGVPTKKTPYEVSEASDVVITMLPTSAHVIDVYTGPNGLLHGGKLLRPWLLLDSSTIDPQTSRNLSATVTNYILREKKGEWEKPFKLDAPVSGSVTAAEAGTLTFMVGGSEEAFLAAKPLLFSMGKSAIYCGGAGSGSAAKICNNLALAVSMLGISEALALGQSLGVSASTLTNIFNCSSARCWSSDAYNPVPGLMEGVPSSGDYNGGFASKLMFKLAKMHQLLTAKGVGILEQGHTIIAKDLNLAVESAKLAGCKYPLTSQAQKIYTELCSVGHEAKDFSCAFRHYYSGIDEPHDQ

SEQ ID NO: 153748 - protein, 408 aa, Glycine max
  Coding DNA Sequence Number=SeqID_36970
  Homolog annotation: Hit_ID=O24097; Match level="QueryCoverage=98%, HitCoverage=99%, E-value=1e-155, Identity=64%"; Hit description =MtN19 protein precursor
  Pfam annotation: Domain name=SURNod19; Domain location=28-407; Score =813.8; E_value=9.2e-242; Accession=PF07712.3; Description=Stress up -regulated Nod 19
MRFLSKDWVVSWALLLLVSCTTFSSASLGKPENKIKTSVFLSPKIELGPGLVSNKNYFDVDFPRGHIAIKSFNAELVDEAGKSVPLQEVYLHHWVIVRYHQPKNVSQNNQTDNIVIVRNSGFCQDGFLVQYFGLGSETRGTATDIPDPFGIEVGNPSEIPYGFEEKWLINVHAIDTRGGVEDRLGCIECRCDLYNVTKDADGNPLSPYYKGGLDCCPDNSTCRLNKGFKGPKRTLNLKYTVKWFSWDNCVVPLKIYILDVTDVLNVSKGVSPKHNCKVEYQVEPCSKGYNSSACIDVRKTSFPMQTGGYVIYGVGHQHVGANESTLYGQDGGVICSSIPKYGNGNEAGNEKGYVVGMSTCYPRRGTIKIKDGETLTLEIIYSNNQSHSGVMGLFYILVAEQLPHQHLL

SEQ ID NO: 153749 - protein, 87 aa, Glycine max
  Coding DNA Sequence Number=SeqID_36971
MCAVVLIHGLSLPFDLKKRLLHKVDDARFFLLRGHKQFSTWALCSTSGFSWAVGEKSGGNGKLEYTLHSLYPQLQYPMSSKLAMVGP

SEQ ID NO: 153750 - protein, 165 aa, Glycine max
  Coding DNA Sequence Number=SeqID_36972
  Homolog annotation: Hit_ID=Q1KL58; Match level="QueryCoverage=49%, HitCoverage=5%, E-value=1e-35, Identity=81%"; Hit description=Dicer -like 2 spliceform 1
QAEAVKRHTDLKVGMYWGDMGVDFWDAATWKQEMEKHEVLVMTPAILLSCLRHSFFKLNMINVLIMDECHHARGKHPYACIMTPLPVTIPAGDPTTSITVRQSTQRWPRCRDWTSDVPPCSPFVLAKQHQTAMPFQHVTHSLRPCFHRRYHPLFNSCNTLSYKLQ

SEQ ID NO: 153751 - protein, 197 aa, Glycine max
  Coding DNA Sequence Number=SeqID_36973
  Gene Ontology: Mol. function=ATP-dependent helicase activity; Cellular component=intracellular; Biological process=RNA processing
  Homolog annotation: Hit_ID=Q1KL58; Match level="QueryCoverage=99%, HitCoverage=11%, E-value=6e-20, Identity=32%"; Hit description=Dicer- like 2 spliceform 1
MKVYTCVSEAVITEFIPTSTPKFKFYSNNGIQFVLFEELASKLKMLKEQLCLNQFPIADPIIFMVFNSGYSVSQHELTLRSSDFTKSIAESAQKRITKIFCSLMFCLDELGVWLALKAAESLSSNEIESFSWGHSGDRVVKDFILEGVHALKSYLQCGNDSSTIERTWSIGDNIKSDVKMGLLTSKVCCLVDSLLEY

SEQ ID NO: 153752 - protein, 186 aa, Glycine max
  Coding DNA Sequence Number=SeqID_36974
  Gene Ontology: Mol. function=transferase activity, transferring nitrogenous groups; Biological process=biosynthetic process
  Homolog annotation: Hit_ID=Q94EG1; Match level="QueryCoverage=81%, HitCoverage=38%, E-value=2e-60, Identity=73%"; Hit description =Putative aspartate aminotransferase
MGSFVKLSRRALETEMPVMVQMQELLRGAKNAVSLAQGVVYWQPPKQALEKVKELVSEPLISRYGNDEGIPELRAALVKKLRDENNLHKSSVMVTSGANQAFVNLVLTLCDPGDSVVMFAPYYFNAYMSFQMTGVTNILVGPGSSDTLHPDAEKQRQSLVAKSIFFPPSRGFTYWLNVGWIGSVYM

SEQ ID NO: 153753 - protein, 49 aa, Glycine max
  Coding DNA Sequence Number=SeqID_36975
MTGSAPAQQQMSYYDHVQTRHQEKGSLYSWVASAAWNAPVVAVPRLPVK

SEQ ID NO: 153754 - protein, 107 aa, Glycine max
  Coding DNA Sequence Number=SeqID_36976
VVCGWWCRELISGSMNIVELLRKHLYSKELDGINKNIVEYIENHGGSKLDCACELSCWGIYHEKPIGLVIGVVHAHVTDHVSAYILKIPLVESWVSHVTSHVEPYMA

SEQ ID NO: 153755 - protein, 234 aa, Glycine max
  Coding DNA Sequence Number=SeqID_36977
  Gene Ontology: Mol. function=DNA binding
  Homolog annotation: Hit_ID=Q2QW42; Match level="QueryCoverage=83%, HitCoverage=89%, E-value=6e-55, Identity=57%"; Hit description =Expressed protein
MSFMRGDFLSRTRKLVKGLAKAQPAWLKAMEQAPPATFPRSAGKIPTITLPEDVYVKKFYKKYPESKSHDAIKYFPFTLYLVFVPFAMFGHLVLVSVLLFHAFDPPPSRVFALRVLELKEQGISEEQAMAIADMEYLTEKKTKKKAYTRLKEIARLQGKRLPQNPYPSAIKEIQAEERKYVRDRFFNPKMLEIVEKQKAEAAAERLSRALEKLALTIIFTIQPLKSAFFFPDIR

SEQ ID NO: 153756 - protein, 150 aa, Glycine max
  Coding DNA Sequence Number=SeqID_36978
  Gene Ontology: Mol. function=transferase activity; Biological process= RNA-dependent DNA replication
  Homolog annotation: Hit_ID=Q1T4N4; Match level="QueryCoverage=57%, HitCoverage=15%, E-value=1e-17, Identity=45%"; Hit description =Polynucleotidyl transferase, Ribonuclease H fold
MEIHASGLSPIKNGTCTVRSAYYMMMKKFVDYDELIVEGDWKLLWNIDVSPRVKLFLWRLCRNMLPSWVKLRTRGVSCPITCSLCNIDVETTSHIFASCHSEEAIQFMQARGYSLVTFEMDCKGVVDKIRRSDPDESEIEVLLFNIAGTS

SEQ ID NO: 153757 - protein, 257 aa, Glycine max
  Coding DNA Sequence Number=SeqID_36979
  Gene Ontology: Mol. function=protein binding; Cellular component =membrane; Biological process=defense response
  Homolog annotation: Hit_ID=Q1T032; Match level="QueryCoverage=71%, HitCoverage=27%, E-value=4e-48, Identity=49%"; Hit description =Disease resistance protein
  Pfam annotation: Domain name=NB-ARC; Domain location=20-245; Score= -72.3; E_value=1.1e-05; Accession=PF00931.13; Description=NB-ARC domain
MKRMSERLDEIADERTKFHLVDMVLERRSGVIEWCQTTSFITEPQVKVDLEKQHLPNSSSIMKSLKRMTKAITEATSGCHCEDLDIEPLQRELQALLQRKRYLLVLDDVWDDEQENWRRLKSVLVYGTKGSSILVTTRLLKVTTIMELFKHRAFRPNEVEQVEFVVIGKEIVRKCGGDPLAAKALKGIELRQLYLSPKVVKQFNTLEISTTAIFQLLHLTIKLTSSNKEVDFPKEFNNVLCWQRKRVLFGRVGSTEA

SEQ ID NO: 153758 - protein, 156 aa, Glycine max
  Coding DNA Sequence Number=SeqID_36980
  Gene Ontology: Mol. function=protein binding; Biological process =defense response
  Homolog annotation: Hit_ID=Q1SWV1; Match level="QueryCoverage=94%, HitCoverage=34%, E-value=5e-21, Identity=68%"; Hit description =Disease resistance protein
MAEAVLEIVLENLKSILQKELGQFLGVDDDMKRLASLFTTIKATLEDAEEKQFSNRVIKDWLAKLKDESLILDDILEEFDLLDKGASILVTTRLSKVATIMGTMSPHELSELSDNDCWELFKHRTFGQNDVEQEELVVIGREIVKKCRGCLLQQKH

SEQ ID NO: 153759 - protein, 497 aa, Glycine max
  Coding DNA Sequence Number=SeqID_36981
  Gene Ontology: Mol. function=binding; Cellular component=nucleus
  Homolog annotation: Hit_ID=Q6ZA95; Match level="QueryCoverage=70%, HitCoverage=85%, E-value=2e-71, Identity=42%"; Hit description=SET -domain transcriptional regulator-like protein
  Subcellular localization annotation: CTP_CleavageSite=40; ConfidenceScore=5.74e-01
MDIIASSMALPSLQPRNTNLSKVSIFQRLTPPTTLIPSWACSSKPNNSTTLSPISSKFPSFLRCSTKPDTSANSETQHTNNPNNEQPNSISNSQNAPQSSDSSSSEAFSSSPPPLGSSHSSSSRGLVLDLGPSNSWDSADIGSPVVKRFLSDEEERWYMWYHGRAKGYPSSDLIGLAVSKNGVHWERGGGPARSSSDVGFVISCGKDWWGFDTGGIRPSEMVIMSSSRVRASSAVYWLYYTGFVSERMEFSDHSLEFSVENPDGMINDGVSCGNGNGKGKVLKSLPGLAISQDGRHWARIEGEHHSGALIDVGSEKEWDSLFISSPQVVFHGNGDLRMYYHSFDVERGHFGVGIARSRDGIRWVKLGKIMGGGKVGSFDEFGVMNPCVTRNRSGGNYVMTYEGVAADGRRSIGLAVSPDGLKEWARRQDEAILKPSDQGCWDDKDVGSPCLVEMDTEGDEWRLYYRGVGNGGRVGIGMAISEGRDIGSFRRWTGFHV

SEQ ID NO: 153760 - protein, 43 aa, Glycine max
  Coding DNA Sequence Number=SeqID_36982
MSSVNIEVALSWKRIAQYRGDKILGDVRYKYGSVGFIPTMLAP

SEQ ID NO: 153761 - protein, 638 aa, Glycine max
  Coding DNA Sequence Number=SeqID_36983
  Gene Ontology: Mol. function=receptor activity; Cellular component =integral to membrane; Biological process=red or far red light signaling pathway
  Homolog annotation: Hit_ID=Q2HT55; Match level="QueryCoverage=99%, HitCoverage=99%, E-value=1e-132, Identity=39%"; Hit description=SPX, N-terminal; EXS, C-terminal
  Pfam annotation: Domain name=EXS; Domain location=440-611; Score =158.7; E_value=1.5e-44; Accession=PF03124.5; Description=EXS family
  Pfam annotation: Domain name=SPX; Domain location=1-305; Score=124.0; E_value=4.3e-34; Accession=PF03105.10; Description=SPX domain
  Pfam module annotation: Pfam domain module=EXS::SPX; Domain location =440-611::1-305
MTFKKDFKQQMVPEWEKEYMDYEGLKRILKEIKNSKQATHNRSLHHRLRLERAFSGIHLQGSNHQREGDIEDQVIEVKTLEQDGSRQLYKTNFQKFDEEGGEVEARLFQKLDEELNKVNAFYKDQVEAAQHEVTLLSKQMEALVALRVKVKSPDTGLKQIISSPEETMDESHQQKDSMVGPEDNPLQQANRNTHHEEQAEANNNYITKDPLEILEHVKVDNVPQSPISTIKKAFTDSSDNELSFSKEELRKVEEQLRLVFVEFYQKLLHLKDYSFMNLSAFSKIMKKYEKHTSRAASAAYMTVVDNSYVGSSDEVNFLLEKVESTFIRNFTHSNHKKGRKLLRQKTKTERHSTTFFTGFFSGCFVALFVATILRITSQQFIKKKEGTFYMENIFPLYRPGTELDYREIFLLTAGHAVVALLCFLINLQIGMNPRSRHYKTANELVPLSLVVVRLPDFFLADQLTSQCMRQFYEEGDINRAFNGLNYLSTIVAMIFRTTFELKKGLSWKVLALVTSALAVLQNTYWDIVRDWGLLRRHSKNPYLRDQLILPHKSFYFIAMVLDIVLRISWMQLVFEMDWSPLHKVAMITVTSCLEIIRRGIWNFFRLENEHLNNVGNYRAFKSVPHPFSYYDDKNDKDA

SEQ ID NO: 153762 - protein, 72 aa, Glycine max
  Coding DNA Sequence Number=SeqID_36984
MLEVAGQTNVFVQAGGANRSGGNHWLCRQWQWRHATCQATRKAPMELAFLHALHIKKQHPHGITFKTTLVQE

SEQ ID NO: 153763 - protein, 332 aa, Glycine max
  Coding DNA Sequence Number=SeqID_36985
  Gene Ontology: Mol. function=nucleotide binding
  Homolog annotation: Hit_ID=Q84WS1; Match level="QueryCoverage=63%, HitCoverage=51%, E-value=9e-90, Identity=65%"; Hit description =Putative axi 1 protein
  Pfam annotation: Domain name=DUF246; Domain location=19-294; Score =290.4; E_value=3.4e-84; Accession=PF03138.5; Description=Plant protein family
MRAAVCTSYSAIPLFLLYDKQKYSFRGAVFQICDMVTVARFLNLTLVVPELDKTSFWADPSNFEDIFDVKHFIDSLRDEVRIVKRVPKKFSSKHGFSTLEMPPVSWSNEKYYLEQALKFTPQIENLGHKLIQMLHEKGSFVALHLRYEMDMLAFSGCTCGCTDKEAEELKQLRYAFPWWREKEIVSDERRSQGLCPLTPEEAALVLRALGFGRETQIYIAAGEIYGGERRLAQLRASFPQIVIFMLGYKCEVKSHIGSPYVVARDSQVYPSNLPNNWYQSRWFDQVSAQTSIQVPQMARMTSGTMCPVGGAGWLPCGRDSHLRGDVLGYKCE

SEQ ID NO: 153764 - protein, 80 aa, Glycine max
  Coding DNA Sequence Number=SeqID_36986
MYIPDQATAYPPGLHISKCTDIKMMPNRTCPRLPIYDEGKKRGLKLYFNKEMPSRDMESSDHIRQKDIVFAYSKKQDQVG

SEQ ID NO: 153765 - protein, 128 aa, Glycine max
  Coding DNA Sequence Number=SeqID_36987
MGIIILCPLRWSHYLMLSLDGFQIWALEDLALLAVVLLISYKEDHEKLFFRFNVDPSIGNFDVLIGERDFLECTSGELDGCGVEIGVTSMSDELESSEDGILMGSFGVMDLHLACVFLFFGKEERMIG

SEQ ID NO: 153766 - protein, 77 aa, Glycine max
  Coding DNA Sequence Number=SeqID_36988
  Gene Ontology: Mol. function=RNA-directed DNA polymerase activity
  Homolog annotation: Hit_ID=Q1S785; Match level="QueryCoverage=61%, HitCoverage=5%, E-value=3e-13, Identity=75%"; Hit description =Integrase, catalytic region
MGSPSMWMEVVFVVMMVVAGAVFLLEFVMVPLLVYFICSPKKNFSSPIILILNSTCISLEKSSQIGPLVAPKIMSST

SEQ ID NO: 153767 - protein, 180 aa, Glycine max
  Coding DNA Sequence Number=SeqID_36989
MIYQKLVRMFWRNAKLKDWKNIVSKVLGKEVVLSMESIAQKSFMHKVGLKDSISDLHKFVLFHLMDEIPFDLPHKVYINIVRNMKSLGGVDDIYYAVIINKLLWEHQFFHIFERMDEDSNQSIISKGTFIAKRLHFSVVNLKAMKGAERQGQDQEAIPTTSGGRRAYHQGATDKEKTYRV

SEQ ID NO: 153768 - protein, 119 aa, Glycine max
  Coding DNA Sequence Number=SeqID_36990
MNSIPTLLILIWVCLRLPLGLLLPGKPLARILAATSLLTVNTSQYVLEKGKEAGKSLAQRSSKNKGKRGALGVPALVTSGHEGESLSHLLRILARRKRKNSEFSDGKAFGNYSSARNSP

SEQ ID NO: 153769 - protein, 44 aa, Glycine max
  Coding DNA Sequence Number=SeqID_36991
MDYESSDPEYESNKLDTDIDESDEDIKMFEKNDSEGESHQHTWV

SEQ ID NO: 153770 - protein, 74 aa, Glycine max
  Coding DNA Sequence Number=SeqID_36992
MTSYLGLANQPRLATSTYLEDEYSSSTDPIALHDKCAQQVLPEMHKMNVNRMEKEEREEMPLQGEDESRRSSPP

SEQ ID NO: 153771 - protein, 58 aa, Glycine max
  Coding DNA Sequence Number=SeqID_36993
MSRGSGALGTSGGVLLPKTKLDQSRPNPSIVSHCESYVIYGLWPLVIDYQGWVINYKA

SEQ ID NO: 153772 - protein, 93 aa, Glycine max
  Coding DNA Sequence Number=SeqID_36994
MDAAFVFKPTEEQIVRLKIHHGGMFIYKSSTVYVNSEIVEEEWGWDVDTMSYIDLRKVIKSIGYKAFKCLWYKHPQKALCRGLKQLNCDSNIL

SEQ ID NO: 153773 - protein, 132 aa, Glycine max
  Coding DNA Sequence Number=SeqID_36995
MRFRPRGHRSSNLVLFVARWSASLRRRPSEGFGVVPKTQCLGAIRKPQHGKEFLIVHLGGPKSRGRKWCNYFEWHDPVANICQKKIIVTLMKKVDELKLREKDLQTKMSDMKMKGKFLGIVLVFSWQRNVIS

SEQ ID NO: 153774 - protein, 276 aa, Glycine max
  Coding DNA Sequence Number=SeqID_36996
  Homolog annotation: Hit_ID=Q10Q33; Match level="QueryCoverage=40%, HitCoverage=34%, E-value=2e-12, Identity=34%"; Hit description =Expressed protein
  Pfam annotation: Domain name=Remorin_C; Domain location=162-274; Score=101.4; E_value=2.7e-27; Accession=PF03763.4; Description =Remorin, C-terminal region
MEHATAVAAAAFAIFSQEVSQIQQQKKMREKPLPRGKSKVDDPKPPISQFGGTSRQFSGSFKPPNDQINNATMDLKRPEKTMTPPSSFGEKVKSSTDGKKPEIQAPKRIPTFGDEDLVNTGEIKPETLQLPRVPPPVHQQMPLKPSPPRPPSPPPPIRPTSARPGANETKADAWEREELEKIKESYEKLLETIDSWEKRKKAKAIRKLNKHQHSESERKRAKVLKNYQDKMNYISQIAGGARAQAEERRRNEVLKAKEKANIIRTTGKIPGPCSCF

SEQ ID NO: 153775 - protein, 54 aa, Glycine max
  Coding DNA Sequence Number=SeqID_36997
MDSLTTVLKVTRLCPWLTVVLKVTTLCPCKGCNNRTREELEEHIKAVIFISKTP

SEQ ID NO: 153776 - protein, 514 aa, Glycine max
  Coding DNA Sequence Number=SeqID_36998
  Gene Ontology: Mol. function=transferase activity, transferring glycosyl groups; Cellular component=cytoplasm; Biological process =metabolic process
  Homolog annotation: Hit_ID=Q94IF1; Match level="QueryCoverage=88%, HitCoverage=97%, E-value=1e-111, Identity=46%"; Hit description =Glucosyltransferase
  Pfam annotation: Domain name=UDPGT; Domain location=5-470; Score= -52.5; E_value=5.6e-08; Accession=PF00201.9; Description=UDP -glucoronosyl and UDP-glucosyl transferase
MTRFEVVFIATPALGNLVPIVEFADLLTKHNPQLSATVLTVTTPQRPLISTYVQSRASSATNLKLLHLPTVDPPTPDQYQSFIAFVSLHIQNHKHQVKNALLNLKKNESNSFDSVRLVALFVDMFSTTLIDVAAELAVPCYLFFASPASFLGFTLHLDRVDPVESESELAVPSFENPLPRSVLPNLVLDANDAFSWVAYHARRYRETKGIFVNTVQELEPHALQSLYNDSELPRVYPIGPVLDLVGSNQWDPNPAQYKRIMEWLDQQPVSSVVFVCFGSMGSLKANQVEEIATGLEMANVRFLWALREPPKAQLEDPRDYTNPKDVLPDGFLERTAEMGLVCGWVPQAVVLAHKAVGGFVSHCGWNSILESLWHGVPIATWPVYAEQQMNAFQMVRELGLAVEIRVDYRVGGDLVRAEEVLNGVRSLMKGADEIQKKVKEMSDICRSALMENRSCHVASETPVAAARCPPAYVAMDAQGALACSAWESEGARSGSANGVGVLGWSGSANGVGVL

SEQ ID NO: 153777 - protein, 731 aa, Glycine max
  Coding DNA Sequence Number=SeqID_36999
  Gene Ontology: Mol. function=transferase activity, transferring glycosyl groups; Cellular component=chloroplast; Biological process =carbohydrate metabolic process
  Homolog annotation: Hit_ID=P53535; Match level="QueryCoverage=90%, HitCoverage=68%, E-value=0.0, Identity=65%"; Hit description=Alpha-1, 4 glucan phosphorylase L-2 isozyme, chloroplast precursor
  Pfam annotation: Domain name=Phosphorylase; Domain location=169-731; Score=456.9; E_value=2.7e-134; Accession=PF00343.10; Description =Carbohydrate phosphorylase
  Subcellular localization annotation: CTP_CleavageSite=58; ConfidenceScore=5.55e-01
MAALPFSTTCRHSNSPLHHNSKTSFIGFSQRNNIWQLFVITKSNSRRAIRKLCVKNVTSDKKQELEEPLNEQDTFNEFVPDSASIASSIKFHAEFTSPFSPEKFELNKAFFATAESVRDSLIINWNATNDYYERMNVKQAYYMSMEYLQGRALLNAIGNLQLSGPYAEALRKLGHNLEDVANKEPDAALGNGGLGRLASCFLDSLATLNYPAWGYGLRYKYGLFKQHITKDGQVEVAENWLEMGNPWEILKNDVSYPVKFYGEVISGPNGSKQWVGGENILAVAYDVPIPGYKTRTTINLRLWSTKVSPEEFDLQAYNSGDHAKAYAVMKNAEKICYVLYPGDESIDGKTLRLKQQYTLCSASLQDIFARFERRLGKRVNWDTLPDKVVVQMNDTHPTLCIPEIIRILVDVKGLSWEKAWNITKRTVAYTNHTILPEALEKWSLTLLQDLLPRHMEIIRKIDEELINEIISEYGIDDLDLFQQRLKKMRILENIELPNSVMELLSITEETPAVDPVKEIDVDDTDVKATEKEDGDDDDDYEVVEEEQEEDNEEPSVEEDTSNKIELKFKVDPKLPMMVRMANLCVVGGFSVNGVAEIHSKIVKEEVFDEFYKLWPEKFQNKTNGVTPRRWIRFCNPDLSKIITKWIGTEDWVTDLEKLAILRKFADNEDLQLEWIEAKRRNKIRVASFLKEKTGYVVNPNAMFDVQLYRFSIPCNGWAVGSQTQSSSSLLS

SEQ ID NO: 153778 - protein, 42 aa, Glycine max
  Coding DNA Sequence Number=SeqID_37000
MEKDELERDKDDGRRRYFENKFKQSMRFIILSNNILILTVGH

SEQ ID NO: 153779 - protein, 662 aa, Glycine max
  Coding DNA Sequence Number=SeqID_37001
  Gene Ontology: Mol. function=hydrolase activity; Cellular component =extracellular space; Biological process=biological_process
  Homolog annotation: Hit_ID=Q9ZQ81; Match level="QueryCoverage=93%, HitCoverage=94%, E-value=0.0, Identity=65%"; Hit description =Putative purple acid phosphatase
  Pfam annotation: Domain name=Metallophos; Domain location=259-489; Score=52.8; E_value=1.1e-12; Accession=PF00149.18; Description =Calcineurin-like phosphoesterase
  Subcellular localization annotation: CTP_CleavageSite=35; ConfidenceScore=5.12e-01
MIPDLPLPFLFSLFIIFFHLAESKPSLTATPTTLPASGATVNLRWSGIPSPSDLDFLAIYSPPTSPHDNFIGYLFLSQSATWRTGSGNLSLPLVDLRSNYSFRIFSWTRAEINPKRQDHDHNPLPVTRHLLAFSEEVSFAPHRGPQQIHLAFVGAHGKEEDMRVMYITRDPRETYVRYGEREDKLDGIAVARVERYEREHMCDAPANTSVGWRDPGFIHDAVLIGLKKGQRYYYKVGNDNGGWSATQSFVSRNSDSDETIAFLFGDMGTAVPYNTFLRTQDESISTMKWILRDVEALGDTPAFVSHIGDISYARGYSWLWDHFFAQIEPVASQVAYHVCIGNHEYDWPLQPWKPDWASYGKDGGGECGVPYSLRFNMPGNSSELTGNAAAPPTRNLYYSFDMGAVHFVYISTETNFVPGSKQYDFLKHDLESVNRSKTPFVVVQGHRPMYTTSHENRDAALRGKMLEHLEPLLVNNNVTLALWGHVHRYERFCPLNNFTCGVNAGHNAGDKKGYTVHIVIGMAGQDWQPVWEPRPDHPDDPIFPQPKWSLYRGGEFGYTRLVATKQKLVLSYVGNHDGEVHDQLEILASGEVVSGDGGCSIADANSKAGNVIVESTLSWYVKGGSVLLLGAFMGYVFGYVTSARKKSEVPESNWTPVKTEET

SEQ ID NO: 153780 - protein, 43 aa, Glycine max
  Coding DNA Sequence Number=SeqID_37002
MGVLIYTSFVEKKHYLSVSVIVSWKQEAHMDVLAFNDAVSFVL

SEQ ID NO: 153781 - protein, 83 aa, Glycine max
  Coding DNA Sequence Number=SeqID_37003
MSSGGGGEGEGEGACESNVADSVARAPKRRRGGAEASGGGSVPVLFCSGKPLADAEGAKRTAMIELLKSHGGLSYLGTTFLCL

SEQ ID NO: 153782 - protein, 37 aa, Glycine max
  Coding DNA Sequence Number=SeqID_37004
MDGLRPDGIHAAIFYHVPNTKVKELMDGYNIFGFSKI

SEQ ID NO: 153783 - protein, 121 aa, Glycine max
  Coding DNA Sequence Number=SeqID_37005
MRDLNKIEILGVLVLTVKNGIGKYEEGKEQEQVSFCTVGTVISLTAGKEHLSSNICGPLYEGGLGQRFFVNLNQAIILALTEKLINFDYHWARLIRARAFKGALHPRCYIKSSLRFGMKNF

SEQ ID NO: 153784 - protein, 139 aa, Glycine max
  Coding DNA Sequence Number=SeqID_37006
  Gene Ontology: Mol. function=receptor activity; Cellular component =integral to membrane; Biological process=intracellular protein transport
  Homolog annotation: Hit_ID=Q307Y3; Match level="QueryCoverage=83%, HitCoverage=52%, E-value=4e-41, Identity=72%"; Hit description =Vesicle transport v-SNARE 11-like
  Pfam annotation: Domain name=V-SNARE; Domain location=42-136; Score= -18.1; E_value=0.038; Accession=PF05008.5; Description=Vesicle transport v-SNARE protein
MSEVFEGYERQYCELSANLSRKCSSASLVSGQEQQQQKLSEIKAGLDDADVLIRKMDLEARSLQPSVKAMLLAKLREYKSDLTNLKKEFKRLTSPNADEVAREELLETGMANTHLSSPILYGLPITTSLQSSLKFSILL

SEQ ID NO: 153785 - protein, 165 aa, Glycine max
  Coding DNA Sequence Number=SeqID_37007
  Gene Ontology: Cellular component=membrane
  Homolog annotation: Hit_ID=Q2QN15; Match level="QueryCoverage=95%, HitCoverage=22%, E-value=2e-34, Identity=49%"; Hit description=Early- responsive to dehydration protein, putative, expressed
MEFLSSIQGYISHSDIEMSASRKVLWFTVWNVFFATVFSGSILSMFNTLLDPKNIPGKLAVAVPAQASFFITYVVTQGWTSVSSELFRVIPFIFSWITRPFTSQDDEFEVPSTPYHKDIPRVLFFGLLGITYFFLAPLILPFLLAYFCLAYIIFRNQVSISLDVI

SEQ ID NO: 153786 - protein, 107 aa, Glycine max
  Coding DNA Sequence Number=SeqID_37008
MYKRVTQLRSDSTQQKNTQRGFPGLFSRKNSVIYYEKKLEDIEENVRLKQLEASLAGEVCVIVQGLTNLNQLEILFPFLTSILTISLGISVSSDKVVRILNHDAVNW

SEQ ID NO: 153787 - protein, 156 aa, Glycine max
  Coding DNA Sequence Number=SeqID_37009
  Gene Ontology: Cellular component=membrane
  Homolog annotation: Hit_ID=Q2QN15; Match level="QueryCoverage=79%, HitCoverage=17%, E-value=1e-39, Identity=60%"; Hit description=Early- responsive to dehydration protein, putative, expressed
MEPFAIFIKGGNCDARRYYPSAKRGSGFINVYAPKYDTAGKFWPIIHNSMIFSLVLMHIIAVGIFALKKLSLASTLTMPLPVLTLLFNEYCRKRFLPIFVAYSAESLKKKDRQDQNDATMTQFYENLVNAYKDPALLPIQHSQNNDNLRSPLISQA

SEQ ID NO: 153788 - protein, 168 aa, Glycine max
  Coding DNA Sequence Number=SeqID_37010
EALPKRFRNVFREEFRKGFRPFFDVLHSFFIVLRSSTGKYLEPSFSIHSMYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 153789 - protein, 149 aa, Glycine max
  Coding DNA Sequence Number=SeqID_37011
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=94%, HitCoverage=38%, E-value=7e-44, Identity=64%"; Hit description =Serine/threonine-protein kinase HT1
MAGSCFHGLRLRMSKSKALPDPSSSSKTQLESDAENVERKRFDSMESWSLIFDSMETWETSKEDQEGEKEEWAADLSQLFIGSKFASGAHSRIYRGIYKQRAVAVKMVKIPSQDEEKKALLEEQFNFEVALLSRLIHHNIVQGVLSMWI

SEQ ID NO: 153790 - protein, 186 aa, Glycine max
  Coding DNA Sequence Number=SeqID_37012
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=82%, HitCoverage=39%, E-value=2e-72, Identity=86%"; Hit description =Serine/threonine-protein kinase HT1
  Pfam annotation: Domain name=Pkinase; Domain location=1-179; Score =55.6; E_value=1.6e-13; Accession=PF00069.15; Description=Protein kinase domain
  Pfam annotation: Domain name=Pkinase_Tyr; Domain location=2-180; Score=24.0; E_value=6.1e-14; Accession=PF07714.7; Description =Protein tyrosine kinase
  Pfam module annotation: Pfam domain module=Pkinase::Pkinase_Tyr; Domain location=1-179::2-180
MTLNLQFIAACKKPPVYCIITEYMSQGTLRMYLNKKEPYSLSTETILRLALDISRGMEYLHSQGVIHRDLKSSNLLLDDDMRVKVADFGTSCLETRCRKSKGNSGTYRWMAPEMVKEKPYTRKVDVYSFGIVLWELTTALLPFQGMTPVQAAFAVAEKMWHCLKDDWSGKFFGSVLYSMIGRTSSF

SEQ ID NO: 153791 - protein, 58 aa, Glycine max
  Coding DNA Sequence Number=SeqID_37013
MRLCISGCPCWVFITCCSGFKYRLHSGPKVGRFISNLCKVLDDSSSGEVSSGIMAPSG

SEQ ID NO: 153792 - protein, 107 aa, Glycine max
  Coding DNA Sequence Number=SeqID_37014
ESPPQRHSVNPEKSNRALGFPALVTGLRSPIGCPFPPARSHHHDIGKVLVTSGKGIRSPTNRAFIKKYCVPRQAQGETPQQPGDGRQRATDARPSPLEFTSAHPQKG

SEQ ID NO: 153793 - protein, 115 aa, Glycine max
  Coding DNA Sequence Number=SeqID_37015
SRVSQFFQEDGCGLAMWDASVAEQIKIDENVEVIGWDICRLFGGGVHWCCGKDKGSRFYVDDHGLKSDYYLSNEDSEKDEVMVVGGLGSWWQWGSREKLWFAKSMYKEQEGQEFE

SEQ ID NO: 153794 - protein, 668 aa, Glycine max
  Coding DNA Sequence Number=SeqID_37016
  Gene Ontology: Mol. function=zinc ion binding
  Homolog annotation: Hit_ID=UPI000034F516; Match level="QueryCoverage =95%, HitCoverage=99%, E-value=1e-176, Identity=54%"; Hit description= metal ion binding
  Pfam annotation: Domain name=zf-DHHC; Domain location=170-234; Score =94.6; E_value=2.9e-25; Accession=PF01529.11; Description=DHHC zinc finger domain
MRKNGWQLPYHPLQVVAIAVFMALGFAFYVFFAPFVGKKMYQYVVMGLYTPLITCVFGLYIWCAASDPADPGVFKSKKYLKIPDSKKLDGLKNSKLGGESTSSMHDGNASTVGPKSVDKEELGTEASFKDAAISTEKKNASSPSLSRLLLVCSPCAYICGCSSSSNESSDQQASEDGMFYCSLCEVEVFKYSKHCRVCDKCVDRFDHHCRWLNNCIGKRNYRKFFTLMVASLLLVLLLITVFLKSSVVCSQNTIPSFLCEATLVPHPTGTGLGNESLLILQWLTGILVLICCFVEKKKFSVDISSKLGSSFSLVPFVIVVAVCTILAMIATLPLAQLFFFHILLIKKGITTYDYIIALREQEQEQQGIGGQQSPQMSPVSSLTGMSSASSFSTFHRGAWCTPPRLFLEDQLDVVPPETASVSSLGKKTMRDEPVKKKNPGAVKISPWTLARLNAEEVSKAAAEARKKSKILQPVTRHNNEPFRLEPDRNSGSSGRRMSPRIETNRRRPGKRIRLPADLPMEAIPKFSASNIDKGFIGTSSLAPLPPKARSVFQPSQAVSSSAGMVASSPESSLDSPDIHPFRVSSTEAEEARRLSDLSAAADVNLKGIPLSRSTSDGYEASGGEDSDRVPTRIVQRSTNWTNMLFSADQYERPFEPKSSSSVVYSRKL

SEQ ID NO: 153795 - protein, 128 aa, Glycine max
  Coding DNA Sequence Number=SeqID_37017
MACWYKELAERDVTKIDIERERENGVVFFVCRVRKGLSDSLRDKPYPGHGRCKEMAFSFSGFLDVGVLACKAFYFCREKRIDLYAVWCGGRAKSCYSQATLTAMDSCLVLLLFAQEKTHATLSLSSLS

SEQ ID NO: 153796 - protein, 909 aa, Glycine max
  Coding DNA Sequence Number=SeqID_37018
  Gene Ontology: Mol. function=translation initiation factor activity; Cellular component=cytoplasm; Biological process=multicellular organismal development
  Homolog annotation: Hit_ID=Q9C793; Match level="QueryCoverage=99%, HitCoverage=88%, E-value=0.0, Identity=67%"; Hit description=Pinhead- like protein
  Pfam annotation: Domain name=DUF1785; Domain location=211-263; Score =101.8; E_value=2e-27; Accession=PF08699.1; Description=Domain of unknown function (DUF1785)
  Pfam annotation: Domain name=PAZ; Domain location=271-403; Score =145.1; E_value=1.9e-40; Accession=PF02170.12; Description=PAZ domain
  Pfam annotation: Domain name=Piwi; Domain location=559-870; Score =349.4; E_value=6.1e-102; Accession=PF02171.8; Description=Piwi domain
  Pfam module annotation: Pfam domain module=DUF1785::PAZ::Piwi; Domain location=211-263::271-403::559-870
MNHLVSYTDSAPKELQQQTKASLKGDDGKKLIPARKPQAVIVARRPDSGGKEGSVISLLANHFLVQFDPSQKIYHYNVEITPHPSKDVARAIKQKLVNNNSAVLCGATPAYDGRKNLYSPVEFQNDKLEFYISLPIPTSKLTSPYGEMSDLKEKHEQLKLFRINIKLVSKINGKELSNYLSKEDDDWIPLPQDYLHALDVVLRESPTEKCIPVGRSFYSSSMGRSKDIGGGAVGLRGFFQSLRPTQQGLALNVDFSVTAFHESIGVIAYLQKRLEFLRDLSQRKTAQLTGEERKEVEKALKNIRVFVCHRETVQRYRVYGLTEEVTENLWFADRDGKNLRLVNYFKDQYNYDIQFRKLPCLQISRSKPCYLPMELCVICEGQKFLGKLSDDQTARILKMGCQRPGERKTIVEGVMRGTVGPTSGDQEKEFKLQVSREMTKLTGRILHPPKLKLGDGGHVRNLTPSRHDRQWNLLDGHVFEGTTIERWALISFGGTPDQKSNVPRFINQLCQRCEQLGIFLNKNTVISPQFESIQILNNVTLLESKLKRILRTASNNLQLLICIMERKHKGYADLKRIAETSVGVVSQCCLYPNLNKLSSQFLANLALKINAKVGGCTVALYNSLPSQLPRLFHIDEPVIFMGADVTHPHPLDDVSPSVAAVVGSMNWPTANKYISRIRSQTHRQEIILDLGAMVGELLDDFYQEVEKLPNRIIFFRDGVSETQFYKVLEEELQSIRCACSRFPGYKPTITFAVVQKRHHTRLFPFETDQSSTQKNNFLYENIPPGTVVDSVITHPKEFDFYLCSHWGVKGTSRPTHYHVLWDENQFTSDELQKLVYNLCYTFVRCTKPISLVPPAYYAHLAAYRGRLYLERSESLGLFRSTSTLSRAAPPKTAPLPKLSENIKKLMFYC

SEQ ID NO: 153797 - protein, 191 aa, Glycine max
  Coding DNA Sequence Number=SeqID_37019
  Gene Ontology: Mol. function=unfolded protein binding; Cellular component=prefoldin complex; Biological process=protein folding
  Pfam annotation: Domain name=Prefoldin; Domain location=54-173; Score= -8.3; E_value=0.088; Accession=PF02996.8; Description=Prefoldin subunit
MDNLRQEKVQRFEEFVDKRLKPDLVHAIAQRFTEVSNYILQNGFKETITDKVFEQQKILYPFSVLYIPLGSISTITRLIIILSNIKICAMLPNLHLDTPRSLPPPSPRPDTQHIFVDVGFGFHVEFTWSEALNYIEKREEKIARQIEEYTQLIASIKAQIKLPAYTTHSLRPHEIGKKLIRLESPQSAECA

SEQ ID NO: 153798 - protein, 1292 aa, Glycine max
  Coding DNA Sequence Number=SeqID_37020
  Gene Ontology: Mol. function=nucleic acid binding; Cellular component= beta-galactosidase complex; Biological process=DNA integration
  Homolog annotation: Hit_ID=Q1ST43; Match level="QueryCoverage=98%, HitCoverage=97%, E-value=0.0, Identity=40%"; Hit description =Integrase, catalytic region; Peptidase aspartic, catalytic
  Pfam annotation: Domain name=rve; Domain location=524-684; Score =137.3; E_value=4.3e-38; Accession=PF00665.16; Description=Integrase core domain
  Pfam annotation: Domain name=zf-CCHC; Domain location=246-263; Score =9.9; E_value=0.023; Accession=PF00098.13; Description=Zinc knuckle
  Pfam annotation: Domain name=zf-CCHC; Domain location=282-299; Score =9.8; E_value=0.024; Accession=PF00098.13; Description=Zinc knuckle
  Pfam module annotation: Pfam domain module=RVT_2::Retrotrans _gag::rve::zf-CCHC::zf-CCHC; Domain location=785-1040::77-192::524 -684::246-263::282-299
MNETTLNNIESYLYLHPSENPSIALVSPVLDSTNYHSWIRSMITALSAKNKLEFVDGSAPEPLKTDRTYGAWRWCNNMVLSWIVHSVAASIRQSILWMDKAEDIWRDLKTRYSQGDLLRISDLQQEASTLRQGTLSVTEYFTRLRVIWDEIENFRPDPACTCNVRCSCSAFAIIAQRKLEDRAMQFLRGLNDQYTNIRSHVLLMDPIPAITKIFSYVAQQERQLLGNSSPNLNFEPKDVSINAAKTICDYCGRIGHTENICYKKHGMPLNHETRNKGTSGRKSCTHCGRMGHTVDVCYRKHGYPPGYKPYNGRSTVNNVVTMDSQPMEDQNQHRESQDVVRFSPEQYKALLALIKQSSTGSTTLEQTKQVASISSCAIDKPSSPGTFQSFTSPWILDSGATDHVTCSLSNLHSYECINPVPVKLPNGHQDASTRTKIGIVEEKHGLYHLIPDQENKVICSTIIHPKCKIIPIDLWHFRMGHLSTERLQCMKPHYPILWNDKTFVCNTCHYAKHKKLPFSSSTSHASHIFDLLHVDIWGPCSKPSMHGHKYFLTIVDDHSRFTWVHLMHTKAETRDIIVNFIASVETQYNKKIKKIRSDNGYEFLMPSFYASKGIMHQTTCVETPEQNGIAERKHQHLLNVTRALLFQANLPSNFWCYALLHATYLVNCIPTPFLHNVSPYEKLHGHLPEISHLRVFGCLCYASTLKANRKKLDPRAHPCIFIGFKASTKGYLVYNLHLHSIITSRNVVFYEDHFSQIPETQSSHPESMEPSSYAEASQYDCWIKAMEAELQALQSNNTWKLTLLPPHKTAIGCRWVYKIKHRADGSIERYKARLVAKGYTQMEGLDYLYTFSPVAKLTIVRLLLAMVAFNQWHLRQLDVNNAFLHGELDEEVYMQVPHGLSVPNSQMVCRLQRSLYELKQASRQWFTKLSGLLISLGFEKSHSDHSLFLRFTGSIITALLVYVDDIILTGNSESEIQDVIKLLDQAFKIKDLGNLKYLLGMEIARSSSGIHLCQRKYTLDILSDSGMLGCRPNVTPMDYSTKLQATAGTPLSTEASSSYRRLIGRLIYLTNTRPDITYAVQQLSQYMSNPTSVHQQAAYRILRYLKGTPGSGIFLSATGTPQLRAFSDSDWAGCQDSRKSITGFVIYLGSSPASWQSKKQSTVSRSSSEAEYRAMATTTCELQWLTYLLQDFRHNFTKPATIYCDNQSAIQIATNPVFHERTKHIEIDSHIVRQKVTSGLLKLLPVPSSLQLADIFTKALPPMVFQNLCNKLGMMNIHSQLEGGILAAPCDS

SEQ ID NO: 153799 - protein, 110 aa, Glycine max
  Coding DNA Sequence Number=SeqID_37021
MTASMAGPNRVCFETNCNGGLIFTLIPPFLLAASMYRHCHQRYTCVPPLPKAEPKLTHLVSQFVLAEPKLTHVSPFVLAGHANVGSPAIGTCRTRRGCFLQRFSLKNKWV

SEQ ID NO: 153800 - protein, 216 aa, Glycine max
  Coding DNA Sequence Number=SeqID_37022
  Gene Ontology: Mol. function=oxidoreductase activity; Cellular component=cytoplasm; Biological process=metabolic process
  Homolog annotation: Hit_ID=Q3J0A0; Match level="QueryCoverage=98%, HitCoverage=79%, E-value=3e-69, Identity=61%"; Hit description =Putative 3-oxoacyl-(Acyl-carrier-protein) reductase
  Pfam annotation: Domain name=adh_short; Domain location=4-123; Score=- 8.3; E_value=1.9e-05; Accession=PF00106.15; Description=short chain dehydrogenase
QGGQAYAVTGDLTREADIQLLYQQVCSLVQSIDIVVNNAGGSGPTEDWTSSLPETWAAGYDKNVLSALRVINLFLPGMREQKWGRIINISSLAALMPPARRPDYAAAKAGIIAMTSSLAKAVAHDGVTVNTLSPGTIHSASLEKAFRQTAKDAGFSADAPWEDIEQAVLPLYANVPMARVGTLKEIADAITFLASPLSGYITGSNLRLDGGMWPGL

SEQ ID NO: 153801 - protein, 97 aa, Glycine max
  Coding DNA Sequence Number=SeqID_37023
  Gene Ontology: Mol. function=nucleic acid binding; Cellular component= intracellular; Biological process=regulation of transcription
  Homolog annotation: Hit_ID=P93719; Match level="QueryCoverage=98%, HitCoverage=18%, E-value=3e-08, Identity=35%"; Hit description=ZPT4-3
  Pfam annotation: Domain name=zf-C2H2; Domain location=7-29; Score =18.1; E_value=0.033; Accession=PF00096.16; Description=Zinc finger, C2H2 type
MEERKKYVCKYCSKSFPCGKSLGGHIRTHMMTEERNNNNNVNVVVDGADDKDNINRFIKLGGTVMRNNNNKKRDLSWCEDSNNNPIYGLRENPKKTM

SEQ ID NO: 153802 - protein, 295 aa, Glycine max
  Coding DNA Sequence Number=SeqID_37024
  Gene Ontology: Mol. function=helicase activity; Cellular component =membrane; Biological process=viral genome replication
  Homolog annotation: Hit_ID=Q1SN45; Match level="QueryCoverage=98%, HitCoverage=17%, E-value=1e-79, Identity=51%"; Hit description=AAA ATPase
  Pfam annotation: Domain name=DUF889; Domain location=1-209; Score =246.7; E_value=5e-71; Accession=PF05970.5; Description=Eukaryotic protein of unknown function (DUF889)
MRLQANAQSVDNQETARFAKWILDIGDGVIGNENDEYATVEIPEYLLITEYNDPIDAIVRSTFPNLYQHHSNPEFFKCRAILASTNETVEEVNDYILSLIPGEHMEYLSSDCINKSKSIESWHFQSITTEFLNSLNTSGLPNHCIKLKIGSPIMLLRNLDQTQDLCNGTRLVVTRLAKHVIAAGIIFGKNPDHNVYIPRMSMSPSQSPWPFKLLRRQFPIMLSYVIAINKSQGQSLSMVGLYLPKPVFSHGQLYIALSRVNSREGLKVLIHDKDKKNMTSTTNVVFKEVFKNLTR

SEQ ID NO: 153803 - protein, 72 aa, Glycine max
  Coding DNA Sequence Number=SeqID_37025
MDSWSYFQALRMKDDFGYKEELWNMKTMLRKIVIRKNVEKVHLDDNVDERCAGDDDGIEVIRFRANSNNAEE

SEQ ID NO: 153804 - protein, 233 aa, Glycine max
  Coding DNA Sequence Number=SeqID_37026
MEGSIDVALVKEFYANLYVSEDKPPKQVRVRGHLIKFDVDSLNTFLETPVVLEPGETLPAYSKFCRLRPDPQELAARLCISGRGFVLNAEGLPWKLLRKYLTTLAQTWSVLSYFNLAPTSRTFDLNLDKARLVYGLVMKMEMNVRALISGQITLMAHSNSSRLEFPALITALCMARGVTSDSLTFESLSLAINLAYIKKNYWTTPRSTFQGPARPGLEDLRVHLLLLPRHLLH

SEQ ID NO: 153805 - protein, 294 aa, Glycine max
  Coding DNA Sequence Number=SeqID_37027
  Gene Ontology: Mol. function=DNA binding; Cellular component=nucleus
  Homolog annotation: Hit_ID=Q2HUC6; Match level="QueryCoverage=26%, HitCoverage=13%, E-value=1e-15, Identity=53%"; Hit description=ELM2; AT-rich interaction region; Homeodomain-related
  Pfam annotation: Domain name=Myb_DNA-binding; Domain location=6-56; Score=21.1; E_value=0.004; Accession=PF00249.21; Description=Myb -like DNA-binding domain
MGEDVSRQWTEEEEDMFHEVVYSNPASLGRNFWKHLSVTVSSRTSKEIVSYYFNVFILRRRAAQNRSRFLDIDSDDDECQTRNSRIFGFENSDDSAIESLGDEDVRVENHDNYSDEDDDDDNTDDGTEDNVHGVTGCDIGNTTEIEGEIDQNPSNSKVNSQIEPWSNPDEHVNGTPGILNYNIAVGDDSCMSFECDANMHVSCHSHGLGGASSALQARGYNCNQSPHTQGKLDLSSNEMDHVYLMEPCVSKDWYPGPEVTEVLTQFFWHQLDRFKLLEGANPGLRKFQSWTKER

SEQ ID NO: 153806 - protein, 173 aa, Glycine max
  Coding DNA Sequence Number=SeqID_37028
  Gene Ontology: Mol. function=oxidoreductase activity, acting on the CH-OH group of donors, NAD or NADP as acceptor; Biological process =electron transport
  Homolog annotation: Hit_ID=Q96558; Match level="QueryCoverage=99%, HitCoverage=43%, E-value=7e-50, Identity=54%"; Hit description=UDP -glucose 6-dehydrogenase
  Pfam annotation: Domain name=UDPG_MGDP_dh_C; Domain location=72-173; Score=82.8; E_value=1.1e-21; Accession=PF03720.5; Description=UDP -glucoseGDP-mannose dehydrogenase family, UDP binding domain
MAQRITSVNAMSALCETIDADVSRCCTQLGQTQGLNQVPECQCWLWWLLLSEGHNELGWCINVQHNFNKKIAILGFAFKKDTGDTRETSTIDMCKGLLGDKAKLSIYDPQVTEDQITKDLSMRKFDKDHPAHLQPPSPTSIKLLSVVWDAYDALKDAHGACILTEWDAFKKLD

SEQ ID NO: 153807 - protein, 226 aa, Glycine max
  Coding DNA Sequence Number=SeqID_37029
  Gene Ontology: Mol. function=DNA binding; Cellular component=nucleus
  Pfam annotation: Domain name=ELM2; Domain location=134-226; Score =10.2; E_value=0.023; Accession=PF01448.14; Description=ELM2 domain
MGYKRCREANEFEDLSLNKAKRFECNNELVSLADIVTPNKAFAKTVIKGDEDGFYNIQWYDPLETDAAKESPYSGDKNGKTSGHFRSCSSEDDTGSGATSLSSASSDCLEFDTPQKVFVPLDDDYLDFDCSPRKSVPIGPNHQATIPVWRGKVNKMLELGIYNHDSPSSGLVSAHTVDEDEERLMGTSVLSMDEFSFHYFSSNEIGQGRTECNCMDRCSIRCVRQH

SEQ ID NO: 153808 - protein, 176 aa, Glycine max
  Coding DNA Sequence Number=SeqID_37030
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SBL9; Match level="QueryCoverage=99%, HitCoverage=42%, E-value=4e-87, Identity=73%"; Hit description=Beta -glucosidase, putative
  Pfam annotation: Domain name=Glyco_hydro_1; Domain location=1-176; Score=-223.2; E_value=1.7e-07; Accession=PF00232.9; Description =Glycosyl hydrolase family 1
FLDPLMFGDYPSSMRTRVGSRLPKFSQSEAALVKGSLDFVGINHYTTFYAKDNSTNLIGTLLHDSIADSGAVTLPFNGTKAISERASSIWLYIVPQSMKSLMIYIKQKYGNPPVYITENDGCNVKGYFVWSLLDNWEWSAGYTSRFGLYFVDYKDNLKRYPKQSVEWFKNFLKPTK

SEQ ID NO: 153809 - protein, 218 aa, Glycine max
  Coding DNA Sequence Number=SeqID_37031
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1SBL9; Match level="QueryCoverage=84%, HitCoverage=36%, E-value=1e-98, Identity=89%"; Hit description=Beta -glucosidase, putative
  Pfam annotation: Domain name=Glyco_hydro_1; Domain location=21-218; Score=-61.1; E_value=1.2e-15; Accession=PF00232.9; Description =Glycosyl hydrolase family 1
MRIRNLLMGIELLIKVKSNFAIKWYMFYQGDIRYGKIIDFSNADVAVDQYHRYEEDIQLMKDMGMDAYRFSISWSRIFPNGYGQINQAGVDHYNKLINALLAKGIEPYVTLYHWDLPQALENKYSGWLNASIIMDFATYAETCFQKFGDRVKHWITFNEPHTFATQGYDVGLQAPGRCSILLHLFCRAGNSATEPYIVAHNVLLSHATVADIYRKKYK

SEQ ID NO: 153810 - protein, 121 aa, Glycine max
  Coding DNA Sequence Number=SeqID_37032
MRLTVLGLSTKCLLTVLGWDFQTLKIDNLNGAQKVKKPSPARPANSCNPRLVPCLKSPVKAAISAQARNRQLHRRDAPQPEIANSSSGLPSTCPVPTMSPMKAHDSSMEDVESKKVTRGGI

SEQ ID NO: 153811 - protein, 167 aa, Glycine max
  Coding DNA Sequence Number=SeqID_37033
  Homolog annotation: Hit_ID=Q5CEG7; Match level="QueryCoverage=62%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVGFAG

SEQ ID NO: 153812 - protein, 183 aa, Glycine max
  Coding DNA Sequence Number=SeqID_37034
  Gene Ontology: Mol. function=unspecific monooxygenase activity
  Homolog annotation: Hit_ID=O04892; Match level="QueryCoverage=87%, HitCoverage=35%, E-value=2e-30, Identity=54%"; Hit description =Cytochrome P450 like_TBP
PAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCPRHLISDAHEWINEIPTVPVYYPAKPTAKGTGLAESAGKEDPVELDSSPTL

SEQ ID NO: 153813 - protein, 66 aa, Glycine max
  Coding DNA Sequence Number=SeqID_37035
MVSFFLTNILLEVVSPIIFLLHSIVIHLQEAKDSIDEEDSRPTGSTWSYTMWYQEHLHLGSIIFQS

SEQ ID NO: 153814 - protein, 69 aa, Glycine max
  Coding DNA Sequence Number=SeqID_37036
MTVEGDRLRNTRHVRRYMEKNEETTMEEKVKMKTNGGLRSTYLKLLCSDYHLMETCLRSFYGGWIFELH

SEQ ID NO: 153815 - protein, 59 aa, Glycine max
  Coding DNA Sequence Number=SeqID_37037
RGGEGSFNRNTSSNNVNFERKRVKHMRIYEKKKNIVFFGTRGLHVESIISLKSGCVSGI

SEQ ID NO: 153816 - protein, 479 aa, Glycine max
  Coding DNA Sequence Number=SeqID_37038
  Gene Ontology: Mol. function=DNA binding; Cellular component=nucleus; Biological process=regulation of transcription, DNA-dependent
  Homolog annotation: Hit_ID=Q9FR43; Match level="QueryCoverage=88%, HitCoverage=91%, E-value=9e-68, Identity=36%"; Hit description =Anther-specific myb-related protein 2
  Pfam annotation: Domain name=Myb_DNA-bind_2; Domain location=28-81; Score=-5.9; E_value=0.045; Accession=PF08914.1; Description=Rap1 Myb domain
  Pfam annotation: Domain name=Myb_DNA-binding; Domain location=26-73; Score=48.1; E_value=2.9e-11; Accession=PF00249.21; Description=Myb -like DNA-binding domain
  Pfam annotation: Domain name=Myb_DNA-binding; Domain location=79-124; Score=45.6; E_value=1.7e-10; Accession=PF00249.21; Description=Myb -like DNA-binding domain
  Pfam module annotation: Pfam domain module=Myb_DNA-bind_2::Myb_DNA -binding::Myb_DNA-binding; Domain location=28-81::26-73::79-124
MARTVSNNDDETAAKEEGEVKDGVRKGPWTPEEDAILMEYVKKHGEGNWNSVQKNSGLLRCGKSCRLRWANHLRPNLKKGAFSPEEEQVIIDLHSKLGNKWARMAAQLPGRTDNEIKNFWNTRMKRRQRAGLPIYPPEVHAEANAYHLQHHRYLEQQQPPPYSSSSFSLLLSSCYPKKLNDPNQIHHHSSANPMQNQPDHSADRSINPSQQFKFSNENSTGNNGNFAFPMSPLSPYGSSSSTLLNHSFGGDHGGFIAGSPYEQPFPLVQGSTTDISSNQTPTPASSYASGVDGLMGASSMVNNNNNNNDYYEVAPLSPHQGNSGLLDALVMEAQGLYHNEKSRSEEDLNLAGKLSCKRKNMEYAEEGGTVPAGVSAMKKNSGNSSNESQRDDDISSSQLSKGKKQIGEDPLEEMNGMDDDLVSLLNQFPLEMPMPEWYRRGENQSLGLENQPKASSPDPADHEHAWTLGTCWNNMPRIC

SEQ ID NO: 153817 - protein, 168 aa, Glycine max
  Coding DNA Sequence Number=SeqID_37039
MLVRATHQALHLETVGERWRQFKSDLTRKWALAADQDGVEDTVCDKYGISKEKWAQFCQTRRDPSWEDVRMKAQAIQKQNTAPHVLSCGGYDYLEQKLLAEKTKKKMQEAAQLGSVDGVIDASSPVRRHVKWKMTRTKKTGEMTTEAAKEIAEKIVSHVQQTITIMFE

SEQ ID NO: 153818 - protein, 73 aa, Glycine max
  Coding DNA Sequence Number=SeqID_37040
  Gene Ontology: Mol. function=nucleic acid binding; Cellular component= mitochondrion; Biological process=DNA integration
MKEVRLQVPLTCASRSKDLVELAKGCKKVGCKWIFKTKRDSHGNLEHYKTRLIAKGFTQKDGFEYKETFSPIL

SEQ ID NO: 153819 - protein, 229 aa, Glycine max
  Coding DNA Sequence Number=SeqID_37041
  Homolog annotation: Hit_ID=Q1SMF0; Match level="QueryCoverage=88%, HitCoverage=39%, E-value=9e-27, Identity=35%"; Hit description =Tetratricopeptide-like helical
MYDSIKYEEVDMDDENEHEPGVNEEQHVDCSDAFNTYEWAQSIAYENGFLAVIMRSDAGMRGRTSFVLIGCERSGQYRSGKKDFVRRDTGSRKHRRPFKLYGKPVVEGQGWMMKLMCGSHNHELAKSLVGHPYVGRLSKDEKTIITDMTKSMVKPRNILLTLKEHNANSCTTIKQIYNARSAYHSSIRGSDTEKQHLMKLLQRDQYIHWHRLKDEDVVLHIWRVNMLIM

SEQ ID NO: 153820 - protein, 102 aa, Glycine max
  Coding DNA Sequence Number=SeqID_37042
EVALRKWMMDRDALGCSGQRISKNLGELASGDYLTFGEQMTHPCNQQLSITNDVEYTEASTDSDRGDHLDMSSEEMEEYRDLQRQLEPTYENESNDSSEDTS

SEQ ID NO: 153821 - protein, 143 aa, Glycine max
  Coding DNA Sequence Number=SeqID_37043
  Homolog annotation: Hit_ID=Q9FHP0; Match level="QueryCoverage=69%, HitCoverage=21%, E-value=4e-16, Identity=47%"; Hit description =Arabidopsis thaliana genomic DNA, chromosome 5, TAC clone:K14B20
  Pfam annotation: Domain name=BSD; Domain location=7-66; Score=14.9; E_ value=0.0048; Accession=PF03909.7; Description=BSD domain
MTIVAIPIGDFDLFDAQQEDDLAVEHLAPSLATIRMELFLGYMSDGNFWKIYFAIVHPRHSKTNIAISSTLQQFAVYVQIMEARAMLTLDLDKRSKEKKESDLSTRGNIPSKREGTRSLCFKYCSEDDIGVTCDLSLRSGICN

SEQ ID NO: 153822 - protein, 166 aa, Glycine max
  Coding DNA Sequence Number=SeqID_37044
MESDSKTFSSIGIELGSDASSVINLDEYMVFDNDSSAAKDFFKKLLYRHVTAIDETLDYPDDNHTFINDVFSQTSSFDEYVRAVEGVPRDAINIIAFAAQHANENKISISNIRHSAQRWFQVNKHSALNSRPEAVSLLDKIINEVYQQEVLWAKSTHYIPLIMVAM

SEQ ID NO: 153823 - protein, 278 aa, Glycine max
  Coding DNA Sequence Number=SeqID_37045
  Homolog annotation: Hit_ID=Q1SKD7; Match level="QueryCoverage=76%, HitCoverage=54%, E-value=4e-10, Identity=25%"; Hit description =Ankyrin
MTSRKRRAVPTPGEASNWDTSRFTSEIAWHRYQDNIQLRNILPERNVELGPGMFDEFLQELRRRRWDQVLTHLPEKRIDVALVKEFYSNLYDPEDHSPRFCRVRGQVVRFDADTINDFLDTPVILEDGEEYTAYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAIKLAYVKKNCWNPA

SEQ ID NO: 153824 - protein, 137 aa, Glycine max
  Coding DNA Sequence Number=SeqID_37046
MAPTRHPLDLEKSNRALGFVALITGLCQSYGVHVTPARRRVTHIRMRAHRHHIGRPIELGHWTWSSIYNIWFASRQPTTMDRCRYMNVSTGSASVSRGRVPPLLYALPRSSLGLRSHGLETGPLPRQGTSLQNLWRP

SEQ ID NO: 153825 - protein, 97 aa, Glycine max
  Coding DNA Sequence Number=SeqID_37047
MPYVRFLSSSNFIVVSADLKQAFGSSFEHKSIVIFNMQNYQHAKRSDSAKAGINRKRIMQQKRHAHAQSSSQPTVNYTSEYDSETSDIACSARNQFT

SEQ ID NO: 153826 - protein, 111 aa, Glycine max
  Coding DNA Sequence Number=SeqID_37048
  Gene Ontology: Mol. function=metal ion binding; Biological process =metal ion transport
  Homolog annotation: Hit_ID=Q1S7A8; Match level="QueryCoverage=98%, HitCoverage=95%, E-value=7e-20, Identity=46%"; Hit description=Heavy metal transport/detoxification protein
VDDVDIDMRMQKVTVMGWADQKKVLKTVRKTGRRAELWPYPYNPEYHALARHYGNGNYFASAKPSSSYNYYKHGYSYGEDFGYYHKPIGAAIIDEKAMSMFSDDNPHACSI

SEQ ID NO: 153827 - protein, 185 aa, Glycine max
  Coding DNA Sequence Number=SeqID_37049
  Gene Ontology: Mol. function=protein binding; Cellular component =integral to membrane; Biological process=protein amino acid phosphorylation
  Homolog annotation: Hit_ID=Q1S2R0; Match level="QueryCoverage=96%, HitCoverage=57%, E-value=2e-32, Identity=48%"; Hit description =Leucine-rich repeat, plant specific
  Pfam annotation: Domain name=LRR_1; Domain location=122-145; Score =9.6; E_value=4.6; Accession=PF00560.23; Description=Leucine Rich Repeat
  Pfam annotation: Domain name=LRR_1; Domain location=148-170; Score =13.2; E_value=0.95; Accession=PF00560.23; Description=Leucine Rich Repeat
  Pfam annotation: Domain name=LRR_1; Domain location=17-39; Score =21.3; E_value=0.0035; Accession=PF00560.23; Description=Leucine Rich Repeat
  Pfam annotation: Domain name=LRR_1; Domain location=41-64; Score=3.1; E_value=75; Accession=PF00560.23; Description=Leucine Rich Repeat
  Pfam annotation: Domain name=LRR_1; Domain location=93-120; Score =5.5; E_value=26; Accession=PF00560.23; Description=Leucine Rich Repeat
  Pfam module annotation: Pfam domain module=LRR_1::LRR_1::LRR_1::LRR _1::LRR_1; Domain location=122-145::148-170::17-39::41-64::93-120
ANQFEGNIPSQIGNLSQLQHLDLSYNSFEGSIPSQLGNLSNLQKLYLGGRALKIDDGDHWLSNLISLTHLSFDSISNLNTSHSFLQMIAKLPKLRELSLIHCSLSDHFILSLRPSKFNFSSSLSVLDLSWNSFTSSMILQWLSNVTSNLVELDLSHNLLEGSTSNHFGRVMNSLEHLDLSYNIFK

SEQ ID NO: 153828 - protein, 167 aa, Glycine max
  Coding DNA Sequence Number=SeqID_37050
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=9e-17, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLLSSNVIHICVRVIMLVRMIRTRLFAAARVWIWSPLKVTTRSPLKARECSPLKLRTCHPLNARACNPLKVRKCSPLKVRTCSPLKVRTCNPLKVMVCSPLMVRTCSPLKMRMCSPMKVRKCSPLKVRACNPLMERMCSPLKVRAGSPLKVRPCSPLKARACKPGIL

SEQ ID NO: 153829 - protein, 55 aa, Glycine max
  Coding DNA Sequence Number=SeqID_37051
MANNITWQKSSLKLLCHHGPHTLLTQEMEALEEDYGDGNGKNESRQYIEGLMDLE

SEQ ID NO: 153830 - protein, 99 aa, Glycine max
  Coding DNA Sequence Number=SeqID_37052
MYVCIWSSILCKWAEMDPRKVADVEVVMVHLLLDDVADLALAIVLPWHKDITEKESHLDLSQSHHVGAHDSRPPPYHAPYKITSWGSKANNLYPLHQNL

SEQ ID NO: 153831 - protein, 75 aa, Glycine max
  Coding DNA Sequence Number=SeqID_37053
MIASTITRYTSITRTLDPWPSPEQFRATIAWPGDRPILHEEAKPTGAQGAAQGDGGRAEDDENMADLVDYFIGGD

SEQ ID NO: 153832 - protein, 218 aa, Glycine max
  Coding DNA Sequence Number=SeqID_37054
  Homolog annotation: Hit_ID=Q1S175; Match level="QueryCoverage=87%, HitCoverage=57%, E-value=2e-57, Identity=51%"; Hit description=MtN19- related
  Pfam annotation: Domain name=SURNod19; Domain location=26-218; Score=- 60.0; E_value=5.7e-10; Accession=PF07712.3; Description=Stress up -regulated Nod 19
MEFISNAMILSFSILLLLPSASYSLYQKPENHIKTAIFVTGSFEMGPGSIATKTFENIKFPKGHVGIKSFDAELVDQEGNSIPSYETYLHHWFAIKYHQNITMSPNPKLRRPEDAFFQRNEGTCNGGILPHYWGFGVESRGTTSKIPDPFAIEQGNPTKIKNGYEEKWLLNIMVIDTRGAQDKKACTQCRCDQMNLPKDFYNVTRDIHNQKLTTNYKG

SEQ ID NO: 153833 - protein, 114 aa, Glycine max
  Coding DNA Sequence Number=SeqID_37055
  Subcellular localization annotation: CTP_CleavageSite=17; ConfidenceScore=5.06e-01
MSGAPDYLHRSPLFSPSAAYTTTISARFLSRRYPADKSIRHATLAADGQITFVGAIVEPSCDYAVTRSVSLNCTREGIKKSETLQVNGAARELPYALGTARITRERGLTFLQVE

SEQ ID NO: 153834 - protein, 109 aa, Glycine max
  Coding DNA Sequence Number=SeqID_37056
MTKLGLCLSSALDDKRVRITVRMTKLGLCLSSALDDKRVRITVRMTKLGLCLSSALDDKRVRITVRMTKLGLCLSSALDDKRVRITVRYLRVSWVQNDQTWSLLVICSG

SEQ ID NO: 153835 - protein, 146 aa, Glycine max
  Coding DNA Sequence Number=SeqID_37057
  Gene Ontology: Mol. function=transferase activity; Biological process= electron transport
  Homolog annotation: Hit_ID=Q1T4N4; Match level="QueryCoverage=63%, HitCoverage=16%, E-value=7e-12, Identity=38%"; Hit description =Polynucleotidyl transferase, Ribonuclease H fold
MDNIFDKTQLEVDGEWDMLCALISLPVSKSSYGEHKAGECAILLPLVTLVGGAGRNFRGDYREFIATKTEWRNQLLHATEGKALDLLSTLIWLVDLDMSHVVIELDCKCVVDKLLHARNDISKLGAILKECKSISSLFPNFVVKFA

SEQ ID NO: 153836 - protein, 161 aa, Glycine max
  Coding DNA Sequence Number=SeqID_37058
MESQREYEKEEEALVLKTTKVVEYLVPKMSIELLCKFPDNSAYDFDYSQSTIWSPLLPRPYTPMDLDLITPKKLSYDEKVGSKLRKKFTASTFNLNLDFIRKNSKSKNKKVPSEFSPTPFRGACNPIMNKRWARALKAASKQFKKWKVKRDPIAHVMLPRS

SEQ ID NO: 153837 - protein, 149 aa, Glycine max
  Coding DNA Sequence Number=SeqID_37059
  Subcellular localization annotation: CTP_CleavageSite=49; ConfidenceScore=5.46e-01
MEIPNCITPLRTKSYSNSFVPFPVSSTTSQMQSYPPRVLDRRLQEDWARATKEGFGVFPSFGPCILAILDASFIGACRPRIFFINGFLCFLEDEWQRNGERKRERRRHFKEKMSLEEAHHHRRPWIRAWRKKEMNEGRGREEHEILCSK

SEQ ID NO: 153838 - protein, 106 aa, Glycine max
  Coding DNA Sequence Number=SeqID_37060
MAHSPDKIKSIDGSKETLKLSVRINDLWFIGTPNKSEQAEMVFVDSNCVLRDIPFRKYRFAGFADVVAGQFEPGLLVDVIGVVEEVVFHQVSGKGRRVVFKLKDLE

SEQ ID NO: 153839 - protein, 75 aa, Glycine max
  Coding DNA Sequence Number=SeqID_37061
KFLQSDRWDFKNNNFWLRLSENGALSAIPTEGNCAKWPKAALSLIPTEGNCTEQPKGALSEPYFRGGCAKTKFLR

SEQ ID NO: 153840 - protein, 203 aa, Glycine max
  Coding DNA Sequence Number=SeqID_37062
  Gene Ontology: Mol. function=binding; Cellular component =intracellular; Biological process=metabolic process
  Homolog annotation: Hit_ID=Q1SCU6; Match level="QueryCoverage=61%, HitCoverage=57%, E-value=3e-52, Identity=82%"; Hit description =Tetratricopeptide-like helical
  Pfam annotation: Domain name=PPR; Domain location=117-151; Score =18.7; E_value=0.022; Accession=PF01535.11; Description=PPR repeat
  Pfam annotation: Domain name=PPR; Domain location=154-188; Score=6.6; E_value=1.2; Accession=PF01535.11; Description=PPR repeat
  Pfam module annotation: Pfam domain module=PPR::PPR; Domain location =117-151::154-188
MDKEEIPASCSKRCYAPKLSPIVLPLLVSLVPVWGKMGHFNIVQLFMLMSSSGAMILTILYSLAVLLQGRQVQSVVIKMGSERNVFVASALIDMYSKGGDIDEAQCVLDQTSKKNNVLWTSMIMGYAQCGGSSEAVKLFGCLLTKQEFIPDHNICFTAVLTTCNHAGFLDKGVEYFNKMTTNYGLSPDIDQYACLIFMQETEI

SEQ ID NO: 153841 - protein, 328 aa, Glycine max
  Coding DNA Sequence Number=SeqID_37063
  Gene Ontology: Mol. function=protein serine/threonine kinase activity; Cellular component=membrane; Biological process=protein amino acid phosphorylation
  Homolog annotation: Hit_ID=Q9FDV7; Match level="QueryCoverage=92%, HitCoverage=63%, E-value=1e-103, Identity=59%"; Hit description =Protein kinase
  Pfam annotation: Domain name=Pkinase; Domain location=50-303; Score =215.6; E_value=1.1e-61; Accession=PF00069.15; Description=Protein kinase domain
  Pfam annotation: Domain name=Pkinase_Tyr; Domain location=50-303; Score=205.7; E_value=1.1e-58; Accession=PF07714.7; Description =Protein tyrosine kinase
  Pfam module annotation: Pfam domain module=Pkinase::Pkinase_Tyr; Domain location=50-303::50-303
MGKLSIKLHDKCKNRKESSSWPLTKCFQHGSGRDDAIGITQEWGIDFSNLFIGHKFSQGAHSQIYHGIYKKEHAAVKFVKVRYNDQKGIPKSLLEAQFLREVTHLPRLHHQNVVKFIGAHKDTDFYCILTEYQQKGSLRVYLNKLESKPISLKRVIDFALDIARGMEYIHAQGIIHRDLKPENVLVDGEIRLKIADFGIACEASKCDSLRGTYRWMAPEMIKGKRYGRKVDVYSFGLILWELVSGTVPFEGLSPIQVAVAVADRNSRPIIPSHCPHVLSDLIKQCWELKPEKRPEFCQIVRVLEQLDQGCSFLPPKKLKQHPLSLRKW

SEQ ID NO: 153842 - protein, 410 aa, Glycine max
  Coding DNA Sequence Number=SeqID_37064
  Gene Ontology: Mol. function=transferase activity, transferring glycosyl groups; Biological process=sucrose metabolic process
  Homolog annotation: Hit_ID=O24301; Match level="QueryCoverage=71%, HitCoverage=44%, E-value=1e-107, Identity=61%"; Hit description =Sucrose synthase 2
  Pfam annotation: Domain name=Sucrose_synth; Domain location=59-410; Score=270.8; E_value=2.7e-78; Accession=PF00862.10; Description =Sucrose synthase
LMQQRRITEPAGWSWVDDSTIFVRTLKLDVDVVNVLITLYVKCGDANTARLVFDKMPQHHPVSFHDSAFPTLAFHLDHTWNQDGFQPNLEIHLLPLLSMKPEDTSLEFNSWDLLFCLKDVIFLPPFVAIPVRPRPGVWEYVHNNVSDLSVEQLSVSEYLCFKEELVDGKINDNLYWSLTLSHLMPHFLAHSTSHTLAMSALAMAEDYLSKLASGTLYSEFEYVLQGMDFERGWGDTAERVLELSDMLLDILQAPDHYTLETFLEREPMVFNVDILSPHGYFGQANVLGLPDTGGQVVYILGQVRALENEMLLQIKKQGLDFTPRILIVTRLIADAKGTTCNQRLERVNGTDHTHILQVPFRSELGTLKAVASEVVVELQGHPASIIGNYSDGNLVASLSAYKMGVTQCTI

SEQ ID NO: 153843 - protein, 352 aa, Glycine max
  Coding DNA Sequence Number=SeqID_37065
  Gene Ontology: Mol. function=transferase activity, transferring glycosyl groups; Biological process=sucrose metabolic process
  Homolog annotation: Hit_ID=O24301; Match level="QueryCoverage=78%, HitCoverage=52%, E-value=3e-79, Identity=47%"; Hit description =Sucrose synthase 2
  Pfam annotation: Domain name=Sucrose_synth; Domain location=1-224; Score=46.4; E_value=8.4e-13; Accession=PF00862.10; Description =Sucrose synthase
MAEDYLSKLASDTLYSEFEYVLQGMDFERGWGDIAERAPDHNTLETFLGREPMVFNVDILSPHGYFGQANVLGLPDIGGQVVYILGQVRALENEMLLQIKKQGLDFTPRILIVTRLIADAKGTTCNQRLERVNEAVASEVVVELQGHPASIIGNYSDGNLVASLSAYKMGVTQCTIMVVYGIDVFNPKFNIVSPGADMSTYFPYYEKHTRLTSLHSSIEKLLFDLEQTNEYIGSLKDKELVNLVVVAGYINVKKSSDRAEIVEIEKMHKLMKKYHLNDTLAILYNLEDMVDFPKEHQFVIEKLMPKTRNNLGKYMCKLKLQGNVGKRDNTIIKSLTNGMTIHFNMFGAFMED

SEQ ID NO: 153844 - protein, 48 aa, Glycine max
  Coding DNA Sequence Number=SeqID_37066
MENWRTALRNNFAGIQTRREWRIGEQRYAITSQGSRLDGGGHMNSARQ

SEQ ID NO: 153845 - protein, 63 aa, Glycine max
  Coding DNA Sequence Number=SeqID_37067
  Homolog annotation: Hit_ID=Q9FQ21; Match level="QueryCoverage=68%, HitCoverage=9%, E-value=3e-14, Identity=86%"; Hit description =Putative Hs1pro-1-like receptor
  Subcellular localization annotation: CTP_CleavageSite=40; ConfidenceScore=5.61e-01
MTQQSSALRATHGSRDSPRVHRTGSSSARGSRSTSTRGRRAGSISYLLDLVVIAACSGIRLVS

SEQ ID NO: 153846 - protein, 98 aa, Glycine max
  Coding DNA Sequence Number=SeqID_37068
  Gene Ontology: Mol. function=receptor activity
  Homolog annotation: Hit_ID=Q9FQ21; Match level="QueryCoverage=99%, HitCoverage=24%, E-value=3e-34, Identity=86%"; Hit description =Putative Hs1pro-1-like receptor
  Pfam annotation: Domain name=Hs1pro-1_C; Domain location=1-98; Score=- 105.6; E_value=7.3e-07; Accession=PF07014.3; Description=Hs1pro-1 protein C-terminus
  Subcellular localization annotation: CTP_CleavageSite=36; ConfidenceScore=5.44e-01
MQSSPEPSRRWRRIATTSWKGSRSFSRGLKNQLSVKSSNGETTSFCFKSKELIELTKMCRDLRHKVLEILEVEVDPKRGPRIQEAAMKLYISKSAFEK

SEQ ID NO: 153847 - protein, 359 aa, Glycine max
  Coding DNA Sequence Number=SeqID_37069
  Gene Ontology: Mol. function=protein binding; Cellular component =membrane; Biological process=defense response
  Homolog annotation: Hit_ID=Q1SW22; Match level="QueryCoverage=99%, HitCoverage=39%, E-value=8e-87, Identity=47%"; Hit description =Disease resistance protein; AAA ATPase
  Pfam annotation: Domain name=NACHT; Domain location=32-175; Score= -27.3; E_value=0.0077; Accession=PF05729.3; Description=NACHT domain
  Pfam annotation: Domain name=NB-ARC; Domain location=1-294; Score =234.0; E_value=3.2e-67; Accession=PF00931.13; Description=NB-ARC domain
  Pfam module annotation: Pfam domain module=NACHT::NB-ARC; Domain location=32-175::1-294
MDPLFIEEDDVVGLDGPRDTLKNWLTKGREKRTVISVVGIPGVGKTTLAKQVYDQVRNNFECHALITVSQSYSAEGLLRRLLDELCKLKKEDPPKDSETACATRNNVVLFDDVWNGKFWDHIESAVIDNKNGSRILITTRDEKVAGYCKKSSFVEVLKLEEPLTEEESLKLFSKAFQYSSDGDCPEELKDISLEIVRKCKGLPLAIVAIGGLLSQKDESAPEWGEFSRDLSLHLERNFELNSITKILGLSYDDLPINLRSCLLYFGTYPEDYEIKSDRLIRQWIAEGFVKHETEKTLEEVGQQYLSGLVRRSLVQVSSFRIDGKVKRCRVHDLIHDMILGKVKDTGFCQYIEEREQSVS

SEQ ID NO: 153848 - protein, 98 aa, Glycine max
  Coding DNA Sequence Number=SeqID_37070
  Gene Ontology: Mol. function=ribonuclease H activity; Biological process=DNA integration
AIKGSALADYLAQQPINDYQSMHPEFPDEDIMTLFEEEVADEDKNKWIVWFDDVSNTLGHGVGVVLVTPNDKCIPFTARLGFDCMNNMAEYEVCARGI

SEQ ID NO: 153849 - protein, 37 aa, Glycine max
  Coding DNA Sequence Number=SeqID_37071
MAFFNDQELIFCFCPFLWHGSADIEILNNPILVKPEA

SEQ ID NO: 153850 - protein, 153 aa, Glycine max
  Coding DNA Sequence Number=SeqID_37072
  Gene Ontology: Mol. function=oxidoreductase activity; Cellular component=integral to membrane; Biological process=electron transport
  Homolog annotation: Hit_ID=Q7XXN7; Match level="QueryCoverage=81%, HitCoverage=28%, E-value=5e-10, Identity=34%"; Hit description =Cytochrome P450
MQQAMDQQEQKYDHLTYRSAIAVEWAMSELLRHPSDMKKLQELNNVVVVEESDLSKLPYLNMVASERNPKVIYPAGPFLVPRESIEDITINEDDVLGFIGSNHIWSLFLAQLVHCFNWELPFGMSPDDLDMSEIFGLSLPRIFNSTLIKNRHL

SEQ ID NO: 153851 - protein, 194 aa, Glycine max
  Coding DNA Sequence Number=SeqID_37073
  Gene Ontology: Mol. function=oxidoreductase activity; Cellular component=membrane; Biological process=electron transport
  Homolog annotation: Hit_ID=Q75W19; Match level="QueryCoverage=98%, HitCoverage=68%, E-value=5e-53, Identity=61%"; Hit description =Cytochrome P450
KETLRLYPVGPLLVPRESLEDITINGYYIKKKSRILINAWAIGRDPKVWSDNVEMFYPERFLNSNIDMRGQNFQLIPFGSGRRGCPGIQLGITTFSLVLAQLVHCFNWELPFGMSPDDIDMTENFGLSLPRSKHLLAELGLFVKSLEKAAASRDVVNISEQVGELMSNIVSKMVLGRSKDDRFDLKGLTHEALH

SEQ ID NO: 153852 - protein, 58 aa, Glycine max
  Coding DNA Sequence Number=SeqID_37074
MPLVGGGSIIGAKVDGDEEEIDIAVWIFVKKHKLNSMNRNKKECSAASREAVKLNFVQ

SEQ ID NO: 153853 - protein, 673 aa, Glycine max
  Coding DNA Sequence Number=SeqID_37075
  Gene Ontology: Mol. function=RNA polymerase II transcription factor activity; Cellular component=integral to membrane; Biological process=transport
  Homolog annotation: Hit_ID=Q1SCZ1; Match level="QueryCoverage=99%, HitCoverage=88%, E-value=0.0, Identity=69%"; Hit description =Prefoldin
  Pfam annotation: Domain name=CASP_C; Domain location=494-673; Score =156.7; E_value=5.9e-44; Accession=PF08172.3; Description=CASP C terminal
MEAPQGGSGSGPERDKSTAPSSSPISVVSAFWKDFELEKEKSILDEQGLRIAENQESSQKNRRKLAENTRDFKKASPEDKLSLFNSLLKGYQEEVDNLTKRAKFGENAFLNIYQKLYEAPDPYPALASIAEQDLKISELESENRKMKVELEEFRTEATHLKNQQATIRRLEERNRQLEQQMEEKVKEIVEIKQRSLAEENQKTLEVLKESFLPLPRWTIERSETWDGHPMAGKARTECGIGWGAKALQDQLQHAKDSVSTMQKLHELAQNQLFELRAQSEEERASKQSEVNLLMDEVERAQSMLLSLEREKLLSADAFPCSIRLAVYSSDTSVSMQGVLRSQLQTANEETETKNSDNFDSNSALENSLNAKEKQISELNMELHNIETALSNERDQHINEVKKLTAMLNEKEAALEEMKKELKARPTEKMVDDLRKKVKILQAVGYNSIEAEDWEVATSGEEMSKMESLLLDKNRKMEHELTQLKVTLSEKTSLLETAEQKIAELTAKVNEQQKLVQKLEDDILKGYSSNSKDRKGNFLDDWDLSEAGGGEVSENTDQRQVSLDQDQSSMLKVICNQRDRFRTRLRETEEEIRQLKEKIGVLTVELEKSKADNVKLYGKIRYVQDYNHEKVISRGSKKYAEDLESGFASDVESKYKKIYEDDINPFAAFSKKVT

SEQ ID NO: 153854 - protein, 46 aa, Glycine max
  Coding DNA Sequence Number=SeqID_37076
MGTPSVGTTRVGTISVGTILVLKLLKVLLSDLVVVNLIVANFIARN

SEQ ID NO: 153855 - protein, 111 aa, Glycine max
  Coding DNA Sequence Number=SeqID_37077
  Gene Ontology: Mol. function=hydrolase activity; Cellular component =chloroplast
  Homolog annotation: Hit_ID=Q8VXZ0; Match level="QueryCoverage=98%, HitCoverage=35%, E-value=2e-27, Identity=65%"; Hit description=Nudix hydrolase 20, chloroplast precursor
MAMLRWMGRNTWGHTKLTVKENLIKECEEEAGIPRSISFKAIPVGAISYLDIDGHRYKRDVEFCYDLKLPKSFLPKNEDGEVDSFKLTSVMQVAEVIHKTFFQAELLSRNH

SEQ ID NO: 153856 - protein, 125 aa, Glycine max
  Coding DNA Sequence Number=SeqID_37078
TPSVFLPPISSSPDLKPPFQNKQTFVLVKVDELDLAQKLNHAFSLFRVLDSKIPEIRTLKLNGGSEGVGIIGSDRMLQLFTKVLVLLQVCEASNQEPHRARWCVDALHFDGVEISGERVQFCDAC

SEQ ID NO: 153857 - protein, 662 aa, Glycine max
  Coding DNA Sequence Number=SeqID_37079
  Gene Ontology: Mol. function=carboxylic ester hydrolase activity; Cellular component=mitochondrion; Biological process=lipid metabolic process
  Homolog annotation: Hit_ID=Q1SD04; Match level="QueryCoverage=99%, HitCoverage=98%, E-value=0.0, Identity=71%"; Hit description =Esterase/lipase/thioesterase; AB-hydrolase associated lipase region
  Pfam annotation: Domain name=Abhydro_lipase; Domain location=274-337; Score=90.6; E_value=4.8e-24; Accession=PF04083.6; Description=ab -hydrolase associated lipase region
MGSLKAITYESLNNIVRLINGVSALLLALLPGKANILEGIHGWELKPTFRGPRFPRWMENGVSSFNQFIHELSVDSDNSSPEYSSGEEDTDRYSDRFDFPPSPASQSSRTSEAGFAKYSRHQMDWIQYIILLIWFPVKLLLWIPLHLFRLVYYGVSKAISVSGNKRPSHLNAHMRVLSLKDHIIHRATDRRRGVVEDLHLGIELSIEAVFDVVHKAAHLLFSPSEAFGTLFRLFSSHESDTKEDCDGVEDTPIYTATLGENDPMPTERNVKYQPLNTDARTCQDVITDLGYPYEAIRVITADGYILLLERIPRRDSRKAVYLQHGVFDSSMGWVSNGVVGSPAFAAYDQGYDVFLGNFRGLVSREHVNKNISSRQYWRYSINEHGTEDIPAMIDKIHEVKTAELRLTKPDIEEETDDDQLYNLCAICHSLGGAAGFHDDSNIVFSMAELLLVLLAPVLSLLVPAFYIPTRFFRMLVNKLARDLHNLPAVGGLVQTLMSYVVGGDSSNWVGVLGLPHYNTNDMPGVSFRVALHLAQMKRTGKFRMFDYGSASANMKVYGSPMPLDLGEHYGLIDIPVDLVAGQKDKVIRPSMVKRHYKLMKGARVDVSYNEFEYAHLDFTFSHREELLSYVMSCLLLVDPNPKHQVNQRVVRSRRKGQVAASG

SEQ ID NO: 153858 - protein, 168 aa, Glycine max
  Coding DNA Sequence Number=SeqID_37080
  Gene Ontology: Mol. function=hydrolase activity; Biological process =aromatic compound metabolic process
  Homolog annotation: Hit_ID=Q9LK01; Match level="QueryCoverage=79%, HitCoverage=49%, E-value=4e-30, Identity=48%"; Hit description =Hydrolase-like protein
MRFILSSEEFYHLSKNLLEFLNPILHYRATKNDYEGGFTSSDIEQLLKNIEFNYENWVSAFSLLVVDPNDEPSVNKFRECLKKMRAEVPASLAKTVFYSDYRDILEKVETPCTIIQTSSDIVVPHKAAVYMESKIKGKVTLEVVDTKGHFPQLTASLQLVDVIKGVLG

SEQ ID NO: 153859 - protein, 1348 aa, Glycine max
  Coding DNA Sequence Number=SeqID_37081
  Gene Ontology: Mol. function=RNA-directed DNA polymerase activity; Cellular component=chromatin; Biological process=chromatin assembly or disassembly
  Pfam annotation: Domain name=rve; Domain location=1015-1171; Score =103.1; E_value=8.4e-28; Accession=PF00665.16; Description=Integrase core domain
  Pfam module annotation: Pfam domain module=RVT_1::Retrotrans _gag::rve; Domain location=594-763::175-256::1015-1171
MCGCDRDQGIIGPKEPLANETLKSPREYIVHTRVGERRGRARIVFAYAEHSSGTLGGGEPGMEGRVASLENEISKLKASVEVLRSQSEKYNTKQDIIAANQEKLMDMFIKSFGKDNPEDGESSAGKNSHGKGAKGDAEKSSFRTNTLDGDALNEFRQSMKKIELPTFTSEDPAGGIIHFFNSLLNDYEDLTWEDLKRELMERYGGIEEGTVFEQLTSLCQTGMVEEYIRRFKSLVAQVPRLMEGQYFAYFMNGLREDICARLRILNMAVSISRGRLMNTTRALEAELERGSRGWKTRVDTLRGGGFGFVSRSQHSGSNTGHEGLKGKHLAYQDLLDRRKKGLCFKCGGPFGPLHQCPVKQLKLILVNEEIQVEYEEDETPNNERSDEDYVVLEGKCSVLTLRGLDTGNRDFPSMMKIRGTVGGIPIVLLVDSGATHDFVSKKLVEAFGWGWENTKKMRILMGDGHKADTCGICRNICVETEAGGMSKTLKGIVGEEPLLASLEGILNEEKGHREGELNQQKRLELEEILKEFEDVFQEPRGIPLERVKEHSITLKPGEAPVNVQPYRYPYHQKNEIKRQVKELLENGWIRHSQSEYSSPVILVKKKSNQWRMCVDYRALNKATIPDKFPIPIIEELLDELHGAKYFSKLDLRSGYHQVRMKVEDIPKTTFRKHEGHYEYLVMPFGLMNAPATVQSLMNEVFRDLLRRGVLVFFDDILVYHEEWEEHIEGLRVVLGILRQHCLYANKEKCSFGQNELRVFGAYHHTTRSGSGSKQGQEHCGVACTQKCEGGLRIFGNYGLLHQTQIAFEELKKRITTAPVLTLPNFEKKFELECDASGLGIGAILMQEHRPIAYFSKALGSKNLAKSAYENLRQLLQQRITTGSQQNWLAKLLGYNFEIVYKPGLENKGADALSRSLGELSSMVSMPVWLDCQALVAEVHEDELWKKKIEALQHGQIDQGDFTYRHGILYYKDRLVISNKSNWIPKLIEEFHSTPQSGHSGFYRTYRRLALNPLLVPAQIWEDISLDFITGLPRSKGYEAVLVVVDRLSKYSHFIPLKHPYTARTVVELFIREVVRLHGVPSSVISDRDSLFMSVFLKEFFRLQGTVLKMSTSYHPQMDGQTEVTNRCLETYLRCFIGDKPRSWVQCLSWAEYWFNTTYHESIGITSFEAIYGRKPPALDRDEILRQLKIHLERARERMKHQLKPYRQASVTNRINPKLCARYYRPYEVLERIGEVAYRLKLPATSRIHPVFHVSLLKKAHGGYPVETELLPDLEEGTVAIAEPEAVLEEEVLMRSQFLELKLEDKQLFLGGGIDRDQGIIGPKEPLANETLKSPKEWIVYTRRKKMAN

SEQ ID NO: 153860 - protein, 500 aa, Glycine max
  Coding DNA Sequence Number=SeqID_37082
  Gene Ontology: Mol. function=ATP binding; Cellular component =membrane; Biological process=cobalamin biosynthetic process
  Homolog annotation: Hit_ID=Q9LK00; Match level="QueryCoverage=88%, HitCoverage=82%, E-value=0.0, Identity=78%"; Hit description =Similarity to nucleotide-binding protein
  Pfam annotation: Domain name=CbiA; Domain location=164-381; Score =38.9; E_value=1.7e-08; Accession=PF01656.13; Description=Cobyrinic acid a,c-diamide synthase
  Pfam annotation: Domain name=DUF59; Domain location=67-140; Score =47.9; E_value=3.4e-11; Accession=PF01883.9; Description=Domain of unknown function DUF59
  Pfam module annotation: Pfam domain module=CbiA::DUF59; Domain location=164-381::67-140
CWAVKSQHENKVGVAEMRMLRWMCEKTGRLCSEESRPDGEKTNNSRQRKTQKDYKRVGDSSVSTGTAEDDVLKALSQIIDPDFGTDIVTCGFVKDLLIDKALGEVSFRLELTTPACPIKDVKANEVVAMLPWVKNVKVTMSAQPARPIYAEQLPAGLQTISNIVAVSSCKGGVGKSTVAVNLAYTLADMGARVGLFDADVYGPSLPTMVSPENRLLVMNPEKKTIIPTEYLGVKLISFGFAGQGRAIMRGPMVSGVINQLLTTTEWGELDYLIIDMPPGTGDIQLTLCQVVPLTAAVIVTTPQKLSFIDVAKGVRMFSKLKVPCVAVVENMCHFDADGKRYYPFGRGSGSQARIMSLIVVQQFGIPHLFDLPIRPTLSASGDSGMPEVVADPQGEVSKIFQNLGVCVVQQCAKIRQQVSTAVTYDKSIKAIKVKVPDSKEEFFLHPATVRRNDRSAQSVDEWTGEQKLQYGDVPEDIEPEEIRPMGNYAVSITWPDGFSQ

SEQ ID NO: 153861 - protein, 632 aa, Glycine max
  Coding DNA Sequence Number=SeqID_37083
  Gene Ontology: Mol. function=transferase activity, transferring glycosyl groups; Biological process=response to oxidative stress
  Homolog annotation: Hit_ID=Q9M2R0; Match level="QueryCoverage=98%, HitCoverage=89%, E-value=0.0, Identity=50%"; Hit description =Anthranilate phosphoribosyltransferase-like protein
  Pfam annotation: Domain name=C2; Domain location=164-264; Score=3.1; E_value=0.11; Accession=PF00168.20; Description=C2 domain
  Pfam annotation: Domain name=C2; Domain location=342-435; Score=71.5; E_value=2.7e-18; Accession=PF00168.20; Description=C2 domain
  Pfam annotation: Domain name=C2; Domain location=48-129; Score=78.6; E_value=1.9e-20; Accession=PF00168.20; Description=C2 domain
  Pfam annotation: Domain name=PRT_C; Domain location=561-632; Score= -49.5; E_value=0.00018; Accession=PF08372.1; Description=Plant phosphoribosyltransferase C-terminal
  Pfam module annotation: Pfam domain module=C2::C2::C2::PRT_C; Domain location=164-264::342-435::48-129::561-632
MANQNQNQKKNKEDFSLKATTPNISAGRAISSDRLPTAFDLVEKMQFLFVRVVKAKDLSEKCESQPCNPFVEVNLGSFTGRTRCLEKTTTPEWNQVFAFAKERIQVLVLEIVVKDKDNDDPDEFMGRVAFTICDVPVRVRPDSPLAPQWYKLEDQNGVKLQGELMVSVWMGTQADEAFSEAWHSDASETSGESIAHTRSKPLSGIFIQGVLGNLALRSRPMKCNASPMWNEDLMFVVAEPFDDCLLVTIEQGNPHKHESLGICVVPLKNVQQRIDATPQASVWCNLQKPKEKEGEEEVGFSSKLNMRISLDGGYHVLDEATHYTSDVRPSSKYLCKPSIGVLELGILNAVGLSPMSKENRTDAFCVAKYGPKWVRTRTIVDSLSPNWNEQYTWEVFDPCTVITIVVFHNGNLNGGKNAGGKKAEGAMDRRIGKVRIRLSTLESDRIYSHSYPLINLHTQGARKMGEIQLAVRFSCSSLLNVLQTYAQPLLPRMHYISPLSIFQLDNLRNQAAAIATLRFKRAEPPLSKEVVEYMLDMGTNVWSMRRGKVQFFRIACLLNVLVSVAKQFHEIHAWKNSITTADTATVEELEEEFDPFPSKFSGDNLKKRYDRLRAISGRVLEMMADLATQGER

SEQ ID NO: 153862 - protein, 58 aa, Glycine max
  Coding DNA Sequence Number=SeqID_37084
  Subcellular localization annotation: CTP_CleavageSite=29; ConfidenceScore=5.57e-01
MVFGASAASVNTSVKFPKNLGKIKSKYFRNASVSDSVEILHRSSPFFIRSSFVLRSST

SEQ ID NO: 153863 - protein, 465 aa, Glycine max
  Coding DNA Sequence Number=SeqID_37085
  Gene Ontology: Mol. function=nucleic acid binding; Biological process= transport
  Homolog annotation: Hit_ID=Q8H6Q8; Match level="QueryCoverage=97%, HitCoverage=17%, E-value=5e-26, Identity=30%"; Hit description=CTV.20
MDRNILDSLFLNIHFHGLDMKEGSIPAALIYRIQYKVMNTCASRVLLKPQKRETTLFITDMTKANVFLPRTIKWDEVTLPEKWVIDKVTPSVPRPAPTIEQIKQDNSVYLEQHSTKNKKTTKSRSNLQLTPLCMNLMMLSDNFSIDKDTLRKDFYSPENQPQRRWFFQHFKDSNRKQIQDKFIFCEFVERVKINVLFFDWFHAYTIREYIDYPWKQDIIGDPTTNAITNWQIKDGEFIQSKLPPTTQYRLPKVKDSHDKPVMATPFKTKDVNKEVTSKDIKSLMEQINYTNKYLQVLGESIKTKTIPKQKSPEEPPSNIPIEKSLFKPFKISDNAKQKIRELRKHKSLIEGVGDNNSELLNKLDSLLRVIPETPQPSERTSKMVTRKEIGESNFKIFSANNIYEWNIDVQTEYNIMNTLQHMTMVAMAYETSHECPEETIIDILVAGFFGQLKGWWDNYLTNDEK

SEQ ID NO: 153864 - protein, 215 aa, Glycine max
  Coding DNA Sequence Number=SeqID_37086
  Gene Ontology: Mol. function=nucleic acid binding; Cellular component= chromatin; Biological process=DNA integration
MLVYVDDIIVTGNNPTAIKSLVTNLNSEFALKDLGDLDYFLGIEVNHHPNGSLMLTQSKYIRDLLSKTAMDEANSISSPMVGGCKLTKTGSEDFMDPTLYRSVVGALQYATITHPEISFSVNKVCQFMSQPTEQHWVAVKRILRYLKGTLHFGLKLETTFSTKHYSVHAFCDANWASDPDDRRSTSGAAVFLGPNLVSWWSKKQSVVAKSSTEAE

SEQ ID NO: 153865 - protein, 347 aa, Glycine max
  Coding DNA Sequence Number=SeqID_37087
  Gene Ontology: Mol. function=aminoacyl-tRNA ligase activity; Cellular component=membrane fraction; Biological process=tRNA aminoacylation for protein translation
  Homolog annotation: Hit_ID=UPI000068C009; Match level="QueryCoverage =99%, HitCoverage=80%, E-value=1e-129, Identity=65%"; Hit description= tyrosyl-tRNA synthetase
  Pfam annotation: Domain name=S4; Domain location=291-338; Score=13.3; E_value=0.042; Accession=PF01479.15; Description=S4 domain
  Pfam annotation: Domain name=tRNA-synt_1b; Domain location=1-256; Score=195.6; E_value=1.2e-55; Accession=PF00579.15; Description=tRNA synthetases class I (W and Y)
  Pfam module annotation: Pfam domain module=S4::tRNA-synt_1b; Domain location=291-338::1-256
MIGDPSGKSAERNLLDEETLLHYVDCLKNQLSQFLNFDGDGANKAELVNNYDWMKNISFLDFAKNVGKNITVNYMMAKDSVKKRFSGEAGAEGMSFTEFTYQLIQGYDFLHLYQNNNVKLQMGGSDQWGNITTGTELIRRKAQGEAFALTVSLITKADGSKFGKSESGENYWLDKKKTSPYKFYQFWLNATDADAERFIKFYTFLGKEEIEALIEEHKTAPHERKLQKKLAEEVTVWVHGREEYEKALKASEILFGRSTAEDLVSLDEEIFLEVFDGVPQKEVAKADVLGINIIDLLSEKSGFLKSKSEAQREIKGNSISVNKQKINDTFTANESDLIDGKFLLLQK

SEQ ID NO: 153866 - protein, 52 aa, Glycine max
  Coding DNA Sequence Number=SeqID_37088
MTGCTSNFAGCRSRQELQRKMRYDVYQGPDAELAEMLERDGCVRNVPWCQMG

SEQ ID NO: 153867 - protein, 61 aa, Glycine max
  Coding DNA Sequence Number=SeqID_37089
  Gene Ontology: Mol. function=microtubule-severing ATPase activity; Cellular component=microtubule
  Homolog annotation: Hit_ID=Q9SEX2; Match level="QueryCoverage=98%, HitCoverage=17%, E-value=8e-19, Identity=55%"; Hit description =Katanin p60 ATPase-containing subunit
  Pfam annotation: Domain name=Vps4_C; Domain location=19-59; Score= -17.3; E_value=0.068; Accession=PF09336.1; Description=Vps4 C terminal oligomerisation domain
VAPDVNIDEVARRTEGYSGDDLTDVCRDASMNGMRRKKVQPSVSLADIERHEKWFAEFGSA

SEQ ID NO: 153868 - protein, 171 aa, Glycine max
  Coding DNA Sequence Number=SeqID_37090
WLRVRTQGLDWLPNLNTVRDDEVKASEESDEVQALKAEVERARVVEEKFKSIAIKLKPWNEEVKGIITGRRHDLEGRAKGNMWAIIDKCKEKLNLAATHEQRLEDEYAKISAEREARERVIDSLHQEATMWTDRFALTLNRSQELPRFLAKAKAMADTYSAPKEIHGLLSY

SEQ ID NO: 153869 - protein, 80 aa, Glycine max
  Coding DNA Sequence Number=SeqID_37091
MGDFISRLSFPENTETFSSLTSYPELRRSEFLIGGYVGARASLLSTTPPFVAMTQELVARGDTLRLFAPRHSVTPSVIDE

SEQ ID NO: 153870 - protein, 66 aa, Glycine max
  Coding DNA Sequence Number=SeqID_37092
MTLVYACHWTRLCLNGEMARHLWMTKGTEDDVNLCVPSDTTVSEWRKGVRNDHNLSPHCIGSAASR

SEQ ID NO: 153871 - protein, 87 aa, Glycine max
  Coding DNA Sequence Number=SeqID_37093
MSEIEEVQEQMKADIEAMKEQMTTMMEGMMSMRKMMEVNMATVITASTTTKVDPTLPSGLNQVNHPLSDMVGQGGEALGSVGGPHFE

SEQ ID NO: 153872 - protein, 47 aa, Glycine max
  Coding DNA Sequence Number=SeqID_37094
MGLSATMHHPKRKTLDEYSLLSSKSEIQHDHRSTSTPYGSHRPGYSA

SEQ ID NO: 153873 - protein, 510 aa, Glycine max
  Coding DNA Sequence Number=SeqID_37095
  Gene Ontology: Mol. function=transporter activity; Cellular component= integral to membrane; Biological process=transport
  Homolog annotation: Hit_ID=Q5K409; Match level="QueryCoverage=96%, HitCoverage=97%, E-value=0.0, Identity=68%"; Hit description=Nitrate transporter
  Pfam annotation: Domain name=MFS_1; Domain location=48-412; Score =48.8; E_value=1.8e-11; Accession=PF07690.6; Description=Major Facilitator Superfamily
MDLELPAHAATVNESQQQKFALPVDSENKATVFRLFSFAKPHMRAFHLSWVSFFACFVSSFAAPPLLPIIRDNLNLTATDIGNAGVASVSGAVFARIAMGTACDLVGPRLASASLILLTAPFVYFTSIINSATSYLLVRFFTGFSLATFVSTQFWMSSMFSAPVVGSANGLSGGWGNLGGGATQLIMPLVFSLIRDIGATKFTAWRIAFFVPAMFQMLTAFSILIFGQDMPDGNFRRLKKSGEKAKDDFSRVLYHGVTNYRGWILALTYGYCFGVELTIDNIIAEYFYDRFNLKLHTAGIIAASFGLANIFSRPGGGYISDVMAKRFGMRGRLWALWICQTLAGVFCIILGLVGSLSVSVVVMIIFSVFVQAACGMTFGIVPFVSRRSLGVISGMTGGGGNVGAVVTQLIFFKGSKFSKERGITLMGAMIIICTLPICLIYFPQWGGMFSGPSSKKVTEEDYYLAEWNSKEKEKGSHHASLKFADNSRSERGRKLNASTEPTEEITPPHV

SEQ ID NO: 153874 - protein, 80 aa, Glycine max
  Coding DNA Sequence Number=SeqID_37096
VEGRGPEYEEPQDLRSNPFQGGGDDAILPPRVLDRRLPPIGYWIELVTSNFELKVLLNFLDIWKKVIKKEPSDLDKRKKY

SEQ ID NO: 153875 - protein, 136 aa, Glycine max
  Coding DNA Sequence Number=SeqID_37097
MITDRGQPPYGKKEVKVLWQQRHKLCLFGYVWTHHHHHAPPVGAGVPTHHHQNPLLSSFLQQQPKTLFLLLIKKIWVYRLEKIKQRFDRQWSREGREHREDDDGIDESNATWEVQCGLLAFSMEMLWWVWWRVRSS

SEQ ID NO: 153876 - protein, 76 aa, Glycine max
  Coding DNA Sequence Number=SeqID_37098
  Subcellular localization annotation: CTP_CleavageSite=73; ConfidenceScore=5.42e-01
MRVALVAGLNPTPYGMSDDSHAPPVSAFPKAPLSFKRIRGMLSLATTNTVIATMTTIAMVATVVIFVTPTMIMAAT

SEQ ID NO: 153877 - protein, 86 aa, Glycine max
  Coding DNA Sequence Number=SeqID_37099
  Subcellular localization annotation: CTP_CleavageSite=60; ConfidenceScore=5.15e-01
MMQFKEDENLPSTTTTPYIKMKLSSYIEKKPTSPFSVEACTCGKGSFVNPNNTVSNNCARSQTSHHHRITATPTACRRGGERVKGE

SEQ ID NO: 153878 - protein, 84 aa, Glycine max
  Coding DNA Sequence Number=SeqID_37100
MKIEEESKGCARSGLENTCKPEVDETHEYIHDLSAYVLALKGLWTILPPWEADLVHRDKYFMDVKGIDCQFPEVGGNHHVIHLL

SEQ ID NO: 153879 - protein, 133 aa, Glycine max
  Coding DNA Sequence Number=SeqID_37101
MQTKLQLAIKDLEKYSTEKLCLELKEADLCEEVEKCISKCATKDVATFDDHVDGFNRALAQVAALYPNVDLFGTRIYKDVVDGKVCEARLTRALSKGEKMRGVATNVYLWKTSEKPKETSQNENSKFGSCIYV

SEQ ID NO: 153880 - protein, 133 aa, Glycine max
  Coding DNA Sequence Number=SeqID_37102
  Gene Ontology: Mol. function=aspartic-type endopeptidase activity; Cellular component=lysosome; Biological process=lipid metabolic process
  Homolog annotation: Hit_ID=Q06EY4; Match level="QueryCoverage=68%, HitCoverage=17%, E-value=7e-14, Identity=52%"; Hit description =Aspartic protease
MANESLNQSPTTIVAGRCRDKVYNFVKLAELYYVGSHGMDITGPTKSPKQEYLAKSLMAKDQFLDSSAKIMYKLGISSSKINLLLPILMEFVEITREGSLALAALPFDGILGLGFQDTSVRKVTPVWYTPELH

SEQ ID NO: 153881 - protein, 218 aa, Glycine max
  Coding DNA Sequence Number=SeqID_37103
  Gene Ontology: Mol. function=protein serine/threonine kinase activity; Cellular component=nucleus; Biological process=protein amino acid phosphorylation
  Homolog annotation: Hit_ID=Q40541; Match level="QueryCoverage=36%, HitCoverage=11%, E-value=7e-32, Identity=85%"; Hit description =Protein kinase
  Pfam annotation: Domain name=Pkinase; Domain location=77-218; Score= -96.5; E_value=0.0082; Accession=PF00069.15; Description=Protein kinase domain
MEVFGTRSYVHAFSSLHISLSCSPCCDLRASHSCLHPAVTSAVCHNLHCDLPQTPFTLSGLPLSRPTLKIKPWKSIYLYSRPLRSPAVGAAPPSSKQQELWFFLRFHNVPCVHTLAHLPQVESVLIATSNATKEKAQVIRTYIKQLLLGLEYFHKNGIMHRDIKVDFYFTDNKGCIKLADFGASKQVVELATISGAKSMKGTPYWMAPEVILQTGHSL

SEQ ID NO: 153882 - protein, 54 aa, Glycine max
  Coding DNA Sequence Number=SeqID_37104
MTLNELGAIISTLHLKMKILTLIGEIVTIKADQMQGQPIPCVQESLQLKRPPVP

SEQ ID NO: 153883 - protein, 54 aa, Glycine max
  Coding DNA Sequence Number=SeqID_37105
  Gene Ontology: Mol. function=ubiquitin-protein ligase activity; Cellular component=ubiquitin ligase complex; Biological process =protein ubiquitination
  Homolog annotation: Hit_ID=Q1SHY7; Match level="QueryCoverage=92%, HitCoverage=12%, E-value=3e-15, Identity=74%"; Hit description=U box
MKVFGLEELHGGGAGVVVGLEPALDVGVVIGDSGAEDDKGFHEDEGDRALEEPR

SEQ ID NO: 153884 - protein, 212 aa, Glycine max
  Coding DNA Sequence Number=SeqID_37106
  Gene Ontology: Mol. function=nucleoside-triphosphatase activity; Cellular component=membrane
  Homolog annotation: Hit_ID=UPI0000162C59; Match level="QueryCoverage =74%, HitCoverage=16%, E-value=8e-40, Identity=53%"; Hit description =ATP binding / ATPase/ nucleoside-triphosphatase/ nucleotide binding
MTEDAPRLFAFSQFQILRAFWRRELSSEPVNVILERLEQEAFAKALEASSEGKSVLDIPEAQTVHERLWVDKYAPKSFTELLSDEQTNREVLLWLKQWDSIVFGSEIRSTSDDVLSSLKRHSSIVHNQKPLNSKFPRMNGGPKWSNGRRYINARSMDESGSSKSIQDVWNAKSRNIGPPEQKPSGYSYIAIHAFVIFEKKICNSAKLVELCY

SEQ ID NO: 153885 - protein, 287 aa, Glycine max
  Coding DNA Sequence Number=SeqID_37107
  Gene Ontology: Mol. function=chitin binding; Cellular component =extracellular region; Biological process=chitin metabolic process
  Homolog annotation: Hit_ID=UPI000044A8F0; Match level="QueryCoverage =74%, HitCoverage=99%, E-value=1e-21, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEDYTSLTSEDYMSSLSEDYKSSPLEDYMSSPSEDYRSSPLEDYTSSPSECYTPSPSEDYTSLPSYGCTQTFRGLDILALRGLRVLIFRGPHVLAIRGLHTLTFRGLNVITFRGLHVLTFRGRHVLPLRGPHVLTIRGLHALAFRGLHVLSFRALHLLPYKGLPILAFRGMDVLSIRGLLAVTFRGLYVLAFRGLHVLTIRGRHVLTIRGFHALAFRGLPVLTFRGIHVLLFRGLHVLAFRGMDIFTFRGIHALTFRGLHVLAFRGLHVLTIRGLHILAFRGL

SEQ ID NO: 153886 - protein, 251 aa, Glycine max
  Coding DNA Sequence Number=SeqID_37108
MVYDRCLSDGKAFPFINSAYNIHGEEFLCDGGEDIKPKYLGDDIVLLMGLSDEKAEKICREEDDSRLSMFHSQEKWSPHLRTGFRLVRVLCWRIPLHAWDLENINKIVAGVEEEVDFDDDLEDLKRLDKARVLLKTPWHPTINHNVLSKQMQKQQGYLEGSLEEISSDESDAGLSLLSGGTLHVGESLMIPMVVQDESEDREAVGGCSLTGNYLRNNVQRQRHTDKLLGSSTNGPDPVFHSCFGTKGPDPN

SEQ ID NO: 153887 - protein, 219 aa, Glycine max
  Coding DNA Sequence Number=SeqID_37109
  Homolog annotation: Hit_ID=Q2J3T9; Match level="QueryCoverage=89%, HitCoverage=76%, E-value=4e-32, Identity=38%"; Hit description =Hypothetical protein precursor
MIALATVLLCGTATRQGALLQRAAIICILVVAFVSPLCALTTALFSARVSHHFILIAVLAPLLALNLEGRLPRLPWRLPALPEIPFLAHTIVYWAWHLPPGYSFALSNSLAYWGMQLALIVTAVWLWRTMLVSAGPGRRIALALATMAQMGFLAAILTFAPYPLFAEHLLTTESYGMTALEDQQLSGLIMWTFGLVPYLVVALSSVRTMLQMRAWRGVE

SEQ ID NO: 153888 - protein, 189 aa, Glycine max
  Coding DNA Sequence Number=SeqID_37110
  Gene Ontology: Mol. function=oxidoreductase activity; Biological process=response to oxidative stress
  Homolog annotation: Hit_ID=Q4EWC0; Match level="QueryCoverage=38%, HitCoverage=10%, E-value=6e-35, Identity=97%"; Hit description=Iron (III) protoporphyrin IX monomer binding protein
MELTKSPAGAHQWVAKDAGEVIPDAYDASKKHRPTMLTTDLSLRFDPAYEKISRRFYENPAEFADAFARAWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 153889 - protein, 112 aa, Glycine max
  Coding DNA Sequence Number=SeqID_37111
  Subcellular localization annotation: CTP_CleavageSite=35; ConfidenceScore=5.57e-01
MPPMYSYPHDFQPGYSFAGIFGSSPSSTGTPSFTQSGQVSTPNAPLAGPWNVPGDIPDMDDLLGVDLRHDFSAEADQVDERANPRRRNPDRAARNWDRPCGTSSRHHRHSDD

SEQ ID NO: 153890 - protein, 208 aa, Glycine max
  Coding DNA Sequence Number=SeqID_37112
  Gene Ontology: Mol. function=protein serine/threonine kinase activity; Cellular component=chromosome, telomeric region; Biological process=protein amino acid phosphorylation
  Homolog annotation: Hit_ID=UPI00003011A5; Match level="QueryCoverage =99%, HitCoverage=72%, E-value=7e-76, Identity=66%"; Hit description =RIO1 protein
  Pfam annotation: Domain name=RIO1; Domain location=2-154; Score =101.6; E_value=2.3e-27; Accession=PF01163.12; Description=RIO1 family
MSKGSKFGRQQQEEAWQNTEVDALYLLAKAGVRVPQPDICLDGVLLMELITDEEGLVAPRLSDVILTPEQARADHALMMNYAVRMLCAGLVHGDLSEFNVLMDKDGPVIIDLPQVVDAAANNHAKSMFERDIGNLAEYYGQFAPELRDSQYAKEIWALYQEGNLTPDSVLSGRFSETLKRADVGSVLEEIQAAGEEHQRRMMARNAEE

SEQ ID NO: 153891 - protein, 111 aa, Glycine max
  Coding DNA Sequence Number=SeqID_37113
  Gene Ontology: Mol. function=hydrolase activity, hydrolyzing O -glycosyl compounds; Biological process=carbohydrate metabolic process
  Homolog annotation: Hit_ID=UPI00005F9D20; Match level="QueryCoverage =91%, HitCoverage=20%, E-value=2e-31, Identity=61%"; Hit description =COG0366: Glycosidases
MGAALVVGGDFLLTVAEEIAPGGVRQIGAQRDRLAAFAAVGQHHHAAGGLGGAGAGEGHAVAVVEVVGLRAVGETLAGGDQLLQLRDRRHINLVLAAVAPLVAVAAPYRSG

SEQ ID NO: 153892 - protein, 132 aa, Glycine max
  Coding DNA Sequence Number=SeqID_37114
  Gene Ontology: Mol. function=nucleic acid binding; Biological process= DNA integration
MTWEEVVEKFLKKYFPESKTAEGKAAISSFHQSPDESLSQALERFRGLLRKTPTHGFTDPIQLNIFIDGLRPQSKQLLDASAGGKIKLKTPEEAMELIENMEASDHVILSDRTHIPTKRSLLELSSQDALLA

SEQ ID NO: 153893 - protein, 67 aa, Glycine max
  Coding DNA Sequence Number=SeqID_37115
MQTNDVQAPLFPFIESCKQNVEFEGSSQNCRKQGTDETATAKNSASYIGKRLLESLVAVAGLLIWLS

SEQ ID NO: 153894 - protein, 277 aa, Glycine max
  Coding DNA Sequence Number=SeqID_37116
  Gene Ontology: Mol. function=aspartic-type endopeptidase activity; Biological process=proteolysis
  Homolog annotation: Hit_ID=Q8H6Q8; Match level="QueryCoverage=90%, HitCoverage=6%, E-value=1e-12, Identity=25%"; Hit description=CTV.20
MAIPFKTKDVNEEVTSKDIKSLMEQANYTNKYLQALGETIKTKVVPKQKSIEGAPPSVPIEIEKPLFKPFKVSEKAKRKIRELRKTKSLTEGVGDNHSELLNKIGSLLKVIPDTPQTSENTSKMVTRSTSKLINVINEDSDQTSDNTTEIGSVSEKNINPINSKHWKTPSKLYYQRPTAPDLLLEERGENNFKSFSANNIYEWNIDAQTEYNIMNTLQHMTMVATAYQTSHECSEETIIDILVAGFSGQLKGWWDNYLTNEEKSKIYSAVKTDLNGK

SEQ ID NO: 153895 - protein, 109 aa, Glycine max
  Coding DNA Sequence Number=SeqID_37117
  Gene Ontology: Mol. function=nucleic acid binding; Cellular component= nucleus; Biological process=DNA integration
  Homolog annotation: Hit_ID=Q8RUQ2; Match level="QueryCoverage=98%, HitCoverage=9%, E-value=9e-31, Identity=58%"; Hit description =Putative retroelement
MAMNKEMESRQKNQTWDLVEQPKGRRVVGCKWIFKKKSRLSIKELICYKESLVAKDIELEQLDVKTVFLHGRLEEDILMQQLEGFEVEGKENVVCRLKKSFYGLKQSPR

SEQ ID NO: 153896 - protein, 291 aa, Glycine max
  Coding DNA Sequence Number=SeqID_37118
MASKKRCASSSRPQEPYDMSRFVFETAWERFKMNVHHRNILPERNMELAYSHYDEFLRELERCQWHRNLTRLMENHINLALVKEFYSNLYDPEDRSPIQCKVRGKTIKFDASMLNTFLETSVVLEPRERYSAYSRFCHTYPDPQAIAAKLCLLGRRFILNVEGALWKLLRNDLTTLAQTWSVLSYCNLAPTSHTSDLNMDRARLVYDLIMKMDMDLGSIISGQISKMAQSNSPRLGFLALITALCIARGVVFDSLTFESLNPAINLAYIRKNCWNSEDPSITFPRSHKAKA

SEQ ID NO: 153897 - protein, 94 aa, Glycine max
  Coding DNA Sequence Number=SeqID_37119
HDFEIPNGGNARIWVVNLVFEFHDDPTVNEYEIVVFLRQVRILMAADMGVAIKYKDEILMAADMGDMGGCCSCHVSFVGKVHDVESESNHNNDD

SEQ ID NO: 153898 - protein, 84 aa, Glycine max
  Coding DNA Sequence Number=SeqID_37120
MLVLESSKPADSVLEFLGLMLLSFCKKHSPLKVTHIPTGSEAVSKDTASTEKAHELITQTQLNKPADLHTNLTEDKLMKPYLLP

SEQ ID NO: 153899 - protein, 453 aa, Glycine max
  Coding DNA Sequence Number=SeqID_37121
  Gene Ontology: Mol. function=protein serine/threonine kinase activity; Cellular component=integral to membrane; Biological process=protein amino acid phosphorylation
  Homolog annotation: Hit_ID=Q9FNE1; Match level="QueryCoverage=84%, HitCoverage=70%, E-value=2e-67, Identity=37%"; Hit description =Receptor-like serine/threonine kinase
  Pfam annotation: Domain name=DUF26; Domain location=64-116; Score =51.8; E_value=2.2e-12; Accession=PF01657.8; Description=Domain of unknown function DUF26
  Pfam annotation: Domain name=Pkinase; Domain location=196-400; Score =19.9; E_value=9.5e-10; Accession=PF00069.15; Description=Protein kinase domain
  Pfam annotation: Domain name=Pkinase_Tyr; Domain location=196-400; Score=-31.4; E_value=1.5e-10; Accession=PF07714.7; Description =Protein tyrosine kinase
  Pfam module annotation: Pfam domain module=DUF26::Pkinase::Pkinase _Tyr; Domain location=64-116::196-400::196-400
  Subcellular localization annotation: CTP_CleavageSite=34; ConfidenceScore=5.52e-01
DQDTTVCGNNSNNNDSNSVANSATNSSSGVYKANAMALVLNLSELAPKSDGFFVGSVERKNVRVYGLAQCWEYVNGSACERCLADAVTRIGSCATQEARALNAGCYLRYSAQKFYNNSGVVPTAGKHGKRRLAKILAASSAALALLLVIATVVFFIRKNVVTRRRERRQFGALLDTVNKSKLNMPYEVLEKATNYFNEANKLGQGGSGSVYKGVMPDGITVAIKRLSFNTTQWADHFFNEGMAYLHEESHVRIIHRDIKLSNILLEEDFTPKIADFGLARLFPEDKSHISTAIAGTLGYMAPEYVVRGKLTEKADVYSFGVLVIEIVSGKKISAYIMNSSSLLHTVWSLYGSNRLSEVVDPTLEGAFPAEVACQLLQIGLLCAQASAELRPSMSVVVKMVNNDHEIPQPTQPPFMNSGSSEFGKSGLPGYNFQPGSNTQSSGNTISESEIEPR

SEQ ID NO: 153900 - protein, 96 aa, Glycine max
  Coding DNA Sequence Number=SeqID_37122
MDSFASSSKVYGWDNNGMSVWQSVFRFYENRLKCKQKRRSPMCALQIVYFKDGGQGSEGESLDDDVNVEALADVGQCTGSGVRDAPTNKEHVNNYD

SEQ ID NO: 153901 - protein, 266 aa, Glycine max
  Coding DNA Sequence Number=SeqID_37123
  Homolog annotation: Hit_ID=Q39KC2; Match level="QueryCoverage=40%, HitCoverage=24%, E-value=3e-56, Identity=97%"; Hit description=ABC sugar transporter, periplasmic ligand binding protein
MKHFTDTLISANIGTKAGTGPPLEVDGIDKLDVPFRGDRGRSQVREEFRDALVGRRVLAGQHPQARAADDRVLRRAFHVRVVRQHARAVAELREFLHVRERTRRRREDPAVAAVELRRRFVLAARVRERAVLRHLLEEGDVLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 153902 - protein, 169 aa, Glycine max
  Coding DNA Sequence Number=SeqID_37124
  Gene Ontology: Mol. function=sugar porter activity; Cellular component=periplasmic space; Biological process=transport
  Homolog annotation: Hit_ID=Q39KC2; Match level="QueryCoverage=60%, HitCoverage=22%, E-value=1e-52, Identity=97%"; Hit description=ABC sugar transporter, periplasmic ligand binding protein
MAKDGTFTYAGRKDEASAKFYSGDCGILTTSSGALANVQKFAKFSYGTGMLPYDANVKGAPQNAIIGGASLWVLAGKDPATYKGVAKFLSYLASPAVAAKWHIKLIDTVDLEGGPVGKPVVPAALMNRPTRGERRFAYWALAECILAYYVGTDEGVSEVLHVAGEKRLH

SEQ ID NO: 153903 - protein, 47 aa, Glycine max
  Coding DNA Sequence Number=SeqID_37125
MQPDEQVLVSVVLPALHAQLLPEELQQRKMAVRGGKPKIRHKIWRMA

SEQ ID NO: 153904 - protein, 160 aa, Glycine max
  Coding DNA Sequence Number=SeqID_37126
  Gene Ontology: Mol. function=DNA binding; Biological process=DNA integration
  Homolog annotation: Hit_ID=Q0ZCD2; Match level="QueryCoverage=86%, HitCoverage=17%, E-value=3e-14, Identity=37%"; Hit description =Integrase
MPSQFVQNPINASAITLRWGKQYQGPQPVASSSSANEPAQPHSTPEKDDDKNLKSKLPNNFYVCESSTGNFDLQQQHIPLPFPPRVISNKKMEKAKKEILETFRRVQVNIPPLDAIKQIPRYAKFLKELCPYKRKLKGSERISMGKNVSTLIGKICSPNP

SEQ ID NO: 153905 - protein, 85 aa, Glycine max
  Coding DNA Sequence Number=SeqID_37127
MDQVDPYESYGSYAKLTSTVEEQNGTVGPQRRRRITQCETNEPPRKANDVRRRRRRRSSNCTARAGKSEEARTEEVNSALGVHNF

SEQ ID NO: 153906 - protein, 149 aa, Glycine max
  Coding DNA Sequence Number=SeqID_37128
MYTGSWLLHLPRLLLLFLVLLILLQTHQLHPGAERPVVHIDPATGKADGPHRKKLRTYLGIVARDKVDITYENWKKVSTAQKDLIWDDIQRLLTVGQKESYFRLWARDGADHDGVDDTVCEKYGISKENWAQFRQTRRDPSWEDVRKKA

SEQ ID NO: 153907 - protein, 81 aa, Glycine max
  Coding DNA Sequence Number=SeqID_37129
  Subcellular localization annotation: CTP_CleavageSite=31; ConfidenceScore=5.07e-01
MKIGSGMLKIRMFKIRMPKIRMFKIRMPKIRMFKITNNKMLRFTSNKLFGMLKRHKMFRDQRVGKKGGLKLQLYSNDIQIS

SEQ ID NO: 153908 - protein, 1193 aa, Glycine max
  Coding DNA Sequence Number=SeqID_37130
  Homolog annotation: Hit_ID=Q1STD0; Match level="QueryCoverage=91%, HitCoverage=97%, E-value=1e-122, Identity=31%"; Hit description =Prefoldin
  Pfam annotation: Domain name=DUF869; Domain location=123-1053; Score =491.0; E_value=1.4e-144; Accession=PF05911.2; Description=Plant protein of unknown function (DUF869)
ELVVVIAVSSHSHSTTLLAGNIPDIYSVIVCLNGDHTAIGNNSNAKNFGLCKFFPVKAFSIMDQKTWLWRKKSSEKTIIAADNTDLSSKENEEALVADKEELEKDLKRLNTKLNSALSDSNAKDELVKKQTKFAQEAMAGLKKADAEVLSMKQDLDEALQQRLVYEERVAHLDGALKECMQQLRFVREEQGQRIHDAVMKASKEFERERIVLEEQLSETSKRLAKAEVENSHLNKSIFARENLIEDLKSQLTQAEADHSALMNRLESTENDNTSLKYEVRVLEKELEIRNEEREFNRRTADVSHKQHLESIKKIAKLESECQRLRLLVRKRLPGPAALAKMKNEVDMLGRDSFEIRRSKLSSTSSVVESSVDTSPETPIRRINTLTEKLCAMEEENKTLKESLDRKMNELQFSRVMLSRTASKLLQLESQTEESSKALVTVEQPRSYLTSHEFSLASMSDAGSDDKASCAESWASALISELEHFRSGKEKEPLSCKSVGASDIDLMDDFVEMEKLAVVSVEKATEISSASLKAISEINGFSGIETKETTPEVEGKEIIPVSDHISTATNETTSEVVGMEIIPVSDQISDLSKSNKKTCSIDIFTGNIPGWLQDVVKMVLEQNHVTNKSSDDILDDIRVALRYVNNPDLCDFDSSKGSGHIDTQDPPQCIHCISCSKNSLVVNPSGDENNADISPIKRIESQSQEDLSKSIGKIIEIVERISLPAVDYDSSDPLDKGDGDIISYKNVGMPTGYMVRVFQWKTSELSNVLRKFLHVCYDLLSGKTDYENFAKELTTALDWIMNHCFSLQDVSSMKDAIKKQFDWDETRSEGETENEISHFAEEDKLHLLRGSLSTLPQVTTLDGHDLQNGEIYYKEKEELTNKEKLISAESQKEVLEGKIQSATDRIKSLMNQLQESEKIIDSLRLEIQSYKESNGKLENEIRNQQVIISNLEEHHTEEELKEACNKVLALEVELEKKNSNCKELEAKCTELQVQLESMSKECSNNDINEKDKALCNDWEITAASEKLAECQETILNLGKQLKAMAVPKDASLFDNVVATQFDANTNTATTTTLTTANVNPSPAPPKFMKVKSRSLLDQMLADDTKAKVPKASDGNANPITIPGVIEPLEKILVLNRVNDHEDRTTDKSLAIVPAKKPGSGTEEGSIDIALDLPYEILEAMGNDPKFMDVVSSFN

SEQ ID NO: 153909 - protein, 154 aa, Glycine max
  Coding DNA Sequence Number=SeqID_37131
  Homolog annotation: Hit_ID=Q1SFS3; Match level="QueryCoverage=99%, HitCoverage=41%, E-value=4e-07, Identity=20%"; Hit description =Lambda repressor-like, DNA-binding
  Subcellular localization annotation: CTP_CleavageSite=51; ConfidenceScore=5.16e-01
MFGYLPHETRTPSFPSFHRGNQLIVLPPIPAKSWSQSILLFSRVGKQQMIRALLFSHLRSNVSNKSAKTATTGLSLLWWYFHGRPAMPFRVCFMRSKPLAESLTTVAILLKEGRHPEERYGFLPLRGHPRISSNSSMVGTNWKSPNVKHLKGWS

SEQ ID NO: 153910 - protein, 182 aa, Glycine max
  Coding DNA Sequence Number=SeqID_37132
  Gene Ontology: Mol. function=nucleic acid binding; Cellular component= nucleus
  Homolog annotation: Hit_ID=Q0PJI4; Match level="QueryCoverage=47%, HitCoverage=31%, E-value=1e-26, Identity=78%"; Hit description=MYB transcription factor MYB138
  Pfam annotation: Domain name=Myb_DNA-binding; Domain location=93-140; Score=31.0; E_value=4.1e-06; Accession=PF00249.21; Description=Myb -like DNA-binding domain
LIGISPEANTTSTATIGGGSAFSIKEHQRSDPRNSDVEEDFLLEQRQALIHEPVHEHQHLDCHAGYAGYPWSNSPPLVPAMPPTTSFMPPVAHASASEEEHRLFLLGLHKVGKGDWRGISRNFVKTRTPTQVASHAQKYFLRRHNQNRRRRRSSLFDITIGKEGERREGGGKNNDRKNDLSI

SEQ ID NO: 153911 - protein, 868 aa, Glycine max
  Coding DNA Sequence Number=SeqID_37133
  Gene Ontology: Mol. function=RNA-directed DNA polymerase activity; Cellular component=chromatin; Biological process=chromatin assembly or disassembly
  Pfam annotation: Domain name=RVP_2; Domain location=397-511; Score= -21.8; E_value=5e-05; Accession=PF08284.2; Description=Retroviral aspartyl protease
  Pfam module annotation: Pfam domain module=RVP_2::RVT_1::Retrotrans _gag; Domain location=397-511::630-798::108-198
MGDRIEALETQMGNVTTTLQELALQMSQHAQQMQQQSLVLTELSKQIGQKGATQEGEASVGDSSQNESRLAGKKVKLPLFEGEDPVAWITRAEIYFDVQNTPEEMRVKLSRLSMEGSTIHWFNLLMETEDDLSWEKLKKALIARYGGRRLENPFEELSMLRQTGSVEEFVEAFELLSSQVGRLPEEQYLGYFMSGLKAPIRRRVRTLNPANRMQMMRIAKDVEEELREEDDDENRASMKKNVGRSEYGPGSKFRTGSNLAQKEITRFSKSGWTNPSRKTVSIGSTSNTTSSLSSTGRKHEGDRRGGTNDRWRGINSEEMEERRAKGLCFKCGGKYHPTQHKCPERSLRVLILGDGESLNDDGEIVAMEGEESEEEEMTEAECKLIGVLGKMGESQTMKIEGKLEHVNVGVLIDSGASHSFISPELVTALGLKVTPTTVKRIKLGDGHKVLSEGVCRRVRLVLGSNEFEIDALVLGLGGLDVVLGVSWLSTLGKVVMDWKDLTMQFWHNGEMMTLKGQGGRQLVQGCLHTYLEGKDRAMSPVELWSLEEKLLDSNVKIQGNIGDLLTTFPEVFTEQLSLPPIRSQVHQINLIPNYGPVNMRPYKYPHHQKEEIEKQVAELLQAGVIRPSMSAFSSPVILVKKKDGSWRMCVDYRSLNKATVPDKYPIPVVDELLDELFGSTVFSKIDLKSGYHQIRVHEQDIHKTAFRTHNGHYEYLVMPFGLMNAPTTFQATMNDIFRPFLRQFVLVFFDDILVYSKNEQDHLNHVKLVLEVLVKHCFVANKKCSFGCSQVDYLGHIISAVGVSVDPSKVKCIMEWPEPKTVKGVRGFLGLTGYYRKFVKDYGKIARPLTDLTKKDNFLWNESAREAF

SEQ ID NO: 153912 - protein, 154 aa, Glycine max
  Coding DNA Sequence Number=SeqID_37134
MKHIALFSVAFLFSAIFVSEAEARKSRFFVIPGFGGGETIDLVYDLPDREPFLRDGEAFDIGYLNSGDRSGYVLYRGERYSRLSDADIARLKATLGFDPTTKDRMERAARASDAPWNLVIIIAVAIVGIFVLVHKGMQLVRWISRLATISAAAG

SEQ ID NO: 153913 - protein, 214 aa, Glycine max
  Coding DNA Sequence Number=SeqID_37135
  Gene Ontology: Mol. function=nucleoside-triphosphatase activity; Cellular component=chromosome; Biological process=DNA metabolic process
  Homolog annotation: Hit_ID=Q8UDH2; Match level="QueryCoverage=100%, HitCoverage=82%, E-value=1e-114, Identity=94%"; Hit description=ABC transporter, nucleotide binding/ATPase protein
  Pfam annotation: Domain name=ABC_tran; Domain location=28-210; Score=- 34.9; E_value=0.00021; Accession=PF00005.17; Description=ABC transporter
MKETPDGRDDYPFSVPALRHLERLEFKTPITFFAGNNGSGKSTLLEGLAAGMTAYAIGNHGQVKGDLYLQHAETVAKAFYFARKKYPKIRMFLRAEDVLGYIRRQNEEALDDFRWEREKALKNGEYFPEETPETFRGIVRNNSLDRRSHGEGFLDIMHRRLHGAGLYFLDEPESPLSPQKQLELAALIRDAADSGGQLIIATHSPVLLAIPEAT

SEQ ID NO: 153914 - protein, 80 aa, Glycine max
  Coding DNA Sequence Number=SeqID_37136
DDSSDDADTKVACKASDMRKRENRWQLAAGTGPATRVVHRAAVFPSQAEKTSKESLSMALPGNPSLPFFSNSLIIVGSSA

SEQ ID NO: 153915 - protein, 146 aa, Glycine max
  Coding DNA Sequence Number=SeqID_37137
  Gene Ontology: Mol. function=structural molecule activity; Cellular component=cytoskeleton; Biological process=keratinization
  Homolog annotation: Hit_ID=Q28658; Match level="QueryCoverage=53%, HitCoverage=71%, E-value=2e-10, Identity=37%"; Hit description=Small proline-rich protein 3
MPSPSEGNSSSPLEGYTPSPFEGYMPSPSEDYTSSPSDGCMSLPSEGYRPSPSEDYTSSPSEGYTPLPSKDYTSSPSKGCTSSLLEGSISTPLEDLRDRARKTSCGPGDVQQGLGDGRQRTTDAPSPPPKPLNSYTKAGALPTTRG

SEQ ID NO: 153916 - protein, 133 aa, Glycine max
  Coding DNA Sequence Number=SeqID_37138
  Homolog annotation: Hit_ID=Q1SP03; Match level="QueryCoverage=75%, HitCoverage=18%, E-value=3e-11, Identity=36%"; Hit description=IMP dehydrogenase/GMP reductase
MGTNQNGKRFYQVKVKGLDVTSLKELGRLMGPLQRQAFRKVYGKILDLTVAEVFTEAVISLAQYYDQPLRCFTFGDFQMVPTIEEFEEILGCPLGGRKPYLFSGFLPSLRKVAAVIGDSAKELDRMKQIRNGV

SEQ ID NO: 153917 - protein, 48 aa, Glycine max
  Coding DNA Sequence Number=SeqID_37139
MIYKEFVHFSDPAIGQTTHPRQKLVGYEEEASALHQRLEMISCPGQNW

SEQ ID NO: 153918 - protein, 62 aa, Glycine max
  Coding DNA Sequence Number=SeqID_37140
MNETLKQNRLLRERGDDNSFPNSPNNSSSDANLQKNSCLGWKNLILRNYLLFANIYQTLMLE

SEQ ID NO: 153919 - protein, 247 aa, Glycine max
  Coding DNA Sequence Number=SeqID_37141
LIWQLAGFYARQHDIGRVEGIGELSKPPKMTERVEALVAKGIVAEEVHSFTVVIHWLSIGWQQGSAVQRTSKEVKVKLTKLNMEGSTIHWFNSLYETEDHLTWLELRQAMIERWVGFRMSNTWATSWEDFAQIYGYRLVYMEEVLEGLSCDDKGHLGKVGNPQQLKGLSDGAVMLEVNDFLKPKSILLTSRDSRGANKDATGEDELILHSQFPPLNLGDKVVLPAAGCDRALKENTESKAEQGMDEY

SEQ ID NO: 153920 - protein, 405 aa, Glycine max
  Coding DNA Sequence Number=SeqID_37142
  Gene Ontology: Mol. function=DNA binding; Cellular component=nucleus; Biological process=regulation of transcription
  Homolog annotation: Hit_ID=Q8W3M8; Match level="QueryCoverage=76%, HitCoverage=92%, E-value=3e-68, Identity=50%"; Hit description=6b -interacting protein 1
MEVMEGGVRNLGFGREYTRLRHQSSLRTILSTHTKWDVLEAKLTELTVTPNNHHHHHHRQSKSKPPTPPYTMDSIAGAPPHADVTPPPPRPSPFPGREDCWSEEATFTLIEAWGQRHLELNRGNLRQRHWQEVADAVNALHGHVSAKARRTDVQCKNRIDTLKKKYKIEKARVSDSGDSATTWPFFRRLDFLIGDNFPAKKPSPPPPSSAGVTRRSTPPAKSPLWPVIPVGPRSGTKKRPAQAKPASASPDSVADSYFRRNFSVFAAAAAAAAAEADSENSDGSKWSSGSEKGTMKKKRGRGDWEFGYREMAEALERFGEIYERVEEAKQRQMVELEKQRMQFAKDLETQRMKLFMETQVHLQKINRSKRSSASEHDDTLLLWNFLEKVFSPDIFCSFRVLPGVS

SEQ ID NO: 153921 - protein, 234 aa, Glycine max
  Coding DNA Sequence Number=SeqID_37143
  Gene Ontology: Mol. function=protein-tyrosine kinase activity; Cellular component=membrane; Biological process=protein amino acid phosphorylation
  Homolog annotation: Hit_ID=Q6ER39; Match level="QueryCoverage=97%, HitCoverage=25%, E-value=1e-92, Identity=69%"; Hit description=CTR1 -like kinase kinase kinase-like
  Pfam annotation: Domain name=Pkinase; Domain location=1-226; Score =59.2; E_value=1.3e-14; Accession=PF00069.15; Description=Protein kinase domain
  Pfam annotation: Domain name=Pkinase_Tyr; Domain location=1-226; Score=24.1; E_value=6e-14; Accession=PF07714.7; Description=Protein tyrosine kinase
  Pfam module annotation: Pfam domain module=Pkinase::Pkinase_Tyr; Domain location=1-226::1-226
MKLYAVILFLGACTKPPRLSMVTEYMELGSLYYLIHLNGQKKKLNWRRRLRMLRDICKGLMCIHRMKVVHRDLKSANCLVNKHWTVKICDFGLSRIMTESPMRDSSSAGTPEWMAPELIRNEPFTEKCDIFSLGVIMWELCTLNRPWEGVPPERVVYSVANEGSRLEIPEGPLGRLISGPCNFPLLHVDGRTQLSTSTNYFGFVLSAECWAECHERPSCEEILSRLVDIEYSLC

SEQ ID NO: 153922 - protein, 197 aa, Glycine max
  Coding DNA Sequence Number=SeqID_37144
  Subcellular localization annotation: CTP_CleavageSite=22; ConfidenceScore=5.57e-01
HMATPPNSPPPPPESATPSSPSTSKKTRKATRLRSLATRPIGVERPVVHVHPEIGKFDGPHRKKLRIYLGIVACDKMDVTYDNWKQAEFDIPESSYLRRKKKIFQTVGERWRQFKLDLTSKWAQAHNKEGEDDKVCEKYRISKEKWTQSCQSCRDPSWEDVQKMEQTIQKQNTTPHVLSSGGYDFLEKKLMEEKQKK

SEQ ID NO: 153923 - protein, 412 aa, Glycine max
  Coding DNA Sequence Number=SeqID_37145
  Gene Ontology: Mol. function=transcription factor activity; Cellular component=intracellular; Biological process=regulation of transcription, DNA-dependent
  Homolog annotation: Hit_ID=Q0MII0; Match level="QueryCoverage=80%, HitCoverage=97%, E-value=1e-117, Identity=64%"; Hit description =Putative transcriptional regulator protein
  Pfam annotation: Domain name=LacI; Domain location=8-33; Score=17.7; E_value=0.037; Accession=PF00356.11; Description=Bacterial regulatory proteins, lacI f
  Pfam annotation: Domain name=Peripla_BP_1; Domain location=65-327; Score=-15.3; E_value=1.1e-05; Accession=PF00532.11; Description =Periplasmic binding proteins and sugar b
  Pfam module annotation: Pfam domain module=LacI::Peripla_BP_1; Domain location=8-33::65-327
  Subcellular localization annotation: CTP_CleavageSite=35; ConfidenceScore=5.42e-01
MQNDKAGVSAQDVADRAGVSRSAVSRAFTPGASVSAATRARVMKAAQELGYHVNHLARGLVRNRSGIVCLIVSEIATPYRATLVRWLTQFLQEAGKVAMLINTDRSDNSVSAALLQAINFRADASIILSGMPDRTITRQCYQHGQRIILINRDEALPGSLSINLDAQAAAETAVMAFQRAGCRQLAFANSLAGTPSLIKREAAFIAVAERAGLTVSVERFGTTSYESGQILAHRLLTRHQRPDAVFCVTDLMACGFMDEARHRFQLRVPEDLCLIGYDNIAQAGWSSYNLTTFAQPVERFARDAIAWLTQTEQEESGFTPQSEQQHDTLLYQADVVWRGSRCAASCSSRGCHSCDTVTSGVANGNSNIANAGLSLISGWCRHSVCGTSASQSLCSVSATAVEKAGTTAATWR

SEQ ID NO: 153924 - protein, 296 aa, Glycine max
  Coding DNA Sequence Number=SeqID_37146
  Gene Ontology: Mol. function=transporter activity; Cellular component= outer membrane-bounded periplasmic space; Biological process=transport
  Homolog annotation: Hit_ID=Q8YCG5; Match level="QueryCoverage=99%, HitCoverage=82%, E-value=1e-126, Identity=72%"; Hit description =IRON(III)-BINDING PERIPLASMIC PROTEIN
  Pfam annotation: Domain name=SBP_bac_1; Domain location=8-282; Score =37.9; E_value=3.4e-08; Accession=PF01547.15; Description=Bacterial extracellular solute-binding protein
MRYTSLAIALSLSCTALPFAATAAGNLNMVCSADVVVCEHMTRIFSQAHPDIKVSMVRLSAGEAYARLRSEARNPRTDIWWAGTGDPHMQAAEEGLTQPYKSPLLDQQQDWAQKQAENSGYRTVGIYAGALGWGYNTKLLADKKLKAPACWADLLDPAFKGEIQIANPNSSGTAYNTLATLVQIMGEDKAFDYLKKLNANISQYTKSGSAPVKAAARGETTVGIVFMHDAVAMEVDGFPIKTVAPCEGTGYEIGSMSIVKGARNLANAKVWYDWALSAEAQSHMKEAKSFQLPSNR

SEQ ID NO: 153925 - protein, 102 aa, Glycine max
  Coding DNA Sequence Number=SeqID_37147
  Subcellular localization annotation: CTP_CleavageSite=72; ConfidenceScore=5.40e-01
MKCVFIHVSSTFELGAIVVIAYCNSPFSTPFRSPMNCVFVHVSSTFEFGAMRSDCLVKFSILNLFRSPKNCVFVHVSSTFEFGAMRSDCLVPFSILNLFGAP

SEQ ID NO: 153926 - protein, 79 aa, Glycine max
  Coding DNA Sequence Number=SeqID_37148
MGSSSYDEDLCGKATVVVGGDEAINDGEVEVVGKELGKQPRSDQRVRCSGVAIVEVGTCCDNVAEFVSAGREQSTNNEC

SEQ ID NO: 153927 - protein, 74 aa, Glycine max
  Coding DNA Sequence Number=SeqID_37149
MENMHRLSLHMQMDPPLITPEAYRQQVAWPGDQPSTDRGEEPSGAAEDPAVDEDLIADLASADWGPWADLGRGS

SEQ ID NO: 153928 - protein, 64 aa, Glycine max
  Coding DNA Sequence Number=SeqID_37150
MPLIFGNTGSGSTSQVRKWNMNSTRWEAKPQYKPIKSLVIHLKVVSKIANTEPDTYEQRETPAL

SEQ ID NO: 153929 - protein, 155 aa, Glycine max
  Coding DNA Sequence Number=SeqID_37151
  Homolog annotation: Hit_ID=Q9SJI9; Match level="QueryCoverage=99%, HitCoverage=55%, E-value=4e-43, Identity=56%"; Hit description =Expressed protein
  Pfam annotation: Domain name=DUF1637; Domain location=4-155; Score =73.6; E_value=6.2e-19; Accession=PF07847.3; Description=Protein of unknown function (DUF1637)
MPYYIQRLYRLCKASFSPNGPVSEEAIAKVCEKLDVRKLQTFSLSPLFLFRVCPSEGEKIKPSDVGLEQEAQVVRNWSSQMPECNGNHQQPPPIKYLHLYEDDSFSIGIFCMPPSSVIPLHNHPGMTVLSKLLYGSVYVKSYDWIDFPGPTDSSE

SEQ ID NO: 153930 - protein, 49 aa, Glycine max
  Coding DNA Sequence Number=SeqID_37152
MGKKSKQSVEGSSGERSEPEKAMEKKVKPQQDALFFLCDFRVVFVTVAK

SEQ ID NO: 153931 - protein, 389 aa, Glycine max
  Coding DNA Sequence Number=SeqID_37153
  Gene Ontology: Mol. function=nucleic acid binding; Cellular component= spliceosome; Biological process=mRNA processing
  Homolog annotation: Hit_ID=Q1SD98; Match level="QueryCoverage=76%, HitCoverage=76%, E-value=1e-120, Identity=72%"; Hit description=Zinc finger C-x8-C-x5-C-x3-H type (And similar), putative
  Pfam annotation: Domain name=zf-CCCH; Domain location=286-312; Score =43.7; E_value=6.3e-10; Accession=PF00642.15; Description=Zinc finger C-x8-C-x5-C-x3-H type (and similar)
MRGASAPPKGIKLNIIPDVDLEHKPSTTKDMITFEYTAQRENTSVTVKVKITTLKWKREVGDGCYFNRRRYRGLRRGGKGHLRSTTAAIDYYVMEDSDQPAKSAENQQTEQVCSFFRKPVNKKNLRKRTIEIEDNEEDSNNETSLLHIQKKTLKADNKLYFSTGSSKSSASAEPSEESGKTVFQFESSKEIQVQHDSKATAILETETEFSKDARAIRERALKQAEESLKGKSASSEDKKLYKGMNSYKDYKAGFRREQTIASEKAGGSHGPLRASAHIRVSARFDYQPDICKDYKETGYCGYGDSCKFMHDRGDYKSGWQMEKEWEEAEKQRKMRLAAGEDADEEEGANLTDEDDEDSLPFACFICRNSFVDPVVTKCKHYFCEHCALK

SEQ ID NO: 153932 - protein, 141 aa, Glycine max
  Coding DNA Sequence Number=SeqID_37154
MKDGEFVDDMFGRLHVLLKESRSSWTDIFKGLDKLEVVGQLSLGMGTKDHNHPRSKRSEKIWHGMSSWEVQIDDREEGKVLTLIRDDLDNENSSNSEDEQVNIYLMTDTNDKIEIKTCSKFDTSSCTSSNDKKDMPYDVLL

SEQ ID NO: 153933 - protein, 77 aa, Glycine max
  Coding DNA Sequence Number=SeqID_37155
MSLSLQSQGFTSFPCPTPDQFRAEVAWPGDWPEARAGEAPAEAPAEAPAEAPNEADEAREDEEIADLLDFLGGSGAT

SEQ ID NO: 153934 - protein, 98 aa, Glycine max
  Coding DNA Sequence Number=SeqID_37156
MLAQRNVMQELYSLLGLPYLEALQRWFTVKAGYHQAVDANCKFLAYSSHTPGDLWKTLRKIKTLQKCQNLAWTACKNILTVMLNLKSRGTNVDENDRA

SEQ ID NO: 153935 - protein, 82 aa, Glycine max
  Coding DNA Sequence Number=SeqID_37157
MTVSGQNLRGVFFVPMQQVIVNHPDLWSAENGVNKNGSPELHIMLAEYIISESPEVVFWVGRLHEDKRNLEAMAWMFGDSNC

SEQ ID NO: 153936 - protein, 90 aa, Glycine max
  Coding DNA Sequence Number=SeqID_37158
VLQEQEVDGFQAPCKECKGSKLAGLRIWTLDLTHQLTNSNCLKLDIGLNSPPQNRVVSQCGISTHPASCTIGTRLESGAWPNNNNISCHG

SEQ ID NO: 153937 - protein, 94 aa, Glycine max
  Coding DNA Sequence Number=SeqID_37159
  Subcellular localization annotation: CTP_CleavageSite=66; ConfidenceScore=5.47e-01
MHTQQTHHDSAPKLVTFPSFKVTPQAKRDPNVMKNHQFPRGNNMAMLRHDNLGEGKRSVFLRREVRAWSAGSLNLGFMEKNWQKKKKEEEEEGS

SEQ ID NO: 153938 - protein, 126 aa, Glycine max
  Coding DNA Sequence Number=SeqID_37160
  Homolog annotation: Hit_ID=Q9SJI9; Match level="QueryCoverage=84%, HitCoverage=44%, E-value=5e-42, Identity=74%"; Hit description =Expressed protein
  Pfam annotation: Domain name=DUF1637; Domain location=2-124; Score =37.1; E_value=2.4e-14; Accession=PF07847.3; Description=Protein of unknown function (DUF1637)
MKFKGFYHLTVLFIIFLFHARAAKLVKDTEMTAPTATTVLYPTLGGNIHTFRAITPCAIFDVLSPPYSSEHGRHCTYFRKSQRKDLPGNLQLNGVTVSDVTWLEEFQPPDDFVIRRGIYKGPVIRT

SEQ ID NO: 153939 - protein, 229 aa, Glycine max
  Coding DNA Sequence Number=SeqID_37161
  Gene Ontology: Mol. function=nucleic acid binding; Biological process= DNA integration
  Homolog annotation: Hit_ID=Q1SB62; Match level="QueryCoverage=98%, HitCoverage=33%, E-value=1e-36, Identity=47%"; Hit description =Integrase, catalytic region; Zinc finger, CCHC-type; Peptidase aspartic, catalytic
MQTFLFWEKAKSRSRWRMVQKISSLMFSMLLIHHNLLSMGQLSKKGFNMKIHEGYCMLIDKNGRFVAKFPVVNVPNGVYETCEIGKKHRDSFSTGKSWRARKLLEIIHSYLCLVEIPTPGGSRCPTKTVRDKTLEETWSGRKKLDDKGEKCIFTGYNTKSKAFKLYNPETMAVIINRDVTFDKKGMWDRSSKSQQEQMVIVDNNEENDEWLLDPTPDKPKSSRRLWRNP

SEQ ID NO: 153940 - protein, 251 aa, Glycine max
  Coding DNA Sequence Number=SeqID_37162
  Gene Ontology: Mol. function=nucleic acid binding; Cellular component= endoplasmic reticulum membrane; Biological process=DNA integration
  Homolog annotation: Hit_ID=Q1RSG2; Match level="QueryCoverage=94%, HitCoverage=19%, E-value=9e-98, Identity=69%"; Hit description =Integrase, catalytic region; Zinc finger, CCHC-type
MDDEIHAIEKNDMLKKALYGLKQAPRAWYKKINSWFVHNGFERCPYKHTLYVKSIDPGDILIMCLYADDLIFIGNNSKLIVEFREVMISCFEMTNLGLMSYFLDIEVNWRDDGIFISQRKYAHDILKKFKMENSKFVSTPVEEKLKLIRDVEGKRVDATLYKSLIGSPRYLVATRPNIIFGVNLLSIFMEEPLISHLQEAKRVLRYIKDSDWARDVEIRKSTSGYVFHLGSNVVSWFSKKKSLVALSTAEA

SEQ ID NO: 153941 - protein, 52 aa, Glycine max
  Coding DNA Sequence Number=SeqID_37163
MTSCEVRFLSVAAQGALLASGTGWNVCVPMPLVQFPSCLHLSVIIFTINVIS

SEQ ID NO: 153942 - protein, 257 aa, Glycine max
  Coding DNA Sequence Number=SeqID_37164
  Gene Ontology: Mol. function=zinc ion binding
  Homolog annotation: Hit_ID=Q5VNV0; Match level="QueryCoverage=66%, HitCoverage=52%, E-value=3e-38, Identity=49%"; Hit description =Glycine-rich protein-like
MQKGREVRDNNIFEPRGFGDFGGFGFHRSMMPSLFGDRDPFDDPFFTDPFDSLFGPSSASRAMQKTNREKGIVIEELDSDDEGGDNGPEIGDKDFDKKKSKSTTEPSVEHPDDDVDAERKNSDITYKNDHYMVEPLKARKFSFQTSRVTYGGIDGAYYTSTRTRKMGANGELMEENKEGDTTTGQATHRITRGIHDKGHSVLRKLDSDGKVDITQTLHNLNEDELAGFEEAWKGNNMAELPGYDVHMKEVNAEGILV

SEQ ID NO: 153943 - protein, 137 aa, Glycine max
  Coding DNA Sequence Number=SeqID_37165
MLLRGVYADLPRAPASWLVEIWVHGRLRRDKMVDEPRSRPITCEPVSSGPIDDPLRARTLPTRPQKRPQWRTGPKSLEGAPERVRARRAGPVAHERCRRVGLFGNAAPIGREADGGRRCVPVGCGTVRAGPPIDSGH

SEQ ID NO: 153944 - protein, 368 aa, Glycine max
  Coding DNA Sequence Number=SeqID_37166
  Homolog annotation: Hit_ID=Q6CQE5; Match level="QueryCoverage=8%, HitCoverage=29%, E-value=3e-07, Identity=84%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTALVCDRSGTTGSHPLWRPFQGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 153945 - protein, 94 aa, Glycine max
  Coding DNA Sequence Number=SeqID_37167
  Subcellular localization annotation: CTP_CleavageSite=54; ConfidenceScore=5.15e-01
MHMGERQGQTSGVAPEWRSNNTGESVAKKVLPCSSTRKWRVKPLMVTCRPNLCRSVKGTPMSKNGKWSSECKNISPEWMTYRTKTYSLGQDLHN

SEQ ID NO: 153946 - protein, 648 aa, Glycine max
  Coding DNA Sequence Number=SeqID_37168
  Pfam annotation: Domain name=DUF688; Domain location=27-583; Score =81.5; E_value=2.6e-21; Accession=PF05097.3; Description=Protein of unknown function (DUF688)
MALALTDKTEIFHFFDEANSMMLKDLMEEKQLNLNQPLLSVRRFSSTLASETDHKSKSQNSLARLPLPPAYKSELNSVPERNAGNVPFVWEKAPGRPKDESKLQTQDFEKPPFTSNFPPGRVSKTKQQSLAEMRTGSTLSNSQSVASLDKKATKNSKGETREKESSGSDDGDEAYEDARDSLSRTESFFMSCSVSGLSGWDEQEVQPFGSFSSDHQQGRNFMIDRFLLAAKAMTSETPQYASKKAHIGQEQQKQKKKEVNTESPCPINQHRPKALPHYTQDIDGEESDDCSEYENYTTTTCGLFPRFCLLNPMPGLRMVDRVPRNAAHGMQAKSAASHIGSSKEQGRTPYGKKLRDSQSGFTEEKEILDILVKSKHGIDPYQRGCTQHDSSYESHVHEKTLYVDSVHKVKSQTNNIGGDFETSIRDSGIYNNSSIDSSPKVIKSKKINSESQVYGRDKNSDILTQNSELDLKRQLAAKWVDEECTLASSKVRYNGKIDLESQCLTKLGHQEISGASCFGLPLALPALKAPSESWLKRTLPTICKRNMTSQSNLTANTKTPKTTPLHPKEFLAMFHGGYGDEVIMHKSGVLFLLGMIFLSLSVISMIIFACGADNSHEYRRKRNRGLTGLGGDDGGGGSNDGGGGGGGG

SEQ ID NO: 153947 - protein, 101 aa, Glycine max
  Coding DNA Sequence Number=SeqID_37169
MDNVPGMHEESNILNPSSCVDEVYVSEEETMLTGFDNGSSRSEYELVDNDGEDNEDYESCTWRIHASLTPDKQTLLEKYSVEPSVEPSSNMQLDQAKRKVQ

SEQ ID NO: 153948 - protein, 438 aa, Glycine max
  Coding DNA Sequence Number=SeqID_37170
  Gene Ontology: Mol. function=protein binding; Cellular component =integral to membrane; Biological process=xylan catabolic process
  Homolog annotation: Hit_ID=Q1SWI7; Match level="QueryCoverage=97%, HitCoverage=99%, E-value=1e-128, Identity=37%"; Hit description =Leucine-rich repeat
  Pfam annotation: Domain name=LRR_1; Domain location=104-126; Score =7.5; E_value=11; Accession=PF00560.23; Description=Leucine Rich Repeat
  Pfam annotation: Domain name=LRR_1; Domain location=152-174; Score =11.9; E_value=1.7; Accession=PF00560.23; Description=Leucine Rich Repeat
  Pfam annotation: Domain name=LRR_1; Domain location=177-199; Score =10.8; E_value=2.7; Accession=PF00560.23; Description=Leucine Rich Repeat
  Pfam annotation: Domain name=LRR_1; Domain location=201-223; Score =17.3; E_value=0.057; Accession=PF00560.23; Description=Leucine Rich Repeat
  Pfam annotation: Domain name=LRR_1; Domain location=251-273; Score =7.2; E_value=13; Accession=PF00560.23; Description=Leucine Rich Repeat
  Pfam annotation: Domain name=LRR_1; Domain location=275-297; Score =15.0; E_value=0.28; Accession=PF00560.23; Description=Leucine Rich Repeat
  Pfam annotation: Domain name=LRR_1; Domain location=299-321; Score =12.9; E_value=1.1; Accession=PF00560.23; Description=Leucine Rich Repeat
  Pfam annotation: Domain name=LRR_1; Domain location=31-54; Score=2.9; E_value=84; Accession=PF00560.23; Description=Leucine Rich Repeat
  Pfam annotation: Domain name=LRR_1; Domain location=323-344; Score =8.9; E_value=6.2; Accession=PF00560.23; Description=Leucine Rich Repeat
  Pfam annotation: Domain name=LRR_1; Domain location=7-29; Score=6.8; E_value=15; Accession=PF00560.23; Description=Leucine Rich Repeat
  Pfam annotation: Domain name=LRR_1; Domain location=80-101; Score =8.9; E_value=6.1; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =104-126::152-174::177-199::201-223::251-273::275-297::299-321::31 -54::323-344::7-29::80-101
MWEALSQVLYLNLSRNHIHGEIGTTLKNPISIPTIDLRSNHLCGKLPYLSSDVLQLDLSSNSFSESMNDFLCNDQDKPMLLQFLNLASNNLSGEIPDCWMNWTSLVDVNLQSNHFVGNLPQSMGSLADLQSLQTHNNTLSGIFPTSLKKNNQLISLDLGENNLSGSIPTWVGENHLNVKILRLRSNRFAGHIPSEICQMRHLQVLDLAQNNLSGNIPSCFSNLSAMTLKNQISVLLWLKGRGDEYRNFLGLVTSIDLSSNKLLGEIPREITYLNGLNFLNLSHNQLIGHIPQGIGNMRLLQSIDFSRNQLSGEIPPTIANLSFLSMLDLSYNHLKGTIPTGTQLQTFDASSFIGNNLCGPPLPINCSSNGKTHSYEGSHGHAYGVNWFFVSMTIGFIVGFWIVIAPLLICRSWRYAYFHFLDHVWFKLQSFRLGSITV

SEQ ID NO: 153949 - protein, 162 aa, Glycine max
  Coding DNA Sequence Number=SeqID_37171
  Homolog annotation: Hit_ID=Q1RW23; Match level="QueryCoverage=92%, HitCoverage=76%, E-value=1e-21, Identity=38%"; Hit description=Plant self-incompatibility S1
  Pfam annotation: Domain name=Self-incomp_S1; Domain location=50-155; Score=84.7; E_value=2.9e-22; Accession=PF05938.2; Description=Plant self-incompatibility protein S1
MLKALAIVIVFLMMIMRVPAMQINEQENGGRKNIVVGAEDDNDGILGDKKTVRVLNGMNDGILVYLHCKSKDDDFHQHVLAVGEYQEWSFRDNIAGTTLYWCTMDANTLHASFEIYNAKRDDSKCDSQCNRTMKNDGGYFYNQFQGRWEKMLFWNIPKLTPV

SEQ ID NO: 153950 - protein, 49 aa, Glycine max
  Coding DNA Sequence Number=SeqID_37172
MDFVAVTMSEQEESNKAASNDKAFASRIIQECFNKQSHVSRFIKDQALP

SEQ ID NO: 153951 - protein, 155 aa, Glycine max
  Coding DNA Sequence Number=SeqID_37173
  Homolog annotation: Hit_ID=Q1RW23; Match level="QueryCoverage=64%, HitCoverage=56%, E-value=1e-17, Identity=44%"; Hit description=Plant self-incompatibility S1
  Pfam annotation: Domain name=Self-incomp_S1; Domain location=43-148; Score=69.7; E_value=9.2e-18; Accession=PF05938.2; Description=Plant self-incompatibility protein S1
MMKALFITIIVLFLIIRVPAVQISQQENGGRKIHVDDILDGTKIVRVTNAMNDGIVVHLHCQSKDTDFHEHVLAVGEHQEWSFKDNLFGTTLYWCTMDAINVHVSFEVYNVDIEENICNVQCNRNLKNDGAYFYHQFESKWEKRLAWYVPNITSV

SEQ ID NO: 153952 - protein, 40 aa, Glycine max
  Coding DNA Sequence Number=SeqID_37174
MANHDSITNECSIASQSMQDKQRLIHPKYKVYSGENGGPH

SEQ ID NO: 153953 - protein, 85 aa, Glycine max
  Coding DNA Sequence Number=SeqID_37175
  Gene Ontology: Mol. function=nucleoside-triphosphatase activity; Cellular component=intracellular; Biological process=regulation of transcription, DNA-dependent
  Homolog annotation: Hit_ID=Q9FNQ1; Match level="QueryCoverage=62%, HitCoverage=41%, E-value=3e-19, Identity=70%"; Hit description=RNA helicase
MRERGFKKSLGTIFVLVPNLQSAIPMIVTTPEKWDTITRKSSDISLSMVVKLLIIDEVHLLNDDRGPVIEALVFRTLRQTLAYDS

SEQ ID NO: 153954 - protein, 161 aa, Glycine max
  Coding DNA Sequence Number=SeqID_37176
  Homolog annotation: Hit_ID=Q1RW23; Match level="QueryCoverage=64%, HitCoverage=58%, E-value=1e-18, Identity=43%"; Hit description=Plant self-incompatibility S1
  Pfam annotation: Domain name=Self-incomp_S1; Domain location=53-158; Score=66.1; E_value=1.1e-16; Accession=PF05938.2; Description=Plant self-incompatibility protein S1
MLKALVITIIVLFLMIIRVPAVQISQQENGGRKILANHQDDLGLHDGLLDGKKTVRVLNGMNNGIVVYLHCQSKDDDFHQHVLAVGKYQQWSFRDNIGGTTLYWCTMDANNVHESFEVYSVEVEEMICDTQCYRILKNDGAYFFNQFQSKWEKRFSWYIPN

SEQ ID NO: 153955 - protein, 81 aa, Glycine max
  Coding DNA Sequence Number=SeqID_37177
  Gene Ontology: Cellular component=endoplasmic reticulum
MRDSNRISVHRILGEGLLADVVLWKNWRGAIAVLVSATALWYLFERAVANLLNVEASFTMMNQVDSSSFDDDKDDDKKPKE

SEQ ID NO: 153956 - protein, 79 aa, Glycine max
  Coding DNA Sequence Number=SeqID_37178
  Homolog annotation: Hit_ID=Q1T6B2; Match level="QueryCoverage=71%, HitCoverage=7%, E-value=1e-22, Identity=91%"; Hit description =Exocyst complex component Sec6
MASSKNLTQQKLKVQGKGYKDKCYEQIRKTVEGRFNKLLNELVFEDLKAALEEARALTVAGTCYHEWDQDLVLKQCKHK

SEQ ID NO: 153957 - protein, 76 aa, Glycine max
  Coding DNA Sequence Number=SeqID_37179
MRDRRISSRLNGVKRKVRNRFMVLGCKSQHGYKGSEGGQGESKRVSLGMQGRETILERGVREVKQETLTDSEGPSR

SEQ ID NO: 153958 - protein, 89 aa, Glycine max
  Coding DNA Sequence Number=SeqID_37180
MGHPLILEEGQLCKDRAHKTPSGPGGAQQGPRVSNSGYGPLDRARKTPSGPGEVQQGLGVSNSDYGPLSVLRSACHRQAQGETPQLWRP

SEQ ID NO: 153959 - protein, 80 aa, Glycine max
  Coding DNA Sequence Number=SeqID_37181
MYMVNDIFTLSRHKENMVQPKPSAGLKGKPHQHALTHHAFLYFNEQKLGPPRPKSCFGIYPNSRKLSASKKWYHTYTNPI

SEQ ID NO: 153960 - protein, 88 aa, Glycine max
  Coding DNA Sequence Number=SeqID_37182
MGNKWEAYNELQTQRKGNIGSNGLSKELIQGRLIWLEAYKNKMPKSSPNMHVKQEVSTRVKPRLLCKQSMGQNTLNEIDDDGSNSYQG

SEQ ID NO: 153961 - protein, 216 aa, Glycine max
  Coding DNA Sequence Number=SeqID_37183
MVCIDQADMTGRLLVGSLTFDCRIMHYIIVRILMPRSSNLAQASEEDLILMWAFLTGHPIDWAHLIHYRMHKALRSSAPLPYPQLVTLLLRHFEIPLDSEPFVQVKCSFAIGAGAVTSFGYRKDMDGQWLKKDAQPAQDERTPSPLPQRDDSSALMHEVLSELRGLRTYVGERFDSLDGRIDAIDARFEGMDTHITQLEEDVSYLRRCFNLPPPSS

SEQ ID NO: 153962 - protein, 237 aa, Glycine max
  Coding DNA Sequence Number=SeqID_37184
  Homolog annotation: Hit_ID=Q1T6B2; Match level="QueryCoverage=44%, HitCoverage=14%, E-value=1e-52, Identity=95%"; Hit description =Exocyst complex component Sec6
MEFYCNSLLFRDLSLDPRVSFLVTGWVVEYKDNLIGLGVDESLAQVCSESGAMDPLMNSYVERMQATTRKWYLNILEADRTQPPKKTEDGKLYTPAAVDLFRILGEQVQIVRDNSTDLMLYRIALAIIQENKGKLDRTWKLEDPQIERKRTHTPSRNNIEKPTWTPSKVKSMIDGGVDAKRVVAAVEVEMAVSRLHYYGLINREGVVRQIKNQEYASFFQKLKVKTTKRREKEPLSP

SEQ ID NO: 153963 - protein, 117 aa, Glycine max
  Coding DNA Sequence Number=SeqID_37185
MVICTLPEDVSVLRPRPRKSLNLAIVIQGSDSTRTHLMVIRTFHQLEASEPVDTQRPMWSSASFPKMSASSGRDYEKTNVVICTLLGDVSVFQLRPRKSLNFAIVTQGSNSMWRRPI

SEQ ID NO: 153964 - protein, 105 aa, Glycine max
  Coding DNA Sequence Number=SeqID_37186
MVGSRSTKTTHETCFPNSISLKKALWATLRVMRRRRLHCESFAIIGPYGISVTLKIRIPQLESISMLAAVEAGVKIHHLQLTRDDHEEAPCDLSTWTITYKDPNT

SEQ ID NO: 153965 - protein, 117 aa, Glycine max
  Coding DNA Sequence Number=SeqID_37187
  Gene Ontology: Mol. function=cytochrome-c oxidase activity; Cellular component=membrane; Biological process=protein complex assembly
  Homolog annotation: Hit_ID=Q1SHZ0; Match level="QueryCoverage=78%, HitCoverage=23%, E-value=6e-37, Identity=69%"; Hit description =Cytochrome oxidase assembly
MRNFSKMVYAKKEGIKAVNERVTDWKFINTLYPFSDEECLQEFDKYKQSPENKRVNKGMKIEEFKFIYWMEYAHRMGGRALGVMFALPYSYFLHKGLGVGQGLIGWWVVKSGLEVGT

SEQ ID NO: 153966 - protein, 68 aa, Glycine max
  Coding DNA Sequence Number=SeqID_37188
MQHAPGPEASAADWGGKEGTVEMVAMTGGKEREGDNGANCQHKEVVKKLVVAVVEGMDLDWVWGKFEK

SEQ ID NO: 153967 - protein, 145 aa, Glycine max
  Coding DNA Sequence Number=SeqID_37189
  Homolog annotation: Hit_ID=Q1S7V8; Match level="QueryCoverage=48%, HitCoverage=31%, E-value=7e-17, Identity=61%"; Hit description=HSP20- like chaperone
MGIAYKFYGLWVLHINILIFILSSPEKERGKTKDKEEEPFVYDRKGTFGHGRGVNLGGAILSSVPRALLGIARKKLQRLPHVFSCVLELPFRFDADVAVEEAPNFFRFMAETDGIDDVRAHTVEIHPGVTKIVVREGGSVELSLN

SEQ ID NO: 153968 - protein, 59 aa, Glycine max
  Coding DNA Sequence Number=SeqID_37190
MKFENDGNNTIEAEVIDEGVKRDDVIGRLCLRSFPKMEKARVTLPMWQKQLMRVTWQGA

SEQ ID NO: 153969 - protein, 186 aa, Glycine max
  Coding DNA Sequence Number=SeqID_37191
  Gene Ontology: Cellular component=endoplasmic reticulum
  Homolog annotation: Hit_ID=Q10LS6; Match level="QueryCoverage=37%, HitCoverage=30%, E-value=1e-08, Identity=40%"; Hit description =Reticulon family protein, putative, expressed
  Pfam annotation: Domain name=Reticulon; Domain location=18-131; Score= -59.9; E_value=0.0089; Accession=PF02453.8; Description=Reticulon
MRDSNRISVHRILGEGLLADVVLWKNWRGAVAVFVSATALRYLFERAGYNFLSFIANVMLLLVGTSFVVQVEGTSTWVVVTENKRGYISCGSVQVEGTSTWLFKENKEGYIPCGSLLVKAFTRLKRNLKDRRPLDPTLNKPFPPLPDLEISKETIARVADALQIWLNLALSVAHDIAIEKNFLLCL

SEQ ID NO: 153970 - protein, 65 aa, Glycine max
  Coding DNA Sequence Number=SeqID_37192
MDPTRWMDDEKAVFLYAISSFEKEFAKIARIKRQATLYAMCCSLQMGTITPYIGNCHHLPQISQL

SEQ ID NO: 153971 - protein, 229 aa, Glycine max
  Coding DNA Sequence Number=SeqID_37193
  Gene Ontology: Mol. function=structural constituent of ribosome; Cellular component=ribonucleoprotein complex; Biological process =translation
  Homolog annotation: Hit_ID=O82529; Match level="QueryCoverage=64%, HitCoverage=100%, E-value=2e-63, Identity=78%"; Hit description =Ribosomal protein L27a
  Pfam annotation: Domain name=L15; Domain location=190-223; Score =43.1; E_value=9.3e-10; Accession=PF00256.13; Description=Ribosomal protein L15
MNGLLGRNVFGLNRLSIKVPQTKLHADLVEGGGNATGREGGGREEEEVRRGPVAHSHEQLTPNPNSINSPNPQTLILPQAEMTTRFKKNRKKRGHVSAGHGRIGKHRKHPGGRGNAGGMHHHRILFDKYHPGFFGKVGMRYFHKLRNKFYSPIVNIDKLWSLIPQDAKDKALKSKDTAPLIDVTQHGYFKVLGKGVLPQNQPIVVKAKLISKIAEKKIKEAGGAVLLTA

SEQ ID NO: 153972 - protein, 242 aa, Glycine max
  Coding DNA Sequence Number=SeqID_37194
  Gene Ontology: Mol. function=copper ion binding
  Homolog annotation: Hit_ID=Q9XHP4; Match level="QueryCoverage=71%, HitCoverage=25%, E-value=1e-58, Identity=67%"; Hit description =Peroxisomal copper-containing amine oxidase
  Pfam annotation: Domain name=Cu_amine_oxid; Domain location=1-242; Score=-166.5; E_value=2.8e-07; Accession=PF01179.10; Description =Copper amine oxidase, enzyme domain
MERRWILAEDSIEGECEIEIPQDMLIKNSKNALDELTDFAYSNALQTLNNPKYFMERSTLCPTLDVDGKIEAEVKLTGILSLGALQPGESRKYGTTIAPGLYAPVWTWQLIASPVKHLISLHSVTEVTVLFPLQVVEVDAKVEEPGKNNVYNNAFYAEEKLLKSELEAMRDCNPLSARHWIVRNTRKVPGSNCLPLAGSEAKFLRRSAFLKHNLWVTPYAPDKMHPGGEFSNQNPRVGEFFD

SEQ ID NO: 153973 - protein, 150 aa, Glycine max
  Coding DNA Sequence Number=SeqID_37195
MAIIQQSSGVFSRDKTTCKQHTESRDEEEACKLITLSGVALQGSLNTIQIVYVTPKQVTSFHFGALSQVPKKFLPHWVAIGPVPNTYSLAAITQSTSFFFGLVYPQKFVKSSSYPFHLTRSLHLSIFLFTTVALVQILSTGMVAASIKPQ

SEQ ID NO: 153974 - protein, 351 aa, Glycine max
  Coding DNA Sequence Number=SeqID_37196
  Gene Ontology: Mol. function=binding; Cellular component=membrane; Biological process=Notch signaling pathway
  Homolog annotation: Hit_ID=Q2DQZ4; Match level="QueryCoverage=76%, HitCoverage=89%, E-value=8e-22, Identity=30%"; Hit description=Sel1 -like repeat
  Pfam annotation: Domain name=F-box; Domain location=43-90; Score =21.5; E_value=0.0031; Accession=PF00646.23; Description=F-box domain
  Pfam annotation: Domain name=Sel1; Domain location=122-153; Score =20.0; E_value=0.0084; Accession=PF08238.2; Description=Sel1 repeat
  Pfam annotation: Domain name=Sel1; Domain location=154-187; Score =28.3; E_value=2.7e-05; Accession=PF08238.2; Description=Sel1 repeat
  Pfam annotation: Domain name=Sel1; Domain location=249-284; Score =36.2; E_value=1.1e-07; Accession=PF08238.2; Description=Sel1 repeat
  Pfam annotation: Domain name=Sel1; Domain location=285-316; Score =8.3; E_value=1.5; Accession=PF08238.2; Description=Sel1 repeat
  Pfam annotation: Domain name=Sel1; Domain location=85-121; Score=8.6; E_value=1.4; Accession=PF08238.2; Description=Sel1 repeat
  Pfam annotation: Domain name=TPR_2; Domain location=122-155; Score =17.0; E_value=0.067; Accession=PF07719.7; Description=Tetratricopepti de repeat
  Pfam module annotation: Pfam domain module=F-box::Sel1::Sel1::Sel1::Se l1::Sel1::TPR_2; Domain location=43-90::122-153::154-187::249 -284::285-316::85-121::122-155
  Subcellular localization annotation: CTP_CleavageSite=22; ConfidenceScore=5.20e-01
MKHRTWPRAFSSLPYSNRSEFSAARSTRLCARPPPPSPPGVGGEFSSLPYDVLAKIAASFDDPNLRAASLVCRAWCEALRPLREAMVLLRWGKRFKHGRRGVRPNVDKALDSFTKAAVRGSALAMVDAGLIYWERGEKPKAMELYLKAAELGNPSAQCNLGLSYLQAEPPNTEKAVKWLRKASVCGNVRAQYQLALCLHRSGGRVRSNLKEAVGALSFSSPLLILSEVVNLFFQGCAKWYMKAAEGGYVRAMYNISLCFSFGEGLASNHQLARKWMKRAADRGHSKAQFEHGLALFSEGDMMKAVVYLELATRAGEKGAAHVKNAVLHRLSSVSRDHAMHLANSWRALPSS

SEQ ID NO: 153975 - protein, 611 aa, Glycine max
  Coding DNA Sequence Number=SeqID_37197
  Gene Ontology: Mol. function=binding
  Homolog annotation: Hit_ID=Q6YT02; Match level="QueryCoverage=95%, HitCoverage=97%, E-value=1e-95, Identity=35%"; Hit description =Putative armadillo repeat containing protein
  Pfam annotation: Domain name=Arm; Domain location=188-229; Score =25.8; E_value=0.00016; Accession=PF00514.13; Description =Armadillobeta-catenin-like repeat
  Pfam annotation: Domain name=Arm; Domain location=230-270; Score=8.4; E_value=1.1; Accession=PF00514.13; Description=Armadillobeta-catenin -like repeat
  Pfam annotation: Domain name=Arm; Domain location=436-472; Score=5.9; E_value=2.2; Accession=PF00514.13; Description=Armadillobeta-catenin -like repeat
  Pfam annotation: Domain name=Arm; Domain location=473-509; Score=6.4; E_value=2; Accession=PF00514.13; Description=Armadillobeta-catenin -like repeat
  Pfam annotation: Domain name=Arm; Domain location=515-555; Score =14.9; E_value=0.17; Accession=PF00514.13; Description=Armadillobeta -catenin-like repeat
  Pfam module annotation: Pfam domain module=Arm::Arm::Arm::Arm::Arm; Domain location=188-229::230-270::436-472::473-509::515-555
MASSEQEKRVEDELSYPIMVAERVRSAVDESDSFKLECSEVGKHVDRILQMLRTLVRFATATATSAATPPLYDRPIRRVAAETAKNLERALALVSKCKRRSILRRVVSIVGAADFLKVLTHLDASGGDMKWLLSILDGGGGIVVSLPPIASNDPILSWVWSFIASIQMGQLNDRIEAANELASLAQDNDRNKKIIVEECGVPPLLKLFKEGTSPLAQIAAANALCHLANDLDRVRVIVSEHGVPAVVQILSDSPMRVQTLAANLVARMAKHDPVAQEDFARENAIRPLVTLLSFDTFVDDPLGHLGKQSIHSIVQINKELGKGGQGGWKFTSSYSNSYLFMEGSSRGGNHRKERGNEDPAVKLQLKVSCAEALWMLARGSVTNSRKITETKGMLCLAKIVEMEQGELQLNCLMTIMEITAAAESNADLRRAAFKTNSPPAKAVVEQLLRIIKEVDSPALQIPAMKAIGSLARTFPVRETRVIEPLVTQMGNRNTEVADEAVAALTKFASPDNYLHIEHSKTIIEFNGIPALMRLLRSNEVTQMHRGLTLLCYLALHAGNSESLEQARVLTVLEGADRTVLPPHIKELVSRAIIHLNLYHAGMNSQRISYLP

SEQ ID NO: 153976 - protein, 73 aa, Glycine max
  Coding DNA Sequence Number=SeqID_37198
  Homolog annotation: Hit_ID=Q9XHP4; Match level="QueryCoverage=90%, HitCoverage=9%, E-value=1e-27, Identity=83%"; Hit description =Peroxisomal copper-containing amine oxidase
MENYSRYVFGVTHIPRLEDWLVMPVERISFTLMPHGFFNCSPAVDFPPSASDLDDKENGMSAKPIQNGMVALL

SEQ ID NO: 153977 - protein, 366 aa, Glycine max
  Coding DNA Sequence Number=SeqID_37199
  Gene Ontology: Mol. function=drug transporter activity; Cellular component=membrane; Biological process=response to nematode
  Homolog annotation: Hit_ID=Q9FR32; Match level="QueryCoverage=92%, HitCoverage=90%, E-value=3e-56, Identity=46%"; Hit description =Ripening regulated protein DDTFR18
  Pfam annotation: Domain name=MatE; Domain location=13-332; Score =56.8; E_value=7e-14; Accession=PF01554.9; Description=MatE
MVESKKLWYLAGPAIFSFVSKYSLGAFTQIFAGHVGTIDLAAVSVENSLIAGFSYGIMRVGNAVRTSGGGREAGHAGSVHATIMGVTPQHGLCTVPFVHLRGTSSEVDRARHRNFGGCGDLRHLDDSAAVRLRAEFSGGEVPAGAEQGDGDRGDSRDGHGAAPGAELAAHGEAGVGARGRRRRAQRIVVVRGGGPVGLCFRRVVLAGVERVLVGSVSESLGVLSPLSCFCCYALVSACKTHPLVAVITSVLIGVLLAIVLMISRNEYPSLFSNDTEVQDLVKDLTPFLCFCIVINNVQPVLSGVAIGAGWQALVAYVNIACYYLFGIPVGLVLGYKLDWGVKEKSRPILILVVPTNNTVSESFLSL

SEQ ID NO: 153978 - protein, 106 aa, Glycine max
  Coding DNA Sequence Number=SeqID_37200
MEGKLFLILIMFVMAHGLLAITVHASSQLPAACDGYELMIDTCKPDLTVGFDPTTDCCFVSYYALNLAMSDKTGKGLPDKCRIKISFPISMCVFWPTVPPTLVPKQ

SEQ ID NO: 153979 - protein, 66 aa, Glycine max
  Coding DNA Sequence Number=SeqID_37201
  Homolog annotation: Hit_ID=Q1T6B2; Match level="QueryCoverage=80%, HitCoverage=7%, E-value=3e-08, Identity=55%"; Hit description =Exocyst complex component Sec6
MLGNLFVCASPQTLVRAVRVVEMQEILDQQIAEEAAEAEGDGAMASVANPRNTGMYVIIFSDIENL

SEQ ID NO: 153980 - protein, 91 aa, Glycine max
  Coding DNA Sequence Number=SeqID_37202
  Homolog annotation: Hit_ID=Q1T6B2; Match level="QueryCoverage=62%, HitCoverage=7%, E-value=1e-23, Identity=94%"; Hit description =Exocyst complex component Sec6
MYSSFIIIGRISLEIHELLLIAQCVVLTPYIGSFVMIDFQAAEKKRLEESASEIGVEPLCAMINNNLRCYDLAMELSNSTIEALPQNYAEQ

SEQ ID NO: 153981 - protein, 118 aa, Glycine max
  Coding DNA Sequence Number=SeqID_37203
  Gene Ontology: Mol. function=transition metal ion binding; Biological process=cytoskeleton organization and biogenesis
MAIEKKKNVCDSVIGTLLNIQGKMKDGLNTHQDLAEMGIRAQLHRREIKCCGPIYLRWMHPVERYMKILKGYTKNLHYPEASIMERYIAEAAIEFCSEYTEKEKPVELPESQHDERVR

SEQ ID NO: 153982 - protein, 115 aa, Glycine max
  Coding DNA Sequence Number=SeqID_37204
MATRPVRTKRPRVHVDPATGKTDGPYRKKLRTYLGIVARNKSDLTSKWALIADKDGVDDTVCKKYDISKEKWTQFCQSHRDPSWELMEEKKKKQLEEAVKSGSTDTIIDPPSPIK

SEQ ID NO: 153983 - protein, 111 aa, Glycine max
  Coding DNA Sequence Number=SeqID_37205
  Gene Ontology: Mol. function=glutamate dehydrogenase activity; Cellular component=mitochondrion; Biological process=amino acid metabolic process
  Homolog annotation: Hit_ID=Q5F2M8; Match level="QueryCoverage=75%, HitCoverage=18%, E-value=7e-23, Identity=64%"; Hit description =Glutamate dehydrogenase 2
  Pfam annotation: Domain name=ELFV_dehydrog_N; Domain location=8-111; Score=2.0; E_value=7.1e-07; Accession=PF02812.8; Description =GluLeuPheVal dehydrogenase, dimeri
MAPGSLSTDHVIASVVFLYTCPSKSEVDLDEVSQVLEPPLTALVELMTWKTNVVDIPYGGAKGGISCNLRELSVNDLGSLSSVFFQKIDDLIGIQRDVPAPDMGTNAHVLI

SEQ ID NO: 153984 - protein, 360 aa, Glycine max
  Coding DNA Sequence Number=SeqID_37206
  Gene Ontology: Mol. function=calcium ion binding; Cellular component =extracellular region; Biological process=pathogenesis
  Homolog annotation: Hit_ID=UPI00006BAB4A; Match level="QueryCoverage =93%, HitCoverage=68%, E-value=4e-46, Identity=36%"; Hit description =RTX toxin, putative
PATAVLDALAPTVALDDVLTNDSTPALTGTVNDPTATVVVNVDGVDYPATNNGDGTWTLADNSLPALTDGPHTITVTATDPAGNAGTDTAVVTIDTTAPNAPLLDPINATDPVSGTAEAGSTVTVSFPDGTTATVMAGTDGSWSVPNPGNLVDGDTVTATATDPAGNTSLPGTGTVSADITAPVVALDDVLTNDSTPALTGTVNDPTATVVVNVDGVDYPATNNGDGTWTLADNSLPALTDGPHTITVTATDPAGNAGTDTAVVTIDTSVPVVSLDDVTTNDTTPALTGAINDPTATIVVNVDGTDYPAVNNGDGTWTLADNTLPALTDGPHTVTVTATDPLEILQLIQQHSLLILYRQT

SEQ ID NO: 153985 - protein, 96 aa, Glycine max
  Coding DNA Sequence Number=SeqID_37207
MEHFLVQVAWPEAQLLLVRPNEAAPPEPTLSQVDPELVDPQSPVVNPLSSPEREVVPPSPPLIIISDASSDEAAAPPDSPSCNIDDGYDFSDWMDC

SEQ ID NO: 153986 - protein, 85 aa, Glycine max
  Coding DNA Sequence Number=SeqID_37208
  Gene Ontology: Mol. function=electron transporter, transferring electrons within the cyclic electron transport pathway of photosynthesis activity; Cellular component=integral to membrane; Biological process=...
  Gene Ontology: Biological process=photosynthetic electron transport in cytochrome b6/f
  Homolog annotation: Hit_ID=Q6EW21; Match level="QueryCoverage=98%, HitCoverage=59%, E-value=2e-36, Identity=79%"; Hit description =Cytochrome b6-f complex subunit 4
MLLQYLTKGQLQYQSGGWWLQMDSEMGFVPKPLKERPITYWALYEVFEIRERNTIRVIFPKELQMDPRVPQSWMVLEPLSLRYRQ

SEQ ID NO: 153987 - protein, 96 aa, Glycine max
  Coding DNA Sequence Number=SeqID_37209
MVVSDEASYTCWGTWAVGPSPSISREGWAPGQATLSKNYSTNRMDPGGATLFAEVDAGVGVGAVEVDEISVGLALSLLAPQKATVRSSTFQQFFLM

SEQ ID NO: 153988 - protein, 156 aa, Glycine max
  Coding DNA Sequence Number=SeqID_37210
  Subcellular localization annotation: CTP_CleavageSite=82; ConfidenceScore=5.52e-01
MNCVFVHVSSTFEFGAVFHDCLSANPQGSPPFSPFFRSSMNCVFVYVSSTFEFGAVFHDCLSVDPQGNPPFSPFFRSSMNCVFVHVSSTFEFAAVIHDCLSADPQGNPPFSQFFRSSMNCVFVHVSSTFEFGAVFDDCLSADPQGNPPFSPFFGAR

SEQ ID NO: 153989 - protein, 182 aa, Glycine max
  Coding DNA Sequence Number=SeqID_37211
MSLPSAVHVFSIIKCEASGDWEARYSVVFQIGSFAKRKKKEEVEMRVVIAKRAGRTKSVSYLCFTLISDKSPETSQKSKGSRLARSVKFRNVAEVEKRRFCAIRPLGPSRRFLQKAVASGGSNLARLGELGGKLLPYFAINRGRSEEEKPRRFRNVSVRNYAKILDRSSRFIVRSSFSSVFN

SEQ ID NO: 153990 - protein, 213 aa, Glycine max
  Coding DNA Sequence Number=SeqID_37212
MLKRVVHSLGLVDKNPRRKSKVRGTMTPSDFGLRSKELYVRVVHQGGQQEVYHHAFPASKLTAKYPGMCVARAQVFMAPHQAVLRPEEHLLLGHKYVVISCTDVEKLKRKHPQQCKTKEHNGVVTSEVNIISECHLSGHKPKENDKLSVPNEMINTRITLSPTPSECKIHENGEVKEPNILGKEKVNAEKDVCQGGEDVEVHLLCKGLLCRQG

SEQ ID NO: 153991 - protein, 674 aa, Glycine max
  Coding DNA Sequence Number=SeqID_37213
  Gene Ontology: Mol. function=ATPase activity, coupled to transmembrane movement of substances; Cellular component=integral to membrane; Biological process=transport
  Homolog annotation: Hit_ID=Q9CAB3; Match level="QueryCoverage=94%, HitCoverage=87%, E-value=1e-160, Identity=51%"; Hit description =Putative ABC transporter; 82503-78258
  Pfam annotation: Domain name=ABC_membrane; Domain location=41-312; Score=29.4; E_value=1.2e-05; Accession=PF00664.13; Description=ABC transporter transmembrane region
  Pfam annotation: Domain name=ABC_tran; Domain location=296-606; Score= 135.2; E_value=1.8e-37; Accession=PF00005.17; Description=ABC transporter
  Pfam annotation: Domain name=SMC_N; Domain location=285-609; Score= -122.4; E_value=0.012; Accession=PF02463.9; Description=RecFRecNSMC N terminal domain
  Pfam module annotation: Pfam domain module=ABC_membrane::ABC _tran::SMC_N; Domain location=41-312::296-606::285-609
HPLLLLPSAPPSTGISVPNNPEASGEQQVYSASGLLDRIRKWVGFLPSILPGGRWWEFSGDVDVQVVAQPVTVWRALGKMWDLVARDRWVIFAAFSALIVAAVSEISIPHFLTASIFSAQSADLAVFHRNDISFFDNETVGDLTSRLGADCQQVSRVIGNDLNLIMRNVLQGGGSLIYLLILSWPLGLSTLVVCSILAAVMLRYGRYQKKAARLIQEVTASANDVAQEMFSLIRTVRVYGTEEEEHGRYKWWLEKLADISLRQSAAYGVWNFSFNILYHSTQASVVQHVNFVVHPGEVVAIVGLSGSGKSTLVNLLLRLYEPTNGQEISDGNVFFLPFLITSTPTPTTSSTSNSKEDQYCEIGIPLSSPRQPSFQLLALSVEQNYGFICRLLMTCIVPDCGFDFGFRFYGEVVGDVDVVAMMEEEPGRRIRLFGGGGAVRLERWQPERKEEREDDIPLKDLDIMWWRERIGFVGQEPKLFRMDISSNIRYGCTQDVKQKDIEWAAKQAYAHNFISALPNGYETLVDDDLLSGGQKQRIAIARALLRDPKILILDEATSALDAESEHNVKGVLRSVRSDSATRSVIVIAHRLSTIQAADRIVVMDGGEIVEVTDSKPGNSLSSYRDKSTLPRPTWWEPRALNHPYIFIRLFDNGELLLKDGLYARLTRKQADAMA

SEQ ID NO: 153992 - protein, 93 aa, Glycine max
  Coding DNA Sequence Number=SeqID_37214
MAQTNRYFRRGRSALRSLGRMLLSSNAIYICVRVVMLVRMIRTRLFAVARVKSCPGMHSSYAIASSSGCARIVGRPSISGDGPGIDKRKLLAP

SEQ ID NO: 153993 - protein, 186 aa, Glycine max
  Coding DNA Sequence Number=SeqID_37215
  Homolog annotation: Hit_ID=Q1SYZ5; Match level="QueryCoverage=85%, HitCoverage=92%, E-value=8e-38, Identity=51%"; Hit description =Uncharacterized plant-specific domain
  Pfam annotation: Domain name=DUF623; Domain location=103-162; Score =81.4; E_value=2.8e-21; Accession=PF04844.4; Description=Protein of unknown function, DUF623
MSSNKRRFMRALYKANGGCGCSKPKSSDVHEPTPKPKISIYQNTNPSSLNSSTTSGDRNDDDEVFTSTTISEPDTNQQNPNNNNSMPKPNPKLVDSIAVEKDSNDPHKDFRASMLQMILEREIYTETDLRELLECFLKLNATCHHQLIVQAFMEICEEVFPKKSMVKGGGAPDQQCRRNQITRKSR

SEQ ID NO: 153994 - protein, 111 aa, Glycine max
  Coding DNA Sequence Number=SeqID_37216
MIVVVVGSIVTSLEVHEVRGLLLLVFVLYGSVDPYVEIKVMDYMIRIKCTDRVIRLGSPSSMDSFASCKMNGNKMEKEEREETPHQGEDESRRSSPPWEAMDKSLEEEGNE

SEQ ID NO: 153995 - protein, 68 aa, Glycine max
  Coding DNA Sequence Number=SeqID_37217
MGVMHLKGFLVGLKVELCTSKGKGSIWSRHFEQARHMSQPTLRREGDARLTGASSKEGKRAELPPTFI

SEQ ID NO: 153996 - protein, 138 aa, Glycine max
  Coding DNA Sequence Number=SeqID_37218
  Homolog annotation: Hit_ID=Q1SWX1; Match level="QueryCoverage=85%, HitCoverage=33%, E-value=4e-14, Identity=39%"; Hit description=IMP dehydrogenase/GMP reductase
MGSSQKPSLKKRFYPVKVKSLGITSLRELGQLMGQLQQQAFRKAYGKIWDLAMVKVSTEAIASLAQYYDQPLRCFIFGDFQLSPMVEEFEEILGCPLGRRKPYLFSGYSCTVDFRGSPLSECGWVGGPGSDRRFSRLS

SEQ ID NO: 153997 - protein, 77 aa, Glycine max
  Coding DNA Sequence Number=SeqID_37219
MPSIDSGDGRTVLLSVVGLRSEPGVKLPAEAGAKVDYRAQSGGVATMGHKTLSPNLKMHRTSPRASDFQISLNLSQF

SEQ ID NO: 153998 - protein, 381 aa, Glycine max
  Coding DNA Sequence Number=SeqID_37220
  Gene Ontology: Mol. function=helicase activity; Biological process =viral genome replication
  Homolog annotation: Hit_ID=Q9LTU4; Match level="QueryCoverage=99%, HitCoverage=27%, E-value=7e-91, Identity=45%"; Hit description =Helicase-like protein
MWYNERISKRKNSTSPRFSLCCGDDKVELPLLQNSPKYLHRLLFDHNSADGRNYQQNICTYNMMFAFTSTSIKLDKSINHLRGPSTIRIQGQPCHRISSLLPMSGKEPKFAQLYIFDTDNEVQNRINVISQHDGIQPQIISSLGEMLDEHNAHAKSFRMTRDRLANSDVDNVRLRLITTREKDGRTYNVPTVSEVAALIVGDFNPNSRRDIIVETQNGQLQRIHELHSNYLGLQFPLLLPYGEDGYRLDILHRATLDNKKRKRNRLTMREWFAYRLQSRPNEAQTLLHSRRLFQQFIVEAYTMVESEKLNYIRNNQKKLRVDKYCSLQNSLDDGTIQGLNKGKRVIWPSTFVGSPRYMDQLYFDGMAICNHDFPNLFITLT

SEQ ID NO: 153999 - protein, 147 aa, Glycine max
  Coding DNA Sequence Number=SeqID_37221
MVYNNGINLKILMSHQRHLTTDFKIAPCVVSLGHTVLNGMPQGSSMICTCCVQVVSSKKWRLRKPSRGYGLPLNYRVDMRASLAYDTGIWGESYRLFRCEIPSLVGVLTGFVVDLGMTFVDNWVVGKEKVCYWLSNDIVGLVGNFAV

SEQ ID NO: 154000 - protein, 102 aa, Glycine max
  Coding DNA Sequence Number=SeqID_37222
MEATKEQIATMMEAMMSMKKIMEANAVAVAATRAVAKVNPMPPSDLNPMNHPTSDIHAFPPYGLPLNYTPPNVAYTPNENVNNSTPIPIESQQPQIDHAHVS

SEQ ID NO: 154001 - protein, 105 aa, Glycine max
  Coding DNA Sequence Number=SeqID_37223
MKATYADMSIKDIIEGPKTAFKIACRPLISVDGCHLKSKFGGQLLIVVGRDPNDQYMLIAFVVVETKTKETWRWFLILLFEDIGITTSFSGISNPDRAERFDDGS

SEQ ID NO: 154002 - protein, 336 aa, Glycine max
  Coding DNA Sequence Number=SeqID_37224
LDKLFDGFGTSVGGVVSQIYVKFTVQAGLVDGQGSNLRPFSRCGVRHGKLPDGRIWCYLQALYIFDGESPGELALNEGDHQVHSMEGFPIQDISGTVLVDEDPGHHEVCYDYEDNHNVILVDKVDALEVPVRKGDRRETSLNRCVDKIDVIAYATVVGVFVCLDLLLFFCMLLGSYVAPMDVLRVLVLLGGCLTVVPPNVFMKFLRDSSSACCRLTKAAEVMRFACVMKASRCSFGSVVSSYCSRLSGFYPKGKVWADCSLSWGRLTRVSSWSWPTFRFFNSSSWCRSISTIPSANMSECERIDERQRGILYRGPMVPLTGGGTCKTNDSDTQVRI

SEQ ID NO: 154003 - protein, 138 aa, Glycine max
  Coding DNA Sequence Number=SeqID_37225
  Gene Ontology: Mol. function=RNA-directed DNA polymerase activity; Cellular component=mitochondrion; Biological process=RNA-dependent DNA replication
MKEVHEGICGLHTGGRSLATKAARAGYYRPTLRPGALNFTRRCKRCQEFANVPRTSPDNLHSLSSHSPFAMWGIEILGRLPKALGVVKYLLVIIDYFTKWIEARPMMPKTSNRHLYIKKKGGRLGTTLKNGKSSLPQA

SEQ ID NO: 154004 - protein, 192 aa, Glycine max
  Coding DNA Sequence Number=SeqID_37226
  Gene Ontology: Mol. function=RNA-directed DNA polymerase activity; Cellular component=mitochondrion; Biological process=RNA-dependent DNA replication
MKTQFMPNFLVKFVGNDTTILNQWTFYINGAPNVKGRGVEIILKGPDNITLEQALKLNFKASNNQAQYEVLIAGLNLAREVGAKRLRCYIDFQFVQGQVANTYQTNETVMLKYYHIAKSLIENFKCFKMYYILRESNTRMELLSNITSTKKVENLKTIIQDTLQTPNIDAEEIMAGEEEEPNRMTPYKNFLI

SEQ ID NO: 154005 - protein, 73 aa, Glycine max
  Coding DNA Sequence Number=SeqID_37227
  Homolog annotation: Hit_ID=Q8LM96; Match level="QueryCoverage=99%, HitCoverage=9%, E-value=2e-08, Identity=48%"; Hit description =Putative retroelement
MLVGLSISSMIVHLSGLASILRCVIMKLRNLSPPIPKAKWNDPMAKVGIFSDECHFLLVWRMHFDLVVSGVGI

SEQ ID NO: 154006 - protein, 43 aa, Glycine max
  Coding DNA Sequence Number=SeqID_37228
MVKRERERDLGVLVDGGIEIKEEIEAEEWQLQIDNSKSQTSEF

SEQ ID NO: 154007 - protein, 183 aa, Glycine max
  Coding DNA Sequence Number=SeqID_37229
  Gene Ontology: Mol. function=DNA binding; Cellular component =chromosome; Biological process=regulation of transcription, DNA -dependent
  Homolog annotation: Hit_ID=O04235; Match level="QueryCoverage=53%, HitCoverage=15%, E-value=2e-46, Identity=88%"; Hit description=FACT complex subunit SSRP1
MTDGHLFNNITLGGRGGTVLNCGYGWGFVVVLDIAGNYPSETPKTLMMRNKRSMYSPYSELHCLFHVKFLSVSLLFDKNNPGQIKIYPGGIIWKRQGGGKLIEVDKSDIMGVTWMKVPRSNQLGVQIKDGLYYKFTGFRDQDVVSLTNFFQNTCGISVEEKQLSVSGRNWGEVDLNGWGNYLN

SEQ ID NO: 154008 - protein, 287 aa, Glycine max
  Coding DNA Sequence Number=SeqID_37230
  Subcellular localization annotation: CTP_CleavageSite=31; ConfidenceScore=5.33e-01
MAEPSKKRKGVSSQSQRHSKTQETQIPSSISSSSLFSSEEQRIRYTNLFSSFSIIDPKFIDMDFFSNESCECIQAFENSNLIPFMSLKFPIYTELVKAFYYNLEIQEGTLISEVYGIKMKFDFSVHDARQLVCTNQADMTGRLLAGSLDFESCILHYLIVHILLPRSSNLAHVSEEDLIVMWAFHTGRQIDWADLVRYRMHKALRLNAPLPCPHLVTLFFQHFNIPLDSEPYVPIKRSFLIGAAVIASFGYRKEHDGSWVKNGAQPIDEEGHLQGGEDSSILQKILE

SEQ ID NO: 154009 - protein, 131 aa, Glycine max
  Coding DNA Sequence Number=SeqID_37231
  Subcellular localization annotation: CTP_CleavageSite=84; ConfidenceScore=5.19e-01
MVLLQVGSMPSIGPSGSSFRERKGHGEKPLISVCSNSVSSLELACLGKPVTSGVSISSPGRAAIAPSVHFPINRRTREVEGRFQGSEVEGIERTKKEEEERRENEVEALPNHDCDQSLHRSLFSVLRATVS

SEQ ID NO: 154010 - protein, 83 aa, Glycine max
  Coding DNA Sequence Number=SeqID_37232
MNPKRIKVLHEWPTTPSVEGRSPEYEEPWDLRSNPFQGSFSNKFLKEVSQGSFSKKLLKEVSQESFSRKLLKEVSQGSYLVYK

SEQ ID NO: 154011 - protein, 210 aa, Glycine max
  Coding DNA Sequence Number=SeqID_37233
  Homolog annotation: Hit_ID=Q47522; Match level="QueryCoverage=24%, HitCoverage=64%, E-value=8e-24, Identity=100%"; Hit description=LacZ protein
MVIREELAAGSRSKRSLSQRLYETETNMLAIVSKYQEELNLAAAHEHKVADEYAQVYAEKEARGRVIDALHQEATMWMDRFALTLNGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 154012 - protein, 54 aa, Glycine max
  Coding DNA Sequence Number=SeqID_37234
PLIELVRTHVPSWEDVHERSVKGKSPEYQEPQDLRSNPFQGGGDDAILPPKGIG

SEQ ID NO: 154013 - protein, 157 aa, Glycine max
  Coding DNA Sequence Number=SeqID_37235
  Gene Ontology: Mol. function=nucleoside-triphosphatase activity; Cellular component=integral to membrane; Biological process =translation
  Homolog annotation: Hit_ID=Q1S1V3; Match level="QueryCoverage=99%, HitCoverage=29%, E-value=1e-50, Identity=62%"; Hit description=AAA ATPase
MRILKQTCTTRNRTIILSIHQPSFKILACIDRILLLSKGTVVHHGSVATLHAFLHSSGFTVPHQLNALEYAMEILSQLNEVKPVTPPSIPESPQSSISTSSVSEGGARSSREIIRFWKIIYRTRQLLLPNTAEALLVGLVLGTIYINIGFDKEGIEK

SEQ ID NO: 154014 - protein, 182 aa, Glycine max
  Coding DNA Sequence Number=SeqID_37236
  Gene Ontology: Mol. function=nucleoside-triphosphatase activity; Cellular component=integral to membrane; Biological process =translation
  Homolog annotation: Hit_ID=Q1S1V3; Match level="QueryCoverage=69%, HitCoverage=21%, E-value=9e-49, Identity=76%"; Hit description=AAA ATPase
MREASVGKVRESEFGEEGGDGGGEVGGFGFEELCGEEEGFGDGEEGEAVVVLGDIGGELAEGGGDERGGVEEEGAVGGEGAGGEDVEEGGFSGAAGAHHGQDLGGEGGQGDVFEDVGWWGVGACGEEKVFVALVVGVVETNLRGLPWRVEVREKSYGVGIETRIGSFPCVGVYKPWCMDDTE

SEQ ID NO: 154015 - protein, 68 aa, Glycine max
  Coding DNA Sequence Number=SeqID_37237
MTKDNNWYLKALHWGNERHRARASSPLGPSRIFLQKAVASGGSNPARLGKLGGKHLPYFAINRGGSEK

SEQ ID NO: 154016 - protein, 559 aa, Glycine max
  Coding DNA Sequence Number=SeqID_37238
  Gene Ontology: Mol. function=metal ion binding; Cellular component =nucleus; Biological process=regulation of flower development
  Homolog annotation: Hit_ID=Q2QPD5; Match level="QueryCoverage=99%, HitCoverage=79%, E-value=1e-159, Identity=51%"; Hit description =Fibronectin type III domain containing protein, expressed
  Pfam annotation: Domain name=Homoserine_dh; Domain location=81-190; Score=-82.7; E_value=0.048; Accession=PF00742.9; Description =Homoserine dehydrogenase
  Pfam annotation: Domain name=fn3; Domain location=171-260; Score =27.2; E_value=6e-05; Accession=PF00041.11; Description=Fibronectin type III domain
  Pfam module annotation: Pfam domain module=Homoserine_dh::fn3; Domain location=81-190::171-260
ILPAELFSLKMTHFVEGALAVFATIFDDNKDPSLWLVCTCESSQGDSCGLSCHIECALQHEKVGVVDHGQLMQLDGGYCCASCGKVTGILGLLDGTSRFKELHEMVKEAKAKLETEVGPVNGVSAKMARGIVSRLPIASDVQKLCSLAIEKADEWLATVPNVHPESREGSLPAACKVVFEEVTASSVKIILIEMSNASSGDIKGYKLWYYKSREESHTKDPVSVFPKAQRRILIPNLQPCTEYTFRVVSFTDMGDLGHSEAKCFTKSIEILEKNSSSSVAMNKKKENLQTECNSSGSKMEPNPTMEDSGFKVRDLGKILHLSWAQEQGCSEEFCCADKRKCCGQSETIKPTNPQELLPSVSRDLDLNVVSVPDLNEELTPPFESSRDEDNGCTLQQAVEADDDAASHDLEKNLARSHGSGGSQTWNHGPTGEVPAVDSRGDACRKRVASTNEETHDCDSTLINDSPLRASDGPFSLDENFEYCVKVIRWLECQGHIKQEFRLKLLTWFSLRSTEQERRVVNTFIQALIDDPSSLAGQLVDSFSDIISNKRPRNGFSNKA

SEQ ID NO: 154017 - protein, 63 aa, Glycine max
  Coding DNA Sequence Number=SeqID_37239
TYIHKETHFRCRSLEEIKNYEKYGSLPRCHKVKIQDKEESNDKTRSETEFTDNYKLMNTTESD

SEQ ID NO: 154018 - protein, 590 aa, Glycine max
  Coding DNA Sequence Number=SeqID_37240
  Gene Ontology: Mol. function=metal ion binding
  Homolog annotation: Hit_ID=Q9ZT97; Match level="QueryCoverage=79%, HitCoverage=63%, E-value=1e-29, Identity=33%"; Hit description =Putative inhibitor of apoptosis
MREKHIRANRRPRSVKPDPDSCDKDAISKSIAESGLKPFKYHLGLNDSSQSPNSIPNAEETGWGYCTEEQLEEILLKNLEFIYNEAVSKLVALGYDEDVAVKAILRNGHCYGGMDVLTNILHNSLAFLNSNSDSGGGGGGAGYNSNGGNLDESDPVFSDLRQLEEYSLAGMLCLLQQVRPHLSKGDAMWCLLMSDLHVGRASAMEIPEPGNGSTVPAAGEVGANLVGAMAPALCRFHGGWGFGSGGGLEFPVNGIFSCGAEMNLQLQRDIEFPKRFNLSPSMKSLLKRNVAMFAAGFRANSKQLQAQVKVVPGRSTVPSLDSSAVSGTEVPAEQSGGNSQNLDSQDAVNSVQSKFGDLNLDENLELVAEDQKDEVIVTLFHQIKDLEKQVSERKDWAHQKAMQAARKLSSDLTELKMLRMEREETQKLKKGKPVLEDTTMKRLSEMENALRKASGQLDLGNAAVRRLETENAEMKAEMEASKLSASESVTACLEVAKREKKCLKKLLAWEKQKAKLQQEIADEKEKILKTKEILVQIRQCQKEAESKVIDWTCISHVRIKVTYFNHKGHADAQTGISPHPRGGGITSWPY

SEQ ID NO: 154019 - protein, 60 aa, Glycine max
  Coding DNA Sequence Number=SeqID_37241
MNKGVGIGNIGCGKSGSRSKLDGRELREVDEDRGLFGSPLLVLRVLSAEKSEPRLVPACG

SEQ ID NO: 154020 - protein, 69 aa, Glycine max
  Coding DNA Sequence Number=SeqID_37242
GSLVGKIHSYCEFLNQARVVRKPTSHVMTHVKKTNHPKQSKRRKLTDEWSKRLKIALFLPTNAINYTMK

SEQ ID NO: 154021 - protein, 657 aa, Glycine max
  Coding DNA Sequence Number=SeqID_37243
  Gene Ontology: Biological process=regulation of GTPase activity
  Homolog annotation: Hit_ID=Q1SD19; Match level="QueryCoverage=92%, HitCoverage=92%, E-value=1e-178, Identity=56%"; Hit description=Arf GTPase activating protein
MAKFTSQEVSALQEGGNQRAKEIYFKEWDAQRHSFPDSRMHHSFILISMVGASNVDRLRDFIKHVYVDRRFTGDKTNDKPPRAKPGDKDDFYQGGSRSPPYEDTYERRYNDRSSPGGRSPGYDQESRQYGDYKKSPGRPPLINDWRREDRRTSDGDYKLESQSPERAKDVDSSSPPVVRPVRDILGENVVPLRISEPPKPNSGRPADSSAPTQRTISSSSLASGNENPVDVKLETTKSLIDFYADPEPPVAPSNLQAQQTTVPQPVVQPANSSNDNWASFDVAPATSATPSSSNLNPLESMLSQLSVPASLPAQVSGVQGPIPSSSLTSTSGVASVSGFSAFPPSNASVPSPGLTSVSPLNNAGQWANLQQQKQPLFPAAVGQSIAQQFTPLLGGAANNQPWNVPSAPTVQGHPSTPMPHTYPYASKPANEAISSVVSQPPASEVKASGRKELPEDLFTVKYSSFPAPVVGWQMGVPHGMGISMQYNNVVPVPSFPQPSKSINPFDVSSEPTANQAPTFPSMSSLQGALPGVPPPGAVHPSSMGNPTHGWTPLSSSFLPAQTQMRATALGPRPYMGQQMPTNMPMPRQEVGNFGNQGAVFGLSNPDQQLTGMKDNLPSWKRLICYYERLICCCRRGCCAVENPSPLEEGKGVEIKNG

SEQ ID NO: 154022 - protein, 54 aa, Glycine max
  Coding DNA Sequence Number=SeqID_37244
  Homolog annotation: Hit_ID=Q6H8D8; Match level="QueryCoverage=81%, HitCoverage=6%, E-value=2e-08, Identity=57%"; Hit description=ZIGA2 protein-like
MASRMKEDEKNERVIRGLLKLQHNRRCINCNSLVTGLWFCLLMACQCEPLSLSS

SEQ ID NO: 154023 - protein, 58 aa, Glycine max
  Coding DNA Sequence Number=SeqID_37245
MTVTVVLTTGWIHNITGCILRMNSDCYHGRLWHHGMGEAAVIALLGQFWVRITEVHMM

SEQ ID NO: 154024 - protein, 169 aa, Glycine max
  Coding DNA Sequence Number=SeqID_37246
  Gene Ontology: Mol. function=metal ion binding; Biological process =metal ion transport
  Homolog annotation: Hit_ID=Q1SD07; Match level="QueryCoverage=75%, HitCoverage=98%, E-value=6e-54, Identity=79%"; Hit description=Heavy metal transport/detoxification protein
  Pfam annotation: Domain name=HMA; Domain location=68-127; Score=52.4; E_value=1.6e-12; Accession=PF00403.16; Description=Heavy-metal -associated domain
MGKLGRVLDTFCLSFGSNTCFCMNSMEFEDEFEKKPLIVSDSDHKLRLKDVVDGKQTLAFQLKPQIVTLRVSMHCHGCAKKVEKHISKLEGVSSYKVDLETKIVVVMGDILPSEVLQSVSKVKNAELWNFQAMTGTLRPLEILTYGNKVDSSSSGQSLTSNSSGVATGQ

SEQ ID NO: 154025 - protein, 153 aa, Glycine max
  Coding DNA Sequence Number=SeqID_37247
  Gene Ontology: Cellular component=membrane; Biological process =transport
  Homolog annotation: Hit_ID=Q1SD20; Match level="QueryCoverage=89%, HitCoverage=33%, E-value=8e-59, Identity=76%"; Hit description=TMS membrane protein/tumour differentially expressed protein
MTSVSLHPKVNAGILSPGLMGLYVVFLCWCAIRSEPAGAECIRKSESANKTDWQSIISFVVAILALVVATFSTGIDSECFQVLQCISNKSLQFRKSDSPAEDDVPYGYGFFHFVFATGAMYFAMLLIGWNSHHSMRKYDPILQLAHNMLCASY

SEQ ID NO: 154026 - protein, 150 aa, Glycine max
  Coding DNA Sequence Number=SeqID_37248
  Gene Ontology: Cellular component=membrane; Biological process =transport
  Homolog annotation: Hit_ID=Q1SD20; Match level="QueryCoverage=98%, HitCoverage=35%, E-value=7e-43, Identity=59%"; Hit description=TMS membrane protein/tumour differentially expressed protein
METGESNSTSSNQSCAVMKDSKWYTQFRNVSNPWMARYVYGLIFLVANLLAWAARDELSSLSALTEMKGLKGCKVGKDCLGADGVLRFSTLILDQLFYMIMFWSTAGTSKLKEGRDEWQSGWWLVKIVVLVLVTIFPFILPSELIDLYGG

SEQ ID NO: 154027 - protein, 140 aa, Glycine max
  Coding DNA Sequence Number=SeqID_37249
GTSFVVQVEGTSTWVVVTENKRGYISCGSVLVEGTSTRLFKENKGGYISCGSLLVKDFTRLKRNLKDRRSLGDWMLQFVYIASCETETKDEEKGNDLGPVRLRKDEGFQMTVAMPTVREFQHHKRLQMRVRKHSSESESN

SEQ ID NO: 154028 - protein, 78 aa, Glycine max
  Coding DNA Sequence Number=SeqID_37250
  Subcellular localization annotation: CTP_CleavageSite=45; ConfidenceScore=5.12e-01
MSFSLGSNNTISKWGRGGGSTTCYTPSVSQVALETSLEKCGGRVRMEGYEGLGVVDQGLNMQQQVVGEVVEKPQVINP

SEQ ID NO: 154029 - protein, 218 aa, Glycine max
  Coding DNA Sequence Number=SeqID_37251
MGSSRRQGGRDDKVCEKYGISKEKWNQFCQSHRDPSCEDSLEEQGSQGNFVAHGRQDVLTTALGVTIKQYFEPSSSSSCTSMSMAPEDLEQLTKNQGPAGGGLELPPKPEVGPSIACVSTKKSYVDPSGQNSDTSDLKKYRLYVDENPPCLVALIRVYEGSNIVHNIPLGNDQVKVGVEEEYWKRVAEATSAQRAQHVNIRSPQGANLEARFSPHLAT

SEQ ID NO: 154030 - protein, 237 aa, Glycine max
  Coding DNA Sequence Number=SeqID_37252
  Gene Ontology: Mol. function=protein binding; Biological process =regulation of transcription
  Homolog annotation: Hit_ID=Q1T621; Match level="QueryCoverage=92%, HitCoverage=39%, E-value=2e-73, Identity=58%"; Hit description=GRAS transcription factor
  Pfam annotation: Domain name=GRAS; Domain location=1-150; Score= -133.6; E_value=0.038; Accession=PF03514.5; Description=GRAS family transcription factor
MEMFDQIHIIDFDIGLGVQWYSLMQVLALRSNGVPSLKVTAIVSPLTCDEFEINIAQEELNQSTKDINMSFELNVLRIESLNTHLCPLSVQFYDNEAIVLRPKVVVTLDQNFDQIDVPFSSNVVHAHHCYSTLLESLDVANLNLDVLQNIENHFILPTIKKIILSPLGLQEKLPTWRNMFLQYGFSPFPFSNFTEAQAEGLVEKEPVKGFQLERKLSPLLYASRGKNSTQFQLRDAE

SEQ ID NO: 154031 - protein, 136 aa, Glycine max
  Coding DNA Sequence Number=SeqID_37253
MHRCPSSYSYKRFLLILTREVRWQAEIPKRLSVQTISVNPDLGSQVAGGETTSLMTCRGYLMVIRTFHQPEVLLSSSRDIQVQQHARFFSVRKGVPIATRPTWAFLRVPKEGGAFWWKQPSSPRRAGWQPPPSFLL

SEQ ID NO: 154032 - protein, 34 aa, Glycine max
  Coding DNA Sequence Number=SeqID_37254
RVSSSTVSDPSFLGDPTVPSSEGKDGNSHPGGSG

SEQ ID NO: 154033 - protein, 159 aa, Glycine max
  Coding DNA Sequence Number=SeqID_37255
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=1e-13, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRWLHALAFRGLDVLTFRGLHALTFRGQHVLAFRGLHILTIRGLHGLPFRGLYVLAFIGLHALIFRGLHVLTLEEDYTSSPSEDYTSSPSHALAFRRLHVLLLRGLHAFPFRGLHVLAFRGLHALAFRGLRVFSFGGLHALAFIGLHIYAFRELKVLCP

SEQ ID NO: 154034 - protein, 140 aa, Glycine max
  Coding DNA Sequence Number=SeqID_37256
  Subcellular localization annotation: CTP_CleavageSite=68; ConfidenceScore=5.25e-01
MDFIKIVKISSGLLEYWILSLLRLLRPQGLTTTRPRLQRPTRPRLQRTRRPRLLRAALPHLKRTTRPRLQKATRPLLKRATRPLLPRTTRPRLYWTTVLALRELHAIAFKRLHILIFRGLDVLGLEDYTSSPSEGYTPSN

SEQ ID NO: 154035 - protein, 41 aa, Glycine max
  Coding DNA Sequence Number=SeqID_37257
  Gene Ontology: Mol. function=aspartate-tRNA ligase activity; Cellular component=cytoplasm; Biological process=tRNA aminoacylation for protein translation
  Homolog annotation: Hit_ID=O81892; Match level="QueryCoverage=97%, HitCoverage=6%, E-value=9e-15, Identity=90%"; Hit description =Putative aspartate--tRNA ligase
MLKVAGFDKYYQIARCFRDEDLRVDRQPEFTQLDMEMAFTP

SEQ ID NO: 154036 - protein, 52 aa, Glycine max
  Coding DNA Sequence Number=SeqID_37258
MSSENDLFVIGSSFTCLRIWSWLRGVVCVVVETMLFGLTVVLAGGRAYLGEA

SEQ ID NO: 154037 - protein, 538 aa, Glycine max
  Coding DNA Sequence Number=SeqID_37259
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=99%, HitCoverage=70%, E-value=1e-125, Identity=38%"; Hit description =Tyrosine protein kinase, active site
  Pfam annotation: Domain name=LRR_1; Domain location=115-137; Score =15.7; E_value=0.16; Accession=PF00560.23; Description=Leucine Rich Repeat
  Pfam annotation: Domain name=LRR_1; Domain location=139-161; Score =5.4; E_value=28; Accession=PF00560.23; Description=Leucine Rich Repeat
  Pfam annotation: Domain name=LRR_1; Domain location=163-182; Score =7.3; E_value=13; Accession=PF00560.23; Description=Leucine Rich Repeat
  Pfam annotation: Domain name=LRR_1; Domain location=187-209; Score =5.3; E_value=29; Accession=PF00560.23; Description=Leucine Rich Repeat
  Pfam annotation: Domain name=LRR_1; Domain location=19-41; Score =14.0; E_value=0.56; Accession=PF00560.23; Description=Leucine Rich Repeat
  Pfam annotation: Domain name=LRR_1; Domain location=211-233; Score =10.6; E_value=3; Accession=PF00560.23; Description=Leucine Rich Repeat
  Pfam annotation: Domain name=LRR_1; Domain location=265-287; Score =15.2; E_value=0.25; Accession=PF00560.23; Description=Leucine Rich Repeat
  Pfam annotation: Domain name=LRR_1; Domain location=289-311; Score =12.1; E_value=1.6; Accession=PF00560.23; Description=Leucine Rich Repeat
  Pfam annotation: Domain name=LRR_1; Domain location=313-335; Score =8.8; E_value=6.4; Accession=PF00560.23; Description=Leucine Rich Repeat
  Pfam annotation: Domain name=LRR_1; Domain location=337-358; Score =18.1; E_value=0.033; Accession=PF00560.23; Description=Leucine Rich Repeat
  Pfam annotation: Domain name=LRR_1; Domain location=360-381; Score =13.4; E_value=0.86; Accession=PF00560.23; Description=Leucine Rich Repeat
  Pfam annotation: Domain name=LRR_1; Domain location=43-65; Score =14.3; E_value=0.45; Accession=PF00560.23; Description=Leucine Rich Repeat
  Pfam annotation: Domain name=LRR_1; Domain location=67-89; Score =16.2; E_value=0.12; Accession=PF00560.23; Description=Leucine Rich Repeat
  Pfam annotation: Domain name=LRR_1; Domain location=91-113; Score =11.2; E_value=2.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=115-137::139-161::163-182::187-209::19 -41::211-233::265-287::...
  Pfam module annotation: Domain location=289-311::313-335::337 -358::360-381::43-65::67-89::91-113
  Subcellular localization annotation: CTP_CleavageSite=74; ConfidenceScore=5.09e-01
MSHNSLNGTIPPQIGSLSNLNTLDLSINNLFGSIPNTIGNLSKLLFLNLSDNDLSGTIPFTIGNLSKLSVLSISFNELTGPIPASIGNLVNLDDIRLHENKLSGSIPFTIGNLSKLSVLSISFNELTGSIPSTIGNLSKVRTLRFIGNELGGKIPIELSMLTALESLQLAGNNFIGHLPQNICIGGTLKNFAAENNNFIGPIPVSLKNCSSLIRVRLQRNQLTGDITDAFGVLPNLDYIELNMSLSQNSINAETSNFEEIASMQKLQILKLGSNKLSGLIPKQLGNLLNLLNMSLSQNNFQGNIPSELGKLKFLTSLDLGENSLRGAIPSMFGELKSLETLNLSHNNLSGNLSSFDDMTSLTSIDISYNQFEGPLPNILAFHNAKIEALRNNKGLCGNVTGLEPCSTSSGKSHNHMRKKIIIVILPLTLGILILALFAFGVSYHLCQTSTKKEDQATNIQTPNIFAIWNFDGKMVFENIIEATEYLDNKHLIGVGGQGCVYKAVLPAGQVVAVKKLHSVPNGAMLNLKAFTCEIQALT

SEQ ID NO: 154038 - protein, 68 aa, Glycine max
  Coding DNA Sequence Number=SeqID_37260
  Gene Ontology: Mol. function=aminoacyl-tRNA ligase activity
  Homolog annotation: Hit_ID=Q45NM7; Match level="QueryCoverage=74%, HitCoverage=30%, E-value=3e-11, Identity=69%"; Hit description =Histidyl-tRNA synthetase
SGPIRHIIRLTSLGFSEAEEEKGLIAEIADKIETYIKEKGPPLALLSKFREGSAFLKDDGSVDALNDL

SEQ ID NO: 154039 - protein, 41 aa, Glycine max
  Coding DNA Sequence Number=SeqID_37261
MCSSPSSADPLDWEMWSLLFFPIDSFAKHKNEGVETRVVMD

SEQ ID NO: 154040 - protein, 71 aa, Glycine max
  Coding DNA Sequence Number=SeqID_37262
MGGQLRAQLVVSTNSTWFPKCMHHSVQSLLDPWMDDEKLLNMDDGDEAGRYKSNQQQGQWRTHPGNQFNKD

SEQ ID NO: 154041 - protein, 109 aa, Glycine max
  Coding DNA Sequence Number=SeqID_37263
MSPCSICFYHMGLSLVVSLFLLFVNHFVLLKFNDVFYILSQHLPCLLHLHLRDNSRTHLSLEQDSIKWHCMPCSTWEESAAECYHTLIKVKLLLFLAIDLFVRFNYSIM

SEQ ID NO: 154042 - protein, 101 aa, Glycine max
  Coding DNA Sequence Number=SeqID_37264
  Subcellular localization annotation: CTP_CleavageSite=47; ConfidenceScore=5.49e-01
MATLLLPLNSYSPTPIRNPNLSSLKIKVNQRHSPFQTRRLHRTPFVRALEEDSNPETVQDGEVNSLGVKVALSMLRFYQTTNLTVRTNHVAAAMRIVTVAA

SEQ ID NO: 154043 - protein, 121 aa, Glycine max
  Coding DNA Sequence Number=SeqID_37265
  Homolog annotation: Hit_ID=Q011Y6; Match level="QueryCoverage=46%, HitCoverage=43%, E-value=2e-20, Identity=71%"; Hit description =Homology to unknown gene
  Pfam annotation: Domain name=DUF37; Domain location=7-61; Score=70.4; E_value=5.7e-18; Accession=PF01809.9; Description=Domain of unknown function DUF37
MLFMCAGEISPILPKSCRYIPTCSEYSMEAYKRYGAVKGTVLTAWRICRCNPLGGHGYDPPRWFGETFFRNKFRKKVLLEEEGGLPKELPEEVSEECLLELLPKDGSSGRPISSFGGTFFR

SEQ ID NO: 154044 - protein, 68 aa, Glycine max
  Coding DNA Sequence Number=SeqID_37266
MALLHLESMFIFLKKLCSRLWSLLLKFFMTEPMLKRKHRSGKSLVITTSRSILKENLLVTPKMSFCAT

SEQ ID NO: 154045 - protein, 243 aa, Glycine max
  Coding DNA Sequence Number=SeqID_37267
  Gene Ontology: Mol. function=DNA binding; Cellular component=beta -galactosidase complex; Biological process=DNA integration
  Homolog annotation: Hit_ID=Q1SAZ0; Match level="QueryCoverage=99%, HitCoverage=23%, E-value=1e-64, Identity=59%"; Hit description =Integrase, catalytic region
MKVPKWKKVVLEEMKALKKNRTWSVMPLPTGKNIVGCKWVFTVKYNSDGHTQTYGIDYSETFAPIAKLNTVRILLSLAANLDWPLHQLDVKNALSMATWRKRYTRIVLMASNTDLGQRLKKNLVAEFEIKDMGSLRYFLGMEVPHSKRGIVVFQQKYILDLLEETGMSGCRPADTPMDPNGKLWGKGSVSVDVGRYQRLGRVCYRQKIYFKILHLCVGKSRDLEKQIKKELLPEAVQKLNLEQ

SEQ ID NO: 154046 - protein, 67 aa, Glycine max
  Coding DNA Sequence Number=SeqID_37268
MVESLRRQTPSCILSPIEETVHSLSAYHVLSASSFFAKRGDWLTKLAMGELSPIQFDLNWAKREYIR

SEQ ID NO: 154047 - protein, 157 aa, Glycine max
  Coding DNA Sequence Number=SeqID_37269
MVKKQQPCRRKQERAKPSRGRGSKNHAQKEEELRSRKEGRRLIGAEEICTAGCTNFKKIARGIKLKHLSFFYTHQFAFHFQFGRSHYPSKKLKIQRTSDSRLGKTIDGFSFLIKIEGYLIRHAYRSRLVCPLKINLYKYKEITTIKISQYSNKMTVK

SEQ ID NO: 154048 - protein, 124 aa, Glycine max
  Coding DNA Sequence Number=SeqID_37270
MVRTRGLGHALGYVTGRGVGRGDRDDYDDAPQRQRPTTSARRQRVPVTAAHDEPVLPAPDVEADVFSDDPMAPADVEDTRADIPADTSTQAAEDEHEGFPGGPSDPSVLTQYTDIVACNVWTGE

SEQ ID NO: 154049 - protein, 167 aa, Glycine max
  Coding DNA Sequence Number=SeqID_37271
MAVVWSIWKMRNRIIFSNESFNGSKLFDDAGQDEIGASPIEIARAYMDSRALEAGPCSKNMIHTVESTMLHGDEAAIKPYDPSPSKKSSTCWPGAVVQDAYITPQSQRNRYGLHNFPRTPYSRTLLTKSKSKLIHMKGDSSQISSTPVRQSHTTMYPEVSFGNVILS

SEQ ID NO: 154050 - protein, 239 aa, Glycine max
  Coding DNA Sequence Number=SeqID_37272
  Homolog annotation: Hit_ID=Q1S7C5; Match level="QueryCoverage=48%, HitCoverage=14%, E-value=2e-13, Identity=43%"; Hit description =Integrase, catalytic region
  Pfam annotation: Domain name=GRP; Domain location=104-185; Score= -25.8; E_value=0.033; Accession=PF07172.2; Description=Glycine rich protein family
  Subcellular localization annotation: CTP_CleavageSite=50; ConfidenceScore=5.19e-01
MASASQGFGSHLFPTTIAKKLDDLTTYTGENMSNQSSNRISCRGPNTPCLASIDALEICSPMRFRLESLLSGKSMDEYLHKIKGYVNELAGVGVPIFHEEHVDAILEGLPSDYALVVSVIESKKRTPSIAEIEALFYGYSHGSSYKFSDSGGTRGGYGRGIGGRSTPSDRSGGRGGPGRGRSGGRSSNTWVNPNPKSVAQPTSQPSGMQTNSASQSNGQTSSTWIPDSRASFHVTGGES

SEQ ID NO: 154051 - protein, 110 aa, Glycine max
  Coding DNA Sequence Number=SeqID_37273
MRQFGYTQAIPTPPVDSWVSYDDIHDRWMHYSDHMIQAGEGCIVPGQCASDYIDWFFRISHPFMTPGQASNPLPDGHAPQPRVVPQAPETPSRAGARSTIDICKARYGVA

SEQ ID NO: 154052 - protein, 127 aa, Glycine max
  Coding DNA Sequence Number=SeqID_37274
  Subcellular localization annotation: CTP_CleavageSite=59; ConfidenceScore=5.12e-01
GNPCGVYPDLSSFIGSGVYPDLSSLTGSGVYPDLSSFTGSGVYPDLSSFTGSGVYPDLSSFTGSGVIQTFVACIKRSAPQLIVLNSYNINLHYFNNNMHMTKTSMRVGNADVYGFLKPQSIQRFGQS

SEQ ID NO: 154053 - protein, 216 aa, Glycine max
  Coding DNA Sequence Number=SeqID_37275
  Gene Ontology: Mol. function=RNA-directed DNA polymerase activity; Cellular component=exocyst; Biological process=RNA-dependent DNA replication
  Homolog annotation: Hit_ID=Q1RV13; Match level="QueryCoverage=71%, HitCoverage=36%, E-value=5e-32, Identity=42%"; Hit description=IMP dehydrogenase/GMP reductase
MLIRGFREEEIKEAIWECGNSKSLRLDGFNFKFIKECWDILKDDVINFLQDFHFSGTFSRAEGLSGLMREAQVKNLFSGFKVGSKGVEVNLLQYTDETIFVGDLTMENVVVVKSMLRCFELVSKLKVNVHMSRFGGISGGRETIKRFPRYLNCRILTFPFVYLGIPIGVNLGRIETWEPIIVKFKKKLASWKHKHLSFAERITLINSVLTSLPLFF

SEQ ID NO: 154054 - protein, 128 aa, Glycine max
  Coding DNA Sequence Number=SeqID_37276
MYPAEEASAGSSATTKCSLRKKVLQDLPRDPRKTTFFRWISQKILQNLLRLDHAEDPAKASSTGIRRRTFHTSSAGVPKSPFPTRGRRFFSRKNLRLQPPAPQVTNVVYPKFPTAIYAIQTVTRRLED

SEQ ID NO: 154055 - protein, 266 aa, Glycine max
  Coding DNA Sequence Number=SeqID_37277
MEESSGFPVLFGGENSNPPDDGGKDKILGLQLSARLQNNGLKDKIFLGLELIARLQHRTRGLRHLTRIHGVDLTNETQDTCPKRSIKKEIYEDVLGISYSTVSQSEKVVAHDLKEPHSGAIKTMSASRKLNTGEKTVLSWMIETGTILQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 154056 - protein, 181 aa, Glycine max
  Coding DNA Sequence Number=SeqID_37278
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q9LIP9; Match level="QueryCoverage=95%, HitCoverage=24%, E-value=2e-62, Identity=69%"; Hit description =Glutamine-fructose-6-phosphate transaminase 2
  Pfam annotation: Domain name=GATase_2; Domain location=2-179; Score =19.7; E_value=1.7e-12; Accession=PF00310.11; Description=Glutamine amidotransferases class-II
MCGIFAYLNYNLNRERQYILQVLFNGLRRLEYRGYDSAGIAIDDSSSSQFSLSPPPLVFRQEGNIESLVKSVYQEVGETELNLGECFGTHAGIAHTRWATHGEPAPRNSHPQSSGHGNEFLVVHNGVITNYEVLKETLLRHGFTFESETDTEVIPKLAKFVHDKANEASADVIPVVVTMLS

SEQ ID NO: 154057 - protein, 384 aa, Glycine max
  Coding DNA Sequence Number=SeqID_37279
  Gene Ontology: Mol. function=glutamine-fructose-6-phosphate transaminase (isomerizing) activity; Cellular component=cytoplasm; Biological process=carbohydrate biosynthetic process
  Homolog annotation: Hit_ID=Q9LIP9; Match level="QueryCoverage=89%, HitCoverage=50%, E-value=1e-156, Identity=82%"; Hit description =Glutamine-fructose-6-phosphate transaminase 2
  Pfam annotation: Domain name=SIS; Domain location=216-348; Score =138.4; E_value=1.9e-38; Accession=PF01380.12; Description=SIS domain
MGVNNIMVLGDVSLKYISNYLAGGQVVTFSQVVLEVMRHLEGAYALIFKSPHYPNELIACKRGSPLLLGVKELAENKEHGSAFEDNKFLSKDGKPRELFLSSDANAVVEHTKKVLVIEDGEVVHLKDGGVSILKFENDMGEHGASLSRAFSVRRALSVLEMEVEQINKGNYEHYMQKEIHEQPESLTTTMRGRLIHRGSNKSKSVLLGGLKDHLKTIRRSRRILFIGCGTSYNAALAARPILEELSGVPVTMEIASDLLDREGPIYREDTAVFVSQSGETADTLLALQYALDNGALCVGITNTVGSAIARNTHCGVHINAGAEIGVASTKAYTSQIVVMVMLALAIGGDTISNQARREAIIDGLFDLPSEFLLAENFVHFAVDG

SEQ ID NO: 154058 - protein, 118 aa, Glycine max
  Coding DNA Sequence Number=SeqID_37280
  Homolog annotation: Hit_ID=Q1SAV3; Match level="QueryCoverage=56%, HitCoverage=10%, E-value=6e-10, Identity=47%"; Hit description =Cyclin-like F-box; F-box protein interaction domain; Galactose oxidase, central
  Pfam annotation: Domain name=F-box; Domain location=7-54; Score=30.0; E_value=8.3e-06; Accession=PF00646.23; Description=F-box domain
MRSEKKPWSPVLCDELIEEILSRILVKPLIQFKCVCKGWNSLMSDPYFIKLHLSKYAAKYDLEHLQLMKNVCLGSIPEIHMESCDRNTRRIPCLFLEQGEKGDIQRIANAVFFPGHWS

SEQ ID NO: 154059 - protein, 121 aa, Glycine max
  Coding DNA Sequence Number=SeqID_37281
MVKDLVREDGNWNYEFIQQLLPHGIVLRIVDVLPPYEDGGMDKRMWPGSKLREFTTSNAYYKINFFADLQDEGIWKKIWRIKALDKATVIRLGHQKIFQLHWNNGHSIENKYSGCKLQALK

SEQ ID NO: 154060 - protein, 75 aa, Glycine max; identical to SEQ ID NO: 142399
  Coding DNA Sequence Number=SeqID_37282

SEQ ID NO: 154061 - protein, 72 aa, Glycine max
  Coding DNA Sequence Number=SeqID_37283
MVNPPQAGIFIESEDNLETSGTNEVIEPEGIPFRSTPAGPRVQKVQYPSLNSARRKDSGSKLEKREIMQRVS

SEQ ID NO: 154062 - protein, 181 aa, Glycine max
  Coding DNA Sequence Number=SeqID_37284
  Gene Ontology: Mol. function=RNA-directed DNA polymerase activity; Cellular component=chromatin; Biological process=chromatin assembly or disassembly
  Pfam annotation: Domain name=rve; Domain location=1-116; Score=32.8; E_value=1.2e-06; Accession=PF00665.16; Description=Integrase core domain
MDFIEGLLLSNGKQAIFVVLDRLSKAAHFIPLSHPYTTSTIAQAFMDHGVQLQLSSAYHPQTDGQTEVVNRFLETYLRCMFVDSPQQWSKWLPLAEWWYNTTFHSAIQTTPYEVVYGQPPPIHLHYLPGESKAYRQVSIAPRANEKLAPKYFGPYPVISRIGEVAYELKLPDHAKIHNVFH

SEQ ID NO: 154063 - protein, 105 aa, Glycine max
  Coding DNA Sequence Number=SeqID_37285
MLAIITKYQEELSLATAHEHRVADEYAQVYAEKEARGRVIDSLHQEATMWMDRFALTLNGSQELPRFLAKAKAVANTYSVPEEIHELLSYCQHMIDLMAHMIRNR

SEQ ID NO: 154064 - protein, 245 aa, Glycine max
  Coding DNA Sequence Number=SeqID_37286
HDMQSSILLALTGSFMIMKGSFIDCFNGSCCDTDILHAEILARHGIHICNWSNITVVECFSILFNPSVYLPHTHFLCISFSSENIICAPRLLAPKQQCRPSICIGEIGNQVDTAHGHDSHMCRLSMLKHNFTLDETELELHKARPRGQIREGADERENGVAAENDSQSPVAASFPCVPSDFNFSFSLLLAFDEGFIVNGLVWVLCGPGYRGGDGGLRAILTDQNKLVVAVCGVTALAAGRGLHCK

SEQ ID NO: 154065 - protein, 275 aa, Glycine max
  Coding DNA Sequence Number=SeqID_37287
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q42783; Match level="QueryCoverage=84%, HitCoverage=88%, E-value=8e-59, Identity=59%"; Hit description =Biotin carboxyl carrier protein of acetyl-CoA carboxylase, chloroplast precursor
  Pfam annotation: Domain name=Biotin_lipoyl; Domain location=186-255; Score=49.3; E_value=1.3e-11; Accession=PF00364.12; Description =Biotin-requiring enzyme
  Subcellular localization annotation: CTP_CleavageSite=66; ConfidenceScore=5.69e-01
MASSLAPATKAATNLRLTHSLRFSPKPNNLRFATKPGNTLLCTRVKAQLNEVALDSSSNATSPPMKAKSKEEPPAKPLAEPSSSVLATQESVSQFITQVASLVKLVDSRDIVELKLKQHDVEVTIRKKEAMPQPPPAPQPSVVYSPPPPALPPPPVPASTPAPTLARATPTPTSAPAVKSAKSSLPPLKSPMAGTFYRSPAPGEPSFVKVGDKVKKGQVVCIIEAMKLMNEIEGILHVIPLCGHLFDASTASFHFCLHYQNVEFCDLESRTCTTE

SEQ ID NO: 154066 - protein, 124 aa, Glycine max
  Coding DNA Sequence Number=SeqID_37288
MGQVAQLLDSILQLSWQVVRTYIGEQVRKVMEDLITAAFAHWDACYLGETTMFYNESKMIRDKNWNHRPIIQASKNRSEATKAKTPGIPLLEWPQAEVLPPSAIGKIVTPWHPMKKEKSISVLL

SEQ ID NO: 154067 - protein, 433 aa, Glycine max
  Coding DNA Sequence Number=SeqID_37289
  Gene Ontology: Mol. function=identical protein binding; Cellular component=nucleus; Biological process=negative regulation of striated muscle development
  Homolog annotation: Hit_ID=Q10AS2; Match level="QueryCoverage=78%, HitCoverage=78%, E-value=1e-129, Identity=71%"; Hit description=RNA -binding protein Luc7-like 2, putative, expressed
  Pfam annotation: Domain name=LUC7; Domain location=1-363; Score =424.3; E_value=1.6e-124; Accession=PF03194.6; Description=LUC7 N _terminus
MDAIRKQLDVLMGANRNGDVREVNRKYYDRDVCRLYLVGLCPHELFQLTKMDMGPCPKVHSLQLRKEYPSRSLGLGYEEAKAKGTDNYDRELEDVIDKLIGECDRKIGRALKRLEDDDAKAAIAISVSEVTQTDEVLELSKQIKEKLKEADQYDLEGKSDLKIRALEVVEELRTKRADKQSMLLLDAFNKDRASLPTPLPNPPPLAPLPVVAPDARTQEMINEKLKKAEDLGEQGMVDEAQKALEEAEALKKLPARQEPVLDSSKYTAADVRITDQKLRVCDICGAFLSVYDSDRRLADHFGGKLHLGYMQIREKLAELQRKDLRPCFLAQEERNKSRKTDRLDDRRSKERSRDRDRESSRDHERGDSRERGRDHDRRSRDRDRHYDRDRGYDRDRDRDSDRTRSYDSRSRRRSRSRSQERSRDYDRHRYRLP

SEQ ID NO: 154068 - protein, 83 aa, Glycine max
  Coding DNA Sequence Number=SeqID_37290
  Homolog annotation: Hit_ID=Q9M9M5; Match level="QueryCoverage=69%, HitCoverage=9%, E-value=1e-18, Identity=79%"; Hit description =Putative 26S proteosome regulatory subunit
MTNVGWGCMEVVTVTKGAMVCLKWRFAEAENEYHRARNQELVNLQEESSIRQEQTRRATEEKIQAQRRKTEREKAEIEHETIR

SEQ ID NO: 154069 - protein, 322 aa, Glycine max
  Coding DNA Sequence Number=SeqID_37291
  Gene Ontology: Mol. function=hydrogen ion transporting ATP synthase activity, rotational mechanism; Cellular component=chloroplast thylakoid membrane; Biological process=ATP synthesis coupled proton transport
  Homolog annotation: Hit_ID=O80796; Match level="QueryCoverage=93%, HitCoverage=94%, E-value=1e-105, Identity=64%"; Hit description =Probable membrane-associated 30 kDa protein, chloroplast precursor
  Pfam annotation: Domain name=PspA_IM30; Domain location=66-282; Score= 209.6; E_value=7e-60; Accession=PF04012.3; Description=PspAIM30 family
  Subcellular localization annotation: CTP_CleavageSite=41; ConfidenceScore=5.61e-01
MAIAMKATPITASGFVSTRNSTLPPFKSSFLRYRSGALEVPGMRVTYSDRLKCNCHGGGALGTQMNLFSRFARVIKSYANAIISSFEDPEKILEQAVLDMNNDLIKVRQATAQVLASQKQLESKYKSIEKASDDWYRRAQLALQKGDEELAREALKRRKSYADNATALKMQLDQQKNVADDLVSKTQLLESKIQEAKSKKDTLKARAQSAKTSTIVSEMVGNINTSSALAAFDKMEEKVLTMEAQADALNQLSTDNLEGKFALLENSSVDDDLAELKKELSGSSKRGELPPGRSVPTSKEIPFLDLELEKELNELRRRAKGY

SEQ ID NO: 154070 - protein, 116 aa, Glycine max
  Coding DNA Sequence Number=SeqID_37292
  Homolog annotation: Hit_ID=Q53LT9; Match level="QueryCoverage=77%, HitCoverage=30%, E-value=1e-22, Identity=54%"; Hit description =Expressed protein
MICFFSLSLSLSPSFAELTILPFRIQRCLPGDGLEEHFVIQMEGVNILAVSYGAPGACPYPRQLKLPGKWSFKSHTVLKSSEQAPRAPIFTEEALGGLEGDGEAVQPIERSFWAKY

SEQ ID NO: 154071 - protein, 47 aa, Glycine max
  Coding DNA Sequence Number=SeqID_37293
MNAVTQAMNMPEEQAGGQPGAPAQQQPGSAVQRGPSSGALCPNEKKF

SEQ ID NO: 154072 - protein, 312 aa, Glycine max
  Coding DNA Sequence Number=SeqID_37294
  Gene Ontology: Mol. function=unfolded protein binding; Cellular component=endoplasmic reticulum; Biological process=protein folding
  Homolog annotation: Hit_ID=Q1S678; Match level="QueryCoverage=55%, HitCoverage=41%, E-value=7e-97, Identity=91%"; Hit description =Concanavalin A-like lectin/glucanase
  Pfam annotation: Domain name=Calreticulin; Domain location=1-235; Score=234.9; E_value=1.7e-67; Accession=PF00262.8; Description =Calreticulin family
GWRSRWVKSDWKSSEGKAGSFKHTAGKWAGDPDDKGIQTSSDAKHFAISAKIPEFTNKNRTLVLQYSVKFEQEIECGGGPDATYSVLVDNRERDSGSMYTDWDILPPRKIKDVKAKKPADWEEREYIEDPDDVKPEGYDSIPREIPDPNAKEPENWDEEEDGKWKPPKIPNPAYKGPWKRKKIKNPNYKGKWKTPWIDNPEFEDDPDLYVLKPIKYVGIEVWQVKGGSVFDNVLICDDPDYAKQVVEEVFANREIEKEGFEEAEKVRKAKEEEDPNSYFCRRLKEQEKKVKGVDEREVMIDDIGTDIETNIE

SEQ ID NO: 154073 - protein, 290 aa, Glycine max
  Coding DNA Sequence Number=SeqID_37295
  Gene Ontology: Mol. function=protein serine/threonine kinase activity; Cellular component=cell cortex; Biological process=protein amino acid phosphorylation
  Homolog annotation: Hit_ID=O23190; Match level="QueryCoverage=92%, HitCoverage=33%, E-value=5e-50, Identity=41%"; Hit description=MAP3K- like protein kinase
  Pfam annotation: Domain name=Pkinase; Domain location=17-283; Score =198.0; E_value=2.2e-56; Accession=PF00069.15; Description=Protein kinase domain
  Pfam annotation: Domain name=Pkinase_Tyr; Domain location=17-283; Score=-14.8; E_value=1.5e-11; Accession=PF07714.7; Description =Protein tyrosine kinase
  Pfam module annotation: Pfam domain module=Pkinase::Pkinase_Tyr; Domain location=17-283::17-283
MDHIVAARSDHEAVTEWEKLKILGEGSYGTVSLAVLTAPEEAKGELIAVKTSKPHGLDSLQKEETILDSFFGCKEILRCIWSLFTMENGRFVYNLLMEFAPCGSLGDLIRKKPLSESQVRVYSRMLLKGLSLVHRFGVVHCDLKPDNILLFPSGEENDVDYQLKIADFGLSRTKDEVFDADFWKIKFRGSPFYMSPESVMGRIETPLDIWSLGCMVIEMMTGFPAWNHIPTTRDLMFKLAFLKEAPPLPSGLSSLCQDFLNKCFVKDSAQRWTANMLLDHPFISAAKSYM

SEQ ID NO: 154074 - protein, 61 aa, Glycine max
  Coding DNA Sequence Number=SeqID_37296
  Homolog annotation: Hit_ID=Q38861; Match level="QueryCoverage=77%, HitCoverage=6%, E-value=8e-16, Identity=81%"; Hit description=DNA repair helicase XPB1
MYYSTKRQQFLIDQGYNFKVITSLPPPDEGPNLSYHRLQDQLALLGKVKYVFTSVLPLKTM

SEQ ID NO: 154075 - protein, 97 aa, Glycine max
  Coding DNA Sequence Number=SeqID_37297
MNPTKNVHDEKASQIAMLVRRDGNRVPKRVSEWVATIGTWDEWQRNGERERERRRHFKGKMSLEEAHHHRRPWIRAWRKNEMNEGRGREEHEILCSK

SEQ ID NO: 154076 - protein, 190 aa, Glycine max
  Coding DNA Sequence Number=SeqID_37298
  Gene Ontology: Mol. function=nucleic acid binding
  Homolog annotation: Hit_ID=Q1S9I4; Match level="QueryCoverage=42%, HitCoverage=7%, E-value=2e-13, Identity=46%"; Hit description =Integrase, catalytic region; Zinc finger, CCHC-type
MFGRFQTILNELHSLGRHYDNYDHIDKILQGISRKWRPQVTTLRAINNLYSMTLEELVRILKVHEQDLANDSRSKKGKFLALTVQRPKCNFVSKESLSKALATNDVLEEESNDNDSDEEDDELNLITRKIKKYVEKQELLQEDHMSTWEDLENSSSDEDTEEEANLCLMADASTGKVELALDTSSDDEDS

SEQ ID NO: 154077 - protein, 90 aa, Glycine max
  Coding DNA Sequence Number=SeqID_37299
MTVEEAIHVRLNDNKPNTTMLELDESSTEMKVENIVKYVARSNHLESQIIGDPKDKVLTRNSFKHRTLLFEIKPKYIDDAMSNEYWVKAM

SEQ ID NO: 154078 - protein, 48 aa, Glycine max
  Coding DNA Sequence Number=SeqID_37300
MLELGDAGHDVEGFVTIVVVIKESGGEVKDGGKNDMDTHINEYLLIKN

SEQ ID NO: 154079 - protein, 422 aa, Glycine max
  Coding DNA Sequence Number=SeqID_37301
  Gene Ontology: Mol. function=phosphatidylcholine-sterol O -acyltransferase activity; Biological process=lipid metabolic process
  Homolog annotation: Hit_ID=Q1S687; Match level="QueryCoverage=54%, HitCoverage=47%, E-value=2e-97, Identity=74%"; Hit description =Lecithin:cholesterol acyltransferase
  Pfam annotation: Domain name=LACT; Domain location=42-394; Score= -112.4; E_value=3.4e-05; Accession=PF02450.6; Description =Lecithin:cholesterol acyltransferase
MRFCPCFGSEEAKGVADRDPVLLVSGMGGSIVNSKPKKFGFTTRVWVRLLLADVEFRNKIWSLYNPQTGYTETLDKKSEIVVPDDDHGLYAIDILDPSWFTKCIHLTEVYHFHDMIDMLVGCGYNKGTTLFGYGYDFRQSNRGFNPATSPPFLLPSPLDQPYISTKFVMIGKVMEGLKSKLETAHKASGGRKVNLISHSMGGIMISCFMSLYRDVFTKYVNKWICLACPFQVVDVEEEAERSDRQMKSRIGWEVTELKHMLHKILNEEDDPHSTELDKNNMESGSECGEAKASSSTRKVELPTFDGNTERLTNSKSSILSDGDPLQFLKSGNRSKEGSVIKNHTSSLVPLYSYVDGDGTVPSESAKGDGLEATERVGVAASHRGILRDETVFQHIQKWLGVEPMVGKHSKTSKVADAQPMVL

SEQ ID NO: 154080 - protein, 104 aa, Glycine max
  Coding DNA Sequence Number=SeqID_37302
MRISCAVIECCLKDGLIIPERVKQRNGWKPISYLVQVGESVCSSERGYAEVGWLFIGKEEEKGGKKKKPNQTRLNENEGDHHDEEEARHKGRRSIAPESYGRAL

SEQ ID NO: 154081 - protein, 61 aa, Glycine max
  Coding DNA Sequence Number=SeqID_37303
MEEIHGEDDEIEAAKEHHLDEDALIPPNLAPCRACRPWIFVLNGVLCFLKINDSRMEKEER

SEQ ID NO: 154082 - protein, 54 aa, Glycine max
  Coding DNA Sequence Number=SeqID_37304
  Gene Ontology: Mol. function=transferase activity, transferring nitrogenous groups; Cellular component=cytoplasm; Biological process= ethylene biosynthetic process
  Homolog annotation: Hit_ID=Q9AVH0; Match level="QueryCoverage=90%, HitCoverage=10%, E-value=4e-18, Identity=89%"; Hit description=ACC synthase
MDFRSFKQAVANFMSEVRGGRVRFDPDRILMSGGATGANELIMFCLADAGDAFL

SEQ ID NO: 154083 - protein, 91 aa, Glycine max
  Coding DNA Sequence Number=SeqID_37305
  Gene Ontology: Mol. function=transferase activity, transferring nitrogenous groups; Cellular component=cytoplasm; Biological process= ethylene biosynthetic process
  Homolog annotation: Hit_ID=Q9AVH0; Match level="QueryCoverage=70%, HitCoverage=13%, E-value=1e-23, Identity=83%"; Hit description=ACC synthase
MDFRSFKQAVANFMSEVRGGRVRFDPDRILMSGGATGANELIMFCLADAGDAFLVPSLYYPAYVPSLSSRLFSFNESHYFTPIKTLKVDTN

SEQ ID NO: 154084 - protein, 93 aa, Glycine max
  Coding DNA Sequence Number=SeqID_37306
  Gene Ontology: Mol. function=RNA-directed DNA polymerase activity; Biological process=RNA-dependent DNA replication
PAILYGTECWAVKSQHENKVGVAEMRMLRWMCEKTGRLCSEESRPDEEKANNSRQRKTQKDYKREIGYFYIIAKARNDVESPGYYIGAGEKRY

SEQ ID NO: 154085 - protein, 879 aa, Glycine max
  Coding DNA Sequence Number=SeqID_37307
  Homolog annotation: Hit_ID=Q9SXY0; Match level="QueryCoverage=94%, HitCoverage=96%, E-value=1e-154, Identity=41%"; Hit description=FAS1
MASPTEVIDVDAENAPTPTPPPPLPPQDPKSNRAKTIMRKRKKVPSLLQNLKSYEEKQAHIETLEKELDALFRYYQEAMAQKVRVELSQCGGSRNVVVAALMEESDLPLSKLVDEIHDKLNEEVSNGAIVLAEPVTYATVKSSALFVGQRVSYGVPNADADVLEDHAESCLWCWETRDLKLMPKSVRGELSVRRTCRRRIHERIMAISEMIAALKKLESEPDYNQGLIKASAKLNKAFPEADIRLLVDGLLQKNSEDMDKKRTSQENKLLIKQLERNRKEAEKEKEKESMHNELQRETLLNESDLKLSQDEARNGEKSSEKKKQIKKQVDEAEKDQRRREKAEAELKKKRSLQKQASIMERFLKRSKIIPSSPSSEKDIVSTKSTASDLPSSKSESLFESATLSMDCTLASSRDVMLEDIRKQVSFYCVLPFFFILVVLFSDLTKNVSLFRTQFSSWRSLGQSLRSNRKQRWGLRQKPRTEVFKELKLSAIKTAVQDVELDTEKHVDRLGECSSDISSCPMNADSSPDAKYSRGRQLLQFDKSHRPAFYGVWPAKSHVVGPRHPLRKDPSLDYDVSSDEEWEEEEPGESLSDCDKDEEECQEECTKSDEESEDGFFVPDGYLSEDEVEGAQVDRMEIDDDIDGADSSPSCKNDIESEEFCALLRQQKYLNNLTEHALRKNQPLIISNLINDKDLSSDHNISGTPKLEQMCLQALSMYVIPGISCIEIYVDKMQDEDQEVCLSTGKSGASPISGVAVIPDSDLPIIVTTIQSCSQGMNKVLVSLQQKFPSVSKSLLKNKVREVSDYVDNRLQVKKEVLDKLGSAVKPEKSSGGPRSIAAFFSKRCLPPTGEGSKPGETSPLPPLKSSSAIDERPQSSYNI

SEQ ID NO: 154086 - protein, 123 aa, Glycine max
  Coding DNA Sequence Number=SeqID_37308
  Subcellular localization annotation: CTP_CleavageSite=54; ConfidenceScore=5.57e-01
MLQNPPPPSSPNLSKPPPSRRRKRNSNPSTTGSRKSLLSSLGFRAGIGTAIEVEDEAGAEKNVGKEAKAVIDTGKHEDEIGVERDIRIVKEGDGNWVIFLNCYSPSLCSLFSRRSFFHLVPQI

SEQ ID NO: 154087 - protein, 389 aa, Glycine max
  Coding DNA Sequence Number=SeqID_37309
  Gene Ontology: Mol. function=phosphoric monoester hydrolase activity; Cellular component=cytoplasm; Biological process=metabolic process
  Homolog annotation: Hit_ID=Q1S694; Match level="QueryCoverage=99%, HitCoverage=99%, E-value=1e-168, Identity=78%"; Hit description=HAD -superfamily hydrolase, subfamily IIA
  Pfam annotation: Domain name=Hydrolase; Domain location=85-355; Score= 53.7; E_value=6.2e-13; Accession=PF00702.16; Description=haloacid dehalogenase-like hydrolase
  Subcellular localization annotation: CTP_CleavageSite=71; ConfidenceScore=5.45e-01
MLRSSTLTQSVTVTCVHHSHRQWFQSIPVNYRFCDAARNSLSSNSAIFKWKRTANYNRNRSGMGTFTTRALAQPLQNADELIDSVETFIFDCDGVIWKGDKLIEGVPETLDMLRSKGKRLVFVTNNSTKSRKQYGKKFETLGLNVSEEEIFASSFAAAAYLKSIDFPKDKKRRGYVRFMYREGYLGVRAIHKVYVIGEDGILKELELAGYQYLGGPEDGGKKIELKPGFLMEHDEDVGAVVVGFDRHFNYYKIQYGTLCIRENPGCLFIATNRDAVTHLTDAQEWAGGGSMVGAISGSTQREPLVVGKPSTFMMDYLANKFGISKSQICMVGDRLDTDILFGQNGGCKTLLVLSGVTTLAMLQSPNNSIQPDFYTNKISDFLSLKAAAV

SEQ ID NO: 154088 - protein, 751 aa, Glycine max
  Coding DNA Sequence Number=SeqID_37310
  Gene Ontology: Mol. function=hydrolase activity; Cellular component =intracellular; Biological process=RNA processing
  Homolog annotation: Hit_ID=Q6YU42; Match level="QueryCoverage=96%, HitCoverage=97%, E-value=0.0, Identity=45%"; Hit description =Calcineurin-related phosphoesterase-like protein
  Pfam annotation: Domain name=Metallophos; Domain location=57-276; Score=47.7; E_value=3.9e-11; Accession=PF00149.18; Description =Calcineurin-like phosphoesterase
MKLRTQTQKSNAISPHRERSTWLLHVVVATVAILCGICAAESNEGVTHVRGGPDSVVWVVQLSDLHFSVHHPNRALDFANLVGPALSVINPSLVLITGDLTDGKSKDLLTMKQNEDEWVEYRTVLDTVIKRSRLQKSLFFDLRGNHDSFGVPVVGASFDFFSKYSINGQLGRNGSVNSVTLETRDWKHLFVGFDSTMLTGLRGPTNLFGHPTDQLLKDLDLELSQWDSQSEKLVTKISFGHFPLSFSAPSSSGRTLEDVFLKHSISAYLCGHLHTKFGMNLKRHHQLDDHSSSLQKLFQFNIHQSSFESTANCSMGAPPIQEFWEWEMGDWRKSRAFRILAIDRGHVSYVDTDFKSGTKRAIILPTFPLDSRFMLTSSCRHNYECQSVAPSSYETIRALVFSLSPIVSVVARVYDSRSGNLDLVLETQMIKHSGDNSRGNLYVAPWNYRAFEDASPDRFWLQIEANDIAGRSTLTELRPFSINGHSLKLSWGWKEFLVMGCQWASLYYPLFWSALYFLFIFLLLPKALLVFPKKIYTYKNFIANKGIVNGVLWFLQELCRIPTLWFGWIGYLFYLMLCPWFMGQVFTEGKNMVYMTYMGWAIETSNGKGKVEYVGSPDIMVVVLPHLLFVVLPAILVTGALTAERAIYREHMLAFLVKKKDDICMDSRKSVLNGSMCGHCKQHCRQIVCINYSRGAQRIVNKGCSALTKSKQNCRTLLKAYEMNPVLHFLGYGISIPLLLAHAISKTRSAE

SEQ ID NO: 154089 - protein, 61 aa, Glycine max
  Coding DNA Sequence Number=SeqID_37311
MRKRKKMRILLKWILLIIEVILKEVKIKIKGFLSLDLVTGDPPQEERSLRIEIEEALKNIT

SEQ ID NO: 154090 - protein, 489 aa, Glycine max
  Coding DNA Sequence Number=SeqID_37312
  Gene Ontology: Cellular component=nuclear chromosome; Biological process=chromosome organization and biogenesis (sensu Eukaryota)
MEPSVSKETPNSGKTDMQLESQIFSNKVESINRSAATDMPEPEKLLSAYQHDGEANDLLMASTPDNQGATEGHTGAAGEKYISGKKRSYTESTLTVQSMDLIESYTGAQSKRTAESVPDDDDLLSSILVGRKSSVLKMKPSPAAPEIASMKRVRSASAPRTSALKRKTFDLTGIKVIEYGLDSSSVEKTNDQESYSRTHTEIHGVEGNNEPMAVQLQEDAEVQPTEVPVLSESHQSKVNLGSHDIDAHGHTSIISHVEELDSSQNVELNNLRANIAVSEAENCSVGPGHESSSLTEVFENDFAASLALMDKTNDLVDSIHSNILSIPNAENLNTIPILEDDFVEDQSDRNGVGAIKCSMETGTQVQTDGVDANDLYTSLATGSTETDEFTNIQASFNGDLPLEENGNSLLGQLNEDQIVASGMDCDDKDARPDCIFIENAKVDCLQSEALGLDEKESLLKDEEIPVCQEAELQSTMCPEIRSPLVDQND

SEQ ID NO: 154091 - protein, 125 aa, Glycine max
  Coding DNA Sequence Number=SeqID_37313
  Gene Ontology: Mol. function=protein binding; Cellular component =nuclear chromosome; Biological process=chromosome organization and biogenesis (sensu Eukaryota)
  Homolog annotation: Hit_ID=Q016T1; Match level="QueryCoverage=71%, HitCoverage=16%, E-value=3e-20, Identity=55%"; Hit description=[D] KOG1213 Sister chromatid cohesion complex Cohesin
  Pfam annotation: Domain name=Rad21_Rec8_N; Domain location=16-99; Score=104.7; E_value=2.7e-28; Accession=PF04825.4; Description=N terminus of Rad21  Rec8 like protein
MQIAHCHSFFPSVQMKFLKLIVVRERAAFDSILFPEVPIALRLSSHLLLGVVRIYSRKVNYLFDDCSEALLKIKQAFRSTAVDLPPEESTAPYHSITLPETFDLDDFELPDNDILQGLVPKYLII

SEQ ID NO: 154092 - protein, 69 aa, Glycine max
  Coding DNA Sequence Number=SeqID_37314
  Homolog annotation: Hit_ID=Q016T1; Match level="QueryCoverage=59%, HitCoverage=7%, E-value=1e-12, Identity=82%"; Hit description=[D] KOG1213 Sister chromatid cohesion complex Cohesin
  Pfam annotation: Domain name=Rad21_Rec8_N; Domain location=29-69; Score=-16.1; E_value=0.02; Accession=PF04825.4; Description=N terminus of Rad21  Rec8 like protein
MLNFNSSLAPRFGERMTPFCGEFVKLRGMFYSQFILAKKGPLGTIWIAAHLERKLRKNQVADTDIGVSV

SEQ ID NO: 154093 - protein, 204 aa, Glycine max
  Coding DNA Sequence Number=SeqID_37315
  Gene Ontology: Mol. function=serine carboxypeptidase activity; Cellular component=peroxisome; Biological process=proteolysis
  Homolog annotation: Hit_ID=Q1S459; Match level="QueryCoverage=91%, HitCoverage=40%, E-value=5e-74, Identity=66%"; Hit description =Peptidase S10, serine carboxypeptidase
  Pfam annotation: Domain name=Peptidase_S10; Domain location=1-204; Score=-92.9; E_value=2.8e-08; Accession=PF00450.12; Description =Serine carboxypeptidase
IGKGATRSTRSPISVLQDIEKVDKAIDGRNVYNILEPCYHFPDAATAKENGTLPKSFKQLGVIERHLLVRKRMFGRAWPFRAPVKPEQSDEVASSWLNNVAVRKAIHAESEKVAGPWELCSSRIEYHHNAGSMIPYHKNLTRLGYRALIFSGDHDMCVPFTGSEAWTRSLGYKIVDEWRPWNSNNQVAGYLQAYENNLTFLTIK

SEQ ID NO: 154094 - protein, 68 aa, Glycine max
  Coding DNA Sequence Number=SeqID_37316
YYHQIFKPEVVKYIKHTIGVWHNDIVKIASDLIGNNEFFMQPDVGTLESSGASGTGTRPESLTFGNKR

SEQ ID NO: 154095 - protein, 83 aa, Glycine max
  Coding DNA Sequence Number=SeqID_37317
MPKSSPNMHVKQEVSTRVKPRLLCKQSMRQNTPNKIDDDGSNSHQGEKQGFQFTKCQETPISKTITHYLYITYNSKRNKQCCT

SEQ ID NO: 154096 - protein, 211 aa, Glycine max
  Coding DNA Sequence Number=SeqID_37318
  Gene Ontology: Mol. function=transferase activity; Cellular component= intracellular; Biological process=translation
MDPTIDLDEVLDQMIDKELEDNSDEEIIRLILESQQQLHGNTTSRSQRRRVVHHNHEEENPVYTEIQFRRRFRMQRHVFLRIVNARSNHDEYFQMRVDALRRKGLSPLQKCTTAIRILAYGSPANSVDEYVRIGICTIFGNEYLRRPNNEDIERLLQMGAERGFPGMLGSIDCMHWEWKNCPVAWKGQFCRGDHRNPTIILEAMASQDLWI

SEQ ID NO: 154097 - protein, 115 aa, Glycine max
  Coding DNA Sequence Number=SeqID_37319
KPRRSGSSEKDVLADAHMIYSQDTETPIEVEEYDRPSPMSRPIGQKAAKRKSKGKECHNTLNLSSIESEAQEKRLQEQERRMEYEILMKDISNMSEQQRKDHEKYCDHIRKKLGY

SEQ ID NO: 154098 - protein, 83 aa, Glycine max
  Coding DNA Sequence Number=SeqID_37320
MAHGSHRGSMVVEEEPARLAQAKFGSPRRADLAQILLLRLKYHISSLRCYIANPNGQKVQNGFQAYSPNLKAIQRLKSPGLQF

SEQ ID NO: 154099 - protein, 123 aa, Glycine max
  Coding DNA Sequence Number=SeqID_37321
MTSRLSQIREGHTKLGQRREGIYRPQFDRPPRNELRERLRNPNRYQRRGRSKSILRGPSNNAQKRHAGEVLPVVHGGRNCESNKRRPPPLIFDDKSIDISVVPDHDDPLLVKAFINNKLQHRQ

SEQ ID NO: 154100 - protein, 270 aa, Glycine max
  Coding DNA Sequence Number=SeqID_37322
MSSGPPPLDEKRCRMTIICLYVPSDTTVSKWQKVSGMTIICLRVSSGPPPLDDKRRRMTIICLCVPSDTTVSEWQKKSEMTIICLYVSSGPPPLDDKRCRMTIICLCVPSDMTVCGWQKVSRMTIICLHVSSGPPPQDDKRRRMTIICLCVPSDTTVSGWQKVSRMTIICLCVPSDTTVSGWQKVSRMTIICLCVSSGSPPLDDKRCRMTIICLCVPSGPPPIDDKRRRMTILCLYASHDPRVSMTEIVGRPTKARLLLLRILNEELRPT

SEQ ID NO: 154101 - protein, 302 aa, Glycine max
  Coding DNA Sequence Number=SeqID_37323
  Gene Ontology: Mol. function=RNA binding; Cellular component =ribonucleoprotein complex; Biological process=mRNA metabolic process
  Homolog annotation: Hit_ID=Q8S7G1; Match level="QueryCoverage=64%, HitCoverage=42%, E-value=2e-17, Identity=31%"; Hit description =Putative nucleic acid binding protein
  Pfam annotation: Domain name=KH_1; Domain location=113-182; Score =62.1; E_value=1.8e-15; Accession=PF00013.19; Description=KH domain
  Pfam annotation: Domain name=KH_1; Domain location=222-284; Score =59.2; E_value=1.3e-14; Accession=PF00013.19; Description=KH domain
  Pfam module annotation: Pfam domain module=KH_1::KH_1; Domain location=113-182::222-284
MVFFVSLHYIGRVNQGWNERGKCAPALPPHFLLKIIHVDSSFYIKKAVLLSYHYIGIDERHEERVIIISSKDNDEKVTDAEKALEQIAHLILKEDDSSLDASKVTAGHVAANTIRLLIAGSQAGGLIGTSGQNIEKLRDSSGASITVLAPNQLPLCASAHESDRVVQLSGDVPAVMKALEEIGCQLRENPPRQVISISPTYNYAAIRPSQPYLDPTSVDYVTFEMLISETMVGGLIGRCGSNISRIRNESGAMIKVYGGKGEQKHRQIQFGGSAQQVALAKQRVDEYIYSQLIQQTGTQQSA

SEQ ID NO: 154102 - protein, 340 aa, Glycine max
  Coding DNA Sequence Number=SeqID_37324
MVGPGSTPCLILCNNYFLQPSSCSITVFDKSYIVIQRSWFLLQRKLCLEDPSSCLSATVYVMSSSIPNSKFKKFFKLDISAITFSVSCDSTMADQKLSEPALKREQLDEFVSSLYFEQRILELRLLQDLENNDECRKNGSLKRLNDQSDVCGFRSCFKNHYDSLPNQRCLRNREEVIQETMEMELENMMELGTLKGKKTYSFKWSRRPEEPILDNNDECRKNGNLKRLNDQSDNGTRSALNLENTTRSFLDNNKSNDNNWNGEMTLPLLVDKSTVCMLNKDEEVDEPLSPGKHMKTAQSVLSLLIATIALLWILTDTMQPVINYQASARTWPPPHSVFFA

SEQ ID NO: 154103 - protein, 353 aa, Glycine max
  Coding DNA Sequence Number=SeqID_37325
  Gene Ontology: Mol. function=RNA-directed DNA polymerase activity; Cellular component=chromatin; Biological process=chromatin assembly or disassembly
  Pfam annotation: Domain name=RVP_2; Domain location=91-191; Score= -55.9; E_value=0.023; Accession=PF08284.2; Description=Retroviral aspartyl protease
MVENTRNQASLCEMEERLSSKMESRFVKLTASMQQTIDGMFQQRQQDSPATSNPPRDEEEGSRPQEIDANVVSEHDSEPLISMNALTRVANFQTMRVTGYCGKKPLHILIDSGSTHNFLDLHIAQKMGCQTEAMDTISVTVADRNKVQISSKVPKFSWSIQNTNFTFDMMLLPLGCCDLVLGIEWLVTLGDITWNFNKLTMEFFVHGKRHVLRGATPTNLATARKQHLHKTIFNGIHLSLLSLQSKVEGSLLHSLTTHANQQLLPPDIDSLLLEFTDVFQEPSGLPPCQIGHDHKIPLTQGANPINKRPYRYAKQQKDIIDGLIQDYLKSGIIQNSDSLYTSPVVLVRKKDGA

SEQ ID NO: 154104 - protein, 144 aa, Glycine max
  Coding DNA Sequence Number=SeqID_37326
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=99%, HitCoverage=9%, E-value=1e-33, Identity=53%"; Hit description=Chromo
MKQLRSFLGLFGYYRRFVSRYGTIAKPLTDMLKRDNFSWSSTTKEAFQELKQRLVTAPVLALPNFSKEFVVEVDASGLGLGAVLMQNHHPTSFISRSLNKQQQSLSTYEKKLLAVVFAVQKNGVTTYFPRSSSLELITKVLSTS

SEQ ID NO: 154105 - protein, 350 aa, Glycine max
  Coding DNA Sequence Number=SeqID_37327
MFVFSKKTKQAISILNPPSDLPANAAAQENNPNPKRTHNAENGVVCNPQMKCKKHTSDLSSTVGVCASCLRERLIALVAARVISRASDEYSRNSDPNPPPPLIFPRSVSPYVSRRKPDYAAAWHDDRRDRLFYSTPQLGPTFCAGDSAYHADAKSFKKRFNKFRIFAKIFRTRSEKFQSDPSCEQASYASPSWFSAFFPTRRRNKDRTGTTEEYSSSAPRRRYRPSDRGMSPVTTEDFGDECDQSPSGSGYVSEASPWWRRSPTVAPSARRSRLGHTKSSSGSGMALWLSPLVRASPNRRWNHKGLPPEMAAAAEVRAAAAKPHLSAAASFCANRSRKLADFGRVNNHNR

SEQ ID NO: 154106 - protein, 131 aa, Glycine max
  Coding DNA Sequence Number=SeqID_37328
  Gene Ontology: Mol. function=phosphopantetheine binding; Cellular component=mitochondrion; Biological process=fatty acid biosynthetic process
  Homolog annotation: Hit_ID=P53665; Match level="QueryCoverage=98%, HitCoverage=99%, E-value=1e-36, Identity=62%"; Hit description=Acyl carrier protein, mitochondrial precursor
  Pfam annotation: Domain name=PP-binding; Domain location=42-124; Score=49.9; E_value=8.7e-12; Accession=PF00550.15; Description =Phosphopantetheine attachment site
MALRAAVLRHVRVPLQAAPKLQPWRAMSSHGDDHLSKEEVVERVLAVVKDFPKVDPSRLRFTLSSPGTRHTPHVSPDVHFQKDLGLDSLDNVEIVMALEEEFKLEIPDKEADKIDSCHLAIEYISNHPMAG

SEQ ID NO: 154107 - protein, 192 aa, Glycine max
  Coding DNA Sequence Number=SeqID_37329
MEDSLENWISLLEMEEYHDGSFDEEEFLREILKEEQQPENLWPQRDQKLSNTSPTVSFDEAISFCGSGTLHKSNSSNSIKSLKRSSSSVSPATTTYLLSFDTSSAKPITLKPSPKLDLALGSSNKRSTSTVTVVKDGCEFEPLMMPQSQARKKVRRSCETQHHIIAERKRRQELTGSIIALAATIPGLKRMK

SEQ ID NO: 154108 - protein, 249 aa, Glycine max
  Coding DNA Sequence Number=SeqID_37330
  Gene Ontology: Mol. function=transcription regulator activity; Cellular component=nucleus; Biological process=regulation of transcription
  Homolog annotation: Hit_ID=Q1PF17; Match level="QueryCoverage=58%, HitCoverage=53%, E-value=2e-18, Identity=37%"; Hit description=Basic helix-loop-helix family protein
  Pfam annotation: Domain name=HLH; Domain location=98-147; Score=46.5; E_value=8.8e-11; Accession=PF00010.16; Description=Helix-loop-helix DNA-binding domain
MGGDDFFNIQSHGHMSPFNEEEYSSGERDMIVQQQVFSPNLSSSSLQSNLELPYSSSPTGNVLSFDNPLVGSLHPQNDSAKSMEQSHCVEPKAYPRTNAQVHILAERKRREELTRCIIALSATIPGLKKTDKVSVLREAVNYVKQLQERVKELENQMRKECVNSIILTKKALICKNDRVEELLEVKVTVLDKEVLIGVHCEKQRKSLLKILSLLNNLHLSITSTSVLPFGSSTLKITIISQKIGIAWDH

SEQ ID NO: 154109 - protein, 63 aa, Glycine max
  Coding DNA Sequence Number=SeqID_37331
MMTRKMQLRQAVVAVAWTIGTLGEKTWCLAQKYSSLSQHKTSWGGKKNQEEHAMQAITYNKTR

SEQ ID NO: 154110 - protein, 355 aa, Glycine max
  Coding DNA Sequence Number=SeqID_37332
  Homolog annotation: Hit_ID=Q00YK5; Match level="QueryCoverage=84%, HitCoverage=82%, E-value=2e-09, Identity=24%"; Hit description =Homology to unknown gene
MFVVFPIANDADRSEVSSDTAIKTSYSEADKMVDGMDFGELCNEFECISSPLVESTARQLARDILELREGNRALGIFAVSVAYKSHIFGTNFDTKLKAAMANPQKDPIRSFTGREKYKRRLWATGALDNPSVEMVMLSTSVLSIKWTIRGKPKSVLGGDLIIRVTSKFTLNQISGQVIEHEEFWDLSASSASAQAFFWTSRALFAAVESVKDLGDSAKNLSSKMSTKKENLEMYPDPSGDPTKTFIWKFIQAGSKSQTIFLSLTRHTFIMNQSGCSNLYAIAFLNMLFFQRDDSFQQDAYQIALLLAVIYLVDVCDSLLNEDKFYFLLVKVKTTKSGEKNLWKWNLPSPYPSLFQ

SEQ ID NO: 154111 - protein, 181 aa, Glycine max
  Coding DNA Sequence Number=SeqID_37333
  Gene Ontology: Mol. function=transcription factor activity; Cellular component=nucleus; Biological process=regulation of transcription, DNA-dependent
  Homolog annotation: Hit_ID=P93392; Match level="QueryCoverage=93%, HitCoverage=62%, E-value=2e-29, Identity=45%"; Hit description=S25 -XP1 DNA binding protein
  Pfam annotation: Domain name=AP2; Domain location=34-99; Score=124.2; E_value=3.6e-34; Accession=PF00847.10; Description=AP2 domain
MESQEITSNITCDGHVEEKYSPPPSLLDGSKREKRTYRGVRSRPWGKFAAEIRDPTRNGVRVWIGTFVSAEEAALAYDQAAFLTRGVLATLNFSVQVVMESLQDMGFKALKNDLSPVLALKRMHVTRTKSRASRSGNKKVKRACGSNGKWDTSTQNLLVLEDLGPEYLDQLLSFTCPGSWC

SEQ ID NO: 154112 - protein, 138 aa, Glycine max
  Coding DNA Sequence Number=SeqID_37334
MACEHRWNFDLHFSPSLEQQAYGRPLPAFRMHVWTIELTQSLLCDPKPLMLPPLAAIRLPSCGFHMTILRKVGPPLQWHVVPVGPGFHGKYVADPWYRFLAEGDFVHGDELLFYYRSHEDIWEMVIRKQRNWGDNDDW

SEQ ID NO: 154113 - protein, 35 aa, Glycine max
  Coding DNA Sequence Number=SeqID_37335
MNAMFALTQRGGFVQPDKDDPNLPLDTAPIKHVTQ

SEQ ID NO: 154114 - protein, 129 aa, Glycine max
  Coding DNA Sequence Number=SeqID_37336
  Gene Ontology: Mol. function=protein binding; Cellular component =chloroplast; Biological process=cell redox homeostasis
  Homolog annotation: Hit_ID=P29450; Match level="QueryCoverage=59%, HitCoverage=42%, E-value=4e-31, Identity=84%"; Hit description =Thioredoxin F-type, chloroplast precursor
  Pfam annotation: Domain name=Thioredoxin; Domain location=31-126; Score=66.2; E_value=1.1e-16; Accession=PF00085.10; Description =Thioredoxin
MNITVYAFESDIGGKLLSWPLRYNQVSSFLAIMCFAMTYTCYEANGPESGHLCGPCKVMAPKFQELSEKYLDVVFLKLDCNQDNRPLAIELGIKVVPTFKILKDNKVVKEVTGAKYDDLVDAIDKVRSS

SEQ ID NO: 154115 - protein, 89 aa, Glycine max
  Coding DNA Sequence Number=SeqID_37337
MGLRIRFVGGGCTNSARKLIRGALDSMIHWWRMHEQRWAINSWGSRLDGGGCMKDNQFIGLRTRFVGGGCTNSARQSICGAPDSMVEDA

SEQ ID NO: 154116 - protein, 107 aa, Glycine max
  Coding DNA Sequence Number=SeqID_37338
MTITLDVVASLLHLPIVRVFHSFKLLHVDDVVEMLVELLEVSAAECWIYDHFSSVGSAVPAENYDERSRVHVDGPLARHCPFPRIRGVWIDRPLMRCAGFRMVTTVL

SEQ ID NO: 154117 - protein, 775 aa, Glycine max
  Coding DNA Sequence Number=SeqID_37339
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=99%, HitCoverage=44%, E-value=0.0, Identity=70%"; Hit description =Prefoldin; tRNA-binding arm; t-snare; Protein kinase PKN/PRK1, effector
EAGELNERATKAETETESLKQELARVEAEKEATLVQYNQCLETISKLEERIKEAEENARRIKEHADIAEKEIEALELQVTKLNEEKEDAALHYQQCMEIISSLEYKLSCAEEEVHRLNSKIVDGVEKLQSSEQKCLLLETSNHTLQSELQSLAQKVGSQSEELNEKQQELGRLWGCIQEERLRFIEAETAFQTLQQLHSQSQEELRSLASELNSKVEILGNVESRKQALEDEVHRDEILNLRETIEKVEQEVELRIDERNALQQEIYCLKEELNDVNKKHEAMIEEVRSTDLDPQCFGSSVKKLQDENLKLKETCEADKGEKEALLVKLETMEKLLEKNTVLENSLSDLNAELDSVRGKVNVLEETCQSLLVEKSNLAAEKATLFSQLQSTTEKLEKLSEKSNLLENSLFDVNAELEGLRVKSKVLEDTCRSLDHEKSSICQEKETLVSQLNITHQTLKDLEKLHSELELKHLELKGERESALQKVEELLVSLYSEREENSRVLKLNEDELAEKELQILILQEDANCKKKEYEEELDRAIHAQLEIFILQKCIDDLEKKNLSLLVECQRLLEASKMSDKMISKLETENVQKQVDVNSLSEKIKILRIGLIQVLKTLDNNSGHFGEDMLEEDQMLLNHIYGKLQERQKSFDTIFNGSQQMAIENSILITFLEQLKLKVENLVTQRDTLDEEFNIQSKQFLALQIEVQKILQKNQELELTISKGEERMEVMTIETDNLRKQLSDLEKSHNNLQEDSCKILEEKKSLTRRFLDLGEEK

SEQ ID NO: 154118 - protein, 132 aa, Glycine max
  Coding DNA Sequence Number=SeqID_37340
SVRRVHVLTFRGLHVLAFRVLHVLAFRGLHILDFRGLHILAFRGMYVLAFRGLHVLASIGLYVLRLQRATCPHLQRAVKKRQSHEVPKVTIELSSSVYSARLSAQLVLSPNPLTRAKREGGAKRNVTNSEPI

SEQ ID NO: 154119 - protein, 99 aa, Glycine max
  Coding DNA Sequence Number=SeqID_37341
MTLIYILKTTMSSVIACLQRRQCPHLHLEDDNVFSHCMPSKGDNVFICISKTTMSSPQKLQYPFSLCFVGLDFLCLPSRVLLLGFALVVSRVKIQLKRN

SEQ ID NO: 154120 - protein, 191 aa, Glycine max
  Coding DNA Sequence Number=SeqID_37342
  Subcellular localization annotation: CTP_CleavageSite=26; ConfidenceScore=5.02e-01
GSENVGLSNANVGENPMPRKPMVPPQCSSTEGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISEIPLWKS

SEQ ID NO: 154121 - protein, 384 aa, Glycine max
  Coding DNA Sequence Number=SeqID_37343
MAPSLLSVFLPIKAKYDAFASISRYLMVKLLESLCLTKGGHQVHIASSLFFLACKDEESTDMRMDNVRGDLKSLKNHHEVVLVDKVDTLEFPIREDDVEMEFSGLAVLSSIGKSARDGVIARTAVAGVFVYLSLSLFFCLLRGSYAAPLGVLWYLVASDPGLGGFVKGSLMGTSKLKASLKLYLSTSFSLVVLAFDISDFVPESGHFFHLDGEKHGMKRYLKVKILDLDGCAPKSAHEFSDRGIVCLSQAGQGGQGHAVRPAGCVLRAEIFDEGVEPIYGTRFAYVRKASKCLSGSVVPSYHSRLSGFHPKGMSASIMGSTKGCRQVVRPARWKCVSRVFVALGTSNTSPQLVMSIGVFHSYLIRMGVFEKGLASEAKSSANHG

SEQ ID NO: 154122 - protein, 201 aa, Glycine max
  Coding DNA Sequence Number=SeqID_37344
  Gene Ontology: Mol. function=RNA-directed DNA polymerase activity; Biological process=RNA-dependent DNA replication
MASPFRQALAGTYTGMLAYRSASELLGCWWGYASLAHVIFAEFLKDLFQVRHMLDYALRLDDHVAHIYLDVSSDLLFKDSVHQSLVSRKLSTWNPDAPSTSLSMLGRGAHSLFSIGLFDHDDIGKPNGIPDFSDEHVGDVPMLMAGKVPTKPCALSEFRFELQLDKLFDGFQASVRGSLVGGYDATSGSLHSVVVLAFGQP

SEQ ID NO: 154123 - protein, 226 aa, Glycine max
  Coding DNA Sequence Number=SeqID_37345
  Homolog annotation: Hit_ID=Q6CQF2; Match level="QueryCoverage=32%, HitCoverage=92%, E-value=2e-11, Identity=64%"; Hit description =Kluyveromyces lactis strain NRRL Y-1140 chromosome D of strain NRRL Y- 1140 of Kluyveromyces lactis
MSTTGLGRHSVLRIFKGRRGRTGHHATCGALPAAGPYLRLSRFQGGQAICTDDRSARARALGFAATAAPSYSSGLGPCPDGRNSPAGSSYPEETSEGPATRRFDYLSPLYPSQTNDCTSVSLRPPPEFPLASPRSGIVHHLSGPDRYALTRTLHRRSGSVGGATHRGIPPISFLAPYGFTRPLTRTHVRLLGPCFKTGRMGSPQADARSAQVPRHAKGARCHPQSR

SEQ ID NO: 154124 - protein, 166 aa, Glycine max
  Coding DNA Sequence Number=SeqID_37346
  Homolog annotation: Hit_ID=Q6CQF3; Match level="QueryCoverage=33%, HitCoverage=59%, E-value=4e-08, Identity=72%"; Hit description =Kluyveromyces lactis strain NRRL Y-1140 chromosome D of strain NRRL Y- 1140 of Kluyveromyces lactis
MPERGEARGNSGGGRSDTDVQSIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPGHPGNGSAGGRVQRLEEHRTSRGV

SEQ ID NO: 154125 - protein, 45 aa, Glycine max
  Coding DNA Sequence Number=SeqID_37347
MKNKLKHFKSTHIELDLLWLAMRKSSGVAGLSEARLKSSEELEGC

SEQ ID NO: 154126 - protein, 185 aa, Glycine max
  Coding DNA Sequence Number=SeqID_37348
MFGSKGENLDKSRRIGPVHGRPGTLDLQAINAFLAFYNRKESPIVTILAGLYDTFDRRCEKNSARIICCTPALYVWGTNTGVLQRARKAWERVQKKDEELRGSSNGPIGSYHRWLKAYAQGLDWLPNLRTTKEVEGEASEEDEKVQALKTELERAQTTKEKSKSIAVSIRKENAELRDINIATIK

SEQ ID NO: 154127 - protein, 88 aa, Glycine max
  Coding DNA Sequence Number=SeqID_37349
MRLSARSMSDKCAETNFAPFIIQEQQAKWVNAQRQTLRPLSFRSSESSGKRTETNYAPFIIQKRQADWVNAQKQILCPLSFKNNKLSG

SEQ ID NO: 154128 - protein, 313 aa, Glycine max
  Coding DNA Sequence Number=SeqID_37350
  Gene Ontology: Mol. function=protein serine/threonine kinase activity; Cellular component=cell cortex; Biological process=protein amino acid phosphorylation
  Homolog annotation: Hit_ID=Q1SH95; Match level="QueryCoverage=99%, HitCoverage=98%, E-value=1e-103, Identity=57%"; Hit description =Protein kinase
  Pfam annotation: Domain name=Pkinase; Domain location=3-229; Score =150.4; E_value=4.6e-42; Accession=PF00069.15; Description=Protein kinase domain
  Pfam annotation: Domain name=Pkinase_Tyr; Domain location=3-229; Score=-24.4; E_value=5.7e-11; Accession=PF07714.7; Description =Protein tyrosine kinase
  Pfam module annotation: Pfam domain module=Pkinase::Pkinase_Tyr; Domain location=3-229::3-229
  Subcellular localization annotation: CTP_CleavageSite=43; ConfidenceScore=5.10e-01
MIWVRGDSLGTGSFATVNIAIPTNTSIHFPSPTAVKSSDVHSSSMLKNEKEILDCLGASPYVKRHGGRLPESYVRRCTRSIVEGLKHIHDNGYVHCDVKLQNILVFENGDVKIADFGLAKEKGEKQGTFECRGTPLFMSPESVNDNEYESPADIWALGCAVVEMLTGKPAWDVRGSNIWSLLIRIGVGEELPKIPEELSEEGKDFLLKCFVKDPMKRWSAEMLLHHPFVNNETVSFHKVNEPLPLPSPSPRTHFDLTHWASTVTTWLPSSPDSDEWRMAEFGSSCSPENRFRRLLTDQTPANWSESDGWTSVR

SEQ ID NO: 154129 - protein, 280 aa, Glycine max
  Coding DNA Sequence Number=SeqID_37351
  Gene Ontology: Mol. function=DNA binding; Biological process =regulation of transcription, DNA-dependent
  Homolog annotation: Hit_ID=Q9FLV7; Match level="QueryCoverage=39%, HitCoverage=32%, E-value=2e-13, Identity=35%"; Hit description =Arabidopsis thaliana genomic DNA, chromosome 5, P1 clone:MZF18
  Pfam annotation: Domain name=DUF313; Domain location=141-253; Score =38.0; E_value=3.2e-08; Accession=PF03754.4; Description=Domain of unknown function (DUF313)
MRDLKTLKELVASVTDWKSLEKMSCKPFKPSILHLAISQDAPHLYSEEQLIQLKNFSKLLSRAESKPNTNKTDKRVAKKRQIEERPKEERIMPAMIKKPRKIILVQNGPSPDLSRRIVLGHSGTSSDLPRRIILEHSGPSPDLPVQFKNRVTELSGHDLKYLMHKRLFCSDVRPNNNRLSMPMNEIMCEFLTQDEIEKLDERDGSNGKGRLVGLEVTVLDPCLREFSLALKKWSMQRTDTYNLVTNWNRIVFINEFEEGHELQIWSFRVDNKLYLLLNKL

SEQ ID NO: 154130 - protein, 133 aa, Glycine max
  Coding DNA Sequence Number=SeqID_37352
MAPKKFSAKRARKATTGEGSSAASQAKIEFDRHWHPLILEEGQHCEYVERISQASGFDEEAISQLLCSPGHDCAQSIAGRRVRIMRTSMTTFTQICMTLLLSNILPSDHNSNLPLPKCQLVYAILTQISVHVA

SEQ ID NO: 154131 - protein, 72 aa, Glycine max
  Coding DNA Sequence Number=SeqID_37353
  Subcellular localization annotation: CTP_CleavageSite=59; ConfidenceScore=5.52e-01
AKTSSRPKRTLWAQRASTAKCSFSALSVTRESGRAQVSRLHAKHEINSLSEMFVFSQAQCMTGTKPKSTYLH

SEQ ID NO: 154132 - protein, 118 aa, Glycine max
  Coding DNA Sequence Number=SeqID_37354
  Subcellular localization annotation: CTP_CleavageSite=61; ConfidenceScore=5.38e-01
MGPKSTLRVVRTLRPSLASLAQSSWSLLSNALGAVSRIFPLDLMMKSVQFQLSLAHQWAKRASTAKRSFSVLSATEESGRASISRPRAKHEISVLNAGVVFSQAQRTTGAKLKSTYLR

SEQ ID NO: 154133 - protein, 210 aa, Glycine max
  Coding DNA Sequence Number=SeqID_37355
MWEYLDNTSSDKDDEKANICLMADIAFEGFESNQEDEDLKKLNELHNHQKEERYDLWRDYEDLKMKTHNFWVECEEHKKLVSFLNNELIKNQEFKGKPQDLAKLHEETRTLKTTSSKFVNGKYNLKKLLGYCRSSLEKYRNGFDGKVYVHDKETIVCYFYGKIGHMMIKSRDHPMKGSPNPFMTNTKGPKKIWAPKKRIFRGADVFDSWK

SEQ ID NO: 154134 - protein, 159 aa, Glycine max
  Coding DNA Sequence Number=SeqID_37356
  Homolog annotation: Hit_ID=Q8XAN8; Match level="QueryCoverage=99%, HitCoverage=28%, E-value=2e-25, Identity=40%"; Hit description =Putative outer membrane transporter of ShlA/HecA/FhaA exoprotein family
MRTGTVSKKSQIVNLNLNYVKWLTMLPANAYYELNFGAQYSPDNLTLQDQFTIGDRWSVRGFQNSDGIYGNKGFFIQNTLNVVTGFDGITPYVGTDYGQIIGKLPSQDLSGKRIMGGVLGVKGAVKAVEYDASLSTPFLYPDDFDVDKYKFNFNFAYQI

SEQ ID NO: 154135 - protein, 148 aa, Glycine max
  Coding DNA Sequence Number=SeqID_37357
MRGYIMVIHTFCHPETASPMTCRGTIWLSAPFVIPRQDDKSDDMRGYRMVIFTFRQPRANEPVDAQRPTSSSTPFVIQGQQVRWQAEIPYGFYSRRPETFKPDDARHSSLLGGGRSSSMAWGNVVVVPFYRFQDTEVLLTLLMHFLSF

SEQ ID NO: 154136 - protein, 306 aa, Glycine max
  Coding DNA Sequence Number=SeqID_37358
  Homolog annotation: Hit_ID=UPI0000612705; Match level="QueryCoverage =37%, HitCoverage=92%, E-value=7e-11, Identity=30%"; Hit description =UPI0000612705 related cluster
MARMEILTMGPDLWWFEVLAQKACRMAGHDMCQGVGLASGSGIKWRRSVYSPLSAIPRLLWCLALRQPGGAILLDESLVSRGPDDLAGGDRHFVELTEAHNHSWKPQDPIGLLRVHWDWQRPVAIVGNPRTLLDSFGSTGCLVGVIPTNSGWHQKSVEPRGEIRVVVVRMIRTRLPVVVWVKSCPGKHSSCTIASLSGCARKVGRPPISGMRSTLKAKACTPLKVRACSPLKVRTCIPLKARACNPLKVRTCSPLKVRASSPLMARTCSPIQVRTCSPLKARACSPLMARTCSPLKGVKPSDGEDV

SEQ ID NO: 154137 - protein, 112 aa, Glycine max
  Coding DNA Sequence Number=SeqID_37359
MTKLGLCLSSGPPPLDDKRVRITVRMTKLGLCVPTDTTVSEWQRGADNRKVSPRIIMTKLGLCVPTDTTVSEWQRGADNRKVSPRIIMTKLGLCVPTDTTVSEWQRGADNRK

SEQ ID NO: 154138 - protein, 355 aa, Glycine max
  Coding DNA Sequence Number=SeqID_37360
  Gene Ontology: Mol. function=helicase activity; Biological process =viral genome replication
  Homolog annotation: Hit_ID=Q2R1R7; Match level="QueryCoverage=99%, HitCoverage=22%, E-value=2e-68, Identity=42%"; Hit description=AT hook motif-containing protein, putative
MWYGERISKNKNCQNPRFSLCCGDDKVELPLLQNPPQYLQQLLFHDDTIDSKNYQHNLRAYNMMFAFTSARIKLDKTINNSRGPLAIRIQGQPCHRIGSLLPMPGKNPKFAQLYIFDTENEVQNRINVMSQYSGIQNHIVSTLSHMLDQHNSHAKSFRMARDRLVGDQANNIKLQLIAARGKDGRVYNMPNVPKIAALIVGDFHPGSKRDIIVETQNGELQRIHELHPSYLPLQYPLLFLYGEDGYRADILHRCTSSSKKRKQNRLTMREWFAYRLQSRSNEAQTLLHSRKLFQQFIVEGYTMVESERLSYIRNNQKKLRVDKYSSLQTSLDTGTAKGLTKGKRVILPSTFVGSP

SEQ ID NO: 154139 - protein, 117 aa, Glycine max
  Coding DNA Sequence Number=SeqID_37361
  Homolog annotation: Hit_ID=UPI000044A741; Match level="QueryCoverage =37%, HitCoverage=11%, E-value=2e-08, Identity=68%"; Hit description =PREDICTED: similar to Ac1147, partial
MLCRDDSRGTPSPGPRESHLTDLSSLAHEAPGFVFVARTRRPGARGAVVIPSLPTVQWTSHNVAGSELAHVAAIRTLHRTIQSVGATGGVYKGHGRSQRELMTRAYYEFLVEDQQLQ

SEQ ID NO: 154140 - protein, 158 aa, Glycine max
  Coding DNA Sequence Number=SeqID_37362
  Homolog annotation: Hit_ID=Q40538; Match level="QueryCoverage=23%, HitCoverage=66%, E-value=3e-08, Identity=84%"; Hit description =Nicotiana tabacum (clone 5) activating factor DNA sequence
MERLKLEGKKAMQILAKLRQTLHQRKQTVQTLQLTLQAVLLESDAVEKSSAKALQQIKLSENQRCCADQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 154141 - protein, 305 aa, Glycine max
  Coding DNA Sequence Number=SeqID_37363
  Gene Ontology: Mol. function=calcium ion binding; Cellular component =membrane; Biological process=homophilic cell adhesion
  Homolog annotation: Hit_ID=UPI000038D621; Match level="QueryCoverage =27%, HitCoverage=39%, E-value=6e-23, Identity=56%"; Hit description =COG2931: RTX toxins and related Ca2+-binding proteins
  Pfam annotation: Domain name=HemolysinCabind; Domain location=116 -133; Score=28.6; E_value=2.2e-05; Accession=PF00353.9; Description =Hemolysin-type calcium-binding repeat
  Pfam annotation: Domain name=HemolysinCabind; Domain location=134 -151; Score=19.6; E_value=0.011; Accession=PF00353.9; Description =Hemolysin-type calcium-binding repeat
  Pfam annotation: Domain name=HemolysinCabind; Domain location=98-115; Score=20.4; E_value=0.0066; Accession=PF00353.9; Description =Hemolysin-type calcium-binding repeat
  Pfam module annotation: Pfam domain module=HemolysinCabind::HemolysinC abind::HemolysinCabind; Domain location=116-133::134-151::98-115
DLPSQWLLFLSAVPPVQLLTGWCVTAKAPPDISAGKCSGRVPFAIQAAQLLGRAIGAGLFAITPAGERGMCCKAIKLGIRSGNGSIDGTGNELANVLTGNEGANRLDGGAGDDQLFGGQGNDRLLGGSGNDVLDGQSGDDHMEGGAGDDIYHVDSLLDSIVELADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 154142 - protein, 186 aa, Glycine max
  Coding DNA Sequence Number=SeqID_37364
  Homolog annotation: Hit_ID=Q1T493; Match level="QueryCoverage=95%, HitCoverage=40%, E-value=7e-25, Identity=31%"; Hit description =Nucleic acid-binding, OB-fold, subgroup
  Pfam annotation: Domain name=DUF223; Domain location=40-135; Score= -4.6; E_value=0.0077; Accession=PF02721.5; Description=Domain of unknown function DUF223
MARIPDKIRSIDGSKDTLKLAVRITDLWFVGTPNKSEQAEMVFVDSEGDQIHAICKSDHLKPWKADLKENCTYVMHNFKVVKNDGQFRVCEHKYKLFFIGVTVVREADLHELPFKEFRFVEFANVVAGNFVSGLLSCTLWENYCTQFLSYLNERGDDGPMVIILTHTKIKDAQGSYPASVSNSFKA

SEQ ID NO: 154143 - protein, 341 aa, Glycine max
  Coding DNA Sequence Number=SeqID_37365
  Homolog annotation: Hit_ID=Q1RTB4; Match level="QueryCoverage=65%, HitCoverage=51%, E-value=3e-11, Identity=26%"; Hit description=IMP dehydrogenase/GMP reductase
LAAIDAFLAYHHSKESPVVAILADLFDTFDRSTINWFPRWKEGKEGVLFSCGDYPNVPLIGTRGCINYNPALAIRQLGYPMRGAPTEESLSPFLVRDLGTQGLKVIQRIHKAWRSPLRKDKELRGIQNGVIGAPEEDEEVRALKLELGKARLAKEKFKSAATHIRKECTELQEENAVTVRALEQETKRARKEEYGREKFRGALWGSNNELKLRRKERDRSRVHGMILKEELIVCARSKRSLAQHLEATEQSMLAIIGQYKEELNQSVAHEQKLVEDFAQVYAEKEARGRVIDALHQEATMWMDRFALTLNGSQDLPRLLAKAKSMAEVCTAPEEIHGLINY

SEQ ID NO: 154144 - protein, 150 aa, Glycine max
  Coding DNA Sequence Number=SeqID_37366
MATRNQPKDVAKGSGCDIGDSLASYVRRGKGKLENPEYEVCASRPGYKNKRGSQLGKIHNICQETVETNGKRTLTKSGTQSQQLLVQWQGKLSDEATWEGRCRDDQQPIPRFQPWGQGCFWGGDIVRPVSEFPKQTLQVYYRRKGKRGNK

SEQ ID NO: 154145 - protein, 165 aa, Glycine max
  Coding DNA Sequence Number=SeqID_37367
MASADDISGKLKSSSDLVLSKQDEKVEKSDKNGLSDIEQLVQGKKFSRVEFDRLVAVLNSRVMDLSNVEQGKEITNLSSRKDDEGLAMTRGLPKVSNEQRLEESTGAIWGTSTPLGLSKSLREKRRKLEDIIVDSELKGWLQTDSVSLFIERTNTITHNLTKAVN

SEQ ID NO: 154146 - protein, 397 aa, Glycine max
  Coding DNA Sequence Number=SeqID_37368
  Gene Ontology: Mol. function=nucleotide binding; Biological process =defense response
  Homolog annotation: Hit_ID=Q9SX38; Match level="QueryCoverage=55%, HitCoverage=26%, E-value=4e-31, Identity=33%"; Hit description =Putative disease resistance protein At1g50180
MPQAIVNFIVQSLGNLLIQEGMFLYRVEDKVLQLQTELRMMRSYLQVADRKQDGNESLRNWISEIREAAYDYDDVVESYALRGASRRKLTSVLSLIKRYALNINKFIETHKVGSHVDNVIARISSLTRSLETYGIRPEEGEALNSMHGKQRSLSSYSHVIEEDIIGVQDDVRILELCLVDPNKGYRVVAICEMGGFTWINLIRRKLRGQKRMRIYFCLLWIIYLYEERKNEAHGRRRDTRRKKKWLAGEHQEKNNAHGKRCSQKKVLAEEGSGMVGNGMLQCNSSWPLKKPCKALKQTVGVGVRPHSGILLVCVDAKSIGKCTRHLQTEIMIVNESKSMFYSNYKAINVSNAKLALSLEGDKRLVERAHDALSACLRDRFPSRFLLSTKRIDASLSG

SEQ ID NO: 154147 - protein, 145 aa, Glycine max
  Coding DNA Sequence Number=SeqID_37369
MKIILSLRMRSVKLMLVSTAQNEEEGALKEATEKAEDVHPSKDKALEAEVGEPSRVHKDVPYVHIPTPLVVVVIVTVEPSSRSTESRLTFLEKQVRPSLILEVVAMQHEPPSLPRAKTMPSSSSKIHLLASMNDFPLWTSLLFFD

SEQ ID NO: 154148 - protein, 82 aa, Glycine max
  Coding DNA Sequence Number=SeqID_37370
MKTFLRSYKIPQSILETHNSDMNANKIFCRYSNPLSQVKAYCPNTSNPMERTHQILPLNTKSTFHGNETAMERWQTEVTGQA

SEQ ID NO: 154149 - protein, 74 aa, Glycine max
  Coding DNA Sequence Number=SeqID_37371
MERKSKGERIQRPQWKWKSEKCKGMNSADPTETRKDKTISSALLETKKCIEHFSPSIQAFIYLIMEMRLISAKK

SEQ ID NO: 154150 - protein, 120 aa, Glycine max
  Coding DNA Sequence Number=SeqID_37372
MGPIHRRRRSVVTTRRHIFIADVTQEMMEHNNPLVLPATALNFLFGSKKYVPIQRAYGRRKQWQITVHNGLPSIAEPWFQHLSQNNLMAGDEVMFFFRFDEHVWETIFRKQVIWEEDLPV

SEQ ID NO: 154151 - protein, 110 aa, Glycine max
  Coding DNA Sequence Number=SeqID_37373
MDSFSNQSRGSSSQLSAQDLKNQLKNQLAIEYAQQFLEPGLELGRKNLTHKLMALFIFSMKVIRVYGGIGIALGERRKHRWVEGENSNGMWQRGEFSRMGVEERHKKFRP

SEQ ID NO: 154152 - protein, 232 aa, Glycine max
  Coding DNA Sequence Number=SeqID_37374
  Gene Ontology: Mol. function=molecular_function; Cellular component =cellular_component; Biological process=biological_process
  Homolog annotation: Hit_ID=O80327; Match level="QueryCoverage=97%, HitCoverage=93%, E-value=6e-88, Identity=64%"; Hit description =Thaumatin-like protein 1 precursor
  Pfam annotation: Domain name=Thaumatin; Domain location=14-229; Score= 222.4; E_value=1e-63; Accession=PF00314.8; Description=Thaumatin family
  Subcellular localization annotation: CTP_CleavageSite=85; ConfidenceScore=5.41e-01
MYAGAYSATFTVTNNCAFTIWPATLTGGGNSQLPSTGFELTSKASSTIDVTAPWSGRFWAKSQCSTDTYGKFTCATGDCGSGQVPCNGNGGTPPVSLVEFTLASNKGQDFYDVSLVDGFNLPVLVIAQGGLRGCNTTSCPSDVNKVCPPNFAVKGSDGSVIACKSARLALDQPEYCCTGPFASADKCPPTPYSVIFKNQCPQAYSYAYDDRTSTFTCSGEQTIPSHFAPKPK

SEQ ID NO: 154153 - protein, 161 aa, Glycine max
  Coding DNA Sequence Number=SeqID_37375
  Gene Ontology: Cellular component=ribonucleoprotein complex; Biological process=mRNA metabolic process
  Homolog annotation: Hit_ID=Q17E06; Match level="QueryCoverage=40%, HitCoverage=39%, E-value=4e-12, Identity=58%"; Hit description=Small nuclear ribonucleoprotein, core, putative
  Pfam annotation: Domain name=LSM; Domain location=5-137; Score=59.3; E_value=1.3e-14; Accession=PF01423.12; Description=LSM domain
MSAGPGLESLVDQTISVITNDGRNIVGVLKGFDQATNIILDESHERVYSTKMLDISETKRNLSMIKKDHLLRSWFYNPNNNTLIFLGELVTWIHYIIGFARTNFMQYTSSSMPLEGVQQLVLGLYIIRGDNISVVGELDEELDSSLDLSKLRAHPLKPVIH

SEQ ID NO: 154154 - protein, 98 aa, Glycine max
  Coding DNA Sequence Number=SeqID_37376
MTSLGLSLYLTWYQHHSHMWHQQLAINLCGGILHGVVVRVETEAREEGHKESLGVESVSVAKVGAKIVFKDPLDEGISMSMMGGVSGAVITVRCGGSA

SEQ ID NO: 154155 - protein, 182 aa, Glycine max
  Coding DNA Sequence Number=SeqID_37377
MEAAENDSVVLETTEPSSSHGSDGDDHLRQSSDVLAKGLSSMLSSVISDFDFRAQQTLQSQNHLSSVIDRLTGELDQLLEDAPLPFIMQQAAKISSVRKRVSSLNLLLKSIQGRIDNIDRMLSIGPTHGSPEASRLLWLDKESGQHALSASRATEDVDNPISYDIYDMILTRTIGLEVLSLQ

SEQ ID NO: 154156 - protein, 139 aa, Glycine max
  Coding DNA Sequence Number=SeqID_37378
  Homolog annotation: Hit_ID=Q9ZV02; Match level="QueryCoverage=63%, HitCoverage=49%, E-value=2e-16, Identity=38%"; Hit description =Similar to MtN3 protein
  Pfam annotation: Domain name=MtN3_slv; Domain location=45-91; Score =4.6; E_value=0.0019; Accession=PF03083.6; Description=MtN3saliva family
MCIIYAPRKQKISTLVMILIADIGGLALTMLIIITFAVKAINRVHAVGWICAISSIAVFAAPLSKMIPNVLGFLFGISQMILYMIYKNAKKNGETNCTEPARKGGHSELQTAQLQWQQIRFPISGGNERESTQSSLMLC

SEQ ID NO: 154157 - protein, 215 aa, Glycine max
  Coding DNA Sequence Number=SeqID_37379
  Homolog annotation: Hit_ID=Q6AVG1; Match level="QueryCoverage=40%, HitCoverage=21%, E-value=2e-19, Identity=54%"; Hit description =Expressed protein
MERPKTYQIPPLENCVIASNALRVHRHIQESMGGQERGIAAVLCLNLSFSLQAFLYPVITPITTILPSPLSSSRLLSVTAPPSLKSFSSSQNTMFNSPSIELKTSLMHNMTYQELFLKASSMISGTQDFTEQTVPKVAFMFLARGPLPLAPLWEKFFKGHDGFYSIYLHQHPCFSETMPEDSVFYGRNIPSEVSLPLLIFISLQTHHKHGVIHAT

SEQ ID NO: 154158 - protein, 184 aa, Glycine max
  Coding DNA Sequence Number=SeqID_37380
  Gene Ontology: Mol. function=nucleic acid binding; Cellular component= nucleus; Biological process=DNA integration
MTRISSIQVLIALASKHKLVVHQMDVKTDFLNNDLEEEIYMTQPKGCVILGQENKVCKLLKPLYGLKQARKQWHDKFNRALLDDVLRTKAFLSSKFDMKDRGEASVILEVRIIRKGDSIQLSQGHYVEKFLKRFGYHDLNPMRQNPLVVMCSHLAEVQLYGDQQRIHNCKINNGIRVCSFGVSW

SEQ ID NO: 154159 - protein, 102 aa, Glycine max
  Coding DNA Sequence Number=SeqID_37381
MEDWGIFSIESLRRILRVMLRLRYSSWCGGLAASNDGSWQPPVIVGGGEGGVRCANSHSVQLPLHYGSLSVIPSRVGIALSAPFALSETEIFVIFKIPTVRL

SEQ ID NO: 154160 - protein, 106 aa, Glycine max
  Coding DNA Sequence Number=SeqID_37382
MLLETKSGGIGARVVFDERQKHDSNSPINLDLNEEVIMWLFVSPIGQTSSTTLAIVGLLLRLRRRVIVGGDNETGGCDRDGRGQGSNSIFGLTVKGRAEEGEGILT

SEQ ID NO: 154161 - protein, 715 aa, Glycine max
  Coding DNA Sequence Number=SeqID_37383
  Gene Ontology: Mol. function=binding; Cellular component =intracellular; Biological process=metabolic process
  Homolog annotation: Hit_ID=Q1T265; Match level="QueryCoverage=92%, HitCoverage=98%, E-value=0.0, Identity=45%"; Hit description =Tetratricopeptide-like helical
  Pfam annotation: Domain name=PPR; Domain location=107-141; Score=8.0; E_value=0.84; Accession=PF01535.11; Description=PPR repeat
  Pfam annotation: Domain name=PPR; Domain location=173-207; Score =32.6; E_value=1.4e-06; Accession=PF01535.11; Description=PPR repeat
  Pfam annotation: Domain name=PPR; Domain location=208-242; Score=0.3; E_value=6.9; Accession=PF01535.11; Description=PPR repeat
  Pfam annotation: Domain name=PPR; Domain location=274-308; Score =32.3; E_value=1.7e-06; Accession=PF01535.11; Description=PPR repeat
  Pfam annotation: Domain name=PPR; Domain location=309-343; Score =44.6; E_value=3.3e-10; Accession=PF01535.11; Description=PPR repeat
  Pfam annotation: Domain name=PPR; Domain location=410-444; Score =40.0; E_value=7.9e-09; Accession=PF01535.11; Description=PPR repeat
  Pfam annotation: Domain name=PPR; Domain location=445-479; Score =19.0; E_value=0.017; Accession=PF01535.11; Description=PPR repeat
  Pfam annotation: Domain name=PPR; Domain location=481-514; Score=8.6; E_value=0.71; Accession=PF01535.11; Description=PPR repeat
  Pfam annotation: Domain name=PPR; Domain location=547-581; Score=5.8; E_value=1.5; Accession=PF01535.11; Description=PPR repeat
  Pfam annotation: Domain name=PPR; Domain location=72-106; Score=27.1; E_value=6.4e-05; Accession=PF01535.11; Description=PPR repeat
  Pfam module annotation: Pfam domain module=PPR::PPR::PPR::PPR::PPR::PP R::PPR::PPR::PPR::PPR; Domain location=107-141::173-207::208-242::274- 308::309-343::410-444::445-479::481-514::547-581::72-106
  Subcellular localization annotation: CTP_CleavageSite=79; ConfidenceScore=5.01e-01
MDPIEECATVYITHSTQSSSIWKQLTSTKVAPSVPTNIPSHLGLRLLKAALNVGDFRRAQQLFDNIPQPDPTTCSTLISAFTTRGLPNEAIRLYASLRARGIKPHNSVFLTVAKACGASGDASRVKEVHDDAIRCGMMSDAFLGNALIHAYGKCKCVEGARRVFDDLVVKDVVSWTSMSSCYVNCGLPRLGLAVFCEMGWNGVKPNSVTLSSILPACSELKDLKSGRAIHGFAVRHGMIENVFVCSALVSLYARCLSVKQARLVFDLMPHRDVVSWNGVLTAYFTNREYDKGLALFSQMSSKGVEADEATWNAVIGGCMENGQTEKAVEMLRKMQNLGFKPNQITISSFLPACSILESLRMGKEVHCYVFRHWLIGDLTTMTALVYMYAKCGDLNLSRNVFDMICRKDVVAWNTMIIANAMHGNGREVLLLFESMLQSGIKPNSVTFTGVLSGCSHSRLVEEGLQIFNSMGRDHLVEPDANHYACMVDVFSRAGRLHEAYEFIQRMPMEPTASAWGALLGACRVYKNVELAKISANKLFEIEPNNPGNYVSLFNILVTAKLWSEASEARILMKERGITKTPGCSWLQVGDRVHTFVVGDKNNMESDKIYNFLDELGEKMKSAGYKPDTDYVLQDIDQEEKAESLCSHSEKLAVAFGILNLNGQSSIRVFKNLRICGDCHNAIKYVSKVVGVTIIVRDSLRFHHFRNGNCSCQDLW

SEQ ID NO: 154162 - protein, 139 aa, Glycine max
  Coding DNA Sequence Number=SeqID_37384
MVGSMNSTSRQGDNSSKGQMNRGTMNLIDNGASHNFISISQQSLMESDYGMQIGRGPKGAAKKPLTMKFMQQEKVKKIRGDPGLSKTLISPQAWMKMIEIKAFSMLWVMESELAESMRLNQVQCDMLEGGAITIKVNSG

SEQ ID NO: 154163 - protein, 110 aa, Glycine max
  Coding DNA Sequence Number=SeqID_37385
  Homolog annotation: Hit_ID=Q10F11; Match level="QueryCoverage=78%, HitCoverage=21%, E-value=3e-12, Identity=51%"; Hit description =Vegetatible incompatibility protein HET-E-1, putative, expressed
  Pfam annotation: Domain name=WD40; Domain location=25-63; Score=17.6; E_value=0.045; Accession=PF00400.22; Description=WD domain, G-beta repeat
MTESFLHQEAMMASNAKVWDVYGNMKGTLEGPGPEGDIVWLMWHPSEHKVVAGCVDSSVWMWGGVTFAHLNTFLGHGDLVTYGDFTPNDTNFSSFGAFFVYSYYLHSYYI

SEQ ID NO: 154164 - protein, 571 aa, Glycine max
  Coding DNA Sequence Number=SeqID_37386
  Gene Ontology: Mol. function=calcium ion binding; Cellular component =mitochondrion; Biological process=protein amino acid phosphorylation
  Homolog annotation: Hit_ID=Q6Z7E0; Match level="QueryCoverage=84%, HitCoverage=83%, E-value=5e-89, Identity=31%"; Hit description =Putative pentatricopeptide (PPR) repeat-containing protein
  Pfam annotation: Domain name=PPR; Domain location=100-134; Score=7.2; E_value=1; Accession=PF01535.11; Description=PPR repeat
  Pfam annotation: Domain name=PPR; Domain location=135-169; Score =25.5; E_value=0.00019; Accession=PF01535.11; Description=PPR repeat
  Pfam annotation: Domain name=PPR; Domain location=170-204; Score =40.0; E_value=7.9e-09; Accession=PF01535.11; Description=PPR repeat
  Pfam annotation: Domain name=PPR; Domain location=205-239; Score =23.9; E_value=0.00058; Accession=PF01535.11; Description=PPR repeat
  Pfam annotation: Domain name=PPR; Domain location=240-274; Score =49.3; E_value=1.3e-11; Accession=PF01535.11; Description=PPR repeat
  Pfam annotation: Domain name=PPR; Domain location=275-309; Score =35.5; E_value=1.8e-07; Accession=PF01535.11; Description=PPR repeat
  Pfam annotation: Domain name=PPR; Domain location=310-344; Score =40.7; E_value=5e-09; Accession=PF01535.11; Description=PPR repeat
  Pfam annotation: Domain name=PPR; Domain location=345-379; Score =30.8; E_value=4.7e-06; Accession=PF01535.11; Description=PPR repeat
  Pfam annotation: Domain name=PPR; Domain location=414-448; Score =27.5; E_value=4.7e-05; Accession=PF01535.11; Description=PPR repeat
  Pfam annotation: Domain name=PPR; Domain location=449-483; Score =43.6; E_value=6.6e-10; Accession=PF01535.11; Description=PPR repeat
  Pfam annotation: Domain name=PPR; Domain location=484-518; Score =34.9; E_value=2.7e-07; Accession=PF01535.11; Description=PPR repeat
  Pfam annotation: Domain name=PPR; Domain location=519-553; Score=3.7; E_value=2.7; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=100-134::135 -169::170-204::205-239::240-274::275-309::310-344::345-379::414 -448::449-483::484-518::519-553
  Subcellular localization annotation: CTP_CleavageSite=47; ConfidenceScore=5.48e-01
MASLLNTVSPAANLSHKTKRPTCGGFLHSQVPNLHTFTLHKGFSRVSASTQIAISPKDTIFNLPNWRIGRNDQKGKELRIYDAFLHLEYLVGKGQKPEVNQATQLLYDLCKFNKARKAVRVMEMMVGSGIIPDAASYTHLVNFLCKRGNVGYAIQLVEKMEGHGFPTNTVTYNTLVKGLCMHGNLNQSLQLLDRLTKKGLVPNAFTYSFLLEAAYKERGVDEAMELLDDIIAKGGEPNLVSYNVLLTGLCKEGRTEEAIKLFRELPAKGFSPSVVSFNILLRSLCYEGRWEEANELLAEMDKEDQPPSVVTYNILITSLSLHGRTEQAFKVLDEMTRSGFKASATSYNPIIARLCNEGKVDLVLQCLDQMIHRRCHPNEGTYSAIAMLCEQGKVQEAFFIIQSLGSKQNFPMHDFYKNLIASLCRKGNTYPAFQMLYEMIKYGFTPDSYTYSSLIRGMCREGMLDEALNIFRILEENDHRPDIDNYNALILGFCKAQRTDLSIEIFLMMVNKGCVPNENTYTILVEGLAFEEETDIAADLMKELYLKKVLSQSTVERLCMQYDIKELVATG

SEQ ID NO: 154165 - protein, 483 aa, Glycine max
  Coding DNA Sequence Number=SeqID_37387
  Gene Ontology: Mol. function=transferase activity, transferring glycosyl groups; Cellular component=integral to membrane; Biological process=metabolic process
  Homolog annotation: Hit_ID=Q8S9A3; Match level="QueryCoverage=85%, HitCoverage=99%, E-value=1e-151, Identity=70%"; Hit description =Glucosyltransferase-6
  Pfam annotation: Domain name=UDPGT; Domain location=8-472; Score= -62.3; E_value=1.8e-07; Accession=PF00201.9; Description=UDP -glucoronosyl and UDP-glucosyl transferase
MAKTTNIAVVSIPAFSHQASIVGFCKRLVHLHDHFHVTCIFPTIDAPIPATLAMLESLPSNIDYTFLPPVQKQDLPQNASSLVLVQTAVSYSMPSFRDLLRSLVSTTSFAALVADPFTNEAVEIAKGEFNLLSYIYFPISAMTMSLLLHLPKLHQQVLCEYKDHKEAIQIPGCLPLQGHDLPSDFQDRSCVDYELILQRCKRLPLADGFLVNSFYEMEKGTLEALQEHCKGSNNNNSCVYLVGPIIQTEQSSESKGSECVRWLEKQRPNSVLYVSFGSGCTLSQQQLNELAFGLELSGQNFLWVLKAPNDSADGAYVVASNDDPLKFLPNGFLERTKGHGYVVTSWAPQTQILGHTSTGGFLTHCGWNSALESIVLGVPMVAWPLFAEQGMNVVLLNEGLKVALRPKINENGVVEREEIAKVIKGVMVGEEGNEIRGRIEKLKDAAADALKEDGSSRMALYQFGTQMENVGKCLSYSLMEVTK

SEQ ID NO: 154166 - protein, 76 aa, Glycine max
  Coding DNA Sequence Number=SeqID_37388
MLQNSDKSYVSSLSPLNLDFLNVQQVWKAVGLWRKISDQMHTSDSAKDLIFELLQSLPMEETHIFVMTLVYLEAVE

SEQ ID NO: 154167 - protein, 615 aa, Glycine max
  Coding DNA Sequence Number=SeqID_37389
  Homolog annotation: Hit_ID=Q10MM5; Match level="QueryCoverage=17%, HitCoverage=11%, E-value=4e-14, Identity=41%"; Hit description =Expressed protein
SFPPHGHERDVVLPISQEKLISLVTEAKGKNNAHQSWSEPTARRMPMPHDGPAKWNSSCLSSRTLEDDASSFALKHKTQTQEQMLSSERYSSGSTTSDMQVKRVLSSMSAVNGTKDFVAMNRSLSGRSRMRSPTKADSSKFDLEKKPYNRQQSSLSHGRTLERKRRIPNVTQLEGAGSVYSVDAKQRNLHSGGMGGKIRDFNASSLNNSIVKNKQVGQGERFIKVNDNKINVVSFNPPLKQKIGIHGKREETSSDNESMRYFRRPSPLRVDALGAFLEQKLKELTSQRDEELATGAPPKKSSAMILQELISALSSENLICHDDHHMFNENVGFHYGAKQERLLGTSCNGNHLSPGSVLEASFSSSSLDESSGHGFHPDSMNYSYYGQLEHDTELSDSATSFKKGSTGEMLSDLINQIPRALESLLTLGTELTRSKLGHMKDILLHAELVLGIATDRREDEGPQLLIYRFLGDDLDSMASDAMWTDANGVVVGCEDSKQRKELKGFLLDCVIEYLESNCCQYFNSGSKAWTKLPLCMKAEMLAQEVKREINEWLSMVGMVPDEIIEWEMSHSLGKWTDFDIEAFEAGVDIDGDILQILVDEVVQDLAGCKQGTISF

SEQ ID NO: 154168 - protein, 712 aa, Glycine max
  Coding DNA Sequence Number=SeqID_37390
  Homolog annotation: Hit_ID=Q9LHJ0; Match level="QueryCoverage=89%, HitCoverage=92%, E-value=1e-153, Identity=47%"; Hit description =Arabidopsis thaliana genomic DNA, chromosome 3, P1 clone: MMP21
SAVEWAHKDDVLNWYQQNAYDNEGSLDGRRMSSQPHSSLSQLHEPKALYRTSSYPEQQRQQQHLQLQPSESAPNWIDQHLYGTETTQDGKRWSSKPHSTIAHLPESRPLHRTSLYPDKQQEFSHLSSEPILVPNSSFTSYPPPGGRSHQASPSQNSGHLNLPYHATGAQMALSPPNRSHFPNSALQLSGINHGPPFGGNMRQFSTGSPLNQIIQNQLVNQAGLYPGDHPNISSGIPMINKYDQMLGLMELRDQIPKSAQLGRQNLRFPPQGFDMGGLRSNSGWPRFRSKYMTTEEIENILRMQLVATHSNDPYVDDYYHQGCLAKKSSGAKLRHHFSPAQIKELPLRPSSNAEPHAFLQVDALGRVPFSSIRRPRPLLEVDPPNSSHAGSPEQGISEKPLEQEPMLAARVTIEDGIYLLLDVDDIDRFLQFNQLQDGGLVLKRKRQGLLEGLAASLQLVDPLGKNGHTVTLAAKDDFVFLRIVSLPKGRKLLGRYLQLLFPGGELMRTVCMAIFRHLRFLFGGLPSDPSAAETISNLARVVSRCIREMDLSAISACLAAVVYTSEPPPLRPLGSSAGDGASLILVSVLERATELLTDPHAASNYNIANRSLWQATFDEFFGLLTKYCVNKYDSVMQSFLIQGTPNMASIGSDVARAISKEMPVELLRASLPHTDDRQKKQLLDFAQRSIPIVGFNSNSGGQGHHVNSESVLS

SEQ ID NO: 154169 - protein, 317 aa, Glycine max
  Coding DNA Sequence Number=SeqID_37391
MNDSSVKNLAITEKKVQQHKPGGCVGIFFQLIDWKRKLSKKKLFSKKLLPPARAKKFKGDEKMPNSKLHLIANENSGGFPSAKKGGNHGVDGEQKSDLRVPSLVARLMGLESIPAAQRDKSKKAVLADVCADGKKESSADHGELDRQGVDLEMGVVKHDSRPQKLQKTGVYERRAVTRFGAEALQIKSVLSRARKYNHHHPKLASSLKSPRVPSGKSASRSARLIGAATKILEPGLQSRSRAKNSLTYPASLYPHKTGIVSNGVEDGSAIMQNQSCYKTSPCKQLMGQTSCKNCGNLLDVVDCKLEVGGQPLVPPPI

SEQ ID NO: 154170 - protein, 68 aa, Glycine max
  Coding DNA Sequence Number=SeqID_37392
  Subcellular localization annotation: CTP_CleavageSite=54; ConfidenceScore=5.18e-01
MGHPTRKKALVKYINVSVIGTTTGNRGSVCWVMLGLRLSAILCCGSVNSLLFMRCNSRAVNALAPTNL

SEQ ID NO: 154171 - protein, 846 aa, Glycine max
  Coding DNA Sequence Number=SeqID_37393
  Homolog annotation: Hit_ID=Q9LHJ0; Match level="QueryCoverage=93%, HitCoverage=98%, E-value=1e-156, Identity=43%"; Hit description =Arabidopsis thaliana genomic DNA, chromosome 3, P1 clone: MMP21
MNSETTVIKRITPTSGLGTGPMAGSVLLLDWVLISSNWLRTGFNQYEPSPSEPFHLLNKVVSGPRSAGVIGERGSRENSTSEWSQREDSFNWYDQNAYDSEGSTDGKRWSSQPHSSLAHLHDSKPLYRTSSYPEQQRQEQHYHLQHCSSEPVPNWLDQHFCDAETAHDHDGKRWSSQPHSSVAHLQESKPLYRTSSYPEKQQELPRFSSEPILVPKSSFTSYPPPGGLSQLGSPSHSTGHLNIPYHTGAAQMALSSQNRSHLSNSALQSSALNLGSHFGGNTRQFPTGSHLNQRIQNQLVNQAGLYPGDHSNLLNNMLQQQLHLHNGSVSPHLMTQLQQQQHRLHHPGQRSAGYLSGFQSHLFNPHPSSGSSVISKYEHMHGIADGRDHRSKSTHKGKHSLRFSLHGSDAGSQKSDSGSFQFRSKYMTSDEIESILRMQHAVTHSNDPYVDDYYHQACLAKKTSVAKLKHPFCPSQIREYPPRSRANTEPHSFVQIDALGRVSFSSIRRPRPLLEVDPPNTSASSDQKISEKPLEQEPRFAARVTIEDGLCLLLDVDDIDRYLQLNQPQDSGTHLRRRRQVLLEGLATSLQLVDPLGKNGHKVGLAAKDDLVFLRLVSLPKGRKLLAKYLQLLPPGSELMRIVCMTIFRHLRFLFGGLPSDPAASETTNNLAKVVCQCVRGMDLGALSACLAAVVCSAEQPPLRPIGSTSGDGASLILISVLERATELLTDPHAACNFNMGNRSFWQASFDEFFGLLTKYCMNKYHSIMQSMLIQSTSDVDDIGPDAAKSIGREMPVELLRASLPHTDERQRKLLLDFAQRSIPVVGFNSNTGGSGSHVNSETVLS

SEQ ID NO: 154172 - protein, 45 aa, Glycine max
  Coding DNA Sequence Number=SeqID_37394
MDGFRAGGHVGGTPNTEDLGQLGNAPTVYIQQPFKLHVPSSYMAR

SEQ ID NO: 154173 - protein, 69 aa, Glycine max
  Coding DNA Sequence Number=SeqID_37395
MVCIMKTNWYKEMYVKVMDTNDTMQAHVLGHKMTEFDAFLFSTQLFLLHIMPNQDAMVLLSSNAALTVL

SEQ ID NO: 154174 - protein, 89 aa, Glycine max
  Coding DNA Sequence Number=SeqID_37396
HRRRHTRCNLDNINLDSVNNVELVDPSFNWISSPSRGFIDIDWGRGTSPSTSKDKMARTSSNAGNCSNIVVSTLSDGSLLVELLWRLDL

SEQ ID NO: 154175 - protein, 131 aa, Glycine max
  Coding DNA Sequence Number=SeqID_37397
  Gene Ontology: Mol. function=protein dimerization activity
  Pfam annotation: Domain name=zf-C2HC_plant; Domain location=46-90; Score=18.3; E_value=0.00027; Accession=PF07567.3; Description =Protein of unknown function, DUF1544
GTSTWIVVTENKRGYISCGSVQVEGTSTWLFKENKGGYIPCGSLLVKVFTRVKCKYCAKTISGGVFRFKHHFVETREDYEPCATVPDEIKLPIMKIVVESKATKENKRRLNSINEDEESAEGVEASQATDL

SEQ ID NO: 154176 - protein, 104 aa, Glycine max
  Coding DNA Sequence Number=SeqID_37398
LYSSIIDGYGGIEDMGMVGVTGEAKERGRTFHVRLEGVEVVAIDKGQGGDRGVGLKGTKLEMVREWIWDGEHSFYTGSAKSVAYVQSPSNPLGSSTILQILYNF

SEQ ID NO: 154177 - protein, 72 aa, Glycine max
  Coding DNA Sequence Number=SeqID_37399
MMKIGSCGSRFGEETSEIWCLEVWGRRGATRKGVAAQRCWFTSSFIKRTTAHNLPSEHDLLENGAEFLYPWF

SEQ ID NO: 154178 - protein, 61 aa, Glycine max
  Coding DNA Sequence Number=SeqID_37400
MREGKTVNSMVRILESGLGKDDTTVRKSTPNPPNPTCQMHITVISNYAHNDGISGERKNRI

SEQ ID NO: 154179 - protein, 177 aa, Glycine max
  Coding DNA Sequence Number=SeqID_37401
  Gene Ontology: Mol. function=hydrolase activity, hydrolyzing O -glycosyl compounds; Cellular component=cell wall; Biological process= carbohydrate metabolic process
  Homolog annotation: Hit_ID=Q8L9A9; Match level="QueryCoverage=34%, HitCoverage=21%, E-value=8e-26, Identity=80%"; Hit description =Probable xyloglucan endotransglucosylase/hydrolase protein 8 precursor
  Pfam annotation: Domain name=Glyco_hydro_16; Domain location=49-177; Score=-45.0; E_value=0.00032; Accession=PF00722.11; Description =Glycosyl hydrolases family 16
MNRDEGYETIGSQGCRYGEICVHWLCLLQFSSAWWLCNVMMKKHPTGKFSLLHGFATSPARKYPDIDSYSCTSAKRGSKDTSRRFRRVQAKHRAMNNINDYAESLFQMCLENGARPERDELDFEFLGNKTGEPYLIQTNVYKNGTGGRKMRHMLWFDPTEDYHTYSIHEGRIRMRSC

SEQ ID NO: 154180 - protein, 46 aa, Glycine max
  Coding DNA Sequence Number=SeqID_37402
MFLAVPNALAKQSENEKSPSPTSKISSELRCWRLKKFPTKCYGESK

SEQ ID NO: 154181 - protein, 52 aa, Glycine max
  Coding DNA Sequence Number=SeqID_37403
MAEKQKLNFGTQMMSSDSVLPLPENPIIVGFGGVGVDFLAVVPTFPKPDSKI

SEQ ID NO: 154182 - protein, 107 aa, Glycine max
  Coding DNA Sequence Number=SeqID_37404
MENTQCSVRTAEVRFKTSPTIEEETMQWKLNISCEEDKQKKITNEEDKQKKKKKACIRSMHISRFIKNFLNPCTCKSPAPMAISSLQIACTNGDFLSAALLHCHGRN

SEQ ID NO: 154183 - protein, 76 aa, Glycine max
  Coding DNA Sequence Number=SeqID_37405
MSTQTCSGKSMNLDSLTVGLSSKLNYFCPETLTPPLPPLTTTGGHQKSSLLVLEPPHGEEHFNQSGILRIHLKDLV

SEQ ID NO: 154184 - protein, 41 aa, Glycine max
  Coding DNA Sequence Number=SeqID_37406
MAKRTDLLWLIRQALESVVFHLLAKPICWLSERPLSATLLG

SEQ ID NO: 154185 - protein, 142 aa, Glycine max
  Coding DNA Sequence Number=SeqID_37407
MTRGNPSDLQPFDPEIDRTFHRLVRHHFVPFEHLEHSITGESVHSVIGDFEHPDFEHYNFEHSDFEHSENMAQPPPRERTLREMAAPDFTYESLCIQYPDEDVPYVLKTRLIHLLPKFHGLAGEDSHKHLKEFHIVCSTMNP

SEQ ID NO: 154186 - protein, 74 aa, Glycine max
  Coding DNA Sequence Number=SeqID_37408
MVVKDRMTPEKEQRGAPNTGEGIGLFWWGWGPKPITIVKIKSSDQSPKGCPTSGQNSGFDNDEDQTRSKNIKEE

SEQ ID NO: 154187 - protein, 411 aa, Glycine max
  Coding DNA Sequence Number=SeqID_37409
  Homolog annotation: Hit_ID=Q9SEE9; Match level="QueryCoverage=27%, HitCoverage=27%, E-value=2e-38, Identity=68%"; Hit description =Arginine/serine-rich protein
  Pfam annotation: Domain name=Extensin_2; Domain location=49-409; Score=-127.3; E_value=0.024; Accession=PF04554.4; Description =Extensin-like region
  Pfam annotation: Domain name=RRM_1; Domain location=95-166; Score =67.3; E_value=5.1e-17; Accession=PF00076.12; Description=RNA recognition motif. (a.k.a. RRM, R
  Pfam module annotation: Pfam domain module=Extensin_2::RRM_1; Domain location=49-409::95-166
MQLQLQLSYGHGDSEIFDLAAKIVVCDSKIFDVVLKLWLRTFQNLVNGLFDFLSAVCIFEFPADATRRGRSPPPQSKRASPPPRKPSPVRESLVLHVEKLSRNVNEGHLKEIFSNFGEVISVELAMDRTVNLPKGYGYVQFKTRGDAEKALLYMDGAQIDGNVIKARFTLPPRQKVSPPPKASAVAPKRDTPRADNASADVDKDGPKRQRESSPRRKPPPSPRRRSPVPRRAGSPRRPDSPRRRADSPVRRRLDSPYRRGGDTPPRRRPVSPGRGRSPSPPRRLRSPARLSPRRIRGSPGRRRSPPPPPRRRSPPRRPRSPPRRSPIGRRRTRSPIRRSARSRSRSFSPRRGRPPVRRGRSSSYSDSPSPRKVSRRSKSRSPRRPLRGRGSSNSSSSSSPPPPPPPPTRKP

SEQ ID NO: 154188 - protein, 172 aa, Glycine max
  Coding DNA Sequence Number=SeqID_37410
  Homolog annotation: Hit_ID=Q9LDY9; Match level="QueryCoverage=47%, HitCoverage=36%, E-value=8e-33, Identity=82%"; Hit description=IojAP protein-like
  Pfam annotation: Domain name=DUF143; Domain location=2-89; Score =31.6; E_value=2.3e-07; Accession=PF02410.6; Description=Domain of unknown function DUF143
MFVVAVELATVASEVKAGDIKVLFVKPLVYWTRFFIIATAFSRPQIDAIGSRIRDRAEKKYGKIPTGDTKPNSWTLLDFGVITFQPPFKQALCSAATQVDPDGTNWKLGYGVQLCANLDPTKDVGRLRQQEDTPLKTKLVKITHCTPTRCIISSLNTANVKMLPSLIPPKPF

SEQ ID NO: 154189 - protein, 443 aa, Glycine max
  Coding DNA Sequence Number=SeqID_37411
MADSDPPSLGRVKLTDLVPWNGLASDSYKISVSILSHSLAQFSAVIVQFPASDGAILRSGLESARMYFHQRETYPPADIINPGLPDIFALFGKAARDILDAISYHLNIRSSPFVEIVDNVPLRNREISSSVLSVCCHARPSFQGPQHHNNITTTQEDGQMIMYPDHDHQVDKSLLSLVKSDRAGLHVRDSQGRWILVDGDLGPQEAIVFPGLALYQATAGYVNPALLKTEINMEANMYGRCSLAFKLLPKSMTNLDCSEMRAAGYGIEAQFQLPVPVDDFMQRSHPTDHLFNRPSLQCFNFQPTHDERRKQNPKSKPLPPSKRLRLEAQRVLKERVQDIADKKGIKLRFCNLKECESHIHSIDSPCANIRMEIGWPLGVPFVHPHDLPNKAKLGFLEAYEPGWTEAHQNSDRLVNTQLTLTATLLLQVSCPYDNAYSTLYLKL

SEQ ID NO: 154190 - protein, 131 aa, Glycine max
  Coding DNA Sequence Number=SeqID_37412
GTPVTFSSRSNGERIGTKGMLLGYLSKKNCGIEIDGDLVLRGMRIRATWEYVSSVKGGQLGMVGSCVICGCGELFCTIARSPPSTTCDGVVPRDMSQGSGDLGDVRRAPGSQPIKEQRPQSKEAYVVAGQL

SEQ ID NO: 154191 - protein, 137 aa, Glycine max
  Coding DNA Sequence Number=SeqID_37413
  Homolog annotation: Hit_ID=Q9LDY9; Match level="QueryCoverage=45%, HitCoverage=26%, E-value=2e-14, Identity=58%"; Hit description=IojAP protein-like
  Subcellular localization annotation: CTP_CleavageSite=51; ConfidenceScore=5.69e-01
MLPSSTVLSLAGTGAGVPVSFSGKLGHLETKFSPRPRKVFSRSCIKGLPLQQNTVNGLKSKKRNTHSSFALGKNAEDSFLSDVNGDTDEMYDELINNYGKVVFSRKDKKPASAEIDDDAESLSYKVSSLRIIICQIM

SEQ ID NO: 154192 - protein, 470 aa, Glycine max
  Coding DNA Sequence Number=SeqID_37414
  Gene Ontology: Mol. function=protein kinase activity; Cellular component=cellulose and pectin-containing cell wall; Biological process=protein amino acid phosphorylation
  Homolog annotation: Hit_ID=Q6H4R9; Match level="QueryCoverage=99%, HitCoverage=74%, E-value=6e-75, Identity=36%"; Hit description =Putative receptor kinase
  Pfam annotation: Domain name=Pkinase; Domain location=202-455; Score =20.0; E_value=9.4e-10; Accession=PF00069.15; Description=Protein kinase domain
  Pfam annotation: Domain name=Pkinase_Tyr; Domain location=195-455; Score=-48.1; E_value=1.6e-09; Accession=PF07714.7; Description =Protein tyrosine kinase
  Pfam module annotation: Pfam domain module=Pkinase::Pkinase_Tyr; Domain location=202-455::195-455
  Subcellular localization annotation: CTP_CleavageSite=49; ConfidenceScore=5.09e-01
LDISNNEISGPLPNLSRISGLNMFLAQNNHLRGTIPAFDFSNFDQFNVSFNNFRGRIPKNVYGYFSADSFLGNPELCGDPLPKNCSDQFMFLSETQAKEESKGPSKQQILMYSGYAALGVIIVLFVVLKLCRREKGIEALKNGVGATDGGGIEKHSNVSSEYKDEVSRSEFSVASESRMVSQSLIVLSRPAAIELKLEDLLRAPAELIGRGKNGSLYKVILDNGIMVVVKRIKDWTISSQDFKQRMQILSQAKDPHVLSPLAFYCSKQEKLLVYEYQQNGSLFKLLHGTPKTFDWTSRLGIAATIAEALSFMHQELGHHGIVHGNLKSSNILLNKNMEPCISEYGVMGMDDQRGSLFASPIDAGALDIFKEDVYGFGVILLELLTGKLVKGNGIDLTDWVQSVVREEWTGEVFDKSLISEYASEERMVNLLQVAIRCVNRSPQARPGMNQIALMINTIKEDEEKSLIYEL

SEQ ID NO: 154193 - protein, 74 aa, Glycine max
  Coding DNA Sequence Number=SeqID_37415
MEVHEDEAWGLLSAIKFVSSLDFNNVMFEFDSKGVVDKIRSSTTNLSELEEIIIECRSLLALNPTYVIGLAKRQ

SEQ ID NO: 154194 - protein, 421 aa, Glycine max
  Coding DNA Sequence Number=SeqID_37416
  Gene Ontology: Mol. function=translation initiation factor activity; Cellular component=cytosolic small ribosomal subunit (sensu Eukaryota); Biological process=translation
  Homolog annotation: Hit_ID=Q2QWZ1; Match level="QueryCoverage=98%, HitCoverage=86%, E-value=0.0, Identity=83%"; Hit description =Eukaryotic translation initiation factor 2 gamma subunit, putative, expressed
  Pfam annotation: Domain name=GTP_EFTU; Domain location=9-179; Score =49.4; E_value=1.2e-11; Accession=PF00009.17; Description=Elongation factor Tu GTP binding domain
  Pfam annotation: Domain name=GTP_EFTU_D2; Domain location=208-282; Score=11.2; E_value=0.027; Accession=PF03144.15; Description =Elongation factor Tu domain 2
  Pfam annotation: Domain name=eIF2_C; Domain location=319-406; Score =186.7; E_value=5.6e-53; Accession=PF09173.1; Description=Initiation factor eIF2 gamma, C terminal
  Pfam module annotation: Pfam domain module=GTP_EFTU::GTP_EFTU _D2::eIF2_C; Domain location=9-179::208-282::319-406
MSWSVTLQSSLAMLMQKYTSVKMNGVQGLCATSGAYGSGKEDSPMCDVPGFENSKMKLLRHVSFVDCPGHDILMATMLNGAAIMDGALLLIAANESCPQPQTSEHLAAVEIMRLQHIIILQNKVDLIQENVAINQHEAISKFIQGTVADGAPVVPISAQLKYNIDVVCEYIVKKIPIPERNFVSPPNMIVIRSFDVNKPGYEVDEIKGGVAGGSILRVNQFIEVRPGIVVKDESGNIRCTPIYSRIVSLYAEQNELQFAVPGGLIGVGTTMDPTLTRADRLVAMPNYPFMPPAMNEDNDPYKISSFISFACQSGGIGSVVNFFLLRRLLGVRTKGSERQGKVSKLAKGEMLMLNIGSMSTGARVVAVKNDLAKLQLTSPVCTSKGEKIALSRRVEKHWRLIGWGQIQAGITLDVPPAPQLS

SEQ ID NO: 154195 - protein, 72 aa, Glycine max
  Coding DNA Sequence Number=SeqID_37417
  Subcellular localization annotation: CTP_CleavageSite=16; ConfidenceScore=5.07e-01
MNHQQQSPVTAYPAVSQSNPAAPPPPVGYPTKDDVPSQQNVPIKTSTRGDGFWKGWESITWTIVAIRNHNPS

SEQ ID NO: 154196 - protein, 144 aa, Glycine max
  Coding DNA Sequence Number=SeqID_37418
MNKLKQEDRHTPKRNITNLQDPKQDPEIREATLEVELEVTKGAFQGTQGLDICRRSEAPLDTYHTNGGIVASRMDTKDFPLNRIQKGTKKRTFWYPNQGYPSSFVLWTTAKVVQKGFRRCQHKTIQAKSMEGLHGRPPIRMKLY

SEQ ID NO: 154197 - protein, 256 aa, Glycine max
  Coding DNA Sequence Number=SeqID_37419
MNALRLTCRTRIVTIEGLSPNPTLNQTLGPCDAPANMVPPPEKDPKGKDRHKKRSHHEHQRGSREPSGHKDGNSREKRLKQQMVEFLPVTTLANLSALANQGFFIKDFQPDRLINPQMIFDHGRKGSPNVDALKDQLSKVDDSLNLVLQPNTMLVGDNKNLENQVLSVTTEVKGLEMHLVNDDALVMSQNDEISRLRSTTLSVFDIKKDVYHGELVPIEEILKDGAPTLERPMTQAEDFHAEGIEADDKENGDHKD

SEQ ID NO: 154198 - protein, 52 aa, Glycine max
  Coding DNA Sequence Number=SeqID_37420
MDVVGGREHPSTKYAGENPSRSASITLPRRFREQIREDFPSFFTVLRSSFFN

SEQ ID NO: 154199 - protein, 95 aa, Glycine max
  Coding DNA Sequence Number=SeqID_37421
MDSLGGSRPLNAPPKIEIHGGGVLSHCFGGGRCSGHDYELGMGLGKNNDGMASLVDIKENCGKFGLSYKPTQTNSICIYVLGRSRSSGGKIRGLG

SEQ ID NO: 154200 - protein, 180 aa, Glycine max
  Coding DNA Sequence Number=SeqID_37422
MTTLTQIWMTLLHSNVLPSDHNFDLPLPKCQLVYAILTQMSVHMAQVIADVIYLFAGMAPTRHPLDPEKSNRALGFLALITGLCQSYGVPITPSKVIRPLITRAFIEKYCTPRQAHDNAHQDTGAPPPPRQADSVGPLCVERYIYHLVRQLAAKHHGQVQIHECLYRFSLSQQGQGSAPF

SEQ ID NO: 154201 - protein, 70 aa, Glycine max
  Coding DNA Sequence Number=SeqID_37423
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=78%, HitCoverage=29%, E-value=3e-19, Identity=80%"; Hit description =Anaphase-promoting complex subunit 10
  Pfam annotation: Domain name=APC10; Domain location=3-70; Score= -87.5; E_value=0.072; Accession=PF03256.7; Description=Anaphase -promoting complex, subunit 10 (APC10)
VGAQSSKLSTLPVNKLIVLFLVFKLDESYTPSKVSIRAGDGFHNLKEIKTVELVKATGWAYLSLSGADPR

SEQ ID NO: 154202 - protein, 130 aa, Glycine max
  Coding DNA Sequence Number=SeqID_37424
MTKLWNYVNYVIYVRGRGCHTVDPEKSNKALGTATKAGSTTLASSRCPITTSTTIAIIRVHLSTLAEDGAPDAHIHFRATVARPRDKPIFQEEASPTNAQRATQGDGGRVEEDEDMAGLVDYFMGGNGSS

SEQ ID NO: 154203 - protein, 151 aa, Glycine max
  Coding DNA Sequence Number=SeqID_37425
MAIVVEVVMGHLLLAKVVEPALVAPRRADKFAQTSCSSPNKILSPGKLVASQGKFEHAAQSGSSEAIIDPSSPIRRNMKWKLARTKKSGRMTSEATRQIADRISITGKVMRQLMLSFIQMQFQGIVHLFELAVVPFGARVNTKGSCVDPLG

SEQ ID NO: 154204 - protein, 37 aa, Glycine max
  Coding DNA Sequence Number=SeqID_37426
MEASLIWEPYQSNQRKKLRNLRKLLEMPLSLSEDTDP

SEQ ID NO: 154205 - protein, 52 aa, Glycine max
  Coding DNA Sequence Number=SeqID_37427
  Homolog annotation: Hit_ID=Q9SZX9; Match level="QueryCoverage=71%, HitCoverage=19%, E-value=1e-07, Identity=73%"; Hit description=60S ribosomal protein L9-2
MAVKGSLRFVYAHFPIKASIGNNNKSIKIRNFLGEKKRFKLVTLRQTLGRNH

SEQ ID NO: 154206 - protein, 119 aa, Glycine max
  Coding DNA Sequence Number=SeqID_37428
MLSACSRSAKLHLRDATRSAMFNGGDVTCFARIIGNLIVYLITWLMEAPLYFPLLQQLTLSLANGSSSLFPIVAAADSFFGSFPVALVLDHILKKGKLHLYGVTDMQLSDDAKILVYSI

SEQ ID NO: 154207 - protein, 107 aa, Glycine max
  Coding DNA Sequence Number=SeqID_37429
MTRSRTKHSEDILQQMKRTFGILTIFCEIFSLGSLLNQPQTYQGASDGGGEYHQLDGSQCLLLDVMTMQMQHLLSRKNEKLYEQIEGLENQLNQNVGRLIWWEQRGQ

SEQ ID NO: 154208 - protein, 191 aa, Glycine max
  Coding DNA Sequence Number=SeqID_37430
  Gene Ontology: Mol. function=methyltransferase activity; Biological process=metabolic process
MRVEYTTRTIKRKGESSLPLAVPRFTPSGFDSTVEEQEFGDLHGMLFMFSNKFTKLSNVEVHRDPGEHVEVKGRGMGRIQPLQSSGRGEFDGEVEKIQGFDFANWLKKTVSKNDFVVMKMDVEGTEFDLIPRLIKTGAICLIDDIFLECHYNRWQRCCPGQRSAKYEKTYDPCLQLFKSLRQSGVLVHRWF

SEQ ID NO: 154209 - protein, 232 aa, Glycine max
  Coding DNA Sequence Number=SeqID_37431
VHLLGLLTENKRGYISCGSVLVEGTSTRFKENKGGRVRVLVERFTETVAVSPSSSRDNQVRWHAKTNMVICSLCRRLNVFRSRLLNSPLRHPETIKSDGMQRQMWSSAPFVGDSMSFNRDCCGLPFVIQRQSSLMACRDKYGHLLPLSKTLSTKTVVVSPLSSRDNQVRWHRQSSPMACGDHHGHSFSLFRDYFSLLYHPETSKSDGVGDDDGHLFLIVSEIIAVPSAIQRE

SEQ ID NO: 154210 - protein, 186 aa, Glycine max
  Coding DNA Sequence Number=SeqID_37432
  Gene Ontology: Mol. function=microtubule motor activity; Cellular component=microtubule associated complex; Biological process =microtubule-based movement
  Homolog annotation: Hit_ID=Q9LY67; Match level="QueryCoverage=72%, HitCoverage=29%, E-value=7e-11, Identity=40%"; Hit description =Kinesin heavy chain-like protein
MLELHYSVVAPPALLMHPRVCPHFVSVQAVCRAKHIKESPRINYSEEKCDTSSSAASPSPSGDESSARILNKLREKLNVEDVKLLEELLIQEGILFEPPSVEEESDIEDLTLQIISSLQTSVEKLTATADELKRENRILRANVDASTESLFYKGANNGSIFQNMILRIPTFFFRWLGYTSSPTGWQ

SEQ ID NO: 154211 - protein, 131 aa, Glycine max
  Coding DNA Sequence Number=SeqID_37433
MVFFLIQKFAMRFPTIYEAESFINVLKEILKGDKDPEPLNTDFGSEISSQSEFMSTNKLSHSRACEDLSFMTPVDNYIPQLPLYANNEVGRPLGSQEKGTTSGHNFEGMLPALPPSFSTLLMDCSQNNHGS

SEQ ID NO: 154212 - protein, 140 aa, Glycine max
  Coding DNA Sequence Number=SeqID_37434
MSAAPSDGVEFANVSGSPLETRAKGFIVISNGMRILEKNNTHGCARSVYLDGEGKGEIKGRRGNRLVKHSLDFRQVRSNAVCRHDVAEEVDVVGDDSGWWDSVRSMAVEWRRMKGDWRCHFKEKMSQEQTHHHRKPWIRA

SEQ ID NO: 154213 - protein, 204 aa, Glycine max
  Coding DNA Sequence Number=SeqID_37435
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=57%, E-value=5e-55, Identity=49%"; Hit description =Integrase, catalytic region
  Pfam annotation: Domain name=rve; Domain location=17-148; Score=16.8; E_value=0.00023; Accession=PF00665.16; Description=Integrase core domain
MKYETQKPTRLLQSLPTPSVVWENLSLNFIMGLPLSSGVSTILVVVDRFSKGIHFGTLLPHYTAYRTTFLFRDMELFRLSGTKLRVSTAYHPQTNGQTEVLNRVLEQYLRSYIHDKPSQWVKFLSLAKCCYNTSVNSSTRFSSFEVIYGRPSPSIPHYLVGSSTMEATNALLSTKADMHATLQRLLLKTQTTMKVAADVHCRDI

SEQ ID NO: 154214 - protein, 88 aa, Glycine max
  Coding DNA Sequence Number=SeqID_37436
  Gene Ontology: Mol. function=microtubule motor activity; Cellular component=microtubule associated complex; Biological process =microtubule-based movement
  Homolog annotation: Hit_ID=Q69UI4; Match level="QueryCoverage=100%, HitCoverage=14%, E-value=2e-24, Identity=52%"; Hit description =Kinesin 1-like
MSNITVCARFRPSNSKEKQNGNDSGCIRNIDSETFIFKDEKDEEFVFSFDRVFYEKSEQSDVYQFLALPIVRDVVVDAFNGTIITYGQ

SEQ ID NO: 154215 - protein, 101 aa, Glycine max
  Coding DNA Sequence Number=SeqID_37437
  Subcellular localization annotation: CTP_CleavageSite=24; ConfidenceScore=5.31e-01
MWNENYDGFYLKTVLFPKLKPYLSAAVTPSKSTTECNFSLDLSPSSPASINHSALPRALTHSAPTHVTNIVSLSLEFMSMKLVWHRHCLQNIFSSLNFGFL

SEQ ID NO: 154216 - protein, 106 aa, Glycine max
  Coding DNA Sequence Number=SeqID_37438
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=72%, HitCoverage=20%, E-value=1e-13, Identity=44%"; Hit description =Putative Nod-factor receptor 1b
AEWLMEAGELGERSREKLHSVVLFDGVTAAESRKIGSDGYGSVYFGVLGNKEFAVKKMRSNKYKEFYAELKVELLGYANGEDDLCLVYEYVPSESLSDHLHDPLHK

SEQ ID NO: 154217 - protein, 62 aa, Glycine max
  Coding DNA Sequence Number=SeqID_37439
MTLQPRSDNVGLGTGDTMQSECEKEMQLEHVDMDLKIKLIRSNNLGLDIKYTSFDLVKPMKP

SEQ ID NO: 154218 - protein, 400 aa, Glycine max
  Coding DNA Sequence Number=SeqID_37440
  Gene Ontology: Mol. function=ATP binding; Cellular component =intracellular; Biological process=transport
  Homolog annotation: Hit_ID=Q4K7L9; Match level="QueryCoverage=62%, HitCoverage=79%, E-value=4e-28, Identity=34%"; Hit description=Type IV pilus biosythesis protein
  Pfam annotation: Domain name=DUF1312; Domain location=2-109; Score= -35.7; E_value=0.039; Accession=PF07009.2; Description=Protein of unknown function (DUF1312)
  Pfam annotation: Domain name=GSPII_E; Domain location=76-351; Score= -89.8; E_value=8e-05; Accession=PF00437.11; Description=Type IIIV secretion system protein
  Pfam annotation: Domain name=PilS; Domain location=18-141; Score =57.6; E_value=4e-14; Accession=PF08805.1; Description=PilS N terminal
  Pfam module annotation: Pfam domain module=DUF1312::GSPII_E::PilS; Domain location=2-109::76-351::18-141
MIVVISLVVAAGALAYFYVNSTSEVTLVTTVMNETRNLRSSSGYGTDDYVPALVKGGSISKSYTITNNLIYNKSGGQLTVKGNGVGFIVTDAGLPQRDCVKVARSIGTADLASTKINNTTFTAEVTAADAATARCGRFVSNVIRKPGATSSPAFTTAGFTAPRYPVTYWGAQVWCCVRPRPLCRGGGDVPLSTPLRRSVELPGATGLILIAGEMGAGKTTSAAAILSRRIAVTGHLGVSIEDPAETLLQGRHGDGRCIQLEVGENEGYASATRKAYRMGASAFLLGEIRDGATAHEVLKASLSMFVVSTIHAASVKEALERYVMFCEEISPAAKANIASTLYVLAHQKMRVNPTNNQRQVDITGFNLRHAATADTIRAKITSGQFNFDDQFNSITYDFKE

SEQ ID NO: 154219 - protein, 94 aa, Glycine max
  Coding DNA Sequence Number=SeqID_37441
  Homolog annotation: Hit_ID=Q877M5; Match level="QueryCoverage=48%, HitCoverage=17%, E-value=5e-12, Identity=73%"; Hit description =Relaxase
MVVALQVNVAHVVARAPDHKASQRVGVQPVAEIIKFKFRGWHQRFSVLMTGFHFVLSVTKPARDSRRRSRSPVVSLLLSPVTVCWRSVTTGAVM

SEQ ID NO: 154220 - protein, 278 aa, Glycine max
  Coding DNA Sequence Number=SeqID_37442
  Gene Ontology: Mol. function=ATP binding; Cellular component =intracellular; Biological process=transport
  Homolog annotation: Hit_ID=Q88BM6; Match level="QueryCoverage=98%, HitCoverage=69%, E-value=1e-94, Identity=62%"; Hit description=Type IV pilus biogenesis protein
  Pfam annotation: Domain name=GSPII_E; Domain location=1-246; Score= -86.0; E_value=5e-05; Accession=PF00437.11; Description=Type IIIV secretion system protein
MALLMDEVFSPELRPQVRGGVPADRAIQLDGDMTGRWGLNRGERIRFRVNLLQGSAGRQDSTIGWTLRVIPSEIPPLETLGLEPELMDNLLPAKGVGLWGGITGSGKSTSLASTYRHCLDTDPDRKVTTKEDPIEFILGRPGDVLPPLQSQVGKDIPDFATGIRADLRRAPSVMGVGEMRDLETIEAGIRAGQLGHLLLSTTHIHSPGEVFARLINEFPHESRDAMALSLLGVLQYVVVQTLLRTTDGKRVAVREFILFDYYLREKLAGMPWSKWGQH

SEQ ID NO: 154221 - protein, 57 aa, Glycine max
  Coding DNA Sequence Number=SeqID_37443
FYSSRPETCEPDDARDSSLLGGRQSSSMAWGSVVVVPLYRFQDTEVLMTLLMSFLSF

SEQ ID NO: 154222 - protein, 431 aa, Glycine max
  Coding DNA Sequence Number=SeqID_37444
  Gene Ontology: Mol. function=zinc ion binding
  Homolog annotation: Hit_ID=Q1S821; Match level="QueryCoverage=64%, HitCoverage=80%, E-value=3e-36, Identity=38%"; Hit description=Zinc finger, RING-type
  Subcellular localization annotation: CTP_CleavageSite=63; ConfidenceScore=5.21e-01
MCVDRGKLPNKPHHPTLPHLFACHSLFSFLPLFVYFSFSLLPSHPLLSLLSPNKNSFLLSTIEEEEQQQQQQHISDIIMAVEARHLNLFPSQLITNRQVMDSGEANMMNMYNNSTPIGGYSSFLPLSGAVTETALPSSVFNHSLANAVKSESGVTYNNNNNNNNVSVSPMSRKRSRDNNNNYGYNNNNNDSFSFLGQDVSLQIQQQQLDIEHLIMQRMEKVRMEIDEKRKRQARRIIEAIEVGVMKKLKTKEEEIEKIGKLNWALEEKVKHLCMENQVWRNIAETNEATANALRCNLEQVLAQRGGMAAEEDVGGGATVCGGAEMDDAESCCGSTEEDGLEKETGGWRTLAGCAGVKDKEGGGNGRLCRNCRKEESLGPAVDLLDNFPSRETRKRIGARGEWRVGSTRVGTDSDRWKIMDQFWGVKKKGGG

SEQ ID NO: 154223 - protein, 128 aa, Glycine max
  Coding DNA Sequence Number=SeqID_37445
MHIWALGSSPQKQKAYTLPFYTGTSELATHVPINRHAGTARETNENAVMYQQLFIQHNKHQRYHFIKWRNKSKTTFDFMEDKADLIIGNYSDGNLVSSLMASKPRVTQVVLWFHRATCRSKLHDDEST

SEQ ID NO: 154224 - protein, 101 aa, Glycine max
  Coding DNA Sequence Number=SeqID_37446
MSVESIASLAQYYDQPLRCFMFGDFQLVPTVEEFKGILGCPLGGRKPYLFSGLYPSMARIAKVVKVLIQELDRVKKNRNGVVGIPKKHLEEKAKALADQGE

SEQ ID NO: 154225 - protein, 133 aa, Glycine max
  Coding DNA Sequence Number=SeqID_37447
MALRDILWSFCAFPSWVDRVRWHAETNYGHSAPLCHLEAASPMTFGDKLWSFRTPFHHSEAIVSDETIMLDDMQRQIMVIRTLLLSEQRVEWWAETNYGHSAHLFAIQRRSCPMARRDKIWSFCAFPSRPDRV

SEQ ID NO: 154226 - protein, 677 aa, Glycine max
  Coding DNA Sequence Number=SeqID_37448
  Gene Ontology: Mol. function=nucleic acid binding; Cellular component= membrane
  Homolog annotation: Hit_ID=Q3BYY2; Match level="QueryCoverage=99%, HitCoverage=78%, E-value=0.0, Identity=70%"; Hit description=ATP -dependent helicase HrpB
  Pfam annotation: Domain name=HA2; Domain location=228-357; Score =58.5; E_value=2.1e-14; Accession=PF04408.13; Description=Helicase associated domain (HA2)
  Pfam annotation: Domain name=Helicase_C; Domain location=79-173; Score=67.5; E_value=4.2e-17; Accession=PF00271.21; Description =Helicase conserved C-terminal domain
  Pfam annotation: Domain name=HrpB_C; Domain location=525-663; Score =287.4; E_value=2.7e-83; Accession=PF08482.1; Description=ATP -dependent helicase C-terminal
  Pfam module annotation: Pfam domain module=HA2::Helicase_C::HrpB_C; Domain location=228-357::79-173::525-663
MSATLDGERLARFLDAPRLSSEGRSYPVAISHFPARRDEALELQVRRSVQQALAEHPGDLLVFLPGQREIARVQAGLQESLDGNVEVLALHGELPVEQQARVLQAASDGRRRVVLATNVAESSVTLPGVRVVIDSGQAREPRYDPNSGFTRLDVVAIAQASADQRAGRAGRVAEGVAWRLWPQSQRLEPQRRAEIDQVELAGLALELAAWGSSDLRFLDPPPAGPMGAARELLQRLGALSSSGAITALGRRVLALGTHPRMAAMLLAAPDARAQALAADLAALLEARDPLRQGGDALAARWRALAAFRNGRAPGDANRSGLAAIDAAAKQWRRRLRCDAAPPASIEAHELGDLLAHAFPDRIGFQHPSDPLRYLLANGRSARLHELSDLRGEPWLVASELRFEARDALLLRAAPVDEGQLRKAWPERFVTEDVVRWDSERRALVALRETRFDRIVLDSRSAGRVDPQHAAQALTDAVAELGLQALPWTEGLRQWQARVESLRRWMPELDLPDCSDAALLANRAQWLQPAFAGKSRLDALDESSFGEALKSPLEWSQRQLVERHAPTRITVPSGLERPITYELDSESGEPLPPVLAVKLQELFGLADTPRIADGRVPLTLHLLSPGGRPLQVTQDLRNFWENTYAEVKKEMKGRYPRHPWPDDPWTATATHRAKPRGT

SEQ ID NO: 154227 - protein, 325 aa, Glycine max
  Coding DNA Sequence Number=SeqID_37449
  Homolog annotation: Hit_ID=Q3QL24; Match level="QueryCoverage=77%, HitCoverage=22%, E-value=7e-12, Identity=30%"; Hit description =Hemolysin-type calcium-binding region
CIDGTVVNVNGVNYTVTAADLTNGFITAAIPVTGEGPVAIHAEAVDAQGNVDVADADVTVTVDTLPADLIGAITIPEDLNGDGILNADELGTDGSFNAQVALGPDAIDGTVVNVNGVNYTVTAADLTNGFITAAIPVTGEGPVAIHAEAVDAQGNVDVADADVTVTVDTLPADLIGAITIPEDLNGDGILNADELGTDGTFNAQVALGPDAIDGTVVNVNGTNYTVTAADLTNGFITATLAATAADPVTGQIVIHAEAVDAQGNVDVADADVTLTIDTTPQDLITAITVPEDLNGDGILNAAELGTDGTFNAQVALGPDAIDGTV

SEQ ID NO: 154228 - protein, 98 aa, Glycine max
  Coding DNA Sequence Number=SeqID_37450
MAPFLFLMVLKGLADLVRQALASGKLKGIQIVASGLKVNFYKSNLIGINLEYNLVDRNKEHQNFQYGFTVKMEMEAMVCLASALGGRFPIKDALGHVT

SEQ ID NO: 154229 - protein, 154 aa, Glycine max
  Coding DNA Sequence Number=SeqID_37451
DTSFVVQVEGTSTWVVVTENKGGYISCGSVQVEGTSTWLFKENKGGYIPCGSLLVKAFTRFEKKSQGPQVAWGLDAEYGCARANTFDGDLGFQVHNVGEVQGLRYTIWVRFKETRSKTVVDFFVLNYNFDTTRHSKTVIYNHLRMYDVKNNFSP

SEQ ID NO: 154230 - protein, 119 aa, Glycine max
  Coding DNA Sequence Number=SeqID_37452
  Gene Ontology: Mol. function=transferase activity; Biological process= biosynthetic process
  Homolog annotation: Hit_ID=Q1S823; Match level="QueryCoverage=99%, HitCoverage=24%, E-value=2e-44, Identity=83%"; Hit description=Myb, DNA-binding; Glycosyl transferase, group 1
MAGKSNEKKGGRRGRACVVVLGDIGRSPRMQYHALSLANQASLEVDIVAYGGSEPHTALLANPSIHIYIMSWNFLKFSEAVVNSQSKLTKDTSTNNAIVEAIGSILHASLVPLCKNTIS

SEQ ID NO: 154231 - protein, 77 aa, Glycine max
  Coding DNA Sequence Number=SeqID_37453
MVKGERNANGLKGILDYGWEEDPSQVEKKIYSFFKERFEEQSGRRPKFDGNPFSHITVEDNVKLCIPFEELEIKEAI

SEQ ID NO: 154232 - protein, 50 aa, Glycine max
  Coding DNA Sequence Number=SeqID_37454
MEMRNQPCMKRVCDLNQARTKVVAIMRVCNLNKGVRTRVARESVWVERNE

SEQ ID NO: 154233 - protein, 475 aa, Glycine max
  Coding DNA Sequence Number=SeqID_37455
  Gene Ontology: Mol. function=translation elongation factor activity; Cellular component=cytoplasm; Biological process=translation
  Homolog annotation: Hit_ID=Q1S824; Match level="QueryCoverage=99%, HitCoverage=71%, E-value=1e-167, Identity=56%"; Hit description =Elongation factor Tu, domain 2; Translation elongation factor G
  Pfam annotation: Domain name=EFG_C; Domain location=356-444; Score =105.9; E_value=1.1e-28; Accession=PF00679.14; Description=Elongation factor G C-terminus
MMSRLWGENFFDSATRKWTNKHTGVNLKSEEKELTGKALMKHVMQSWAPASSALLEMMIYHLPSPARAQQYRVENLYEGPLDDQYATAIRNCDPEGPLMLYVSKMIPASDKVAMVGLDHFITNNATLTNEKEVDAHPIRAMKFSVSPVVSVAVTTRVPSDLPKLEEGLKRLAKSNPMVVCTLPETGEHIISAAGKLHLEICLKDLQDDFMNGAEISISDPILSFRETVLERSCHTVMSKSPNKHNRLYMEARPMEAGLAEAIDDEKIGPGVDPKNRSKILSEELGWDKDLALAPMVKDPTWWWILARAYSTSMKSKTQLLLGLREHQLEVQWLRGGQIISTARRACYAAMLTAKPRLLEPVYLVEIQAPEQALGGVYSVLNQKRGHVFEESQRPGTPLYNVKAYFPVIESSKFNESLRAKTGRKAFPQLVFDHWDMVPSDPLEPGTPAAALVAKIRRKKSFDVEMRPFFEFEDRL

SEQ ID NO: 154234 - protein, 174 aa, Glycine max
  Coding DNA Sequence Number=SeqID_37456
RLDDSGEIALESTTTMGSHEKLSVDTFLSTTDKETQALNANRRENKILGGSNQSQERGEFFKENMPKENQPSQSENQHVVTNEGHMGQDNGEDICKKGATKKLEVNKKELVGLLTKGLEETAFEKEKEGQMGDTNLGLIEKDMINMVAYGEVDTERKDNGKAKLIEKEYNNQGM

SEQ ID NO: 154235 - protein, 83 aa, Glycine max
  Coding DNA Sequence Number=SeqID_37457
MEWVGYKLTIGLLEEYTSLLVNYKDVRLKLNDVEKKNRDSIFELILQVDNEDCITYFGLCEALKQCTITLDKNYYLYINEEHI

SEQ ID NO: 154236 - protein, 122 aa, Glycine max
  Coding DNA Sequence Number=SeqID_37458
MDEKTKKKLEEAAQSGSIEVVIDPQSPIRRHVKWKMARTKKTGQMTFEAAKEIAEKIVSFVPYGRQDVLTAAIGRPEHPGHVRVAGAGVTIKQYFGLAPWTFRTSSSMAPEELEQLTQQIRD

SEQ ID NO: 154237 - protein, 885 aa, Glycine max
  Coding DNA Sequence Number=SeqID_37459
  Gene Ontology: Mol. function=translation elongation factor activity; Cellular component=cytoplasm; Biological process=translation
  Homolog annotation: Hit_ID=Q1S824; Match level="QueryCoverage=93%, HitCoverage=100%, E-value=0.0, Identity=81%"; Hit description =Elongation factor Tu, domain 2; Translation elongation factor G
  Pfam annotation: Domain name=EFG_C; Domain location=766-854; Score =86.9; E_value=6.4e-23; Accession=PF00679.14; Description=Elongation factor G C-terminus
  Pfam annotation: Domain name=EFG_IV; Domain location=651-764; Score =152.8; E_value=9e-43; Accession=PF03764.8; Description=Elongation factor G, domain IV
  Pfam annotation: Domain name=GTP_EFTU; Domain location=75-390; Score =238.7; E_value=1.2e-68; Accession=PF00009.17; Description=Elongation factor Tu GTP binding domain
  Pfam annotation: Domain name=GTP_EFTU_D2; Domain location=437-514; Score=38.5; E_value=2.2e-08; Accession=PF03144.15; Description =Elongation factor Tu domain 2
  Pfam annotation: Domain name=MMR_HSR1; Domain location=78-208; Score =5.6; E_value=0.0003; Accession=PF01926.13; Description=GTPase of unknown function
  Pfam module annotation: Pfam domain module=EFG_C::EFG_IV::GTP _EFTU::GTP_EFTU_D2::MMR_HSR1; Domain location=766-854::651-764::75 -390::437-514::78-208
MVIFGGSLAYTTSLFQSLYLLDRASCLVFYVLHSSQPVVIVSVADLACLVQKQGPVIKMVKFTTHRLRHIMDCKHNIRNMSVIAHVNHGKSTLTDSLVAASGNIIAQEGEAERGNTVKSSGISLYYAMPEGDLKNFKGEREGNEFLINLIDSPGHVDFSSEVSTALRITDGALVVVDCVEGVCAQTETVLRQALGERVKPVLALNKMDRCFLELNLDPEEAYLTLQRVVESVNVIVGNYEDALLGDVKVYPEKGTVAFSAGLHGWGFTLTNFAKMYASKFGVDEAKMMSRLWGENFFDSATKKWTNRHTGASTCKRGFVRFCYEPIKQVIELCMNDQKDKLCPLLQKLGLNLKFEKELTGKALMKCVMQSWLPASSAILEMMIFHLPSPASAQKYRVENLYEGPLDDPYASAIRNCDPEGPLMLYVSKMIPTSDKGRFYAFGRVFSGKVSTNMKARIMGPNFVPGEKKDLYVKSVQGTSIWMGKKYETVEDVPCGNTVALAGLDHFITKNATITNETEIEAHPIRAMKFSVSPLVSVAVNCNAASDLPKLVEGLKRLAKSDPIMMCTISETGEHIIGATGELHLETCVKDLKDDFMNGIEISISDPIVSFKETVLEKSCHTVMSKSPNKHNRLYMEARPMEEGLVEAIERGKIGPKNNNKMVCEEFGWDKDLAKRIWCFGPDTIGPNMMVDACKGVQYLNEIKEAVLAGFQIASREGPLAEENLRGVCFDLCDVVLHADTIHRGGGQIIPTARRAFYAAILSAKPRLLEPVYVMEIQAHEKALGGINSVVNKKRGHVFEEIQRPGTPFYNVKAYIPVIESFKFSETLRTQIGEQAFPQMVFDHWDMVQSDPLEPGTPASACVADIRKKKGLNEQVMPLCVFEDML

SEQ ID NO: 154238 - protein, 117 aa, Glycine max
  Coding DNA Sequence Number=SeqID_37460
MATPSIENLNINEDDPVLNGGLWSFDKNMSIFGVIEEGKDPTTIPLFYVPFLIQMHNLPVEFMSQKVEESLRNYTIQFLEYDEKNNVNFLCLFMRIKVLLNIQKPLTYKNQETTRRS

SEQ ID NO: 154239 - protein, 297 aa, Glycine max
  Coding DNA Sequence Number=SeqID_37461
  Gene Ontology: Mol. function=protein dimerization activity
  Homolog annotation: Hit_ID=Q1SYN6; Match level="QueryCoverage=46%, HitCoverage=19%, E-value=5e-13, Identity=31%"; Hit description=Zinc finger, BED-type predicted
MVYKYPFSIIEGEGWMWAFQYANPDFQKVSALRRGIDVSETIFKCLEVWGIEEKVFSVSVDNVSYNDSCFKNLKENLSLDTKLVLNGDLFHVKCCAHILNWLVQDRLGKIKDIIQNVRESVKYINHNDARLKAFSDVVEQKRLKERKLILDCPTRCKFRVIGIFFPLLDKLEGIAKENVEKVQSVFQQLYDGYVALRNEESSSNERNVGGINSLTIHLPYTFSMTRFDQLMSLVHENEAVPPMKSELDAYLEEKNTYISNNENSSCSALECAGGREIDEYRSRLNEESIEALICSGD

SEQ ID NO: 154240 - protein, 46 aa, Glycine max
  Coding DNA Sequence Number=SeqID_37462
MSESVVGKSGEARDGCSFESSSMMNKSRTIGKEVGVGGGGVRGPRQ

SEQ ID NO: 154241 - protein, 523 aa, Glycine max
  Coding DNA Sequence Number=SeqID_37463
  Gene Ontology: Mol. function=nucleic acid binding; Cellular component= mitochondrion; Biological process=DNA integration
  Homolog annotation: Hit_ID=Q1SRN1; Match level="QueryCoverage=83%, HitCoverage=28%, E-value=1e-125, Identity=51%"; Hit description =Integrase, catalytic region
MQQVLATIQGLKLSKYLHEEHVPKKFESKEYEEVGSITRCLAPCIDISTNPHKDGWFGAIMADLEKISSLLCVSDSCEGFVPQNTHPMTTRAKPGVFKLKTYASYKEGSYDHTIEPHIVKEAMAKPEWLKAMKEEHDALIQNDTWSLVDPPPGCKPIGCKWVFKSKFNADGSFQRHKARVVAKGYHQREGFNFKETFSPVIKPATIRTVMSLVVSQQWPIHQVDINNAFLHGGLQETVYMTQPPSFVSSDKHEVCKLLKALYGLKQAPRSWFHKLSLTLRSLRFNSAKSDTSLFMRFTPTSKTYVLVYVDDIIITRSSSSEITSLISHLNNKFSLMDLGPLHYFLGIEVKHYSDGGILLSQSKYIIDLLHKTNLLDSKSQPTPMVSGLKLTIDGSFSVQDPTHYRSIVRALQYIIVIRPEISFSVNKVCQFMHRPQEHHWRAVKRILRYLQGSITYGLHIKPSPQLHIMGFCDSDWGSDPDDRKSTTSYCVYLGPNLVSWSSRKQVVVSRSSTEAEYRTCFSK

SEQ ID NO: 154242 - protein, 136 aa, Glycine max
  Coding DNA Sequence Number=SeqID_37464
MPISPYGNISWSVSFRHRDRTHKTPSGPEEVQQGPRVSSSDYGPLDRTRKTFSGPEEVQQGPRVSSSNYGPLSVLRSARQPQQVHQAPINWAFIKKYCAPRQAQGETPQQPRDGRQQATNALPPPLEFTSTHPRKG

SEQ ID NO: 154243 - protein, 103 aa, Glycine max
  Coding DNA Sequence Number=SeqID_37465
MVVVGPRVADFVTEISIIVQKHVHFNINKWKHVPEVAKEKIVTKVLDSFDVDGAHPENTKDVILFIVGRLYPNHRYEMSTINQSKLLIIDVEGIHFKLLALKR

SEQ ID NO: 154244 - protein, 91 aa, Glycine max
  Coding DNA Sequence Number=SeqID_37466
MLMIILSTSVLSTSVQKSKLKVINNRCRKYENEGLKKRCKNKKYLKKGQAQDVLSAKTSIGAKRGRGALSANTGTRAKRASRTKCEYKHPR

SEQ ID NO: 154245 - protein, 112 aa, Glycine max
  Coding DNA Sequence Number=SeqID_37467
MKTEQLALRTARAKRDCSAKPRDSRLGAKCMASPKRLALPTQGGESTWDSSRFTSETAWHKYQHNVHLRNILPDRNIELSASMFDEFYGDLQRRQWHWVLTKLPEKQITIAL

SEQ ID NO: 154246 - protein, 163 aa, Glycine max
  Coding DNA Sequence Number=SeqID_37468
HYAHPKEGSSLNADEALWKLLWKDFTTLAQTWSALSYFNLALISHTSDLNVDRARADIWLGDEDGHGLEQLHFRAPSCLSQSRNTKRPASSTTSSTTYRTPPAAIHLSLDGPAYSDTLVHLPGPAGHCPGSLQTLCAPGDGPTTNDPRGLHPTGCLARSPALY

SEQ ID NO: 154247 - protein, 190 aa, Glycine max
  Coding DNA Sequence Number=SeqID_37469
  Gene Ontology: Mol. function=structural constituent of ribosome; Cellular component=intracellular; Biological process=translation
  Homolog annotation: Hit_ID=Q9C887; Match level="QueryCoverage=85%, HitCoverage=45%, E-value=2e-42, Identity=53%"; Hit description =Myosin-like protein; 97843-94399
MALQRDLAASKEELHCMNMAIGDIRSDHEMHSRELVDKGMNMEADLRANEPLKNELIQLRAEVQKLNSLKQDLTTKVQTLTQDVSILQAKNQQIPMMRAEIDGLYQELIRARTMVDYEKKANIEFMEQRQSMEKNLVSMTREVEKLRAELASVDGRHWAVGMSDNSLCYLRLINDNYDRLIFLYASWPEG

SEQ ID NO: 154248 - protein, 64 aa, Glycine max
  Coding DNA Sequence Number=SeqID_37470
MGSKIYPKVHENPRAFFSSSSPRLLESSIEYPWGVGLHHRPSEIRVIPPSEIVSIAGEHKLQTA

SEQ ID NO: 154249 - protein, 218 aa, Glycine max
  Coding DNA Sequence Number=SeqID_37471
EQIKANMEAMKEKMTTMMEAMMSMRKMMEVNTAIVVVASTATDVDPTQPSDFNQVNHPVSDMVPQPMGETHEVPRDHALADFEPYLGYATEGQTFCGIPLPNTLGGPQYRPQPQPLHFAVGRLPPAMVEREKFDHIKERLREIEGDGNYAFADMVELCLAPDVVIPPKFKVPNFDKYKGTTCPNNHLKMYCRKLGAYVKDEKLLMHFFQESLARAAIA

SEQ ID NO: 154250 - protein, 86 aa, Glycine max
  Coding DNA Sequence Number=SeqID_37472
  Gene Ontology: Mol. function=oxidoreductase activity, acting on single donors with incorporation of molecular oxygen, incorporation of two atoms of oxygen
  Homolog annotation: Hit_ID=Q1SCC5; Match level="QueryCoverage=82%, HitCoverage=18%, E-value=2e-12, Identity=50%"; Hit description=2OG -Fe(II) oxygenase
MVITRTDELEAGTVSSYDRISELKAFDDSKAGVQGLVENGVTKVPRMFYCEHTNDSNGSTSEPNSKFSIPTIVNQIQSSVFPPLSS

SEQ ID NO: 154251 - protein, 160 aa, Glycine max
  Coding DNA Sequence Number=SeqID_37473
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1SCC5; Match level="QueryCoverage=99%, HitCoverage=73%, E-value=8e-20, Identity=54%"; Hit description=2OG -Fe(II) oxygenase
VINHGIPSDVLDEMIKGTSRFHQQDAKARKEYYTRDPNRKVVYVSNYSLYHDPAATWRDTLCCVMTPHPPEAGELSAQQLLTNDKFISVKHRVLANHIGPRISVASLFRKDGDDSLVYGPNKELLSEVNPPLYRDVSLKEYLTYYYAKGIGTSGPSHFKL

SEQ ID NO: 154252 - protein, 86 aa, Glycine max
  Coding DNA Sequence Number=SeqID_37474
MSEVKDVTVTKLILVTKVTCAGQFFGEVYALDMETLACKRLEDKVDSGGHLEPRGWCAFASAHRGGHEGFGELIGAEYDMAAYDGF

SEQ ID NO: 154253 - protein, 209 aa, Glycine max
  Coding DNA Sequence Number=SeqID_37475
MLVHFINGFHPPQPQFKQEWRTVHVDGFSSRHGSGAGVILERPNGIALAQSLCFRFKASCNQEKYKALSIGLRLAREDLSARSPRQRKFLLVVVDLFTKWVKAEPFASIATQTNRYKIPLEECVEAKLHDDDKGDDKKLKGQSKNEFKMFKIESRTLQDSRGKLNSRIKNQDSRDQGSRLKIQESRKGYSRIKKKLNQDKYEKVFSKTE

SEQ ID NO: 154254 - protein, 104 aa, Glycine max
  Coding DNA Sequence Number=SeqID_37476
MPPDSQVTIANETFSRTRSEDADISGKGVDDDVWITIRCVRMPPDSQVTIAKGGEVDKSGAFAPRYPQFVMRNSDKSGVLSLKCEHALVKKQNLQLIRATYNFW

SEQ ID NO: 154255 - protein, 132 aa, Glycine max
  Coding DNA Sequence Number=SeqID_37477
MASLRLCPRTKKEAIKVMHYVEVRMKIKKVEELDLDPRTNNDNQVKPLEETPHSDSVLRKGRSLGWETNFLTMTKAVSNRLSENTLPRIDSDFHCHKLAICKNAKPNAQRKRKIREERSRAIKQEVAKLMAA

SEQ ID NO: 154256 - protein, 60 aa, Glycine max
  Coding DNA Sequence Number=SeqID_37478
MVKIVGNLWHARLGHPNDHICGDLLILPHILVINIMSTVSSAASPSSTPTIKNNSSNVNV

SEQ ID NO: 154257 - protein, 36 aa, Glycine max
  Coding DNA Sequence Number=SeqID_37479
MFECEIFNLLRELFGSSGSQNDTVGFTFWTMKGKRL

SEQ ID NO: 154258 - protein, 348 aa, Glycine max
  Coding DNA Sequence Number=SeqID_37480
  Gene Ontology: Mol. function=oxidoreductase activity; Cellular component=proton-transporting two-sector ATPase complex; Biological process=ethylene biosynthetic process
  Homolog annotation: Hit_ID=Q1SMV3; Match level="QueryCoverage=82%, HitCoverage=76%, E-value=1e-93, Identity=57%"; Hit description=2OG -Fe(II) oxygenase
  Pfam annotation: Domain name=2OG-FeII_Oxy; Domain location=221-303; Score=71.2; E_value=3.4e-18; Accession=PF03171.10; Description=2OG -Fe(II) oxygenase superfamily
MVATSTNELEAGTVSRYDRKSEIKVFDESKTGVQGLVENGVTKVPRMFYCEHSNLSDGLTTESNSNFTIPSIDLTGINDDPILRDAVVGKVRYACEKWGFFQVTNHGIPTQVLDEMIKGTGRFHEQDAKVRKEYYTRDMSRKVIYLSNFSLYQDPSADWRDTLAFFWAPNSPNDEELPAVCRDIVPEYSTKVMALASTLFELLSEALGLDRFHLKEMGCDEGLLHLCHYYPACPEPELTMGTSRHTDGNFMTILLQDQMGGLQILHENQWIDVPAAHGALVVNIGDLLQRFESLWNLTQWQSCALENGWSWVGIWKQFLCICKSKVMYNDPFSYVRIARSLLAPGYIS

SEQ ID NO: 154259 - protein, 135 aa, Glycine max
  Coding DNA Sequence Number=SeqID_37481
  Gene Ontology: Mol. function=nucleic acid binding; Cellular component= mitochondrion; Biological process=DNA integration
  Homolog annotation: Hit_ID=Q1SJP8; Match level="QueryCoverage=89%, HitCoverage=6%, E-value=3e-42, Identity=68%"; Hit description=D -galactoside/L-rhamnose binding SUEL lectin; Integrase, catalytic region; ...
  Homolog annotation: Hit description=Galactose-binding like; Peptidase aspartic, catalytic
MIPSTRYFMVYTYADADYAGSVDDRRSTFGYYTFLGGNLVTRRSKKENVVARSSADAEFWAMALGICELLWMKIILDDLKIEWNGPMKLYCDNKSAINIAHNLVQHERTKHVEVDNHFIKEKLDSGTICTSLQMF

SEQ ID NO: 154260 - protein, 592 aa, Glycine max
  Coding DNA Sequence Number=SeqID_37482
  Gene Ontology: Mol. function=nucleoside-triphosphatase activity
  Homolog annotation: Hit_ID=UPI0000162C59; Match level="QueryCoverage =48%, HitCoverage=29%, E-value=7e-68, Identity=47%"; Hit description =ATP binding / ATPase/ nucleoside-triphosphatase/ nucleotide binding
  Subcellular localization annotation: CTP_CleavageSite=3; ConfidenceScore=5.16e-01
MMRGANRGMLISSTGNRAPKTRSSDTILRKGRSSNLGYQPFGSRGGFHRGCSGHIAGHSIARGGRMYVQCSDAGLIFTCFTCAQFDIGSQVVGQKDTSKNVLDVWKEIFHKRRTKKTERKSHRGKSFEFDSLYSLVSNRGDSNLILDGIHENVLQLNYHDPVMQKTVKCFDNLGVYDLMHQYIMHTQQMPLYVYLPLVAITVHHIVSQVQKPNIEWPKSHQRYRTMMMEKMDILNTWHHKIPPYIARNLSASSFVEDLISPLLHILSPPTVRPVAFQLLSDKEQNDLAQLVSTMVSYTITYKTLKSDILPQTQRCEVADGLALSLVPPISDFINFKDYTSNHYVLSVAMKQVLVHESISATHQHFHLLNLIPASTPWPCCRKCCLGFCGKVLEIFTQDKDSHHKAFHTQLSPLCGWITVRAMSPKKPSAMSTSLSNKGLLHMKFHSQPASEMRYNLGYFIINDTSSPVQQSSQNLTLSSHPTLQAILLLVEKHKILQVGNDKAGAFTNGGHEVIETGTNNIPLANTSHATAVDLKINENQANVLSWQLNANPTTVSPNLDSNKISRAADCGKLLNMGNMKKPSRSSSSFFDR

SEQ ID NO: 154261 - protein, 88 aa, Glycine max
  Coding DNA Sequence Number=SeqID_37483
MNLIIVIKRKEHALRHPYRTRARARVMGEVEEVQEQMKTDMEAAKEQMATMMEAMMSMKKIMEVNAAAIAATSTIAEVDLTPHMASTK

SEQ ID NO: 154262 - protein, 297 aa, Glycine max
  Coding DNA Sequence Number=SeqID_37484
  Homolog annotation: Hit_ID=Q1RTB4; Match level="QueryCoverage=74%, HitCoverage=60%, E-value=1e-23, Identity=28%"; Hit description=IMP dehydrogenase/GMP reductase
MGSSQKPSLEKRFYQVKIKSLEVTSLRKLGQLMGQLQRQAFRKAYGKIWDLARVEVSMEPIASLSQYYDQPLRCFTFEDFQLVPTVKEFEEILGCPMGGRKPYLFSRFYPSTTRVAKVVKISAQELDRGVLFPNVDGLVDLAAIDVFLAYHNHKESPVVAMLAGLYDTFDRRCPSIRYKEGRIKILSSCEGCPNVPLMGTRGCINYNPVLAIRQLGYPMRGAPLDESITPFIARGFRDHNARWLRVRTQGLDWLPNLKTVRDDEVKASEESDEVQALKAKLERARVVEEKFKSIAIK

SEQ ID NO: 154263 - protein, 359 aa, Glycine max
  Coding DNA Sequence Number=SeqID_37485
  Gene Ontology: Mol. function=superoxide dismutase activity; Cellular component=cellular_component; Biological process=removal of superoxide radicals
  Homolog annotation: Hit_ID=Q0X0Q5; Match level="QueryCoverage=53%, HitCoverage=92%, E-value=1e-65, Identity=65%"; Hit description =Superoxide dismutase
  Subcellular localization annotation: CTP_CleavageSite=28; ConfidenceScore=5.56e-01
MRGGLSSSSSSIARPSKRLRTCGSAKRRANASWSAASTLIAKRVARWKVDRLCACNARFHSTSGGCNDTGTNELMVRPMGLPCASRAQTMATPVGKWPSSRRRARGGISTDGTGAGAGKTPAHGPAYGSVSPLMRPWPGERTDVVRATVLVVQVVGVFPDIQCEDRSVAGQADGFTHQRAVLVGAAFHLQAAIAIAGQPGPTAAETGLRGLGEGILEGIETAEIAVDGRCQFIIGCATAGAEYGPEQAVVGVATAVVADRATLRLGHGIEVGDQRLDRLLGDAGLLDGGVEVVDVGLVVLAVVDLHRARIEVRLEGVIGIGKRGKRVRHRSNLRGEGQRGWPWGDRYRTSTLVEVKGKD

SEQ ID NO: 154264 - protein, 101 aa, Glycine max
  Coding DNA Sequence Number=SeqID_37486
MGEIEEVQEWMKADMKVMKEQMTTMMEAMMSMKKIMEVNAAAVAATSTVGEVDPTLLSDLNQINHPTSDMIGQRGKELGSTVGPHFVQVHNKHVFPPYCDF

SEQ ID NO: 154265 - protein, 81 aa, Glycine max
  Coding DNA Sequence Number=SeqID_37487
MCPVITTKKLYPLLAMNPKDVGLLCPVINQEVNPASCNEPKECWSLVFSVCNEEDLLLKTVTKSRSLEKLFVRMEERKKIE

SEQ ID NO: 154266 - protein, 322 aa, Glycine max
  Coding DNA Sequence Number=SeqID_37488
  Homolog annotation: Hit_ID=Q47522; Match level="QueryCoverage=16%, HitCoverage=70%, E-value=6e-14, Identity=70%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSEPLGSATSVRGGCTSLPKLEDRAQAVAPPDRRGCTAWQSSKLELWRCYLLTEEVAPPSLARNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 154267 - protein, 145 aa, Glycine max
  Coding DNA Sequence Number=SeqID_37489
MSEIEEVQEQMKANMKAMQDQMISMMEAMLSMRWMMEDNAAAVAATSVAAEADSTLPSDIFFPIERKPWPNTCKIYKDSYFVKGFLQDSGNLKRVAWGLDVGTGHGRTRNTTIEEPWEQWSEEEKKVSSIQFKSQKYHYICIRNG

SEQ ID NO: 154268 - protein, 73 aa, Glycine max
  Coding DNA Sequence Number=SeqID_37490
MERSHNFNNGKRSQEVSPTLKCYKCNQPNEKKSYKERRSKKAYIAWDDNDSSDGSEKEINLLSKDYESDENIS

SEQ ID NO: 154269 - protein, 128 aa, Glycine max
  Coding DNA Sequence Number=SeqID_37491
MGEVEEVQEQMKTDMEAMKEQTATMMEVMLSMKKIMEVNAAAIPATSTIAEVDLTLYMASTKLIIQPQIRRSGREKVGRYGRPSFSAKNKHAFLPYGLPPNYTPPNVAYTPSENVNNYTFILIKSRQP

SEQ ID NO: 154270 - protein, 112 aa, Glycine max
  Coding DNA Sequence Number=SeqID_37492
MGDPISKLSFPACLHFSGENTETFSSLTSYPELRRSEFLIRGYVGARASLLSTTPPFVAMTQELVARGDTLRLSAPRHSVTPSVIDEQRPMWSSAPFPEMSAFSDGDFSSLT

SEQ ID NO: 154271 - protein, 236 aa, Glycine max
  Coding DNA Sequence Number=SeqID_37493
  Gene Ontology: Cellular component=integral to membrane; Biological process=vesicle-mediated transport
  Homolog annotation: Hit_ID=Q69WS1; Match level="QueryCoverage=98%, HitCoverage=99%, E-value=3e-89, Identity=72%"; Hit description =Synaptobrevin-like protein
  Pfam annotation: Domain name=Synaptobrevin; Domain location=127-230; Score=115.8; E_value=1.2e-31; Accession=PF00957.11; Description =Synaptobrevin
MGQQSLIYSFVARGTVILAEYTEFTGNFTSVAAQCLQKLPSSNNKFTYNCDGHTFNYLVDNGFTYCVVAVESAGRQIPIAFLERIKEDFTKKYAGGKAATAAAHSLNREFGPKLKEEMQYCVDHPEEISKLAKVKAQVSEVKGVMMENIEKVLDRGEKIELLVDKTENLRSQMSSVRQAFYYTIEVLAQDFRQQGTKIRRKMWFQNMKIKLIVLGIIIALILIIVLSVCGGFNCGK

SEQ ID NO: 154272 - protein, 244 aa, Glycine max
  Coding DNA Sequence Number=SeqID_37494
MDNHEWMMYDHYLIMKTWTPEFMVESDTIDIDPNTFQADRGEFVRVCVELDLSKPVVGKEEEVENTIPGKIDSEDKAPLSNKVVDTFPYKNVTPSHKEVEGHMGGIWVLAKKQRNLTLSLVESNNRAITFQISLGGFNWLCSTVYARPNLAASYKLWEYLMRFKASISIPWLMIGDFNEVAFILEIRAINMAKKLDRVMAYQPWGNMFPRMYAINLTRWIFELQWGPLMVIFHHGDAAEDKRKE

SEQ ID NO: 154273 - protein, 319 aa, Glycine max
  Coding DNA Sequence Number=SeqID_37495
  Homolog annotation: Hit_ID=O24035; Match level="QueryCoverage=37%, HitCoverage=39%, E-value=7e-52, Identity=84%"; Hit description =Pantoate--beta-alanine ligase precursor
  Pfam annotation: Domain name=Pantoate_ligase; Domain location=128 -313; Score=-48.2; E_value=1.3e-10; Accession=PF02569.6; Description =Pantoate-beta-alanine ligase
MKYWVNAAVSRELQAIGNPPNVLKNLRLYFPFIFLPKYLDLFGGVHHIGTVVISIVPTLSLTHQPWTLLWLEPCETLQADLRLQSSYGLFGKLSPKLADKNSIIINNPFSSKGVTRSGKGAFLVGAAIDPMETRLNTCSFNMHYNCHILLICLSLQSSCNVCLVLVNELVVASLWGCIAWWDVRIQLQGIGLKCGVRDLDFSIKVIGAEITRDNDGLAMSSRNVHLSPEEREKALSINKSLLRAKSAAGDGQVHCEKLTNLVIQSVTDAGGRIDYAEIVDQNNLEKVEQIKSPVVFCVAAWFGKVRLIDNMEINLSMNV

SEQ ID NO: 154274 - protein, 125 aa, Glycine max
  Coding DNA Sequence Number=SeqID_37496
MMLDHMSQLGNPDIVCKLSSAGESLLLYHVDGVLPTIIQLKIISVEAKLHGESKNNSSESRTIQEFKIRIKKNSRLKTKVKSQESRFKVQDLKNQDQDSRLKIQESRESLIKISIKSFSQKLSST

SEQ ID NO: 154275 - protein, 158 aa, Glycine max
  Coding DNA Sequence Number=SeqID_37497
  Gene Ontology: Mol. function=GPI anchor binding; Cellular component =membrane; Biological process=cell adhesion
  Homolog annotation: Hit_ID=Q5N9U4; Match level="QueryCoverage=80%, HitCoverage=29%, E-value=1e-22, Identity=53%"; Hit description =Endosperm specific protein-like
MTLYLGHACAMTICKDVGCMVNLNIILSVLLNPWLTPFNQPWLLRPWVLAASRSTFHALTALSQSTLASFRAQLRRPCYPVAIFGVSKVLLPREILGRNPIVSAKPLDNAPPPDDDALSPENSSGFDGQPSQLSSPPGFREDVRSHAGGSIFCCGVLF

SEQ ID NO: 154276 - protein, 349 aa, Glycine max
  Coding DNA Sequence Number=SeqID_37498
  Gene Ontology: Mol. function=calcium ion binding; Cellular component =flagellin-based flagellum; Biological process=ciliary or flagellar motility
  Homolog annotation: Hit_ID=Q9STP7; Match level="QueryCoverage=91%, HitCoverage=91%, E-value=1e-75, Identity=44%"; Hit description =Putative calcium binding protein
  Pfam annotation: Domain name=efhand; Domain location=180-208; Score =17.0; E_value=0.07; Accession=PF00036.22; Description=EF hand
  Pfam annotation: Domain name=efhand; Domain location=219-247; Score =20.6; E_value=0.0058; Accession=PF00036.22; Description=EF hand
  Pfam annotation: Domain name=efhand; Domain location=263-291; Score =7.9; E_value=1.9; Accession=PF00036.22; Description=EF hand
  Pfam annotation: Domain name=efhand; Domain location=302-330; Score =7.0; E_value=2.4; Accession=PF00036.22; Description=EF hand
  Pfam module annotation: Pfam domain module=efhand::efhand::efhand::efh and; Domain location=180-208::219-247::263-291::302-330
MSRAVVYILIATAILFFIFRSPLNHEESKGRLNRRFGYKLLERAPKFDPLVTNIERVVENKMYHEPAPRMLSNLDSTASVSDAVETYQYLTSGGKLNTTLRLIILFPLLDREPKDGVIDFNELEAWISQRATERLDYLTQAELDSKDKNRDLAVSFKEYLPQFSEMDIGKKEMGHGEAGWWMERFEVADINHNGLLNFTELKDFLHPEDSKNQEMLKWMLKDRLKRMDNENDGKLNFNEFEDHLYSTYESYMDFETNGGHVHSPKDKFVELDVNKDQFLSPEELIPILSYLYPGELAYAKYFTCYLMNEADDDGDGKLTLQEMLDHEFTFYNTVHADGYQESDDDHDEL

SEQ ID NO: 154277 - protein, 228 aa, Glycine max
  Coding DNA Sequence Number=SeqID_37499
  Gene Ontology: Mol. function=aminoacyl-tRNA ligase activity; Cellular component=mitochondrion; Biological process=embryonic development ending in seed dormancy
  Homolog annotation: Hit_ID=Q9XEA0; Match level="QueryCoverage=50%, HitCoverage=12%, E-value=3e-31, Identity=56%"; Hit description =Putative leucyl tRNA synthetase
MTPFGAAMPSVVLPFGGMPFVWDRRRITMDSEFPYKALMSTRFSPSPITLWLRVLHPRPSRHHSSALQLQGCHRQRHHQFRQTPRFCCSSRRDSTLLLFLSQASLGARNNYIPYKGAIIVVTGAVMEQELSCNEAALKVIEWVEKSGNGKRKLRDYLFARQRYWGELIPIIFLDDNGETVPLCETELPLILPELHDFSPTGSGEPPLSKAMSWKLKMGMSKLKPMQYE

SEQ ID NO: 154278 - protein, 66 aa, Glycine max
  Coding DNA Sequence Number=SeqID_37500
MNNTTLHYATHYSIWKLCQNCSGHKYWNIALKVRSGRHGAIHITIDIKHSKVYKVSTTYLNQNETL

SEQ ID NO: 154279 - protein, 57 aa, Glycine max
  Coding DNA Sequence Number=SeqID_37501
  Homolog annotation: Hit_ID=Q8LIG5; Match level="QueryCoverage=74%, HitCoverage=6%, E-value=1e-14, Identity=81%"; Hit description =Putative arabinoxylan narabinofuranohydrolase isoenzyme AXAH-I
MPLIQISENDQFMEFHLQEINHAGAGGLWAELVSNRGFEAGGPNTPSNIDPWSNYWK

SEQ ID NO: 154280 - protein, 37 aa, Glycine max
  Coding DNA Sequence Number=SeqID_37502
MSARCKFIIFTSKNMPKSVSGIGFPDASEAFTVRVVV

SEQ ID NO: 154281 - protein, 299 aa, Glycine max
  Coding DNA Sequence Number=SeqID_37503
MGTRGCINYKPVLAIRQLGYPMRGAPSEESIMPFIARDFSDPNARMFQRVQKAWSAVQRKDKDLRGSNNVIIGGYHKWLKARTQELDWLPKLKFSSEEEVETPEESEEVQALKVELERMQVIKEKLKTTTIKEEWGRNKFRGALWGGNNMLKLRRAKRDQSRVEGMILEDKLKTCQRSKRSLFGELSKTEGNMWAIIDQYKEKLSLVATHEQRLEDEEAMMWMDRFAFTLNGSQELPRLLAKAKAMVDVYSAPEEVQEQMKDDIEALKDQMASMMEAILNMKRMMERNMVAVVAANTAT

SEQ ID NO: 154282 - protein, 410 aa, Glycine max
  Coding DNA Sequence Number=SeqID_37504
  Homolog annotation: Hit_ID=Q1S1P8; Match level="QueryCoverage=94%, HitCoverage=93%, E-value=1e-124, Identity=59%"; Hit description =Cyclin-like F-box
  Pfam annotation: Domain name=F-box; Domain location=6-54; Score=23.1; E_value=0.00098; Accession=PF00646.23; Description=F-box domain
MEYCKDVLSCLDSDTSLKIFMCLDDLADLVRVTCVSRSWRHFVIANGLCKQLCLRMFPQLSRVAFVVELNQNGAKEHAEVGSSYSMEWLSLLREHRVFAYLGRALMSSVAMNCIAKTVGASSTDNFPQESIDNTLEPRDHINGRYYYWSSNGQSNPNVPETLTYELVSPICVITEINIQPFQADFQIGSPIYSAKSVRFKMGHPKASLDATDDEMFVWTYTSPEFPMSKVFNISGLSTGFPLHNFCLIDFLMPDMKNEMWHFHEIDSWSTFFNVNIENRLQKFKLPEPVLCIGGFLQIELLGRIQRQEMDGLLYICVSHVQVLGGSLSPPFNVDILQPSGMFVLKRDQLADHQPVVTSGNESQEISAEQREVRDFQHIVTILSGQALGIVEDEWDEEEFDVDDFDPEYAL

SEQ ID NO: 154283 - protein, 197 aa, Glycine max
  Coding DNA Sequence Number=SeqID_37505
LGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 154284 - protein, 170 aa, Glycine max
  Coding DNA Sequence Number=SeqID_37506
GAEDYGSLCVLSSFSSYRQQKVYTNNHSGISARQRDSKVSMTDLVSAEDNGAEDDVSLCVLSGFSSYRQQKVYTNNHSGISARQRDSKVSMTDLVSAEDNVAEDDVSLCVLSGFSSYRMQKVYTDNHSGISARQRDSKVSMTDLVSAEDDVNLHVSTGLSAAIDEGRRRP

SEQ ID NO: 154285 - protein, 245 aa, Glycine max
  Coding DNA Sequence Number=SeqID_37507
MVGEKVNLPKVIFYYWMQGFKDKFNPKMKKNLVPYEYAQKHIKRKVKKDPRKFQPLLRLRRSLWSKPTKRPKLDETLERKQALELEEGVLTSVKALLAKEHKRKLTKDAKIANLEQFEQEMKKTKMNELERVQPLVEHATEIMSPDVAQRQAEKKTIIVPKDMDLVEKEALEEAILKYIIEASLRESKDDIVETNPRIAPVRPRPMSDVDEQLIDANQSNIIDVDKLRRLEEICKVPKSVSIEVM

SEQ ID NO: 154286 - protein, 130 aa, Glycine max
  Coding DNA Sequence Number=SeqID_37508
MGRSGSGGKAFPWCGVLENKTERARHHKLFTSFGGQARKESAVLFYEVLGCQRGRAGRGVLPHSPSLIPAVGARSWRGAAPSWHNGGGWWQVLLQMEAPPCDGGVLRWERGRESRRGIVDATAHPGIWTE

SEQ ID NO: 154287 - protein, 207 aa, Glycine max
  Coding DNA Sequence Number=SeqID_37509
MALAHRGLFKFSREGGECPMKSVLDQAMEEEEVELECVGCYDAVHGQNFESNNSNVSKSFLYLSFQTEVNPKKKDVNVVMIRRKKAKEELKKKSIAYLKGIIKDVVVNVDKFIFLADFLVLDMKENEDFLIILGLRLGKLTLRLGTSSTGNETNDGVLEMDSNDVNNIDGLEEENSISEGEENEEDKDELVEDDEVLEEKSDFAYEF

SEQ ID NO: 154288 - protein, 111 aa, Glycine max
  Coding DNA Sequence Number=SeqID_37510
  Subcellular localization annotation: CTP_CleavageSite=31; ConfidenceScore=5.46e-01
MGRSLLLVIGSRCCTSNSMNFQNCPSFKNQKASRRSDKGSSGISERSCFGNIPEEVFFRKKPKVIWKNPSSGSLPEHLFRKVSERSSSSGRIPEEGFFQKNSGKRVLPDDL

SEQ ID NO: 154289 - protein, 89 aa, Glycine max
  Coding DNA Sequence Number=SeqID_37511
MSSEEMEEYRELLRQLESTLEEESDYSFEDTSYLPTEDLIRDLKRFMRITNIVKYPRVPAEYIRLKTFSFSLNKKFLDWIWSLLEHITT

SEQ ID NO: 154290 - protein, 112 aa, Glycine max
  Coding DNA Sequence Number=SeqID_37512
  Homolog annotation: Hit_ID=Q5QLC5; Match level="QueryCoverage=43%, HitCoverage=29%, E-value=9e-09, Identity=69%"; Hit description=NLI interacting factor (NIF) family protein-like
MKSAAKGYKNCRTSWLLQKRTPETGEKVIYLENDNVLLENKQKELKGTLNNLLQSRQNFVNAYEVVLDLDETLVCAFETSSLPAALWTQAIEGGLNCLQLVLKAMLDPLLTE

SEQ ID NO: 154291 - protein, 324 aa, Glycine max
  Coding DNA Sequence Number=SeqID_37513
  Homolog annotation: Hit_ID=Q8RZK0; Match level="QueryCoverage=26%, HitCoverage=30%, E-value=9e-36, Identity=76%"; Hit description=Beta 1,3-glucanase-like
  Pfam annotation: Domain name=X8; Domain location=138-221; Score =165.9; E_value=9.9e-47; Accession=PF07983.3; Description=X8 domain
MGVRSWRHVLFSLCLVFNSGLCKATTLREEEHQEISYEFGTKLDAVPVVNPTTPGTTNPYPTLNPTTPQAPGSTGQTPSTPPTTPYMTPINPYTNPTTPKTSPTNPYTNPTTPTMTPPSPTTTPTTPTTPTTASSGGQWCVASQSAAENTLKVALDYACGYGADCSAIQPGASCYNPNTLKDHASYAFNDYYQKNPAPTSCAFGGTATLTNKDPSNGNCRYTSSKTPSMTPPTPTYVSPPNPPSTMTPTTPTTMTPSAPSTMTPTTPGIMTPTAPGMTTIPGGASVYGTGPAGSPNTATFASHSEVLLLTLFGLWASLRVENYI

SEQ ID NO: 154292 - protein, 69 aa, Glycine max
  Coding DNA Sequence Number=SeqID_37514
MTGLSEKEKHRSGSWNNRQGDSRLSMEIIDLCGYCEIRDPGGGINRSLLKIHDLVVDGGEKVKGDGAML

SEQ ID NO: 154293 - protein, 188 aa, Glycine max
  Coding DNA Sequence Number=SeqID_37515
MMGTELVLLEAGEEIEIRNCFNEDVGWVNECARVGEELFEIKIVEEAPDTCDHCIMCTRVSSDISVRSKSSTNEDGGSLLQDLEVVEDSLAGQALEKQDFEFEFENVQIQNDEGEREQGVQEVNVDLGFVATNQIKKIVPPGVVETLRHVEVGQFEMSPGLTSIGSSPPLVLDYESHSEGPKPLVIST

SEQ ID NO: 154294 - protein, 113 aa, Glycine max
  Coding DNA Sequence Number=SeqID_37516
MEPPSEASFKERRTTNLTYMCKLTHNLLFNIVMHRLGSRGYVSGKDRLCMYKVMVGEKVNLPEVIFYYWVQEFKDKFNPKVKKNLILFGILFTQIMRNIGVDVSTMEPSTGTS

SEQ ID NO: 154295 - protein, 86 aa, Glycine max
  Coding DNA Sequence Number=SeqID_37517
MKDWGNFLHRVLEKDSEDSTPITAFFLVWRFGGKQQRPPVVVGGGEEGVKISLSKFVSLSGSPFFALSTKIHAERNSLCTNSRSVC

SEQ ID NO: 154296 - protein, 60 aa, Glycine max
  Coding DNA Sequence Number=SeqID_37518
MTRLQTGQGGANTIWRLLDLGSRGLGILGKVKGEAYRSGKGKRLFFCQLVIVTWIVTNEG

SEQ ID NO: 154297 - protein, 64 aa, Glycine max
  Coding DNA Sequence Number=SeqID_37519
MESIGVLCDHILTIVLHLDMLELPNSLLHEYCNMVELFTDLSQIEDEIFFKDVLDEDEIDVQKF

SEQ ID NO: 154298 - protein, 70 aa, Glycine max
  Coding DNA Sequence Number=SeqID_37520
MVKSFKVQVQMQFSEICGAMSYLTLTCTDNPINVWCCTLFTQMRMFTPLTWFSKIHVSLARDAEHHGQHS

SEQ ID NO: 154299 - protein, 250 aa, Glycine max
  Coding DNA Sequence Number=SeqID_37521
  Subcellular localization annotation: CTP_CleavageSite=4; ConfidenceScore=5.01e-01
MGTSKSYGGPTNGLVPDFVDNPPAPTLTPPNDIPTDSQTQNGNTAPGNLPSDSSGAGPLSTPKGNFTRYARSRSPSALGRAVAGYVRNGTGGPSRASRRMGSSRVVAGGLLNIIGNFEQGGATQALQRFDLGSLAGEPASSVFLSLVEFLCPPGGSVDEGIARQAMLDTIRDLAETGEESFDALTPEQLQEVFLGFVVHSIEGKIMSDIGKNAIKLPDDVEAIADIQETLHSFIDSATRSQLRNDLSDVS

SEQ ID NO: 154300 - protein, 54 aa, Glycine max
  Coding DNA Sequence Number=SeqID_37522
MTVSSPPTLTYYQTTSVPLTLYSCITNMGPRMTDVVVVDIQRHLEQRRCGARRR

SEQ ID NO: 154301 - protein, 171 aa, Glycine max
  Coding DNA Sequence Number=SeqID_37523
  Gene Ontology: Mol. function=DNA binding
  Homolog annotation: Hit_ID=Q1SFS3; Match level="QueryCoverage=74%, HitCoverage=29%, E-value=2e-13, Identity=31%"; Hit description =Lambda repressor-like, DNA-binding
MGQLQQQAFHKAYGKIWDLAMAEVSTEAIASLAQYYDQSLRCFTFGDFQLSPMVEEFEEILGCPLGCLLRELDHRKQVENGAVGIPRKCLEAKVRILAGKGEWAPFIDILALLIFGGVLFPNVDGLVDLAAIDAFLAYHNHKESPVCRYAKPTYMTPSTEDVTRAIQGLFA

SEQ ID NO: 154302 - protein, 356 aa, Glycine max
  Coding DNA Sequence Number=SeqID_37524
  Gene Ontology: Mol. function=protein serine/threonine kinase activity; Cellular component=integral to membrane; Biological process=protein amino acid phosphorylation
  Homolog annotation: Hit_ID=Q6RZU8; Match level="QueryCoverage=70%, HitCoverage=60%, E-value=2e-43, Identity=61%"; Hit description =Crinkly4-like protein
  Pfam annotation: Domain name=Pkinase; Domain location=196-349; Score=- 113.7; E_value=0.087; Accession=PF00069.15; Description=Protein kinase domain
  Pfam annotation: Domain name=Pkinase_Tyr; Domain location=196-355; Score=-130.2; E_value=0.00018; Accession=PF07714.7; Description =Protein tyrosine kinase
  Pfam module annotation: Pfam domain module=Pkinase::Pkinase_Tyr; Domain location=196-349::196-355
MQLEDMEGAHVNGRNSLHILKEALSSQRSKNYGEVLESSGTGFYEMVVVFSCLWLQISSLGSMSSIVVSYGVKGGHVEMGVPQPMVKGAQYLHISVGDYDICGLRKPLTGRHRNTSLVVCWGYNMTNNNVFDGQVQSISPGSQFNCGLFSHNRTVFCWGDEPLLPLAKELKDFGLCSCQWAKGEQTKRELFKPKGSEMQHLVGLGGLQRDLKHGTIVAVKRTIMSPNVQKNSKEFHTELDLLNLLGYCEEGGERLVVYECMAHGSLHQHLHGNKVMQEQMDWVTRVTIAMQATHQIEYLHGYVSPPVIHKDIKSSNILIDEEHNVRVADLSLSLLGLTDSRLSKDLTWVIVSKNMT

SEQ ID NO: 154303 - protein, 99 aa, Glycine max
  Coding DNA Sequence Number=SeqID_37525
  Homolog annotation: Hit_ID=Q1RYZ2; Match level="QueryCoverage=97%, HitCoverage=6%, E-value=2e-38, Identity=80%"; Hit description=NAD -binding site; Serine/threonine dehydratase, pyridoxal-phosphate- binding site; ...
  Homolog annotation: Hit description=AMP-dependent synthetase and ligase
MDPKRSIEDQFSKLHPSMPVNTRIGIVGAGSSGLSIAYALDRLGYNNITILEKHHTVGGMCELVEIEVYDLGGQVSATSSAPVIFHLAKETGCPLEKSL

SEQ ID NO: 154304 - protein, 164 aa, Glycine max
  Coding DNA Sequence Number=SeqID_37526
  Homolog annotation: Hit_ID=Q4J4Q3; Match level="QueryCoverage=31%, HitCoverage=29%, E-value=8e-08, Identity=45%"; Hit description =Hypothetical protein precursor
  Subcellular localization annotation: CTP_CleavageSite=40; ConfidenceScore=5.42e-01
SAAAPAADAVLAAAAGLSAGRGAGRHFALSGGGVSGVGRRSALAWRAVWSGRSQWQSHPARSACAGVAHDGSAGWRTSVSQVMVKRNTTPIRQAESSPMMAISLSSRDSIDISLRASVVGCWPQLIHNVSIRTKIIRVTEVTASTTMAKKEAFFSGIAAQSVME

SEQ ID NO: 154305 - protein, 154 aa, Glycine max
  Coding DNA Sequence Number=SeqID_37527
  Gene Ontology: Mol. function=siderophore-iron transporter activity; Cellular component=outer membrane; Biological process=siderophore transport
  Homolog annotation: Hit_ID=Q6D988; Match level="QueryCoverage=98%, HitCoverage=20%, E-value=2e-52, Identity=65%"; Hit description =Putative ferric siderophore TonB-dependent receptor
  Pfam annotation: Domain name=TonB_dep_Rec; Domain location=17-154; Score=8.0; E_value=0.052; Accession=PF00593.14; Description=TonB dependent receptor
MDGEQRHRGVEANVFGEPVLGLRLNASATWIDPVMKKTAGGTYDGKQAIGVPRYTYVLGAEYDIKPVEGLTATALLNHSGAQYANSANTLKLDSYTTLDLGMRYRMKVNQNDLVWRVAVENVTNEKYWSNVDDTGTYLAQGDPRTLKISMSYDF

SEQ ID NO: 154306 - protein, 79 aa, Glycine max
  Coding DNA Sequence Number=SeqID_37528
  Homolog annotation: Hit_ID=Q9AYF0; Match level="QueryCoverage=88%, HitCoverage=5%, E-value=8e-10, Identity=43%"; Hit description =Helicase-like protein
MVESERLSYIRNNQKKLRVDKYSSLQTSLDTRTAKGLTKGKRVILPSTFVGSPRYMDQLYFDDLTKGQLLGKVVAYIHG

SEQ ID NO: 154307 - protein, 58 aa, Glycine max
  Coding DNA Sequence Number=SeqID_37529
  Subcellular localization annotation: CTP_CleavageSite=50; ConfidenceScore=5.36e-01
SLSAPLQVIKRAASAHPLSERSALSQKSLTCAKRSIRPLSARARTRQLIEAVTESNKH

SEQ ID NO: 154308 - protein, 251 aa, Glycine max
  Coding DNA Sequence Number=SeqID_37530
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=81; ConfidenceScore=5.73e-01
MARACSPLKSRACSPLKARTCSPLKARKCSPLKVRACSSLMARAWSPLKARTCSPLRARTCSLLKVRACCPLKVRMSSPLKAMACSPLKVRACSPLKGRMCSPLKMSMCSPLKGRTCSPLNVRRCSPLKARTCSHQKVRACCPLKAWTCSPLMARMCSLLKTRTCSPLKARTCSPLKARTCSPVKAMTCSPLMARTCSPLKTWTCSPLMARMCSPQKARTCCPLKARTCSPLMVRTCSPLKARTCSPLKAR

SEQ ID NO: 154309 - protein, 286 aa, Glycine max
  Coding DNA Sequence Number=SeqID_37531
  Homolog annotation: Hit_ID=Q10RA9; Match level="QueryCoverage=43%, HitCoverage=50%, E-value=1e-39, Identity=61%"; Hit description =Expressed protein
  Pfam annotation: Domain name=Alba; Domain location=17-87; Score =102.9; E_value=9.5e-28; Accession=PF01918.11; Description=Alba
MDRYQKVERPKPESPINENEIRITTQGAIRNYITYATSLLQEKHAREIVLKAMGQAISKTVAIAEILKKRIPKLHQDTGISSVSIVDTWEPIEEGLVPYQAPSNVEQPKPHSNYQQQSIKPAQVHNAVNEEVEVGVGGEVEEGIGEGVVMAIKVVMEIIKDTGITRGDNGGYSNRGRGGGRGRGWGYRGTGYEGGRGGGYEGGRGGGYEGGRGGGYEGGRGGGYEGGRGGGYEGGRGGGYEGGRGGGYEGGRGGGYERGRGGGRGYGRGRGRMGGRTRGGGGGNQA

SEQ ID NO: 154310 - protein, 105 aa, Glycine max
  Coding DNA Sequence Number=SeqID_37532
MSLHSSSSVNGEGATPKDPFHNLCKSLSEELHDYYEGRHRAHPRPHSHWREKERKPQEANINLPHFHGKDNVEANLDREIRVEQQLKRKSTSKSYDSHYYPKKDQ

SEQ ID NO: 154311 - protein, 61 aa, Glycine max
  Coding DNA Sequence Number=SeqID_37533
MVAFYNVSLSLSGQSLPFVGQSETLIIRALIHLIVSTQALGEHSPKGSRYINVQTSACLRK

SEQ ID NO: 154312 - protein, 109 aa, Glycine max
  Coding DNA Sequence Number=SeqID_37534
GTSFVVQVEGTSTWVVVTENKRGYISCGSVLVEGTSTRLFKENKGGYIPYGSLLVKDFTRLKRNLKNHSILKSKILAQSSTLVNEIASDDEGENASDMMGSGLTTHLEE

SEQ ID NO: 154313 - protein, 209 aa, Glycine max
  Coding DNA Sequence Number=SeqID_37535
MREIAHPSKHKHLLTSHQEGEHNPMMRPKGVDLTPNPFMQVKGRNKARVPRPQKRVIDFNIQTVLYVNKVPNELDPTNNNELGVAKGVKNWGVEEVGGSDEEEGVGANEGGVGLVLVLVLEAGSKAKDWLFFEEMLWMPWRKNHGWLRWLERVEKEDEEIMECHSLHTVEALIRMGIGRRDRISSMRKRERETHGVSGWRVEELIGAVR

SEQ ID NO: 154314 - protein, 101 aa, Glycine max
  Coding DNA Sequence Number=SeqID_37536
MQQVEEQARAVLAGGSAPRIPLRLCSTIPLGLLFHFLHFAFAFPPRQYAEAPLARAKETIYGSVVWTEFPNFLWKMGLQIWRRREKERKREKRERKEEADG

SEQ ID NO: 154315 - protein, 202 aa, Glycine max
  Coding DNA Sequence Number=SeqID_37537
MTRQHEFNNDDVANLLCIPDYTYEVGTLGKALRILRPNIRTLTQIWTNFSLDNGLQVDAVAIISDEMQKVITSAFSFTGSASRLSGFPALIIGLCKFHGVHIPTHPVKSIQPPINKVYIVTHCTNPLEEVQGLVPRHQPPSKAPITELMTMHFTYLEQQQVTNQQPYTSLNDYFYMLTIHQHQHPIELFPWLSPTQFSQHVA

SEQ ID NO: 154316 - protein, 441 aa, Glycine max
  Coding DNA Sequence Number=SeqID_37538
  Gene Ontology: Mol. function=heat shock protein binding; Cellular component=integral to membrane; Biological process=protein folding
  Homolog annotation: Hit_ID=Q10QF7; Match level="QueryCoverage=25%, HitCoverage=18%, E-value=8e-28, Identity=55%"; Hit description =Expressed protein
  Pfam annotation: Domain name=DnaJ; Domain location=376-439; Score= -13.2; E_value=0.084; Accession=PF00226.21; Description=DnaJ domain
MEDRSSARTRRSIFAGAAEPETLDPDDFADVFGGPPRSLLVHKFSRSNSFYEEIFRPPEFASPAPAKGSRSLPVFRIPAKNEAFYSDIFGSDDDRRSRERSGPQSKAKSKSNSSSALSSEELSPLRTAVGDDVALSAFASKLRPINVPCRWNSTTMMPGEHPIKQGGPLFPCNSQSFEIQFQDNEYKESFKSSHLGFSRRVSSPETISLESNSYQSMKVSADDWEISSPFSAVSGLCQEPEAKSSVHDHLFPELVIEQDDDDDEVMSSYVIEVNSNLREESCGTADLDEAIAWAKEKFQSRNSDEESSSRNEGNEQATTGVEGECHGDGIGEVKSSKVQTETEKLDRDIRSWSSGKETDIRLLLSTLHHILWPESGWYAVPLPNLIESSQVKKAYQKARLCLHPDKLQQRGATFLQKYIAEKAFSILQDAWTAFISEDVSF

SEQ ID NO: 154317 - protein, 104 aa, Glycine max
  Coding DNA Sequence Number=SeqID_37539
  Gene Ontology: Mol. function=protein serine/threonine kinase activity; Cellular component=integral to membrane; Biological process=protein amino acid phosphorylation
  Homolog annotation: Hit_ID=Q9LKZ6; Match level="QueryCoverage=88%, HitCoverage=16%, E-value=2e-19, Identity=72%"; Hit description =Receptor-like protein kinase 1
MSWSLFRNRFNRVRFFNSAKLAGTSSESMLWRELAEGEEVSKLGRDVASKLVAEEGEVLEVLPGAVLRKDLAEEEVAAEVKVAKKEHGGDGERNFQIHSHEDRI

SEQ ID NO: 154318 - protein, 94 aa, Glycine max
  Coding DNA Sequence Number=SeqID_37540
  Gene Ontology: Mol. function=RNA-directed DNA polymerase activity; Biological process=DNA integration
MDVKNAFLNGFIEEEVYVKQPQVQIDVDGIIFRATNESLCKDFSYMMKSEFKMSMTGELKFFLRLQIKQDSKDYAGDKLNEKAQVVDAIILNPV

SEQ ID NO: 154319 - protein, 137 aa, Glycine max
  Coding DNA Sequence Number=SeqID_37541
MVKNDNGIDHENISDAPRPRVFFFFLLLLTNFTENLSIYDAEPFSSAPSHLFVGNKGWRLHSSLPRRAGYFSPKLSGGPGKLKDNCTVKGPQIDMASDMALKYTRQAWNRTLVNLTWELEELILTTSTPTSISSKFW

SEQ ID NO: 154320 - protein, 306 aa, Glycine max
  Coding DNA Sequence Number=SeqID_37542
  Homolog annotation: Hit_ID=Q9LRY4; Match level="QueryCoverage=64%, HitCoverage=69%, E-value=4e-09, Identity=28%"; Hit description =Arabidopsis thaliana genomic DNA, chromosome 3, TAC clone:K7P8
MQILQWLFRRAHEQERKSSNNFNLPPKREDISEQNEGKEINLLKRDRSYKGTRRNKWSSPGCKNFKIFAFLYRKDIPKAFFYSTLNLKRLGSFNRKQFLYFMKMKREESSSRDVGNVNKADSGGQHVGNKVLPITEAPLSSSAERSDQCDATETKGQTKGDKKKPMSRMKELLRWAASAKTEKGGKFNGRKLYCNHKSITDCHNDQTATILVLMFRRRGTLKAVPDDDHGCTDSPKISFRWDVESCSTTSSVYSAISIASSSKNEQNQIATSTISIPPEHTGHNNNTSRKKGNWITTDSEFVVLEL

SEQ ID NO: 154321 - protein, 1480 aa, Glycine max
  Coding DNA Sequence Number=SeqID_37543
  Gene Ontology: Mol. function=RNA-directed DNA polymerase activity; Cellular component=chromatin; Biological process=chromatin assembly or disassembly
  Pfam annotation: Domain name=Chromo; Domain location=1385-1433; Score= 28.0; E_value=3.3e-05; Accession=PF00385.14; Description='chromo' (CHRromatin Organisation MOdifier
  Pfam annotation: Domain name=RVP_2; Domain location=319-455; Score= -31.9; E_value=0.0003; Accession=PF08284.2; Description=Retroviral aspartyl protease
  Pfam annotation: Domain name=rve; Domain location=1099-1238; Score =78.0; E_value=3e-20; Accession=PF00665.16; Description=Integrase core domain
  Pfam annotation: Domain name=zf-H2C2; Domain location=1040-1081; Score=15.2; E_value=0.0034; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1385-1433::319 -455::586-755::103-193::1099-1238::1040-1081
MADHATRKTTTDRLEDAITRLTHSQASLSDKYSELSGKVDSILDHLRLRDTNSNNPNAHASSAQRNHVKLDIPRFDGRDPLGWIFKITQLFDYQNTPEEERITVASFYLDGAALSWYQWMFRNGFITSWTGFLQALESRFAPTFYDDPKGALFKLAQRGTVNDYLTEFERLANRVIGLPPPFMLSCFISGLSPEIRREVLALQPISLPQATALAKLQEDKLRDRRRAFSRPTESSFPSTQPTNPSIKAKAPFVQRTPEEIAFRREKGLCYNCDERWNSTHRCKGRVLLFIADSPSPETTDSDPEPLSLPDDEHQDAQDQVTDDTFPHISLHALSGFPSSETFRLYGTINHARLTILIDSGSTHNFLQPRIAHFLRLPVRPTSPLRVLVGNGSVLDCNQLCSNTPLSLQGHFFNVSFHLLPISGADAVLGIEWLKQFGPVITDYTALIMKFHHLGQAIELHADVSNRPELVSVPQVKRLVRTGSTSALFHLNLLPVTRPEPPRHHLPHHHLPHPDPAIENLLRRYHQIFETPTTLPPPRTVTHHINLLPSSSPINVRPYRYPHFQKTEIEKQVSDLLAAGLIRTSTSPYSSPVLLVKKKDATWRMCVDYRALNAVTVRDRFPIPTIDELLDELGQSSWFSKLDLRQGFHQILMHEPDIEKTAFRTHQGHYEYRVMPFGLSNAPSTFQAAMNSLLTPFLRRCATVFFDDILVYSKTLSLHTQHLEMIFKALLDAQFYLKYTKCVFAQTQVDYLGHVVSGKGVKPDPSKIQAMLQWPTPTSVRELRGFLGLTGFYRKFVRNYASIASPLTTLLCKDGFEWNEDSQAAFDALKSAMTRAPILALPNFSEPFTVETDASQTAMGAVLVQRDHPVAFFSKVFGPRLTHASTYIRELHTIVTAVRKWRQYLLGRSFTILTDHKSIQELMTQVIQTPEQHYYLSKLLGFDYTIRYKSGASNIVADALSRAPPPSGQLLLLSVPHLDFISDLQQSLHSDQEFQTLLSKIQAQPSDYPNHQLHNGLILSQGRIWLPNTNPYIPTILLEYHATPLGGHMGVAKTTHRLESSFTWQNLKTDVKRFVRECKICQQTKTSTRRPGGLLQPLSLPTGVWEDISMDFITHLPASHGYTVIFVIVDRFSKGVHLGALPTHFSAYKVATLFIDLVCKHHGFPRSIVSDRDPIFLSSFWRELFRLHGTLLRMSTAYHPQTDGQTEPANWFRYLALAEWSYNTSLHTSSGFTPFEVIYGKPPPSLPHYLPGHTTNEAVDTLLTSRQEIHTKLRQRLLKAQEAMKHHTDSKREDVSFTVGQWVYVKLRPHRQRSVTGDTHSKLSKRFFGPFQILERIGPVAYRLRLPDNARIHPVFHCSLLRAHHGPPPSSLDTWPLQVVDHRPIPHPLCFLDSKMDHTTSPPTRLVLTQWKGQPPEDTTWEPWSELRDSYHLEDKVVFGEGGIDMPMHKPAPEATNPSPGVTRTRRETTTPHHLHDYVLE

SEQ ID NO: 154322 - protein, 64 aa, Glycine max
  Coding DNA Sequence Number=SeqID_37544
MSGKGYQLGKRIFGLCKELKKFDMLTFRNTRKVASNLKKPQLRLCRGTDGGSSRSRQEVVHGDN

SEQ ID NO: 154323 - protein, 589 aa, Glycine max
  Coding DNA Sequence Number=SeqID_37545
  Gene Ontology: Mol. function=transferase activity; Cellular component= intracellular; Biological process=translation
  Homolog annotation: Hit_ID=Q6Z277; Match level="QueryCoverage=99%, HitCoverage=84%, E-value=1e-65, Identity=26%"; Hit description =Putative fertility restorer homologue
  Pfam annotation: Domain name=PPR; Domain location=11-45; Score=16.0; E_value=0.095; Accession=PF01535.11; Description=PPR repeat
  Pfam annotation: Domain name=PPR; Domain location=138-172; Score =51.6; E_value=2.7e-12; Accession=PF01535.11; Description=PPR repeat
  Pfam annotation: Domain name=PPR; Domain location=173-207; Score =37.6; E_value=4.3e-08; Accession=PF01535.11; Description=PPR repeat
  Pfam annotation: Domain name=PPR; Domain location=208-242; Score =33.6; E_value=7e-07; Accession=PF01535.11; Description=PPR repeat
  Pfam annotation: Domain name=PPR; Domain location=243-277; Score =50.9; E_value=4.3e-12; Accession=PF01535.11; Description=PPR repeat
  Pfam annotation: Domain name=PPR; Domain location=278-312; Score =17.6; E_value=0.045; Accession=PF01535.11; Description=PPR repeat
  Pfam annotation: Domain name=PPR; Domain location=313-347; Score =31.3; E_value=3.3e-06; Accession=PF01535.11; Description=PPR repeat
  Pfam annotation: Domain name=PPR; Domain location=348-382; Score =38.4; E_value=2.5e-08; Accession=PF01535.11; Description=PPR repeat
  Pfam annotation: Domain name=PPR; Domain location=453-487; Score =26.8; E_value=7.6e-05; Accession=PF01535.11; Description=PPR repeat
  Pfam annotation: Domain name=PPR; Domain location=47-81; Score=2.8; E_ value=3.5; Accession=PF01535.11; Description=PPR repeat
  Pfam annotation: Domain name=PPR; Domain location=488-522; Score =42.3; E_value=1.7e-09; Accession=PF01535.11; Description=PPR repeat
  Pfam annotation: Domain name=PPR; Domain location=523-557; Score =49.2; E_value=1.4e-11; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=11-45::138-172::173 -207::208-242::243-277::278-312::313-347::348-382::453-487::47 -81::488-522::523-557
MSKLGWTPSLRSCNCLLAKLVWAGERDTTLMVFEQVLKMGIVPDVYMISIVVNTHLSRRGSVERAERFVEKMEGMGFEVNVVVYNALVGGRGRADEAERLLRRMGGWFWLIMCMQGQVGKAEKVFRGMGGWNVRPDFYSYNTLLDGYCREGRMGKAFMLCEEMIREGIDPSVVTYNMVLKGLVDVGSYGDALSLWRLMVERGVAPNEVSYCTLLDCFFKMGDFDRAMKLWKEILGRGFSKSTVAFNTMIGGLGKMGKVVEAQAVFDRMKELGCSPDEITYRTLSDGYCKIVCVVEAFRIKDTMERQTMSPSIEMYNSLINGLFKSRKSSDVANLLVEMQRRGLSPKAVTYGTHISGWCNEEKLDKAFSLYFEMIERGFSPSSVICSKIVISLYKYDRINEATGILDKMVDFDLLTVHKCSDKSVKNDFISLEAQGIADSLDKSAVCNSLPNSIVYNIAIYGLCKSGKIDEVRSVLSILLSRGFLHDNFTYGTLIHACSAAGDVDGAFNIRDEMVERGLIPNITTYNALINGLCKVGNMDRAQRLFHKLPQKGLVPNVVTYNILISGYCRIGDLNEASKLREKMIEGGIS

SEQ ID NO: 154324 - protein, 281 aa, Glycine max
  Coding DNA Sequence Number=SeqID_37546
MASVVVLKCQVKLANPEDSYKLTFQAYGSDDFLFFSTAPGRLPFFFMYRCLFEVLSVILPLNAFQCALLEHLNVAPSELYPKNWAMVLMMPRQKQHKFYFKFKSRPRKQRSRRKLSLSLSLLKESLSDCKVIEATCLTLPNKTVWQIGWLSLNSVFKKLFEFDSNVFHRFKDHFFKVLTTDVVANGMALMFNRDEEPRFLFYWQSDPSKIKSYDKDLLTLVGMIGDFARRPLVKQVGLVGGTVPLFVAAPFIGEGGQPIGEVCPVVVAIEVAPSAGCCGAR

SEQ ID NO: 154325 - protein, 115 aa, Glycine max
  Coding DNA Sequence Number=SeqID_37547
MDDDTPQWGRSADGNFTTKTTYESLISNHGQDTNNIFNHRFCNEDHRLLELSKLIVMEQFVQRIARLLVVGFSVTVMANSSWGLLVHFGDVWGGYGEVFKYFEWLAFGMSRVLGN

SEQ ID NO: 154326 - protein, 186 aa, Glycine max
  Coding DNA Sequence Number=SeqID_37548
ADMEAMKDQMAAMMEAMLSMKKIMEVNAAVVATISVVAEGGETLGSTDGPHVVQSKNSFPPYDLPPNYAPPNVVHVPDENADHSALVPLESQQAQLGHAHFAQPMGGILSPAMEEREKFDLIEERLRVIEGIEDYPFANMAELCLVPDVVIPPKFKVPDFDRYKGTTCPKNHLKMNFGKMGVYAKR

SEQ ID NO: 154327 - protein, 175 aa, Glycine max
  Coding DNA Sequence Number=SeqID_37549
  Gene Ontology: Mol. function=RNA-directed DNA polymerase activity; Biological process=RNA-dependent DNA replication
MALDRTQLQNMCKKEHESFKEYTQRWRDLATQVAPPMMEREIITMIVDTLPVFYYEKMVGYMPSSFVDLVFAGERIEVGLRRGKFDYVASTSAGNKKTSTGGAKKKEGDAHAITATPTWTKSQQTPHNPTYQYPPPQYNYSTNIGSPPIPMPIQQRMPTQPQRPPPQNPFLAQPR

SEQ ID NO: 154328 - protein, 320 aa, Glycine max
  Coding DNA Sequence Number=SeqID_37550
  Gene Ontology: Mol. function=protein binding; Cellular component =integral to membrane; Biological process=Notch signaling pathway
  Homolog annotation: Hit_ID=Q8GUM5; Match level="QueryCoverage=90%, HitCoverage=40%, E-value=1e-82, Identity=53%"; Hit description =Nicastrin precursor
  Subcellular localization annotation: CTP_CleavageSite=49; ConfidenceScore=5.10e-01
MELTVFSLFFFFFTFHLPSCFSGQSSSMESVPDLQNTMYASIDGYPCVRLMNLSGTIGCSNPGRDKVVAPILRFENVDKIAEPSAILVSLDEFPTLFTRISDDSSFASKVLGVLVEPTGDVQNKLKGFSPDQKFPQAQFALYHNTSYQWNSIGSGIMWKSYKFPVFLLTESGSKTLQEFVTKNEDKKKSYTSNVAEFDLVMQVKFLGLYSINAVKLDTMLIMQDIQDQNFRFLADNCLEPQKLSFCSVWSSLPPINISSLQQSKPILLTVASMDSASFFRDRSLGADSPISGLIALLAAVDALSHLDGLGDLSKQFLVHL

SEQ ID NO: 154329 - protein, 203 aa, Glycine max
  Coding DNA Sequence Number=SeqID_37551
  Gene Ontology: Mol. function=oxidoreductase activity, acting on NADH or NADPH; Cellular component=mitochondrion; Biological process=ATP synthesis coupled electron transport
  Homolog annotation: Hit_ID=Q9FGI6; Match level="QueryCoverage=67%, HitCoverage=18%, E-value=9e-46, Identity=69%"; Hit description=NADH -ubiquinone oxidoreductase 75 kDa subunit, mitochondrial precursor
  Pfam annotation: Domain name=Fer2; Domain location=129-193; Score =52.8; E_value=1.1e-12; Accession=PF00111.17; Description=2Fe-2S iron- sulfur cluster binding domain
GAGVCAWRMRSPSLWDGEVGGVMYWTRSQSSRVKEVSLRCKYACEEGVIAGLKTMISLREAIRPTSRLLLGSQNPTTFLLRTIVSKPELRNPEASAAQPEQPPAPDLPPRTPLAGARVHFSNPEDAIEVFVDGYPVKIPKGMTVLQACEVAGVDIPRFCYHSRLSIAGNCRMCLVEVEKSPKPVASCAMPALPGQPLQFPDFG

SEQ ID NO: 154330 - protein, 109 aa, Glycine max
  Coding DNA Sequence Number=SeqID_37552
  Gene Ontology: Mol. function=protein serine/threonine kinase activity; Biological process=protein amino acid phosphorylation
  Homolog annotation: Hit_ID=Q1SK93; Match level="QueryCoverage=58%, HitCoverage=15%, E-value=1e-16, Identity=59%"; Hit description=EPS15 homology (EH); Protein kinase
MTDPWLVFRSALSSVGSSLTDRLICLSSETPPSACLDVRVLIYDSVNLIMESCAAANLYNQIVTVVYDCHTMRVMHRDLKLENFMSLSKDDNSPLKATNLGLFVFFKPN

SEQ ID NO: 154331 - protein, 104 aa, Glycine max
  Coding DNA Sequence Number=SeqID_37553
  Homolog annotation: Hit_ID=Q1RYZ2; Match level="QueryCoverage=99%, HitCoverage=7%, E-value=8e-40, Identity=76%"; Hit description=NAD -binding site; Serine/threonine dehydratase, pyridoxal-phosphate- binding site; ...
  Homolog annotation: Hit description=AMP-dependent synthetase and ligase
MNSHKLAVIDSFSRKYQEVKVTDDYVFVMSPTLQIQVKNSGHFGVHALSEVASHLAPDYVEHHGLKSIPKSVAHGYTASGYGFIQHMPYAYIHEFTRTSMAGKI

SEQ ID NO: 154332 - protein, 124 aa, Glycine max
  Coding DNA Sequence Number=SeqID_37554
VPQRWGKEGDWKPPILNYPSRGFLFSLLQGFYFANSPIVKGYDAKVYFSQLQHDVEIYNGLVVCEKREGFERKREKTKKRGRGGIVVIFRVKYVKKRNMEEGDDHKAGFTALMSILRDTVKNWE

SEQ ID NO: 154333 - protein, 90 aa, Glycine max
  Coding DNA Sequence Number=SeqID_37555
  Homolog annotation: Hit_ID=Q9FJD4; Match level="QueryCoverage=48%, HitCoverage=5%, E-value=3e-12, Identity=77%"; Hit description =Importin beta
MPMLQSAVEVYAHTSGADDDMTEYTNSLTNGILKAYSGILLGFKAIQGNWPYELEEALHCTSLMKLATRQVVWDQIKKGGMKWFFINSKL

SEQ ID NO: 154334 - protein, 182 aa, Glycine max
  Coding DNA Sequence Number=SeqID_37556
  Homolog annotation: Hit_ID=Q1SWS9; Match level="QueryCoverage=40%, HitCoverage=36%, E-value=5e-09, Identity=44%"; Hit description =Ovarian tumour, otubain
METISKRFQQLDVYGKIHLKSKLREIVYPDMNSMYPPLEKVKTKGAPKKPLAKQQKSTKRDPSYWEIVIIGEEHLHKELTSWSDQYMNLVGGIEKFEELRHFLLVDNLSKVTMDKWMNIMDMGYVIASQYNVIVVSLSLQHSMTFFPLRSVVMRPLSFTTSGVAMEYTLSFSGKAVAHSVHS

SEQ ID NO: 154335 - protein, 47 aa, Glycine max
  Coding DNA Sequence Number=SeqID_37557
MEGPIHKESRVDVHENPNILFICLLICNILRVEFRHHQDLIKYHDDI

SEQ ID NO: 154336 - protein, 216 aa, Glycine max
  Coding DNA Sequence Number=SeqID_37558
  Gene Ontology: Mol. function=metal ion binding; Cellular component =cytoplasm; Biological process=ubiquitin cycle
  Homolog annotation: Hit_ID=Q9ZTM6; Match level="QueryCoverage=85%, HitCoverage=64%, E-value=5e-80, Identity=64%"; Hit description=PGPD14
  Pfam annotation: Domain name=zf-C3HC4; Domain location=77-119; Score =30.7; E_value=5.1e-06; Accession=PF00097.15; Description=Zinc finger, C3HC4 type (RING finger)
  Pfam annotation: Domain name=zf-MIZ; Domain location=73-122; Score= -11.5; E_value=0.04; Accession=PF02891.10; Description=MIZ zinc finger
  Pfam module annotation: Pfam domain module=zf-C3HC4::zf-MIZ; Domain location=77-119::73-122
VQQMCINCGVCMGRYFCSKCKFFDDDLSKKQFHCDECGICRNGGVENMFHCNTCGFCYSSYLKDKHKCMEKAMHTNCPICFEFLFDTTKAIALLACGHNMHLGCIRQLQQRLMYACPVCSKSFCDMSVIWEKVDEIIESRPMPEEYQNVKIWILCNDCVETSEVSFHTMALKCPKCKSYNTRRTQAAPAEPAASAESAESAAPAESDASSSSSRVE

SEQ ID NO: 154337 - protein, 202 aa, Glycine max
  Coding DNA Sequence Number=SeqID_37559
MAADKLKLNCDASVSLDQRKATAGGVFRNHLGSVIFTYAANIGFCSVLLADKVVILPIRAIVWPSVRGGGFELHQANQVADKMANHGMSLDNLADKFNVITVFNYHYNDDFISKKMVCEWWLSFPRRREKAFVMADDLFDGLPPPSSSTLILPQQQQQQQHNHEPILVATNNNNPESSAVPAPKPILKSALKRPNPTQPDTQ

SEQ ID NO: 154338 - protein, 277 aa, Glycine max
  Coding DNA Sequence Number=SeqID_37560
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=87%, HitCoverage=86%, E-value=6e-64, Identity=49%"; Hit description =Putative dioscorin class A
  Pfam annotation: Domain name=Carb_anhydrase; Domain location=35-268; Score=70.0; E_value=7.6e-18; Accession=PF00194.11; Description =Eukaryotic-type carbonic anhydrase
MQRQSHISVAISLICILFCSKLTRALDEPEYGYNEKSENGPQHWGDLKEEWADCKIGQMQSPIDLSTNGVEVIPKLGGLKYWNYKPQHAIVSNRGHDVAVMWEDDAGSIDINGTLFFLQQAHWHWPAEHTINGRRYDLELHMVHVSTQPDGTNKTAVVGILYKYGSPDPLLSKLGKYIMEIPEEDEEKSVGVIDPSEIIKGSKMYYRYMGSLTAPPCTEDIIWTVDKKVRTVSRGQVKLLKDTVLNYYAKWNARPLQFINQREIQLYVPKIKNKPLY

SEQ ID NO: 154339 - protein, 332 aa, Glycine max
  Coding DNA Sequence Number=SeqID_37561
  Homolog annotation: Hit_ID=Q017M6; Match level="QueryCoverage=71%, HitCoverage=40%, E-value=2e-07, Identity=25%"; Hit description =Homology to unknown gene
AAPKKSLKFKTTTDASEAQVIEAMQKITSHIKNPAKFSKAAKLAIQLIQAGSVKSEISDYFFAILEAAMSSSINSTDPSVRADYHSLFSVAQNTKEHLNKKQKNQLETWTINAVVANDLYTDDSFVFSKAAGQIKEAISNLPVATEEEDTEEAKSLKDSTVIADEGGKTPATDNDNEGEEAQADPFGLDALIPNSTKKGEKLKAKNEASVKIREDEEETNRFLKSQREALITCLEIAARRYKTPWCQTVIDILVKHAFDNVARFTARQRDAVGKLWASIREQQTRRKQGKSVNGKLDVNAFEWLQQKYAGEKISIRHSVGASGDRRAQQWLG

SEQ ID NO: 154340 - protein, 216 aa, Glycine max
  Coding DNA Sequence Number=SeqID_37562
MADNDGVRLWGLKITAQFRTYGGGNGGSRWLKEEGSHGHRLKGALKPSVFTPKTYTLKSPLGPFPPDSAIATSLTFYEISQVFPLTALIGFPNVREDEKGLKPPFHCLYSMGISPSTDISLQIPTGDSNSRYFHATANSRRKRNIISQLEDIDSSFKAQSHDDICEAHMDPKLNEDDNATLLAPFTIEEFRKAIFQMHNGKSPGLDGLNPTFYKKF

SEQ ID NO: 154341 - protein, 361 aa, Glycine max
  Coding DNA Sequence Number=SeqID_37563
MASRKRKAIASRHQEPYDTTRLTSEGAWERYSQNIHSRNTLSERNEYYSNLYEPEDKSPKQVRVRGRLIKFDATSLNAFREMPPVIQPGEQYPSYSIFCKLNADPQELASKLCIPSVLSYSNITPTSHTSDLNLDRARLVYELVMKMDMDLGFLISHQISHMAKSNSSRLGFPALISALCVARGVVSDSLTFESLSPAINLAYIKKNRWNLYDPMIEFPGTRKARARGSEGPSSAAPASFAPAPPPLPPAHSPAPVPSTPSSSFQHRCSEVTIPLLQSIHRGLCLVMQSMHDSAQHQPFIRMDEFMAQVAWPGVQPSPLGGEVAHEATPEATPQVSHATSPVVEVSEGEEGVEDTDYAVDL

SEQ ID NO: 154342 - protein, 121 aa, Glycine max
  Coding DNA Sequence Number=SeqID_37564
DNESSTAHAPQQHEPELENNHSSEATISGAVDCKTRRLETRSNEVVHHGPVPALADAPFLGVDPSSPQHAADSSIPILEIHEGQTIPVLPLDTSPPVTPVWHLTDEKNVQIQDNQDQSQEF

SEQ ID NO: 154343 - protein, 82 aa, Glycine max
  Coding DNA Sequence Number=SeqID_37565
MMLLSLKECMSNRCNPGWRNHLNLRWSSPQQQQQQPAPSFQNASGPSRPYVPPPMQQHNSHSSNNNNNNRDNNQLRPLLNLP

SEQ ID NO: 154344 - protein, 50 aa, Glycine max
  Coding DNA Sequence Number=SeqID_37566
MPVNFLIDEDVKFQLENEIEQPSTRVELKQKQKQVRVKPATLLAEQGLIM

SEQ ID NO: 154345 - protein, 97 aa, Glycine max
  Coding DNA Sequence Number=SeqID_37567
MEKELKSGMRWLPRKENKIRFFYNIVEEVRNIMTTSIIKDIKECKVGNSNILEHSSKYDFRPYIKKYNLLQIMSTNYMLLMNQTLHANHCKTHTWLT

SEQ ID NO: 154346 - protein, 199 aa, Glycine max
  Coding DNA Sequence Number=SeqID_37568
  Homolog annotation: Hit_ID=Q1SBR5; Match level="QueryCoverage=87%, HitCoverage=21%, E-value=2e-08, Identity=26%"; Hit description =Glutamic acid-rich protein cNBL1500
MDFFSNESFECFQAFENYNLIPFMSLKLPVYSELAKAFYSNLEIHEGTLISEVYGIKMVIDQPLFYDLTQLPSEGVPFEDALIDDWKFDFSVHDARRLVCTNQTDMARRLLAGSLAFESRILYYLIVRMLLPRSSNLAQVSEEDLIVMWAFHKGLQIDWAHLVRYRMHKALRLNAPLPYPHLVTLFLQHFNIPLDSEPY

SEQ ID NO: 154347 - protein, 88 aa, Glycine max
  Coding DNA Sequence Number=SeqID_37569
MVQREWMKELAFPMTRNVVDSDSKCPFAFSKVQGRVVIDYTNMIINYQRATLPEITVCNRLHYYGNRLPMVILARKQKPKGFLGEKKF

SEQ ID NO: 154348 - protein, 84 aa, Glycine max
  Coding DNA Sequence Number=SeqID_37570
MTNLLRYLLFLLTKIQGTNRLRILCLNTGAYILCGRSRASSEAYIHLVFQREQGRVHLLWLFACKGFYKVKGNLKNRWLLGYWM

SEQ ID NO: 154349 - protein, 203 aa, Glycine max
  Coding DNA Sequence Number=SeqID_37571
MAFFQGYTKYKVWGEKVASAQDFGRQPKGEDHFKSWFPFFSYLVVAILHCLDICLLSHVNAHSRKDGIPQLTLQQGKVKVVVAREDVAEQQRHPHLGQGGHAGAHDPHSPPCDSPGKILRWCTQQLGDGLLVETVILVPPLAVLALLTLFQDQRVVQELFKGVCVKSNPLAHYPRAHVTDSFFGGPGVGVEFHDNFEIELSHR

SEQ ID NO: 154350 - protein, 52 aa, Glycine max
  Coding DNA Sequence Number=SeqID_37572
MTFILAQECRQIREREREGGIGVEEGRTWHVSLQAATVIGQCNTEKQQLQLY

SEQ ID NO: 154351 - protein, 415 aa, Glycine max
  Coding DNA Sequence Number=SeqID_37573
  Homolog annotation: Hit_ID=Q9SK61; Match level="QueryCoverage=77%, HitCoverage=94%, E-value=5e-80, Identity=46%"; Hit description =Expressed protein
MRRNHSNSGNYRNPCLTMHQPWASLLVYGIKRVEGRSWPAPITGRLWIHAASKVPEESTIKAMEYFYKEIYALNGITDIQFPQHYPVSRLLGIIPQPRSLLNVNSVQFIAHQFECLITGCVEVVGCLTRDELACWEMVPEGVRVEAQTDYCWLCERPQKLLIPFEMRGYQGVYNLEKKIYEAAVRGLSPVNSPLPVKFPLPDPQNPFSLKPGSISALTPNLKATEVDKSSSISLAIAGAQAAATQFSKKDQNSHSTAQNNAPTNMNANNEDTEVATSYNLRSQGRSMEKGNISSTKLSKTFDDLTLPSYHEEKSSRNRSEGSSKQNRSPGAEADLRQFPQPPSKVSLSENGVFIECERISVALDGEKDGYPFFILGKDEGSGQTEAAHLCMYPLPCFVYECKVAPATQGISHILK

SEQ ID NO: 154352 - protein, 408 aa, Glycine max
  Coding DNA Sequence Number=SeqID_37574
  Homolog annotation: Hit_ID=Q7XDY9; Match level="QueryCoverage=89%, HitCoverage=86%, E-value=7e-24, Identity=37%"; Hit description =Expressed protein
  Subcellular localization annotation: CTP_CleavageSite=86; ConfidenceScore=5.51e-01
MLSLSVPPLNLKPITPNDLFLSSASPSPHRRYFVKPISAVLNSSSFKKPEQPLLPQHQVYQPFRPPPSPLPSQFGTLDIAGRIDILANRLGLWYEYAPLINSLIREGFSPPTIEETTGISGVEQNRLIVGAQCPRLPRPLQCLTPTSSLPSRPAAPSSSTRSVSSAPRSAVAAARFLVENRCDGKCRAGARTQSREHRNPSEQRTSALEQALRVAETEAARNMILEELEGNGEEGDKVDAGEGAVRVPVVRLRIGEVAEASSVVVLPVSAAEEREILEAPYESRSQGVFGVVVAEKGWGKWVVLPSWDPVVGLGKGGVVVSFPDARVLPWKVNRWYKEEPILVVADRSKKEVGADDGFYLVNADGEGLKVERGSGLKEKGFTQSLGTVLLVVRPPKEENDELSDEDWE

SEQ ID NO: 154353 - protein, 66 aa, Glycine max
  Coding DNA Sequence Number=SeqID_37575
MGIRVPDSRREYVGMERMDTNADSFVTSCSTSLNAWMQSITPLSTDYNLLLLMIHEPKLNHSDTEK

SEQ ID NO: 154354 - protein, 166 aa, Glycine max
  Coding DNA Sequence Number=SeqID_37576
MRQVAGGYTQVIICTKTASADLDPYVRGIYPSGRRIYQVIIRTKTTSVVPDPCVRWEADIPKCLLVQRQHLLILTHASGGSISVQRQHLLILTHESEIPFGYPHTCFRYSKAINVLLSSQDNQILLVIQGQSSKMTCQKPLLLSKNDKSDSIRDVMVFTNRAIGRL

SEQ ID NO: 154355 - protein, 323 aa, Glycine max
  Coding DNA Sequence Number=SeqID_37577
  Gene Ontology: Mol. function=nucleic acid binding; Cellular component= intracellular; Biological process=DNA integration
MSNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQGQENKVCKLRKSLYGLKQAPKQWYEKFDQTLNDDSRFGSVMFLMNCTRPDIAYAVSRLSRYTHNPGNEHWIALCRLLRYLKGGGAISWKSSKQTCIARSTMESEFIALNLAGQEAEWLRNLLADVPLWGKRSIPVSLHCDSEAAIGIAKNSVYNGKRRHIRIRHSSVRELLKNGVISLQFVRSENNLADPFTKGLTKKVVLESSRGMGLKPLC

SEQ ID NO: 154356 - protein, 220 aa, Glycine max
  Coding DNA Sequence Number=SeqID_37578
  Gene Ontology: Mol. function=nucleic acid binding; Biological process= DNA integration
  Pfam annotation: Domain name=RVP; Domain location=71-173; Score= -13.2; E_value=0.076; Accession=PF00077.10; Description=Retroviral aspartyl protease
MAGSLSKIIPDMSKIEPLDGSNYRRWSQKLLILFEALEVDYVLFEDPPADVNASESSTPETPATPVVTPLPAETQEEGLANMVDNKVDWILDTGASKHLCANKELFHQIEDADDGECVFMGNSATTGVLGKGKILLKLTSGKTLSLSDVLYVPSLRRNLISGSCLNRAGLKLVFEADKVVITKNGFIHETSAPYTPQQNGIAERTNRTLKEMMNAMLLSS

SEQ ID NO: 154357 - protein, 163 aa, Glycine max
  Coding DNA Sequence Number=SeqID_37579
  Homolog annotation: Hit_ID=Q0EAF2; Match level="QueryCoverage=36%, HitCoverage=18%, E-value=8e-23, Identity=88%"; Hit description =Catalytic subunit of protein phosphatase 1
MFKHETTPFREGVMLGLKLTSNKNDNMQFKKKKTTEITANLNGCFKLQQIRLLQENLSGSGTEMADLRLRQLHLLPRPAANFEKAIDYVVQKSLVHLFPSQKKHKVNVSVGACLGEDDDQTAVVLLAEGCRLRMTAWGDYGHWFLRGGEERKSGNWFERRGFD

SEQ ID NO: 154358 - protein, 493 aa, Glycine max
  Coding DNA Sequence Number=SeqID_37580
  Gene Ontology: Mol. function=nucleic acid binding; Cellular component= intracellular; Biological process=DNA integration
  Homolog annotation: Hit_ID=Q1S1X7; Match level="QueryCoverage=96%, HitCoverage=36%, E-value=1e-169, Identity=60%"; Hit description =Integrase, catalytic region; Zinc finger, CCHC-type; Peptidase aspartic, catalytic
MKNDTWKLVEKPAKQKVVGCKWIFKRKPEEIGMDSYRYKARLVARGFTQREGIDYNEIFFPVVKHTSIRIILALVAVHNLELEQMDVKITFLHRNLEETIYMSQLEGYEVKGKEEMVCLLKKSLYGLKQSPRQWYKIFDSFVVSKGFSRSSYDSCVYFRRLKPDCFIYLLLYVDDMLIASADMEAIKELKNLLQSKFEIKDLGAARRILGMDIIRKRNEGLLYLSQLSYVQKLLRRFNMLDSKPVSTPIAGHFKLSITHSPQTEDEIKDMSRIPYSNATGSLMYAMVCTRPDLAYSASIVSRFMANPGKQHWSAVKWILRYLKGSKSVGLVYGRNSERINGLSGYVDADYAGDIDKRRSLTGYLFTLYGSVISWKANLQSVMALSTTEAEYITLTEAIKEAIWLKGLVHELEGKTGPIEVWCDSQSAIDLSKNQVFHERTKHIDIRMHCIQDIIAQGEVEVRKVAGANNPADMLTKGGELAGPNIEDPRWRLL

SEQ ID NO: 154359 - protein, 252 aa, Glycine max
  Coding DNA Sequence Number=SeqID_37581
  Gene Ontology: Mol. function=hydrolase activity; Cellular component =nucleus; Biological process=carbohydrate metabolic process
  Homolog annotation: Hit_ID=Q0EAF2; Match level="QueryCoverage=73%, HitCoverage=57%, E-value=1e-106, Identity=95%"; Hit description =Catalytic subunit of protein phosphatase 1
  Pfam annotation: Domain name=Metallophos; Domain location=50-238; Score=130.6; E_value=4.4e-36; Accession=PF00149.18; Description =Calcineurin-like phosphoesterase
MVRYIQYPCKTKYVVLVVEEFIFMNSNNDSARSSNLKQQNFNQNIQNPCDVHGQYSDLLRLFEYGGLPPEANYLFLGDYVDRGKQSLETICLLLAYKIKYPENFFLLRGNHECASINRIYGFYDECKRRFNVRLWKTFTECFNCLPVAALIDEKILCMHGGLSPDILNLDQIRNLQRPTDVPDTGLLCDLLWSDPSKEVQGWGMNDRGVSYTFGADKVSEFLQKHDLDLICRAHQVKLPAFGVQCVMPSLLG

SEQ ID NO: 154360 - protein, 739 aa, Glycine max
  Coding DNA Sequence Number=SeqID_37582
  Gene Ontology: Mol. function=nucleic acid binding; Cellular component= intracellular; Biological process=DNA integration
  Pfam annotation: Domain name=RVP; Domain location=189-290; Score= -9.8; E_value=0.036; Accession=PF00077.10; Description=Retroviral aspartyl protease
  Pfam annotation: Domain name=rve; Domain location=391-530; Score =27.8; E_value=2.8e-05; Accession=PF00665.16; Description=Integrase core domain
  Pfam annotation: Domain name=zf-CCHC; Domain location=151-168; Score =30.7; E_value=5.1e-06; Accession=PF00098.13; Description=Zinc knuckle
  Pfam module annotation: Pfam domain module=RVP::RVT_2::rve::zf-CCHC; Domain location=189-290::639-737::391-530::151-168
RDLAMGTRFDVEKFTGENDFSLRRIKMQALLVHQGLDDALQGASKLPSTLSDKEKKDLLSKAHSTIILSLGDEVLREAVLDLKSVDVRIDEEDQAVMLLCSLPSSFENLVDTMLFGRDTLTLEEALMARGRLEKRDSKSKNKKRSKSRNKKACYYCKKEGHFRKECPERKKKNNGKYNDESDIAVVADGYESAEVLSISTEKHSEEWILDSGCSFHMTPNLEWFSSYKEIDGGKVLVGNNMACNVIGIGTVKLKMQDGSVKLLLDVRHVPELKRNLLSLGMLDQSGCSFKGEGGTLKVFKGSLQIMKGTRQNDLYKLQGNIILNSACLVSISEPNASKLWHYRLGHVSEKGLEELHKQGLIDNGNYQKLSFCEHCVYGNQKRVSFHNATHTTQGILDYVHSDVWGPAKVLSLGGAKYFITFIDDWSRKVWTYLLKHKNQAFKCFKQWKLLVENQTGRHVKLLRTDNGLEYLSKLEPRAKKGIFLGYPEGVKGYKVWLLDPEGPKSIMSRDVLFREEDMITDYQQKSDSIRKGVQAEQNRHSDQGIRLEVEKLAQTSSPVEDRNEASHDEPMISSIPEPVDTSYNLVRDRQRRQIKAPVRLGYADLIAYALSIEIDNQGSEPISYKDAISRTDSDQWRSAMQDEFDSLMKNDTWKLVEKPAKQTVVGCKWNFKRKPEETGMDSYRYKARLVARVVKHTSIKIILALVAVHNLELEQMDERGDGMFAEEISVWTETIPKAV

SEQ ID NO: 154361 - protein, 47 aa, Glycine max
  Coding DNA Sequence Number=SeqID_37583
  Subcellular localization annotation: CTP_CleavageSite=5; ConfidenceScore=5.10e-01
MAYALAYYKMHDKGVRTTSTNPVAPSTRFFYTLDSLRTVSPSSSSHA

SEQ ID NO: 154362 - protein, 83 aa, Glycine max
  Coding DNA Sequence Number=SeqID_37584
  Homolog annotation: Hit_ID=Q8GRZ5; Match level="QueryCoverage=42%, HitCoverage=13%, E-value=5e-13, Identity=91%"; Hit description =Phosphoenolpyruvate carboxylase kinase
MEEGFVDEFAGVGFVGEWVEAAEDGAETTATDLLAKLREKSPNQCILEPNIPSVDTLHSYTTFHALRTAIHAFTYTPTSNFLL

SEQ ID NO: 154363 - protein, 132 aa, Glycine max
  Coding DNA Sequence Number=SeqID_37585
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIREVIKKDLKLNDLDRSMLCKIDSEGKARKVTRCSCNCATMTTSLHQLRLMFFLLHE

SEQ ID NO: 154364 - protein, 190 aa, Glycine max
  Coding DNA Sequence Number=SeqID_37586
  Gene Ontology: Mol. function=calcium ion binding; Cellular component =mitochondrion
  Homolog annotation: Hit_ID=Q5QIT3; Match level="QueryCoverage=84%, HitCoverage=29%, E-value=2e-42, Identity=57%"; Hit description =Protein phosphatase 2A beta
MEVVTDAASLDLELLQLPEFSGLALKSNLNFIEKLFDQWLSLPESNRLVTSLLNEAKSGAPLTVPGNCSSPNASSNSLPSMFPAGTAPPLSPRSTSGSPRIVKHRVGPSNLGSPLKVVSEPVKEVIPQFYFQHGPPPPNELKEECLFKIDRLFHDHMDGMQRQQEKKGGSSKNENVKMNVWLHKNSQDTK

SEQ ID NO: 154365 - protein, 66 aa, Glycine max
  Coding DNA Sequence Number=SeqID_37587
MELPYVATYLTTGRRKKIKEAPSKKKTSGSFHQRLFEENIRKTKKWKEPFGVGEARPSELELTQSS

SEQ ID NO: 154366 - protein, 107 aa, Glycine max
  Coding DNA Sequence Number=SeqID_37588
  Gene Ontology: Mol. function=nucleic acid binding
MSTLITHVKITEGYTTMYCKAWLAKQKAIENIYGNWERSFCDLSKLLQAMQQFLPGMVMEKETLPMSPQGGQTVEGFANSIVFFKVSNYGFQYCKFVVQVDGTWLYD

SEQ ID NO: 154367 - protein, 78 aa, Glycine max
  Coding DNA Sequence Number=SeqID_37589
  Subcellular localization annotation: CTP_CleavageSite=40; ConfidenceScore=5.49e-01
SYWCLSFFITFCFLLSLAHQWAKRASTAKRSFSATKESGRASASRPHAKPEISALSTTGVFSQAQRMTDAKPESTYPR

SEQ ID NO: 154368 - protein, 151 aa, Glycine max
  Coding DNA Sequence Number=SeqID_37590
  Homolog annotation: Hit_ID=Q1SFS3; Match level="QueryCoverage=60%, HitCoverage=16%, E-value=5e-07, Identity=40%"; Hit description =Lambda repressor-like, DNA-binding
MTGPLQMQAFRKAYGKILDLTIAEEILGCPLGGRKPYLFSGFLPSLSKIAVVKYLDGKARDMANQEEWVPFADALALLIFGVVLFPNVDGLVDLSTIDAFLAYHHRKESPVVAILADLFDTFDRREAEQSTGFLDGRKERRKFSSHVGTVA

SEQ ID NO: 154369 - protein, 184 aa, Glycine max
  Coding DNA Sequence Number=SeqID_37591
  Gene Ontology: Mol. function=DNA binding
  Homolog annotation: Hit_ID=Q1S0F5; Match level="QueryCoverage=82%, HitCoverage=31%, E-value=3e-10, Identity=29%"; Hit description=IMP dehydrogenase/GMP reductase
MEEFEEILGCPLGGRKPYLFYGFYPSVARIAKVVKIMAQDLDRVKKNRNGIVGIPRKHLEEKAKALADQGEWASFIDVLVLLVFGVILFPNVDGLVDLAAIDSFLAYQHSKESPVAAILADVYDTFDQRCKKSGARIICCTPTLYVWLVSHLFLHESRPACPLQGHNICTEKGKAIWEQLLASV

SEQ ID NO: 154370 - protein, 137 aa, Glycine max
  Coding DNA Sequence Number=SeqID_37592
  Homolog annotation: Hit_ID=Q9AVH2; Match level="QueryCoverage=99%, HitCoverage=68%, E-value=1e-26, Identity=41%"; Hit description =Putative senescence-associated protein
MIGRADIEGSKSNVAMNAWLPQASYPCGNFLTPLASNSDGRRTISTLHDVPLQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 154371 - protein, 63 aa, Glycine max
  Coding DNA Sequence Number=SeqID_37593
MEMEMGKMNQGNILRANTNGNDADVAPKFSPLKIVHFGNPSQDTVDPRDGGFGGRLWRWKWEK

SEQ ID NO: 154372 - protein, 332 aa, Glycine max
  Coding DNA Sequence Number=SeqID_37594
  Gene Ontology: Mol. function=calcium ion binding; Cellular component =mitochondrion; Biological process=protein amino acid phosphorylation
  Homolog annotation: Hit_ID=Q7XDD8; Match level="QueryCoverage=78%, HitCoverage=73%, E-value=4e-48, Identity=28%"; Hit description =Pentatricopeptide, putative, expressed
  Pfam annotation: Domain name=PPR; Domain location=114-148; Score =29.1; E_value=1.6e-05; Accession=PF01535.11; Description=PPR repeat
  Pfam annotation: Domain name=PPR; Domain location=149-183; Score =51.0; E_value=3.8e-12; Accession=PF01535.11; Description=PPR repeat
  Pfam annotation: Domain name=PPR; Domain location=184-217; Score=8.2; E_value=0.8; Accession=PF01535.11; Description=PPR repeat
  Pfam annotation: Domain name=PPR; Domain location=218-252; Score =28.7; E_value=2.1e-05; Accession=PF01535.11; Description=PPR repeat
  Pfam annotation: Domain name=PPR; Domain location=44-78; Score=30.0; E_value=8.5e-06; Accession=PF01535.11; Description=PPR repeat
  Pfam annotation: Domain name=PPR; Domain location=79-113; Score=43.9; E_value=5.4e-10; Accession=PF01535.11; Description=PPR repeat
  Pfam annotation: Domain name=PPR; Domain location=9-43; Score=18.3; E_ value=0.028; Accession=PF01535.11; Description=PPR repeat
  Pfam module annotation: Pfam domain module=PPR::PPR::PPR::PPR::PPR::PP R::PPR; Domain location=114-148::149-183::184-217::218-252::44-78::79- 113::9-43
MEGCYPDIVTYNSLVNLTSKQGKYEDTALVILNLLSHGMQPNAVTYNTLIHSLINHGYWDEVEDIMKIMNETSSPPTHVTYNILLNGLCKSGLLDVAISFYSTMVTENCSPDIITYNTLLSGLCKEGFIDEGIQLLNLLVGTSSSPGLVTYNIVIDGLARLGSMESAKELHDEMVGKGIIPDEITNSSLTWGFCWADKLEEAMELLKEMSMKERIKNTAYRCVILGLCRQKKVDIAIQVLDLMVKSQCNPDERIYSALIKAVADGDCPGKFNTSGHVQESLLGSFDRYLRGTARSNSIGYSHSARTKISVVEVDMNMCSCQSNLQVCRFLIT

SEQ ID NO: 154373 - protein, 60 aa, Glycine max
  Coding DNA Sequence Number=SeqID_37595
MNAERLKNPTQGGTKGPTAQRIRENEAHTQPKASYESREGKTKASTGNPSKRKVLHQLKS

SEQ ID NO: 154374 - protein, 72 aa, Glycine max
  Coding DNA Sequence Number=SeqID_37596
MALQTASLVLACFLGKSGGSLKDSTLFGLLLSEPIKANLSSSTLRCKREGDARLMGASSKGGKCAESPPMFI

SEQ ID NO: 154375 - protein, 82 aa, Glycine max
  Coding DNA Sequence Number=SeqID_37597
MAESHSKETENGKERCAAQVTGWNLCKSDCVLKLVLGGVAEIQSVDAIQYHPTPISLVINSINALPSFVCWICLWFSSALIR

SEQ ID NO: 154376 - protein, 212 aa, Glycine max
  Coding DNA Sequence Number=SeqID_37598
  Gene Ontology: Mol. function=RNA-directed DNA polymerase activity; Biological process=RNA-dependent DNA replication
MFSAGWMCEGRVAMIHEETLQEKPNWVRSCPPEFKLGNWRIVKQPRIFMANSISDNECFEGNNTEDPNIDFEQLISQAEEGEDEDWGLPPKLKRMVEQEDREVKPHQEEMEIVNLGVGEERKEVKVGTSMSTNIRDELVALLRNYQDIFAWSYQDMSDLSADIVQHRLPLNPKCSPIKQKLRRMKPEMSLKIKEEVKMKFDVGFLAVARYLE

SEQ ID NO: 154377 - protein, 209 aa, Glycine max
  Coding DNA Sequence Number=SeqID_37599
MHALLRSFKSGNWSESKVLDSVGLSCRAFTRNLGAISLLNSLYDCSYSHLFLHNRRLFAEIAYQITQVPRVFDTRFLSFYTTCAIQCTCRKLELGFEDQKIDFDLFVEDRPAPEHNVCLQRISVHVLSRESQALSAQPLHLRLIWSAKLAKVELSELKFDLNSAKLQPDRYATTYPWLSGTYCRQAQFLMALIEVHDTKRQSWQLSEIH

SEQ ID NO: 154378 - protein, 237 aa, Glycine max
  Coding DNA Sequence Number=SeqID_37600
  Homolog annotation: Hit_ID=O82268; Match level="QueryCoverage=51%, HitCoverage=56%, E-value=8e-48, Identity=76%"; Hit description =Expressed protein
MGRSPNYKGIRRIAYPANTSRLCLKIANIAKVNPDGACAEGVGLRAAAVLLVGGAEAADEGVEAAPGLAERAGTWGRWVGETEERARVVMNLSLPELVEVVEEFQHVRTAAQGQGEWRTVVPQVLAERVPVPSLLVLVAARSSSAPAVVASRRQQRHCRRRRWMIRGARAGYCLHLVPAAGGVAGKGRPRRQQQPGHVRVVIGGKWNDSWVKGKGVVKNRGLNEGEESVVPKQDKVW

SEQ ID NO: 154379 - protein, 62 aa, Glycine max
  Coding DNA Sequence Number=SeqID_37601
MAKKYNHPVHVDDEEFDIRFSQHRYEATSCGDNSKTHPPQTLPRRDLGLKSFDTTTGGLKNG

SEQ ID NO: 154380 - protein, 97 aa, Glycine max
  Coding DNA Sequence Number=SeqID_37602
MAPPDSIPIVEKFNEMVAWPETQPSLHKEDEGPTAQVAATTPEQSLEATSEPSAPVVNLPSPQLAADPSTPLLQMPEDPTTPVLVWTLLLPLLQCFN

SEQ ID NO: 154381 - protein, 962 aa, Glycine max
  Coding DNA Sequence Number=SeqID_37603
  Gene Ontology: Mol. function=DNA binding; Cellular component=nucleus; Biological process=regulation of transcription
  Homolog annotation: Hit_ID=P92948; Match level="QueryCoverage=85%, HitCoverage=97%, E-value=0.0, Identity=70%"; Hit description=Myb -like DNA binding protein
  Pfam annotation: Domain name=Myb_DNA-binding; Domain location=59-103; Score=41.7; E_value=2.5e-09; Accession=PF00249.21; Description=Myb -like DNA-binding domain
  Pfam annotation: Domain name=Myb_DNA-binding; Domain location=7-53; Score=52.4; E_value=1.6e-12; Accession=PF00249.21; Description=Myb -like DNA-binding domain
  Pfam module annotation: Pfam domain module=Myb_DNA-binding::Myb_DNA -binding; Domain location=59-103::7-53
MRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDVACVKDENYEPGDDPRKLRPGEIDPNPESKPARPDPVDMDEDEKEMLSEARARLANTKGKKAKRKAREKQLEEARRLASLQKKRELKAAGIDIRQRKRKRKGIDYNAEIPFEKRPPPGFFDVTDEDRPVEQPQFPTTIEELEGKRRVDVEAQLRKQDIAKNKIAQRQDAPSAILHANKLNDPETVRKRSKLMLPPPQISDQELDDIAKLGYASDLAGSQELAEGSRATQALLTNYAQTPGQGMTPLRTPQRTPAGKGDAIMMEAENLARLRESQTPLLGGENPELHPSDFSGVTPKKKEIQTPNPMLTPSATPGAAGLTPRIGMTPTRDGFSFSMTPKGTPLRDELHINEDMNMHDSTKLELQRQADMRRSLRSGLGSLPQPKNEYQIVMPPVLEDAEEPEEKIEEDMSDRIAREKAEEEARQQALLRKRSKVLQRELPRPPTASLELIRNSLMRTDGDKSSFVPPTSIEQADEMIRRELLTLLEHDNGKYPLDDKVIKEKKKGAKRAVNGSAVPVIEDFQEDEMKEADKLIKEEALYLCAAMGHEDEPLDEFIEAHRTCLNDLMYFPTRNAYGLSSVAGNMEKLAALQNEFENVRNKLDDGKEKMVRLEKKVMVLTQGYEMRVKKSLWPQIEATFKQMDVAATELECFKALQKQEQLAASHRINNLWGEVQKQKELEKTLQNRYGSLIEELEKMQNVMDQCRLLAQQQEEIEANNHARESTEIIESKAGETDVQSTENCETVPDSVEHGHALAVESSDDGTADQQVDIVHDQATSSVSHDMDVDSDKLANPTPAAENVDGKLEVTATASYTDDGKTMLEMGAAVEVSSSPNHDVVADAVNSHDNSMEETNAVGEETN

SEQ ID NO: 154382 - protein, 51 aa, Glycine max
  Coding DNA Sequence Number=SeqID_37604
MAKHPISPAPSAGQQYLVLPRLLAKCVAMGSANPIGETRAIAFQKKRSGQA

SEQ ID NO: 154383 - protein, 163 aa, Glycine max
  Coding DNA Sequence Number=SeqID_37605
MYYGEGNVGSHPIDSLRYFGSEKSKEEFTHPRGLDKEFEEKELNVKILKSLNRTWQPKKQQQGGEKKAKSHNKKKTYIAWEENASSSSSDSSDEEEAYLCLMVDNEVESVKGGRSGKHFSSNEELFLSTWSFKVSCFFSQTRLDSPRQMKPVKTGVHPMSFLA

SEQ ID NO: 154384 - protein, 675 aa, Glycine max
  Coding DNA Sequence Number=SeqID_37606
  Gene Ontology: Mol. function=RNA-directed DNA polymerase activity; Cellular component=chromatin; Biological process=chromatin assembly or disassembly
  Pfam annotation: Domain name=Chromo; Domain location=573-627; Score =29.8; E_value=9.7e-06; Accession=PF00385.14; Description='chromo' (CHRromatin Organisation MOdifier
  Pfam annotation: Domain name=RVP_2; Domain location=333-454; Score= -49.0; E_value=0.0066; Accession=PF08284.2; Description=Retroviral aspartyl protease
  Pfam module annotation: Pfam domain module=Chromo::RVP_2::Retrotrans _gag; Domain location=573-627::333-454::133-223
MEQMQAEIEALKAQVPQVDVLRRHFLCRLGSFALIPLPILPLSLTRGTSDTDCNIGAFVESFRFECIQTCMMSQLLDNVESRITSIETFLHSHDASMQRHEIFETPPHGSSRPDDLRLVTKQVNLPPFTSEDPLAQISMDGMTWRWFKVLSDFDAYLTRATFKCALLECYGDNQLGNPFSQLKLLRQTTIIDGYVEAFEILTVQVPLLTEEQYMGLFLGGLRKDIRLKVLAFEPLNRHRLIFVARLIKCKLGRVTTHSANGLISAVHSASGSTGSHNRGPRSGPITQAQPLHDPQDNVASVSESPTSLEDQPDINVQDMACQVLDYRALDPSELIQSKTIKLEGELAEYPILLLVDSGDSHSFIARELVSSLNLEVTLTKAFSVGLGNESTCSTQGVCKELRVKLGRYTIVTDAYILNLGGVDIVLGVEWLKKFGRTTMDWQKKTVSFEDNGQLTMLNGHHFKDIHRSLPTKKYADAHRRHVTYAPGDWVFVKPCPHRQQSVVRRINPKLFPRYYGPFQVLSCVGEVAYKLQLLDSAQIHPVFHVSQLKRSMKSGSAPTTLPPGLAVAEYEPPSPEAILVTRVGKHQGNSVEEWLILWKSQPVEEASWERAVSIKEKFPNFCLEDEATFIGGGIDRNLSSKREKECCEVLRVSVYLGLGSTSDLEIEIGIKRALL

SEQ ID NO: 154385 - protein, 289 aa, Glycine max
  Coding DNA Sequence Number=SeqID_37607
  Homolog annotation: Hit_ID=Q8W3G7; Match level="QueryCoverage=57%, HitCoverage=33%, E-value=6e-12, Identity=35%"; Hit description =Putative hydroxyproline-rich glycoprotein
  Pfam annotation: Domain name=VQ; Domain location=44-74; Score=41.8; E_ value=2.4e-09; Accession=PF05678.4; Description=VQ motif
MDNSKNRHNDNLGVNKMGKNIRKSPLHQPNYGNNNNINVGRQQQQPQPQVYNISKNEFRDIVQKLTGSPSQDPQSKPPQNNNSPKPQSMRLQKIRPPPLPHVRPPLPVPYNNTTLPAARPAQFRQQPSPNPLPQVNSIAESPISAYMRYLEHSITDPASRGAQFQHHPASSALLPNPPMLPLNGTSPPPPVPDVPSPQPNGPPIFPLPSPISQFLLPSPNGYMNFLSPQPGYPPLLSPGIQFPYPLTPNFPFSPLAQSGILGPGPQPPLSPGLFPLSPSGFFPITSPRW

SEQ ID NO: 154386 - protein, 74 aa, Glycine max
  Coding DNA Sequence Number=SeqID_37608
  Subcellular localization annotation: CTP_CleavageSite=36; ConfidenceScore=5.58e-01
MPETSMLQNGLKPRTTVLKPSKQQTKKGQTSMPKPRCGSRSTNPSKLRAGWESELKRLPARGLSVAGARDLNSN

SEQ ID NO: 154387 - protein, 175 aa, Glycine max
  Coding DNA Sequence Number=SeqID_37609
  Homolog annotation: Hit_ID=Q1S735; Match level="QueryCoverage=51%, HitCoverage=40%, E-value=1e-09, Identity=69%"; Hit description =Probable transposase [imported]-Arabidopsis thaliana-related
MELHHFLKFVDPSNASKTTENLYKILRDVVLRVGLENVVHVVTDNAANYVVVACVEKLKLTEPLVLVLRLVDSEDKLTMGFLYHAMHKAREEMVRSGNNGKLLNKCRLLLSKLLDVKGENAIATGGKAQPAIASGGKAGERGVSPLGAGETAMLHVNLAGLQLFRLAGLVLLSID

SEQ ID NO: 154388 - protein, 55 aa, Glycine max
  Coding DNA Sequence Number=SeqID_37610
MWRGFMMTMTKDSHMEGFEGKGFLRKTKVVVQGGLVVQDGGARRPMVALGFEREG

SEQ ID NO: 154389 - protein, 182 aa, Glycine max
  Coding DNA Sequence Number=SeqID_37611
  Homolog annotation: Hit_ID=Q0MX19; Match level="QueryCoverage=19%, HitCoverage=19%, E-value=3e-08, Identity=88%"; Hit description =Leucine rich protein
  Subcellular localization annotation: CTP_CleavageSite=61; ConfidenceScore=5.05e-01
MVIVTTAVYWGLNSQLRLTANRTTIAWLGLPSCVTPVNTLTAPAWGHVLPSTVSPEGNDVKARTFSTTGLAWAVLRRYGNINPLSIDYACRPRLSLHGWFPPPLRWPHDALLPINTAGPRRPTNNVNATTSVACLSPVTLSARNHLTSELLRTLSRVAASKPTSWLSEQLHILSHLARALGP

SEQ ID NO: 154390 - protein, 91 aa, Glycine max
  Coding DNA Sequence Number=SeqID_37612
MSYRMSRHHASEHAVYMCPYEQIKQGTIKVAHKSLKSQNSQNNSSIPDLVQNSCSLHDYIAVYDSGLQLLDAGGDLSSSEKSAVKELKDNF

SEQ ID NO: 154391 - protein, 245 aa, Glycine max
  Coding DNA Sequence Number=SeqID_37613
  Gene Ontology: Mol. function=DNA binding; Biological process=DNA integration
  Pfam annotation: Domain name=Transposase_23; Domain location=147-217; Score=5.9; E_value=0.00026; Accession=PF03017.5; Description =TNP1ENSPM transposase
MARTKKTGEMTTEAAKEIAEKIDSFVPHGRQDVLAAAIGCPEHPGRVRAAGAGVTIKQYFGSAPRTSRSVSSLPPDELQQLTQQIRDQLEESITEKVTRQVMASFSQLQSQMQSQAPPEPLVGPGPSGPRVSTKGSCVDPSGNDPEMGDSDRCGLYIEADPARMVSVGRVYEGSTLVHSTPLLLGQVKVSVDEVKDADAPVPVPTAEVSLVGQALHTFLAWPTHLIKSLSHQLLIVLTICFFFLN

SEQ ID NO: 154392 - protein, 65 aa, Glycine max
  Coding DNA Sequence Number=SeqID_37614
MVDFAKIFNRSSSLIPRSSVFNRDKSNLTKHFVLKELRRSDFLITIEEYIGAKGNTLVDCKKIKI

SEQ ID NO: 154393 - protein, 192 aa, Glycine max
  Coding DNA Sequence Number=SeqID_37615
  Gene Ontology: Mol. function=1-deoxy-D-xylulose-5-phosphate synthase activity; Biological process=terpenoid biosynthetic process
  Homolog annotation: Hit_ID=Q8L692; Match level="QueryCoverage=95%, HitCoverage=25%, E-value=1e-83, Identity=80%"; Hit description=1 -deoxy-D-xylulose 5-phosphate synthase 2 precursor
MAFCGGTFVKLNYSVSPCHKYKAPSPYHSYRNKFCVRVSASGSADEERTIIKKEKDGWKINYAGEKPATLLLDTINYPIHMKNLSTQDLEQLAAELRADIVHTVSNTGGHLSSSLGVVELAVALHHVFNTPEDKIIWDVGHQAYPHKILTGRRSRMHTIRKTSGLAGFPKRDESIHDAFGVGHSSTSISAGL

SEQ ID NO: 154394 - protein, 361 aa, Glycine max
  Coding DNA Sequence Number=SeqID_37616
  Gene Ontology: Mol. function=1-deoxy-D-xylulose-5-phosphate synthase activity; Biological process=terpenoid biosynthetic process
  Homolog annotation: Hit_ID=Q8L692; Match level="QueryCoverage=94%, HitCoverage=47%, E-value=1e-157, Identity=81%"; Hit description=1 -deoxy-D-xylulose 5-phosphate synthase 2 precursor
  Pfam annotation: Domain name=TPP_enzyme_C; Domain location=129-269; Score=-51.1; E_value=0.094; Accession=PF02775.11; Description =Thiamine pyrophosphate enzyme, C-term
  Pfam annotation: Domain name=Transketolase_N; Domain location=55-280; Score=-214.0; E_value=0.079; Accession=PF00456.11; Description =Transketolase, thiamine diphosphate b
  Pfam module annotation: Pfam domain module=TPP_enzyme_C::Transketolase _N; Domain location=129-269::55-280
FCVRVSASGSADEERTIIKKEKDGWKINYSGEKPATPLLDTVNHPIHMKNLSTQDLEQLAAELRADIVHSVSETGGHLSSSLGVVELSVALHHVFNTPEDKIIWDVGHQAYPHKILTGRRSRMHTIRKTSGLAGFPKRDESVHDAFGVGHSSTSISAGLGMAVARDLLGKNNSIISVIGDGALTAGQAYEAMNNAGFLDSNMIVVLNDNKQVSLPTATLDGPASPVGALSSALSKIQASAEFRKLREAAKSITKQIGKQTHQVAAKVDEYARGIISGSACTFFEELGLYYIGPVDGHKIEDLVTIFEKVKAMPAPGPVLIHCVTEKGKGYPPAEKASDKMHGEKGIFLLHLKNKEFKINFV

SEQ ID NO: 154395 - protein, 34 aa, Glycine max
  Coding DNA Sequence Number=SeqID_37617
MTTSNSAVQHDNDDDNHYDASSLARVIFGDTSCI

SEQ ID NO: 154396 - protein, 198 aa, Glycine max
  Coding DNA Sequence Number=SeqID_37618
  Homolog annotation: Hit_ID=Q1STZ2; Match level="QueryCoverage=35%, HitCoverage=18%, E-value=3e-08, Identity=42%"; Hit description=IMP dehydrogenase/GMP reductase
MEGGENRDSYFVWEISKCSLDGDAGLHQLQSRPHYKTTWLPYERGAIRGRPHTFHYTRVHKAWGMSEKKDKELRGSSNGPIGGYRRWLKAYAQDLDWFPSLSTTWGMEIETLEEDEEVQALKIELEKAQTVKEKFKLVVVKIRKENAQLRDVNIAITKALEQETKRARREEHGQKKFRGALWDSNSELKLQREAQDQS

SEQ ID NO: 154397 - protein, 104 aa, Glycine max
  Coding DNA Sequence Number=SeqID_37619
  Pfam annotation: Domain name=LisH; Domain location=21-47; Score=12.1; E_value=0.061; Accession=PF08513.1; Description=LisH
  Subcellular localization annotation: CTP_CleavageSite=62; ConfidenceScore=5.29e-01
MWKTNQPNTTKSFGMGKISPVHVALIVYQYLNDNNFSQTRSTFRNEASSLFSDSLINEASKSWMSLGQILDDYMCLKVQKVMLDEQQVEIRHPNRPIVLNLFPT

SEQ ID NO: 154398 - protein, 222 aa, Glycine max
  Coding DNA Sequence Number=SeqID_37620
MAVIHDGYLLDLFRAKIRIFYLPIHLNSLLFGKKFSLPGITHLFFVGTKMWRQVKATSQDESIGRRRNINPVHVAFIVDKYLCDNHFSNTRCIFRNEASSLFATSSINQLPKTLEEMLNEYIFLKKQNVVLNQERVMVMEEKNRIQILLQGMQNALNTYNAFQRSPSLNVAGMNANFAVVPQPRVYNKTPQGTTFFFSLTNHELKYWLPLYVLVLIQGGLQL

SEQ ID NO: 154399 - protein, 113 aa, Glycine max
  Coding DNA Sequence Number=SeqID_37621
MEHETFLATWLAEIDFSPNGLDGGSSQYCIIIVILQRILLGERAVYAMMLVFPPEFSPLKTILFGNPSQDTVEPLMEALEEDYKDGNEINESRQFIEGVLDLEKRINRLDTLT

SEQ ID NO: 154400 - protein, 42 aa, Glycine max
  Coding DNA Sequence Number=SeqID_37622
MSTACHLDKDETGQSIDVKKYRGLEVGLLKEEATGRQAPPRC

SEQ ID NO: 154401 - protein, 82 aa, Glycine max
  Coding DNA Sequence Number=SeqID_37623
  Gene Ontology: Mol. function=transferase activity; Cellular component= mitochondrion; Biological process=DNA integration
  Homolog annotation: Hit_ID=Q1S5C0; Match level="QueryCoverage=98%, HitCoverage=12%, E-value=3e-28, Identity=77%"; Hit description =Polynucleotidyl transferase, Ribonuclease H fold
MGVGFFANKKETNGLQVGRYKARLVAKGFTQTYEIDYSETFAPVAKMNTIRVILSLATNYDWELQQFDVKNAFLHGKLEEKI

SEQ ID NO: 154402 - protein, 103 aa, Glycine max
  Coding DNA Sequence Number=SeqID_37624
  Subcellular localization annotation: CTP_CleavageSite=50; ConfidenceScore=5.31e-01
MIFWHHQNIKFFASTVVCTFSSKTQCLSTETTLVSRFCHPETSESDDTPKATLASPFINQRQASPLTHGDQCGRLHLFVEDSMSIDPNYFSLSFSSSRDKRVR

SEQ ID NO: 154403 - protein, 60 aa, Glycine max
  Coding DNA Sequence Number=SeqID_37625
MENEQFLIEQTWRSTQKRSCNAQWNALKLLHDKHMLHSSCILEKMEVEESLLGLWLPLHY

SEQ ID NO: 154404 - protein, 137 aa, Glycine max
  Coding DNA Sequence Number=SeqID_37626
  Gene Ontology: Mol. function=nucleic acid binding
  Homolog annotation: Hit_ID=Q1RVN3; Match level="QueryCoverage=69%, HitCoverage=14%, E-value=1e-08, Identity=34%"; Hit description =Nucleotide-binding, alpha-beta plait
  Pfam annotation: Domain name=RRM_1; Domain location=39-109; Score =8.6; E_value=0.023; Accession=PF00076.12; Description=RNA recognition motif. (a.k.a. RRM, R
MKVMQKSSLAGRQSQNLEIGDNNKHYRLNWRNNADITSFYFTHFPDEANAELLWRHFKKWGDVREVYIAKRLNKDGKRYRFMRFKGVSDAKGLEVRLDNIFINDCKLFVNLPRFDRPVRNTELLQTNPIGRKYTDEA

SEQ ID NO: 154405 - protein, 84 aa, Glycine max
  Coding DNA Sequence Number=SeqID_37627
MRTILRRYHGSEFQQSFKFTCPLIRFSQYIKCWVAYAFPNILNITKNVKREKIKQGNSLFSSDDDEGCHYRVETMVKEVVVEWH

SEQ ID NO: 154406 - protein, 110 aa, Glycine max
  Coding DNA Sequence Number=SeqID_37628
  Gene Ontology: Mol. function=chitin binding; Cellular component =extracellular region; Biological process=chitin metabolic process
  Homolog annotation: Hit_ID=UPI0000612705; Match level="QueryCoverage =96%, HitCoverage=92%, E-value=2e-17, Identity=32%"; Hit description =UPI0000612705 related cluster
  Subcellular localization annotation: CTP_CleavageSite=35; ConfidenceScore=5.66e-01
MWSSLKARMCSPLKARTCSPLKARTCNPLKVMACSPMQARACSPLKVRACSPLKARTCSPLKVRACSPLKVRMCSPLKARKCSPMKARMCSPLKVRACSPMKARACSPLK

SEQ ID NO: 154407 - protein, 443 aa, Glycine max
  Coding DNA Sequence Number=SeqID_37629
  Homolog annotation: Hit_ID=Q84JM5; Match level="QueryCoverage=31%, HitCoverage=21%, E-value=6e-44, Identity=69%"; Hit description =Angustifolia
METSTVCLKERTNNESELKQMLQQLVKNQEIKQELNGSLKKHKLHKTLKSQEIILEKKRMKDEDRMEMHPSHIKKTEGIKEIKLWSERWMQEQDIMLEDKITNKQSIQEKINAHSTKQVKKTMEGSGSECCNNTEVHSWTRKAQLATFGGCSEGETKEDHLVCVLHQALETEQYNEVLKESKIGRSSESLKPKKDLVFFEEESVSPSSSLEPPNRKSSEVDISIKGTRDAELVVEESPIKDHPMSQSTFGPTHNANKGKSMNGYNVIQLTAKANESLLSKYENWDEDGGTGKGGIVRTMRKGDIEIEHAHFEGQAASGQRPSGSGDSDDAENEAATAAHAAAERLDGAEPAGGGERVAGEEVRAAEEAEEERHDRVRDLLGARGVNVDEAEAEVGGEGGVDGAVGGAEAEDEVVGAEAALGGAREVGEGVEEHGGGGLDLAIG

SEQ ID NO: 154408 - protein, 205 aa, Glycine max
  Coding DNA Sequence Number=SeqID_37630
  Gene Ontology: Mol. function=DNA binding; Cellular component=nucleus; Biological process=regulation of transcription, DNA-dependent
  Homolog annotation: Hit_ID=Q0PJI6; Match level="QueryCoverage=91%, HitCoverage=58%, E-value=1e-48, Identity=56%"; Hit description=MYB transcription factor MYB133
  Pfam annotation: Domain name=Myb_DNA-binding; Domain location=18-63; Score=51.9; E_value=2.2e-12; Accession=PF00249.21; Description=Myb -like DNA-binding domain
MEDQNKKVRKPYTITKSRENWTDQEHDKFLEALHLFDRDWKKIEAFVGSKTVIQIRSHAQKYFMKVQKNGTSEHVPPPRPKRKAAHPYPQKASKNALTISQVARPLQSSSALSESSHIYRPDSSSVVRTPVSSVPLPSWVYNVTPPVSLPRVTKDDMVMMSQQINPFSSSNESTPRGWPISKQTDQGDQGKPTIGRNAFLTQILI

SEQ ID NO: 154409 - protein, 102 aa, Glycine max
  Coding DNA Sequence Number=SeqID_37631
MASMRVKNEIEWAVVGRAAHNSVWWSERRTGWSARRRGAEEGAAAAAAAVPQDSALAAKPLHIALSLTRKLGVHFLAREAFIKWECGCMNAIVEHHLLHLIV

SEQ ID NO: 154410 - protein, 340 aa, Glycine max
  Coding DNA Sequence Number=SeqID_37632
MSFESEDKGLLDQATDQGLEKKLKISYTREFLLSLSGLDICRELPSGFDRSLLSEFEDASQDRQRSTGGLSMHSFSRRNEYSSSPPTKGDSFSRGIHGKWETRSSGLSDKDSDSQSELDSDFGKRFGNQSRRSWQGPEHDGLLGSGSFPRPSGYTPGLSASKFRANDNYQLNRSNEPYHPPRPYKAPHSRRETNDSFNDETFGSLECTSEDRAEEERKRRASFELMRKEQHKAFQEKHKLNPDKNNSDFDTTSLADDDEKMLVNRSNKSVEPHVTLPALSNDEKSSSLSQTPSAARPLVPPGFASTKLERNLATKTSLNTHSTEGILVVTVNSYDRKLPS

SEQ ID NO: 154411 - protein, 215 aa, Glycine max
  Coding DNA Sequence Number=SeqID_37633
  Gene Ontology: Mol. function=metalloendopeptidase activity; Cellular component=membrane; Biological process=proteolysis
  Homolog annotation: Hit_ID=Q6EPN8; Match level="QueryCoverage=85%, HitCoverage=50%, E-value=4e-77, Identity=68%"; Hit description =Putative Ste24p
MAFPYMEAVVGFMILMYIFETYLDVRQHSALKLPTLPKTLEGVISQEKFEKSRAYSLDKSHFHFVHEFVTIVIDSTILYFGVLPWFWKISGDFMTIASLNAENEILHTLAFLAGVMIWSQITDLPFSLYSTFVIEARHGFNKKGGPYLAIYLWAFTFGLSIVMMTLYPVLIAPLFNKFTPAVEVWGWEDLELGLDEEQSILVFGRSIPEEGHNSL

SEQ ID NO: 154412 - protein, 320 aa, Glycine max
  Coding DNA Sequence Number=SeqID_37634
  Gene Ontology: Mol. function=structural constituent of ribosome; Cellular component=cytosolic ribosome (sensu Eukaryota); Biological process=translation
  Homolog annotation: Hit_ID=O04603; Match level="QueryCoverage=82%, HitCoverage=81%, E-value=2e-85, Identity=63%"; Hit description=50S ribosomal protein L5, chloroplast precursor
  Pfam annotation: Domain name=Ribosomal_L5; Domain location=84-140; Score=101.1; E_value=3.2e-27; Accession=PF00281.9; Description =Ribosomal protein L5
  Pfam annotation: Domain name=Ribosomal_L5_C; Domain location=206-291; Score=112.8; E_value=1e-30; Accession=PF00673.11; Description =ribosomal L5P family C-terminus
  Pfam module annotation: Pfam domain module=Ribosomal_L5::Ribosomal_L5_ C; Domain location=84-140::206-291
  Subcellular localization annotation: CTP_CleavageSite=44; ConfidenceScore=5.76e-01
MATAPSLLHSSGSSFFSQFRAFQFSSSSLFPHGNRHGNAVVSVKASASGVVLVEKSEAEKANRLKTAYTEKIIPLLMEEFSYTNKHQVPKIEKIVVNCGIGDAAQNAKGLDAAISDLALITGQRPIKTRARASLATFKIREGQPLGIAVTLRGNAYSFNLKHDLQPPTIYIPDVKISEATASSIIGCEKSRLRFISKHATEFLSCQRMMYSFLDRVINLGLPRTRDFQGVNPNSFDGHGNYSIGIKDQGVFPEIRADVVGKPRGMDICIVTTANTDQEAQKLLALMGMPFREGSGPATTIRKKKLKSHHFDAKSKGRGRR

SEQ ID NO: 154413 - protein, 107 aa, Glycine max
  Coding DNA Sequence Number=SeqID_37635
  Gene Ontology: Mol. function=binding
  Homolog annotation: Hit_ID=Q9SLA6; Match level="QueryCoverage=71%, HitCoverage=26%, E-value=2e-29, Identity=77%"; Hit description =Expressed protein
  Pfam annotation: Domain name=Sel1; Domain location=4-41; Score=16.8; E_value=0.08; Accession=PF08238.2; Description=Sel1 repeat
  Pfam annotation: Domain name=Sel1; Domain location=42-77; Score=30.4; E_value=6.2e-06; Accession=PF08238.2; Description=Sel1 repeat
  Pfam module annotation: Pfam domain module=Sel1::Sel1; Domain location=4-41::42-77
MGDPEAQYALGCHLRVEVRNDYVQSDQQAFYYLEKAVDQLHPGALYLLGAVYLTGDCVKKDIASALWCFHRASEKDHPMCYPAFRIFRVGCYVPLFGIDNKAKENAS

SEQ ID NO: 154414 - protein, 176 aa, Glycine max
  Coding DNA Sequence Number=SeqID_37636
  Gene Ontology: Mol. function=metalloendopeptidase activity; Cellular component=membrane; Biological process=proteolysis
  Homolog annotation: Hit_ID=Q0VJ93; Match level="QueryCoverage=89%, HitCoverage=43%, E-value=1e-65, Identity=69%"; Hit description=CAAX peptidase
  Pfam annotation: Domain name=Peptidase_M48; Domain location=1-173; Score=103.6; E_value=5.8e-28; Accession=PF01435.8; Description =Peptidase family M48
MGVDRSKLNNSGIGYRIESTYTAGSHAYMYGFFKNKRIVLYDTLIQQCKDDEEIVAVIAHELGHWKLNHTVYTFVAMQILTLLQFGGYTLVRNSTDLYRSFGFDTQPVLIGLIIFQADGFAKKLGYASGLRGGLVKLQEENLSAMNTDPWYSAYHYSHPPLVERLAALDEPDKKED

SEQ ID NO: 154415 - protein, 120 aa, Glycine max
  Coding DNA Sequence Number=SeqID_37637
MHPALLLVHPTSFKNSTNAPVFFPCADQVDPWKTCEPSADQIKFGLRIKLIRKAFYGSTTDQLDKENPGDRVLGHAWKVEGSVRKKTNARKEQRKRKEERMAIKQKEREEELKRLKNLKK

SEQ ID NO: 154416 - protein, 44 aa, Glycine max
  Coding DNA Sequence Number=SeqID_37638
MTVRIRGDQPPHLGYNIFYTTWHKIPERTIVPNWGEVLWRQQEE

SEQ ID NO: 154417 - protein, 158 aa, Glycine max
  Coding DNA Sequence Number=SeqID_37639
  Gene Ontology: Mol. function=DNA binding
  Homolog annotation: Hit_ID=Q1SFS3; Match level="QueryCoverage=88%, HitCoverage=27%, E-value=4e-50, Identity=68%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)
MDIPLRSTRKYLFKKTDLLRLRELASLVSDPVDFQTHHGKLLRILRVDVEEGCLETLVQFYDPLYHCFTFPDYQLVPTLEEYSYLVGLPVPDKIPFHGFEPTPKPSDIAAALHLKTSIIQANLTSKGGLQGLPTHFLYQQASIFAEAAITSIPCLQDQ

SEQ ID NO: 154418 - protein, 466 aa, Glycine max
  Coding DNA Sequence Number=SeqID_37640
  Gene Ontology: Mol. function=translation elongation factor activity; Cellular component=intracellular; Biological process=translational elongation
  Homolog annotation: Hit_ID=UPI00005F742B; Match level="QueryCoverage =99%, HitCoverage=66%, E-value=0.0, Identity=81%"; Hit description =COG0480: Translation elongation factors (GTPases)
  Pfam annotation: Domain name=EFG_C; Domain location=373-460; Score =164.6; E_value=2.6e-46; Accession=PF00679.14; Description=Elongation factor G C-terminus
  Pfam annotation: Domain name=EFG_IV; Domain location=251-371; Score =238.1; E_value=1.9e-68; Accession=PF03764.8; Description=Elongation factor G, domain IV
  Pfam annotation: Domain name=GTP_EFTU_D2; Domain location=96-163; Score=79.5; E_value=1e-20; Accession=PF03144.15; Description =Elongation factor Tu domain 2
  Pfam module annotation: Pfam domain module=EFG_C::EFG_IV::GTP_EFTU _D2; Domain location=373-460::251-371::96-163
MDRYLEQGDLSEDEVIAGLRQRTLAGEIQPMLCGSAFKNKGVQRMLDAVIELMPSPLDVPPVAGINERGEHDERHADDEEPFSALAFKLMSDPYVGQLTFVRVYSGVLRKGDSVWNAVKGRKERIGRIVQMQANDRIEIDEIRAGDIAACVGLKEVTTGETLCDPNAVITLERMEFPDPVISLSIEPKTKGDQEKMGLALQRLAAEDPSFRLHTDEESGQTIISGMGELHLEIIVDRLKREFGVEANIGRPQVTYRETIRKTVREVEGKFVRQSGGKGQYGHVVLTLEPQAAGSGFAFEDATKGGVVPREFIPSVEKGIREALNSGVLAGYPVVDIKATLTFGSYHDVDSSEMAFRMAAIFGFKAAAKQANPVILEPVMQVEVETPEEYAGGVMGDLSSRRGTLQGMDERFSARIIRAEVPLAEMFGYATTLRSMSQGRATYSMEFAHYAEAPRNVAEAIIAARAQ

SEQ ID NO: 154419 - protein, 538 aa, Glycine max
  Coding DNA Sequence Number=SeqID_37641
  Gene Ontology: Mol. function=transferase activity, transferring hexosyl groups; Biological process=carbohydrate biosynthetic process
  Homolog annotation: Hit_ID=Q22YW5; Match level="QueryCoverage=48%, HitCoverage=57%, E-value=9e-54, Identity=38%"; Hit description=FAD binding domain containing protein
  Pfam annotation: Domain name=Glyco_transf_8; Domain location=267-515; Score=97.3; E_value=4.5e-26; Accession=PF01501.10; Description =Glycosyl transferase family 8
MVLADGSVREFQRGDADFPAAMVSLGALGIVTAITLRTQPFRLFTCHKFAASADSLEQDLLTWNEQHELSKAWWFVDDNLMHVWNADVASAEDSQAWHDHQREVIEHGDQADSSLNDTIDQTLEHMHRDTQIHGKGGKQFRTVTRFRDFTDISGDIYQLFCRGIAVPQINVEIGVPLAKTPEIISKIKAWYAQNRPHMHYPIILRCTGASQAWMSPAHQQPTCFFGFVVYYADDGSLSQDGLHFLTEVEKLLAAEGGRPHWEAMYAWVTLLTQPEYYVGVKALHRSLKRSETRWPLIVMVTDAIDLSMREALQALGCVIHPVQPLMPDAALEQHYASAQFGEVWSKLRAWELTGCERVVFLDADMLVLRNMDELFTLDLGKHALAACHACRCNPNQIASYPDSWQPEHCHYTWQARGETPPADLDNYLNGGFLVLQPDQAVFDWLQQKVAEIDDLRRYPFSEQDLLNEVFAGRWLPLPYIYNALKTLPFQHAGLWHDDEVKNLHYILAKPWKRDLNQPEAQRDRYYALDKLWWELGAD

SEQ ID NO: 154420 - protein, 590 aa, Glycine max
  Coding DNA Sequence Number=SeqID_37642
  Homolog annotation: Hit_ID=Q98DA1; Match level="QueryCoverage=40%, HitCoverage=85%, E-value=5e-98, Identity=73%"; Hit description=Outer membrane lipoprotein
  Pfam annotation: Domain name=Lipoprotein_9; Domain location=355-590; Score=387.7; E_value=1.7e-113; Accession=PF03180.4; Description=NLPA lipoprotein
MQRFVRQRTLCQALTVGAGCQRACQRLYRNHAGRGGQHAIHLCQAVIHLLQRRARGKRYALFILSEDAAQRTEIQQYVLRLYAQHATGRQTAAEHAHFAVRVAQQLLQLGFTARLMQLLALANYRILRPVPERRRVIAQRGRYRQLTVAANTVLFTVVGGKQRVEGVAVGDVMHTNTAEQAVYVHGIQAVDKDALTLAAGQDVIQQIEGTFVHRFDAIRLHDVTPAQQVFCTHQAHKIGMRDVIVKTGFHQFDHRLFRLQRSKIQAGFMLADRLIHLLQHLNIQLLFVDEVIHHHALGGLCQFSNLLHSRALHTVFGEGLQRTGEDAFFQPFRVIFTFGVVAPFSVAQAADKTAVKVGIMSGEDEDVWREVIKQAAAKGLTVKTVIFNDYNQPNEALQNGEVDANAFQHQPFLNNQIKVNHYDIVRVGDTAVWPIGLYSKKVKSAAALKDGAVIGVPNDPSNEARGLVLLQQQGLIKLKPGVGIAATTADITDNPHHLKIKELDSGIIGRSVPDLDAAVVNTDWALKSGLTAADRIAQEPVKDNPYNNFIAVKKENASAPWVKTLVASYQNDAVKTVFDKVYKGTGETAW

SEQ ID NO: 154421 - protein, 489 aa, Glycine max
  Coding DNA Sequence Number=SeqID_37643
  Gene Ontology: Mol. function=protein serine/threonine kinase activity; Cellular component=membrane; Biological process=protein amino acid phosphorylation
  Homolog annotation: Hit_ID=Q10SE3; Match level="QueryCoverage=99%, HitCoverage=94%, E-value=1e-152, Identity=57%"; Hit description =Protein kinase domain containing protein, expressed
  Pfam annotation: Domain name=Pkinase; Domain location=168-439; Score =131.4; E_value=2.5e-36; Accession=PF00069.15; Description=Protein kinase domain
  Pfam annotation: Domain name=Pkinase_Tyr; Domain location=168-439; Score=125.4; E_value=1.6e-34; Accession=PF07714.7; Description =Protein tyrosine kinase
  Pfam module annotation: Pfam domain module=Pkinase::Pkinase_Tyr; Domain location=168-439::168-439
MSIFDGAFMNTQLSKHTSIFGLRLWVVIGILIGVFIVFTLFLLSLCLVSRRNRRRSGAGTGYKVAGGADAAKDIHTIVHLPGPHMLRPPAPEIHVEMGKKTEHRVVVQCDRVSSEESKVTVGSGCETTSSFGSGSVGGPGPGLGPEVSHLGWGRWYTLRELEDATGGLSPENVVGEGGYGIVYHGVLNDGTKIAVKNLLNNKGQAEKEFKVEVEAIGRVRHKNLVRLLGYCVEGAYRMLVYEYVDNGNLEQWLHGDVGAVSPLTWNIRMNIILGTARGLAYLHEGLEPKVVHRDVKSSNILIDRQWNSKVSDFGLAKLLCSENSYVTTRVMGTFGYVAPEYACTGMLTEKSDIYSFGILIMEIITGRSPVDYSRPQGEVNLIEWLKTMVGNRKSEEVVDPKLPEMPSSKALKRALLIALRCVDPDATKRPKMGHVIHMLEADDLLFHTEQRTEGESSRSYQSEQRDSNLDKRRDGGANDKSEDASTRWR

SEQ ID NO: 154422 - protein, 156 aa, Glycine max
  Coding DNA Sequence Number=SeqID_37644
  Gene Ontology: Mol. function=nucleic acid binding; Cellular component= intracellular; Biological process=DNA integration
  Homolog annotation: Hit_ID=Q1T034; Match level="QueryCoverage=94%, HitCoverage=26%, E-value=4e-26, Identity=37%"; Hit description=Zinc finger, CCHC-type
MADDQCQFITEGTSLTRPPGFVGEDYPYGKDKMKMYIKSTQYRIWLIITNGDIRIHRLEAGWIDDNLAIMELNTKARYTLTCAISKNEYNKICRLRTTKEIWDSLSINHEGTEDVRLRNVVTLTRHFESFTMKDEESVDDMFGRLQVLLKNLNAIG

SEQ ID NO: 154423 - protein, 149 aa, Glycine max
  Coding DNA Sequence Number=SeqID_37645
  Gene Ontology: Mol. function=N-acetyltransferase activity; Biological process=metabolic process
  Homolog annotation: Hit_ID=Q2WTZ5; Match level="QueryCoverage=97%, HitCoverage=97%, E-value=9e-28, Identity=43%"; Hit description =Acetyltransferase
  Pfam annotation: Domain name=Acetyltransf_1; Domain location=51-128; Score=40.2; E_value=7.1e-09; Accession=PF00583.14; Description =Acetyltransferase (GNAT) family
MVKIEHADPRSAESQWLIEKLSAELAAITGDGGNSRASVDTFQGEGALWVIARDAQGTAVGCGALRPVAAGIAELKRMFSDRSLPGIGCALLSALEAAAKTLGYRELWLETRHVNQRAVDFYIRQGYRQRENYGPYRGREEAICLGKTL

SEQ ID NO: 154424 - protein, 768 aa, Glycine max
  Coding DNA Sequence Number=SeqID_37646
  Gene Ontology: Mol. function=monosaccharide-transporting ATPase activity; Cellular component=membrane; Biological process=transport
  Homolog annotation: Hit_ID=UPI00005F8EC8; Match level="QueryCoverage =62%, HitCoverage=97%, E-value=0.0, Identity=77%"; Hit description =COG1129: ABC-type sugar transport system, ATPase component
  Pfam annotation: Domain name=ABC_tran; Domain location=305-491; Score= 172.4; E_value=1.1e-48; Accession=PF00005.17; Description=ABC transporter
  Pfam annotation: Domain name=ABC_tran; Domain location=553-746; Score= 92.0; E_value=1.8e-24; Accession=PF00005.17; Description=ABC transporter
  Pfam annotation: Domain name=Peripla_BP_1; Domain location=4-276; Score=-37.6; E_value=0.00036; Accession=PF00532.11; Description =Periplasmic binding proteins and sugar b
  Pfam module annotation: Pfam domain module=ABC_tran::ABC _tran::Peripla_BP_1; Domain location=305-491::553-746::4-276
MAKDIQVGVSMALFDDNFLTILRTAMQKEMQKDNVKGQVEDAKGDVSQQLQQVQNFIGQGVDAIVVNPVDTNAVKPIMDAATKAGIPLVFVNRKPAGQLTDKMAYVGSDSELAGRLQMEALAKAMNGKGNVAILMGDLANESTRDRTKGVEAVVAKYPGIKVVQKQTAKFTRNDAVDVVSNWMTAGDDIQAIASNNDEMAIGALQALGKNPNHILIAGVDGTPDALQMLKNGKMVATVFQDAKGQGEGAVQTAVKLANGEKVEKIINIPYQLITKDNMAQFENRISKFFPGVKALDNVSLRIKPGSVHALMGENGAGKSTLMKCLIGMYRPDKGTIRIKGEPVQFQDTMDALRSGISMIHQELNLVPYMTVAENIWLGREPMKYGFVDHGKLNQQTQELLNKLNIRLKADRLVGELSIASQQMVEIAKAVSWNSDIVIMDEPTSALTETEVAHLFTIIRDLRAQGKAIIYISHKMDEIFAITDEISIFRDGTWVGSNSTTAFTRQSLITQMVGRELTQLFPKFNSAIGEEVLTVRNLTCKDRFTDVSFSVRKGEILGVAGLVGAGRSEVMESLFGMESFDSGEVLIDGVPVKIDSPSTAIEKGMAFLTEDRKKSGLFLVLSVLENMSIVNMPDYIGKSGFVSHMKMAQDCMEQIRKLNIKTPTMDQIINNLSGGNQQKVLIARWLLAQPKILILDEPTRGIDVGAKAEIYRLISELANRGVAIIMVSSELPEILGMSDRVMVMHGGRITGILDKEEADQETILSLASE

SEQ ID NO: 154425 - protein, 748 aa, Glycine max
  Coding DNA Sequence Number=SeqID_37647
  Gene Ontology: Mol. function=transcription factor activity; Cellular component=cyanelle; Biological process=regulation of transcription, DNA-dependent
  Homolog annotation: Hit_ID=Q47083; Match level="QueryCoverage=84%, HitCoverage=100%, E-value=1e-130, Identity=52%"; Hit description=HTH- type transcriptional regulator cbl
  Pfam annotation: Domain name=DUF178; Domain location=534-744; Score= -89.6; E_value=0.087; Accession=PF02621.5; Description=Uncharacterized ACR, COG1427
  Pfam annotation: Domain name=HTH_1; Domain location=105-164; Score =79.8; E_value=8.6e-21; Accession=PF00126.17; Description=Bacterial regulatory helix-turn-helix protein, lysR family
  Pfam annotation: Domain name=HTH_1; Domain location=432-493; Score =65.3; E_value=1.9e-16; Accession=PF00126.17; Description=Bacterial regulatory helix-turn-helix protein, lysR family
  Pfam annotation: Domain name=LysR_substrate; Domain location=188-380; Score=113.2; E_value=7.5e-31; Accession=PF03466.10; Description=LysR substrate binding domain
  Pfam annotation: Domain name=LysR_substrate; Domain location=517-725; Score=171.7; E_value=1.9e-48; Accession=PF03466.10; Description=LysR substrate binding domain
  Pfam annotation: Domain name=MarR; Domain location=103-166; Score= -0.4; E_value=0.04; Accession=PF01047.13; Description=MarR family
  Pfam module annotation: Pfam domain module=DUF178::HTH_1::HTH_1::LysR_ substrate::LysR_substrate::MarR; Domain location=534-744::105 -164::432-493::188-380::517-725::103-166
MGMVYELDAIAAAVISGSSLMSGVGRITGTLIGAVILGLIKSGFTFVGVDAYVQDIIKGMIIVAAGASSPADKRYGSCAALINPFGAENSSFGHSGIRDGGNMNLRRLKYFVKIVDIGSLTQAAEVLHIAQPALSQQVATLENELDQQLLIRTKRGVTPTEAGKILYAHARTILRQCEQAQTAVINAGQALNGQVSIGLAPGTAASSLTMPLLQTVREQYPDVLVYLHENSGTSLNEKVMNGQLDMAVLYDRAPTAGINSIPLMKEELYLVGATACPGATVDLADVAQMNLFLPRDYSAVRKRVDEAFSLRRLSAKIIGEIESISTLTAAVSSGMGVTVLPESAARALSIAESAAVAERLSAPAAVAIGAGGRQIASHLPAPAREPLPLPMGEGRGEGSKAHHIYPHLRAIHSLSLWERAGGQETGEKGVNFQQLKIIREAARCEFNLTEVANTLFTSQSGVSRHIRDLEDELGVEIFIRRGKRLLGMTEPGKALLTIAERILDEAGKVRRLADVFTNETSGVLTIATTHTQARYSLPRVIKAFRQLYPNVRLELNQGSPQEIVAMLLAGEADVGIASEQLVNNTSLAAFPWFSWHHSLLVPHDHELLANQPVTLASLSRHPLITYRQGITGRSRVDRAFQAAGLRPDIVLSAQDSDVVKTYVELGLGVGILADQACDIYDGEDLVKIDAHHLFDANTVWLGLKRGQLQRNYVWQFLELCNANLSLEEIKRQALSYETDDEPAIDFQI

SEQ ID NO: 154426 - protein, 499 aa, Glycine max
  Coding DNA Sequence Number=SeqID_37648
  Gene Ontology: Mol. function=N-acetyltransferase activity; Biological process=metabolic process
  Homolog annotation: Hit_ID=Q3KCN2; Match level="QueryCoverage=40%, HitCoverage=33%, E-value=5e-71, Identity=64%"; Hit description =Thiamine pyrophosphate enzyme
  Pfam annotation: Domain name=Acetyltransf_1; Domain location=35-108; Score=52.5; E_value=1.4e-12; Accession=PF00583.14; Description =Acetyltransferase (GNAT) family
  Pfam annotation: Domain name=FR47; Domain location=36-113; Score=6.8; E_value=0.003; Accession=PF08445.1; Description=FR47-like protein
  Pfam annotation: Domain name=TPP_enzyme_N; Domain location=258-428; Score=128.6; E_value=1.8e-35; Accession=PF02776.8; Description =Thiamine pyrophosphate enzyme, N-term
  Pfam module annotation: Pfam domain module=Acetyltransf_1::FR47::TPP _enzyme_N; Domain location=35-108::36-113::258-428
MTLADAEAGYRLTQQLGWAHRREDWQQLIALGEGVVVEAQGDYLGGAIGWRWGPDAATIGLVIVSEQARGRGIGRQVMQAMLEKFSGCNVRLHATDMGQGLYEKLGFQACKRVAQHQTRALAQQPAVMVPDGLTLRPAVEADAAAIDALDYQANGLRRTRLHQQLLAQSVVLQDTQGTLQGFASRRRFGHGWTIGPVIADDVAAAQALVSQLMQDLTQQFVRLDTPDARLGAWLLNLGLAQVDAPYAMVHGTPWRAAPNGPQTFALAWGVTRIYGYPGDGINGVLGAIQRANKAGAGIEFIQVRHEEMAAFMAAGHAKFTGELGVCLSTGGPGATHLLTGLYDAKMDHAPVLAIAGQAETTARGASYQQEMNLDRIFADVANFVQEAAAPAQVQHLVDRGVRIAKAQNGVAVIILPKDLQDENWQPPQHAHGFTHSGPGYQRPKIVPYDEDLRRAAEVLNAGKKVAVLIGAGARGAAVEVVQIANLLGAGVAKALLGKD

SEQ ID NO: 154427 - protein, 252 aa, Glycine max
  Coding DNA Sequence Number=SeqID_37649
  Gene Ontology: Mol. function=two-component sensor activity; Biological process=two-component signal transduction system (phosphorelay)
  Homolog annotation: Hit_ID=UPI000038349C; Match level="QueryCoverage =41%, HitCoverage=43%, E-value=2e-28, Identity=58%"; Hit description =COG2200: FOG: EAL domain
MLQAGIFAIFHYDLLVCKECAPFICGKPLEEGNVGSCIPDIQSAMNGLFLDECGFLPGRHKWRPYRLGIVFGRSKWQNHRTVQGFVGCAFMRTRIILDECGFLPGRHKWRPHRTAQGFVGCAFMRTRTKTNELNAVLPSHHPLNLAQRHRPAEQISLQLITPGIGQRVFLALGFDAFGGDGQAHGVAEAHHGFDNRGGVLRHAQRLGKRPVDFNLVDRKRAEIIQARITGAEIIQRDTEPGVAQRDDTVARF

SEQ ID NO: 154428 - protein, 170 aa, Glycine max
  Coding DNA Sequence Number=SeqID_37650
  Homolog annotation: Hit_ID=Q84VH5; Match level="QueryCoverage=83%, HitCoverage=25%, E-value=2e-55, Identity=69%"; Hit description =Envelope-like protein
KLSAGKLSVKYAILHRIGTVNWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGIDDGEAAEEEEDAAEDTESDDDDSDATP

SEQ ID NO: 154429 - protein, 251 aa, Glycine max
  Coding DNA Sequence Number=SeqID_37651
MEASKKRSDDTSPDMECLLLLQLSYHTSNLNMGRARLVYGLVTNMDTNIGALISDQISSIAQSNSSRLGFLALITAICRARGVTSNSLIYESLSSTINLAYIKKNCWNVDDLIVNFRGARKARSLQVVAPPGSILTVEQFLEKVSWPGTLPSLEREGGGPSAQVPQQVQDASSKTTIPEPFIFEVGETQPADPPTLVHEIPADPPTPLLDLPEDPSTLVLGLTTAPSATHVLHLTDEEGTQDEDTQSQDLS

SEQ ID NO: 154430 - protein, 136 aa, Glycine max
  Coding DNA Sequence Number=SeqID_37652
MAEKTKKRLEEAAQSGSTESIIDPPSPIRRHVKWKMARTKKTGQMTSKAAKEIADRIASQGSFVPHGRQDILIAAIGRPEHPGRARATGASVPIKQYFGSASRTSRSSSSMPPEDLQQLTQQIRDQLKESITEKVT

SEQ ID NO: 154431 - protein, 128 aa, Glycine max
  Coding DNA Sequence Number=SeqID_37653
MFLIFNTSALKGLIDTPSPKSKAAARWIVVKYFNEVRPLEVERFKALCIQWAQYYLKKKNLETLFSIIKLVISERWSLYFLQELTIDFNEWMAKDQSVIGKSQMYYDKNPKNDKHDITKPNEPNLHNK

SEQ ID NO: 154432 - protein, 138 aa, Glycine max
  Coding DNA Sequence Number=SeqID_37654
  Pfam annotation: Domain name=zf-CCHC; Domain location=51-68; Score =22.8; E_value=0.00017; Accession=PF00098.13; Description=Zinc knuckle
MSKSYGSYSYPKKDQGQGILGVTPSKPKDDKGKTIEKQDPKASMQEKTSSIKCFKCLGRGHITSQCPTTKTMIMRGQDIYSSQDKATTSPSSSETEEAKGEESSEEIYPQEEGQPLVVKEKCKEVSREGAQSMKNLGI

SEQ ID NO: 154433 - protein, 64 aa, Glycine max
  Coding DNA Sequence Number=SeqID_37655
VLLLSVPYSEPVQGSGRMAWRLAEARAGEALAEAPAEAPDEADEAREDEEMTDLLDFLGGSGAT

SEQ ID NO: 154434 - protein, 98 aa, Glycine max
  Coding DNA Sequence Number=SeqID_37656
MDKVDIFVPHPLTNACLLIQLSPECGCKPLVCLLKQPALLSVDFQDRSIRDYSSCTLVGGQPFPCVQESPTTRDPQSLNPFSEIRRREEEVSRKKGRL

SEQ ID NO: 154435 - protein, 41 aa, Glycine max
  Coding DNA Sequence Number=SeqID_37657
MGQIPTFMKVPLSIITTVENDDGGDGINDDHDDEGVDGRGC

SEQ ID NO: 154436 - protein, 62 aa, Glycine max
  Coding DNA Sequence Number=SeqID_37658
MPISPCGNISWSVSFRHRDRACKTPSGPEEVQQGPRVSSSDYGPLLVLRCAHRPQQVHQAPY

SEQ ID NO: 154437 - protein, 275 aa, Glycine max
  Coding DNA Sequence Number=SeqID_37659
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-41, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLRVLPFRWLHALTFRGLHVLAFRGLHVLTIRGLHALTFKRQHVLPFRRLHVVAFIGLHAFPFRGLHVLTFRRLHAHAFRGLHVLAFRGLHALAFRGLHVLPFRGLRALAFSGLHVLAIRGLRVLTIRGLHVLALRALHALTFRGLHVFAFRGLHILTFGGLHVLTIRGQHVLTFRGLHAHPSRGLHVLAFIGLHALAFRGLQLLTIRGLHALAFRGLQVLVFRGLHDLAFRGLNVLAIRGLHVLAFRGLHALAFKGLHVFAFKGLHILNFRGLH

SEQ ID NO: 154438 - protein, 78 aa, Glycine max
  Coding DNA Sequence Number=SeqID_37660
MASTDTAYSQHRLWITPIIIRASRRLNLALPPFSERGVLPADTLIREMELGICFETSSLRATNCHYSEAYGDPPKLKG

SEQ ID NO: 154439 - protein, 188 aa, Glycine max
  Coding DNA Sequence Number=SeqID_37661
  Gene Ontology: Mol. function=ribonuclease H activity; Cellular component=intracellular; Biological process=DNA integration
MNGAVEAANKNIKKIVQKMVVTYKDWHEMLPYALHGYRTSVRTSTGATPFSLVYGMEAVLPVEVEIPSMRVLMEAQLSEAEWCQSRYDQLNLIEEKRMKALCHGQLYQQRMKQAFDKKVRPRVFQEGDLVLKKVLSFQPDSRGKWTPNYEGPYVVKRTFSGGALILTTMDGGELPRPVNADAVKKYFV

SEQ ID NO: 154440 - protein, 53 aa, Glycine max
  Coding DNA Sequence Number=SeqID_37662
MEHASRESRVALPPKGRLRQIARQLVLSSSIRLARIQMFANDRPWTKLGYDSH

SEQ ID NO: 154441 - protein, 114 aa, Glycine max
  Coding DNA Sequence Number=SeqID_37663
MTIICLRMSTGSPPLDDKRAQNDHNLSLRAIGHDCVWMAKSISHLNDHLEETLGSTKIEENHSKCIDLTQGKVYGKLGFWIKACRTDGHGICQGLASGSGIKGMSHIISMAQMQ

SEQ ID NO: 154442 - protein, 472 aa, Glycine max
  Coding DNA Sequence Number=SeqID_37664
  Gene Ontology: Mol. function=oxidoreductase activity; Cellular component=integral to membrane; Biological process=electron transport
  Homolog annotation: Hit_ID=Q211D2; Match level="QueryCoverage=95%, HitCoverage=61%, E-value=1e-132, Identity=52%"; Hit description=Twin- arginine translocation pathway signal precursor
  Pfam annotation: Domain name=Ald_Xan_dh_C2; Domain location=45-417; Score=-179.5; E_value=9.8e-07; Accession=PF02738.8; Description =Aldehyde oxidase and xanthine dehydrogenase, molybdopterin binding domain
KSPPALAVYAKNTWAAIQGRERLKVTWDDAQAERRNTEEIYAEFRQVAQKTGVVAKSLGKPDEVFDKADKVIEAEYTFPYVAHAPMEPLDGYLFWDGESVKARYGCQIQTLDHKQLCELFELPPDKVQIETILAGGSFGRRIDFGNALVGPDLVADMAAAAKGIGPGHGVKVVWTREDDIRNGWYRPMILHRLRGAIRGGKVVGWTNTVVGHSWTLNSPLTALVVNGLDPMMVEGASEVPYTFDAFRCDAHIVPGKVPTTSLRSVGSTHTGHAVESFIDQLLQETGQDPVEGRLALMGDAPREAGVLRAVAKAADWQGAKVVDGRARGVGVAKAFGTYVAQVAEVSIGEGGIPKVHKVWCAVDCGVAVNPDVIRAQIEGGIGYGLSIALYGNITLKDGVVEQSNFNNFRPLRIDEMPEVEVIIVPSSEKPTGVGELGIPTIAPAVGNALALLGRPRTSLSLPLHNPRRSAVI

SEQ ID NO: 154443 - protein, 63 aa, Glycine max
  Coding DNA Sequence Number=SeqID_37665
  Homolog annotation: Hit_ID=Q7VWS1; Match level="QueryCoverage=99%, HitCoverage=8%, E-value=5e-07, Identity=50%"; Hit description =Putative exported oxidoreductase subunit
MSISQHPLSRRRFIVGAGALVIGAYLPSTGALARSAGPAASGEAAFDANAFVQIGVDGIVTVI

SEQ ID NO: 154444 - protein, 190 aa, Glycine max
  Coding DNA Sequence Number=SeqID_37666
  Gene Ontology: Mol. function=DNA binding; Biological process=DNA recombination
  Homolog annotation: Hit_ID=UPI00005F927C; Match level="QueryCoverage =92%, HitCoverage=50%, E-value=2e-88, Identity=82%"; Hit description =COG0582: Integrase
  Pfam annotation: Domain name=Phage_integrase; Domain location=31-165; Score=45.1; E_value=2.4e-10; Accession=PF00589.13; Description=Phage integrase family
ETNPASELASALTAPKSTHYPHLLADELADFLQALATYSGSPITRLATRILMLTGVRTVELRQAEWKEFDFDKCVWEVPVERMKMRRPHLVPLSDQVVASLREIQTVTGRYNLVFPGRNDITKPMSEASINQGYNTAWIELQLAHVDKNTIRGTYNHAQYLEQRREMLQWYGDYLDKLGQDTNDVMVKTG

SEQ ID NO: 154445 - protein, 293 aa, Glycine max
  Coding DNA Sequence Number=SeqID_37667
GTLGDYANQQGPINFSSIVIPHSHNKVVVLKPTLLSLIDAHSFVGMDHEDPYIHLSFFMELCSTIGTSDEDAEVIYRRAFPFSLTELKEGKKIKEPNLELKVLPPYLKYVFLAGISTSYCMHMILMEEVFRKEVVWLLEVGMIYLVTNQLSMKCDLSLREWTLSKVYSEYTYPKGGITIGSLKVVRRPEPRLSFLFVCMHLLMYVGEVALKKWMMDRDTLGCSGWRGSKDLRELASAIAPDCHPHDFVRPSRHGRIKCDCYALRMRELEDSPLQPPISGGVHGASMEDVHLDR

SEQ ID NO: 154446 - protein, 746 aa, Glycine max
  Coding DNA Sequence Number=SeqID_37668
  Homolog annotation: Hit_ID=Q6KA74; Match level="QueryCoverage=84%, HitCoverage=93%, E-value=0.0, Identity=66%"; Hit description=Ankyrin repeat protein-like
  Pfam annotation: Domain name=Ank; Domain location=148-180; Score =20.4; E_value=0.0064; Accession=PF00023.20; Description=Ankyrin repeat
  Subcellular localization annotation: CTP_CleavageSite=26; ConfidenceScore=5.33e-01
MHLDLLTHSPNFHNSKSKNITLCSKSSSAITDLNPASPRKVFGAITDPNLKIDLIFAFSFFLLASITVMTVAAYIEREREQMEDISKYAHSPAHVAVARRDHAALRHLVSTIPRLAKAGEVNTEAESLAAELKADEVSTVIDRRDVPGRETPLHLAVRLRDVVSAEILMTAGADWSLQNEHGWSALQEAVCTREEAIAVIIARHYQPLAWAKWCRRLPRIVASAARIRDFYMEISFHFESSVIPFIGRIAPSDTYRIWKRGSNLRADMTLAGFDGFRIQRSDQTFLFLGEGYASEDGKLNLPPGSLLALAHKEKEVTNALEGAGTQPTEAEVNHEVSLMSQTNMYRPGIDVTQAELVPHLNWRRQEKTEIVGNWKARVYDMLHVMVSVKSRRVPGAMTDEELFAVDDGESMVNGDNNDDQYDDVLTAEERMQLDSALRMGNSDAICQDEEPGGGFDGHENGSNGGGVKEKKVWFGWNKKNMKGGDEPEDLKTTKKFSGDQQKPQPQSEFVKEDPAETKKGKDKNIRRKKKKGGINESKNESEFKKGLRPVLWLTPDFPLKTDELLPLLDILANKVKAIRRLRELLTTKLPLGTFPVKICLLDMNTLALQEWSHVGVLNVAIPIVPTIRVLVTFTKFEDLQPAEEFSTPPSSPAYFQDAKSKESEGSTSWISWMKGSRGTQSSDSDSHKFKDEMDPFSIPSDYKWVDANERKRRMKAKRAKSKKHKKQTVAKGGDGMQLGSDDVEEY

SEQ ID NO: 154447 - protein, 100 aa, Glycine max
  Coding DNA Sequence Number=SeqID_37669
  Gene Ontology: Mol. function=DNA binding; Cellular component =intracellular; Biological process=DNA integration
  Homolog annotation: Hit_ID=Q1S3H4; Match level="QueryCoverage=90%, HitCoverage=22%, E-value=3e-24, Identity=47%"; Hit description =Integrase, catalytic region
MYALEKFRSYLIGSKVVIDTDHVAIKYLLEFYLEIKDKKGSDNQILEEFPNEKILTISERPWFADMANFKAASALPGDFTWHQNRKFLRDSRSDLVLNNT

SEQ ID NO: 154448 - protein, 596 aa, Glycine max
  Coding DNA Sequence Number=SeqID_37670
  Subcellular localization annotation: CTP_CleavageSite=65; ConfidenceScore=5.38e-01
MEPLNHKSFERVVSQKALQMGNSFPCQICVVGFLCGVCLTSLFMAALTSFGSFQFSPILFSTMSMASNSSGNSTFPNDINKVTRSDCQFKLKETERLEDSKSSREQNNDERVSLLYSAWSAVLNEPTSGGKEHLQKHGISGSSLPHAPHLENCKVKTQLYDYFDKRKGNEVFPPWTTWKGSLQTFPVAAINEQMQNLRHDAVSEGAYPPWKHLQIAGSDEENYPLTRKVQRDIWIHQHPLNCSSPDVKFLVTDWERLPGFGIGAQIAGMCGLLGIAINEGRVLVTNYYNRAEHGGCKGSSRSSWSCYFFPETSLECRRRAFELMKSEDAWSKGIVTTKENYTTKHIWAGPTPRKWGLQWNYLQPTTDINGTLLASHRKMDIRWWRAQAVRYLMRFPTEYTCNLMNEARHASFGKLAAEMVLQSLAGDWPKESSGRARSNDIDEYVWSNHKPWVPRPLLCMHVRMGDKACEMKVVGFEEYMQLADRTRRHFPHLNNIWLSTEMQDVIDKTREYSHWNFYYTKVRRQAKINMSMAAYEASLGRETSTNYPLVNFLMAADSDFYVGALGSSWSFLIDGMRNTGGKVMAGFLSVNKDRFW

SEQ ID NO: 154449 - protein, 100 aa, Glycine max
  Coding DNA Sequence Number=SeqID_37671
MKENPTSVQAEAFAKAEDDTIVHEPATVTRDQVQDIVEAMPSKVILMMPKNQELSKFQRFKNLVSRIKIQDSRIKFQESRFKNNQDQDSRFKNQEKTQSR

SEQ ID NO: 154450 - protein, 595 aa, Glycine max
  Coding DNA Sequence Number=SeqID_37672
  Gene Ontology: Mol. function=histone-lysine N-methyltransferase activity; Cellular component=nucleus; Biological process=chromatin modification
  Homolog annotation: Hit_ID=Q1S200; Match level="QueryCoverage=98%, HitCoverage=85%, E-value=2e-89, Identity=35%"; Hit description=SET -related region; Pre-SET; Histone H3-K9 methyltransferase
  Pfam annotation: Domain name=Pre-SET; Domain location=368-516; Score =25.8; E_value=1.9e-06; Accession=PF05033.6; Description=Pre-SET motif
  Pfam annotation: Domain name=SET; Domain location=518-594; Score= -2.4; E_value=0.0015; Accession=PF00856.18; Description=SET domain
  Pfam module annotation: Pfam domain module=Pre-SET::SET; Domain location=368-516::518-594
MAPHPRVIKAYNAMRSLGISDEEVKPVLKNLLQLYDRNWELIEEDNYRTLIDAYFELKEDKQTEGKRKAPISYLDGRKPKHKLHLVDGDIQASATDNSSEGLSIEDTEIPPNVFKQKIIKPSQTSIGHMEPTTSSQALQTVSSKVDGISTLPCMAARDRKLHRGKASAAGHCEDPIVETSNPRIQRENISSDHHQKELMTPRTEKLKLHLGPVSTSYNVSSNASNGNCRAKSLSALYQNVHKEDATSACNNSKRTQKGNIDIASSPLGEIKISLNCEVALGQPNFRIPDLDAVMKSIEEKYLKAHMIVEPQSSMVKLLDDLCGSYLKLGLSLSPNGSTSKFANSRNVTCLPLQTVTEDDKNSFHFLDDITKGSENVKISLLDETGSEDVPQFNYIPYNVIYQDANVNISLARIADEGCCADCAGDCLSLSLPCACSQETGGEFAYTPRGLLKDDFLKACMSMKLEPLDHHFVYCQECPLERSRNDIVPEPCKGHLVRKFIKECWRKCGCDMQCGNRVVQRGLRCKLQVFLTQEGKGWGVRTLEDLPKGCFVCEYAGEILTNTELYERIMQKSGNDRHTYPVTLDARLGLGRGVNG

SEQ ID NO: 154451 - protein, 287 aa, Glycine max
  Coding DNA Sequence Number=SeqID_37673
  Gene Ontology: Mol. function=receptor activity; Cellular component =anchored to membrane; Biological process=protein amino acid phosphorylation
  Homolog annotation: Hit_ID=O22784; Match level="QueryCoverage=90%, HitCoverage=89%, E-value=3e-47, Identity=38%"; Hit description =Expressed protein
  Pfam annotation: Domain name=DUF26; Domain location=189-243; Score =39.3; E_value=1.4e-08; Accession=PF01657.8; Description=Domain of unknown function DUF26
  Pfam annotation: Domain name=DUF26; Domain location=78-132; Score =37.8; E_value=3.7e-08; Accession=PF01657.8; Description=Domain of unknown function DUF26
  Pfam module annotation: Pfam domain module=DUF26::DUF26; Domain location=189-243::78-132
  Subcellular localization annotation: CTP_CleavageSite=35; ConfidenceScore=5.44e-01
MDVSHSTILISFTFLLFLPSSKPVSDYSTLVYKTCASQTFNDQLLSQTLNSLFQQLIAQSSQHKFFKTTEAVSDDTAISGLFQCRDDISKEDCFSCVNLLPQMSNTLCSESISARVQLDGCYIHYETEELPEPETKSESKSRNLIIHNECGEPVVDYIKFKELMDEAFVNLESGILNSNGYYAMNYKSVKLMAQCEGDSDICDCSNCVSDAVQVAKEECGTPLSARIYLDKCFISYYNIPRNFVPGARRNNNTEKLAAIIVGGAATLFLGFAFLSLLNSRFRKDDYE

SEQ ID NO: 154452 - protein, 93 aa, Glycine max
  Coding DNA Sequence Number=SeqID_37674
MELYGEGESSVMLHDFLWKLRRSNTQSPNSETLRTETESVRLVCQENVRKIQCVTALLYEAEAEESPSLLGRIDCDFQRFSVVIGRDSQEKGG

SEQ ID NO: 154453 - protein, 85 aa, Glycine max
  Coding DNA Sequence Number=SeqID_37675
MVEIILGLQGDICGNSRNGVPFVAGKDKIELIDNENLSKVSIVIVSSPPIVVILQDNDIDISIENLESEVAKLYATKMAQQLLEW

SEQ ID NO: 154454 - protein, 139 aa, Glycine max
  Coding DNA Sequence Number=SeqID_37676
MVIPKFKVLDFDKYKGTTCLKNHLKMYCQKMGEYAKDEELLIHSSQESLTGVAVTWYTNLEPSRVHSWKDLMVAFVREYQYNSDVALNRMQLQNICKKGAQIFQRIHPKMERLGNSSSTPNNRERDYHNDSRHMIGVLL

SEQ ID NO: 154455 - protein, 373 aa, Glycine max
  Coding DNA Sequence Number=SeqID_37677
  Homolog annotation: Hit_ID=Q1SSZ2; Match level="QueryCoverage=51%, HitCoverage=40%, E-value=4e-44, Identity=46%"; Hit description=C2 calcium/lipid-binding region, CaLB
  Pfam annotation: Domain name=C2; Domain location=11-95; Score=64.7; E_ value=2.9e-16; Accession=PF00168.20; Description=C2 domain
MSMLASPFQLLELNIISAQDLAPVSKSIKAYAVAWLNPERKLTTQIDPNGQNNPTWNEKFVFRVDDDFLTSDESLIIIEIYASAWLRDILIGTVTVLASNLLPRSINTRKSKIRFVALQVRRPSGRPQGILNIGVNLVDSTMRSMPMYSELSASAVGYWDVMDPKKPKLQQNETNNNDSSCKLLTLQRSQSEKNDSTINDYAYNCSKENGYDEGGDDCQGSEVGMPMAKKGVIMNMNGSLCSDVGPSPSVVAAAIAKGLYPLPMMTAPRKPGNLVFQDWPEERGGLTAVYDHLGKNNENKKVRHVHSIPKGKGQKHRKGSSDGGLFSCFGTAMGCEFSITCGGGHGNRKKRYEGGSKAPPTAESELTYDESYI

SEQ ID NO: 154456 - protein, 142 aa, Glycine max
  Coding DNA Sequence Number=SeqID_37678
  Homolog annotation: Hit_ID=Q337N7; Match level="QueryCoverage=90%, HitCoverage=9%, E-value=9e-12, Identity=36%"; Hit description=SNF2 domain-containing protein, putative, expressed
MLGMFLFYFPVRLFCNILWWIANYHEHESLLQENEEEKLSKEEQDMAWEVYQKSLEWEEVQRVPLGESIMPEQKPEMPIAMPQNVSESCSILPTKLSRRFTIRKCTNLAHMLTLRSQGTKFGCSTVCGECAQEIRWEDLKKR

SEQ ID NO: 154457 - protein, 590 aa, Glycine max
  Coding DNA Sequence Number=SeqID_37679
  Gene Ontology: Mol. function=binding; Cellular component =intracellular; Biological process=RNA processing
  Homolog annotation: Hit_ID=Q10RX5; Match level="QueryCoverage=89%, HitCoverage=93%, E-value=0.0, Identity=59%"; Hit description=Pre -mRNA processing protein PRP39, putative, expressed
  Pfam annotation: Domain name=DUF946; Domain location=49-588; Score =1251.6; E_value=0; Accession=PF06101.2; Description=Plant protein of unknown function (DUF946)
MCLNQQQQRQEEEKKSALFFILLLCEKRREMFGCNSLCWDSSVPEFTDPDPLPFSLPSPLPQWPQGGSFASGRICLGEIEVIKVNNFEKVWRCTSLNGKSLGFTFYRPLEIPEGFFCLGYYCQSNHQPLRGYVLVARETSFDASVLESPALEKPLNYSLIWSLDSHDECVYFWLPNPPTGYKAMGIVVTSSPKEPEVEEVRCVRDDLTETCETSDLLLTVKSKYAKDSFQVWNTQPCDRGMLARGVDVGTFFCGSTYFDSEQVVDIMCLKNLDSSLHAMPNQNQIHALIQHYGPTVYFHPDEKYLPSSVQWFFKNGAVLHAAGNKKGIAIDYQGSNLPSGGTNDGAFWIDLPTDGDARNNLKKGNIESAELYVHVKPALGGAFTDIVMWVFCPFNGPATLKVALMNIEMSKIGEHVGDWEHFTLRISNFTGELWSVYFSQHSGGGWIHAFDLEFNKGNKPIVYSSKDGHASFPHPGTYLQGSSKLGIGVRNDAAQSKFIVDSSVKYQIVAAEYLGEGVITEPCWLQYMREWGPTVVYDSRSEIEKIINLLPLFVRFSVENLFELFPTELYGEEGPTGPKEKDNWLGDEYC

SEQ ID NO: 154458 - protein, 272 aa, Glycine max
  Coding DNA Sequence Number=SeqID_37680
  Gene Ontology: Mol. function=nucleic acid binding; Cellular component= nucleus; Biological process=response to DNA damage stimulus
  Homolog annotation: Hit_ID=Q337N7; Match level="QueryCoverage=99%, HitCoverage=18%, E-value=6e-85, Identity=59%"; Hit description=SNF2 domain-containing protein, putative, expressed
  Pfam annotation: Domain name=Helicase_C; Domain location=194-272; Score=48.9; E_value=1.7e-11; Accession=PF00271.21; Description =Helicase conserved C-terminal domain
MDMNVVKKDLPPKTVFVITVKLSPLQRKLYKRFLDVHGFTTQVHPEMLRKRCFFAGYQALARIWNHPGILQLTKEVKDYVKHEDAVENFLVDDSSSDENSDYNVLAGEKMRYANDLLQRKDDNGFFLKGWWNDLLHGKIYKEIDHSGKMVLLMEILTMSSDVGDKVLVFSQSIPTLDLIELYLSRIPRRSKREKFWKKGKDWYRLDGRTESSERQKLVERFNEPLNKRVKCTLISTRAGSLGINLHAANRVVIVDGSWNPTYDLQAIYRSWR

SEQ ID NO: 154459 - protein, 69 aa, Glycine max
  Coding DNA Sequence Number=SeqID_37681
MVVRTVVVASWVNGHVLVDLKMETACNSGDGVALKSGWRWWHSEANVRRLGGGSRPWCSGDELGGVRRR

SEQ ID NO: 154460 - protein, 68 aa, Glycine max
  Coding DNA Sequence Number=SeqID_37682
MRRRRNLGQNKRFVITQVSQEVQTTIGLFINMMKRRLLIHEHQWTADRSNQRLNHSKDSSLPMPKKVA

SEQ ID NO: 154461 - protein, 785 aa, Glycine max
  Coding DNA Sequence Number=SeqID_37683
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=99%, HitCoverage=93%, E-value=0.0, Identity=52%"; Hit description=Protein kinase; Actin-binding, actinin-type
  Pfam annotation: Domain name=LRR_1; Domain location=107-129; Score =9.2; E_value=5.5; Accession=PF00560.23; Description=Leucine Rich Repeat
  Pfam annotation: Domain name=LRR_1; Domain location=11-33; Score=9.0; E_value=6; Accession=PF00560.23; Description=Leucine Rich Repeat
  Pfam annotation: Domain name=LRR_1; Domain location=131-153; Score =12.4; E_value=1.4; Accession=PF00560.23; Description=Leucine Rich Repeat
  Pfam annotation: Domain name=LRR_1; Domain location=155-177; Score =15.7; E_value=0.16; Accession=PF00560.23; Description=Leucine Rich Repeat
  Pfam annotation: Domain name=LRR_1; Domain location=179-201; Score =12.5; E_value=1.3; Accession=PF00560.23; Description=Leucine Rich Repeat
  Pfam annotation: Domain name=LRR_1; Domain location=203-225; Score =10.6; E_value=3; Accession=PF00560.23; Description=Leucine Rich Repeat
  Pfam annotation: Domain name=LRR_1; Domain location=227-249; Score =7.9; E_value=9.6; Accession=PF00560.23; Description=Leucine Rich Repeat
  Pfam annotation: Domain name=LRR_1; Domain location=251-273; Score =9.4; E_value=4.9; Accession=PF00560.23; Description=Leucine Rich Repeat
  Pfam annotation: Domain name=LRR_1; Domain location=275-297; Score =14.8; E_value=0.31; Accession=PF00560.23; Description=Leucine Rich Repeat
  Pfam annotation: Domain name=LRR_1; Domain location=299-321; Score =18.1; E_value=0.031; Accession=PF00560.23; Description=Leucine Rich Repeat
  Pfam annotation: Domain name=LRR_1; Domain location=323-345; Score =18.6; E_value=0.023; Accession=PF00560.23; Description=Leucine Rich Repeat
  Pfam annotation: Domain name=LRR_1; Domain location=347-367; Score =10.5; E_value=3.1; Accession=PF00560.23; Description=Leucine Rich Repeat
  Pfam annotation: Domain name=LRR_1; Domain location=35-57; Score =14.0; E_value=0.54; Accession=PF00560.23; Description=Leucine Rich Repeat
  Pfam annotation: Domain name=LRR_1; Domain location=59-81; Score =18.6; E_value=0.023; Accession=PF00560.23; Description=Leucine Rich Repeat
  Pfam annotation: Domain name=LRR_1; Domain location=83-102; Score =7.8; E_value=10; Accession=PF00560.23; Description=Leucine Rich Repeat
  Pfam annotation: Domain name=Pkinase; Domain location=475-749; Score =161.7; E_value=1.9e-45; Accession=PF00069.15; Description=Protein kinase domain
  Pfam annotation: Domain name=Pkinase_Tyr; Domain location=475-749; Score=107.6; E_value=3.6e-29; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::Pkinase::Pkinase_Tyr; Domain location=107-129::11 -33::131-153::155-177::...
  Pfam module annotation: Domain location=179-201::203-225::227 -249::251-273::275-297::299-321::323-345::347-367::35-57::59-81::83 -102::475-749::475-749
EIPAEFGNLTSLQYLDLAVGSLSGQIPAELGKLTKLTTIYMYHNNFTGKIPPQLGNITSLAFLDLSDNQISGEIPEELAKLENLKLLNLMTNKLTGPVPEKLGEWKNLQVLELWKNSFHGPLPHNLGQNSPLQWLDVSSNSLSGEIPPGLCTTGNLTKLILFNNSFTGFIPSGLANCSSLVRVRIQNNLISGTIPVGFGSLLGLQRLELAKNNLTGKIPTDITSSTSLSFIDVSWNHLQSSLPSDILSIPSLQTFIASHNNFGGNIPDEFQDCPSLSVLDLSNTHISGTIPESIASSKKLVNLNLRNNRLTGEIPKSITNMPTLSVLDLSNNSLTGRIPENFGNSPALEMLNLSYNKLEGPVPSNGMLVTINPNDLIGNEGLCGGILHPCSPSFAVTSHRRSSHIRHIIIGFVTGISVILALGAVYFGGRCLYKRWHLYNNFFHDRFQQSNEDWPWRLVAFQRITITSSDILACIKESNVIGMGGTGIVYKAEIHRSHITVAVKKLWRSRTDIEDGNDVLREVELLGRLRHRNIVRLLGYVHNERNVMMVYEYMPNGNLGTALHGEQSARLLVDWVSRYNIALGVAQGLNYLHHDCHPPVIHRDIKSNNILLDANLEARIADFGLARMMIQKNETVSMVAGSYGYIAPEYGYTLKVDEKIDIYSYGVVLLELLTGKTPLDPSFEESIDIVEWIRKKKSSKALVEALDPAIASQCKHVQEEMLLVLRIALLCTAKLPKERPPMRDIITMLGEAKPRRKSVCHNGGQDTSSVEKPTIFTTSPVISLL

SEQ ID NO: 154462 - protein, 95 aa, Glycine max
  Coding DNA Sequence Number=SeqID_37684
MERAIKEDSSNPSSFINDNDIYFTVVGGKNAKGNVYGLPALSKMITSKSAQPLVIQPKVVNQIQEMHETIQNLNVELMTKVDKEMTLEEQMMQLM

SEQ ID NO: 154463 - protein, 1261 aa, Glycine max
  Coding DNA Sequence Number=SeqID_37685
  Gene Ontology: Mol. function=nucleoside-triphosphatase activity; Biological process=proteolysis
  Homolog annotation: Hit_ID=P72991; Match level="QueryCoverage=37%, HitCoverage=70%, E-value=6e-44, Identity=29%"; Hit description=Cell division protease ftsH homolog 4
  Pfam annotation: Domain name=AAA; Domain location=762-952; Score =158.5; E_value=1.8e-44; Accession=PF00004.19; Description=ATPase family associated with various cellular activities (AAA)
  Pfam annotation: Domain name=Peptidase_M41; Domain location=1044 -1219; Score=-102.3; E_value=0.00018; Accession=PF01434.8; Description=Peptidase family M41
  Pfam module annotation: Pfam domain module=AAA::Peptidase_M41; Domain location=762-952::1044-1219
  Subcellular localization annotation: CTP_CleavageSite=54; ConfidenceScore=5.63e-01
MTSSPLHSPLHFPQRPLFTSIRPIPNRTFISKNPRRTPRTPLLLAPITLTPPITFAAKSTPTPTPSPNDDVFSKHLVRALFCFAVGFSALGAFHAPPPAFAIAAPWTYWAKRGTEEKERAKSHQYSDCTDRLLETVSFLLKTVDEVRNGNGDVSEAEAALEAVKSKKEEMRKEINGRLYPALKRLRRERKALWKRSGEIVGEILNAMAEYDKLKAKVAANEKENENARMKELEESVGVMEDEYNGVWERVGEIEDRISREETVALSYGVREINFIERECEQLVERFKREVKNKDFKSLPTGSVTRLSKSAIQKDLETVHRKQAEQIILPSILDVEDLGPFFHEDSINFAQCLTRSLKDSREKQRNLEAQIRKKMKKFGKEKRSIIYSPEEEVVKGFPEVELKWMFGNKEVVLPKAVGLHLYHGWKKWREEAKANLKQNLIKDAEFGRQYVAERQERILLDRDRVVSRTWYNEEKSRWEIDPVAVPYAVSKKLIEHVRIRHDWGAMYIALKGEDEEFYVDIKVVAEYEMLFEDLGGFDGLYMKMLACGIPTAVHLMWIPFSELNIRQQFLLILRVSHGILSGLWNSGVVTNARNWIFKNIKDTTDDIMVVIVFPTVELLVPYPVRIQLGMAWPEEIYQTVDSTWYLKWQSEAELNFRSRQTTTDDDEERSEYAEVAASGISLFLHLVHKYYISQKLKKIKQRRKDGVDPIKTAFEQMKRVKKPPIPLKNFASIESMKEEINEVVTFLQNPKAFQEMGARAPRGVLIVGERGTGKTSLALAIAAEAKVPVVEIKAQQLEAGLWVGQSASNVRELFQTARDLAPVIIFVEDFDLFAGVRGTYIHTKNQDHETFINQLLVELDGFEKQDGVVLMATTRNLKQIDEALQRPGRMDRIFHLQRPTQAEREKILYLSAKETMDDQFIDYVDWKKVAEKTALLRPIELKIVPMALEGSAFRSKVLDTDELMDYCGLFATFSSMIPQWLRKTKIFNKFSKGLVNHLGLTLTKEDLQNVVDLMEPYGQISNGIEYLSPPLDWTRETKFPHAVWAAGRGLTALLLPNFDDVDNLWLEPLSWQGIGCTKITKARNEGSINGNSESRSYLEKKLVFCFGSYVASQMLLPFGEENLLSTSEIQQAQEIATRMVIQYGWGPDDSPAIYYRSNAVTALSMGDDHEYVMAAKVEKMFDLAYLKAREILQKNRLVLEKIVEELLEFEILTGKDLERITKDNGVIREQEPFTLGEVQASEPTSGSFLERGNASGSALLAS

SEQ ID NO: 154464 - protein, 164 aa, Glycine max
  Coding DNA Sequence Number=SeqID_37686
  Gene Ontology: Mol. function=nucleic acid binding; Biological process= DNA integration
MAQPPPRERTLREMVAPDFTYESLCIQYPDEDVPYVLKIGLIHLLPKFHSLAGEDPHKHLKEFHIVYSTMKPSDVHEDHIFLKAFPHSLEGVAKDWLYYLAPRSITSWDDLKRVFLEKIFPASKTTAIRKDISGIRQLSGESLYEYWERFKKLCASCPHPQIFE

SEQ ID NO: 154465 - protein, 147 aa, Glycine max
  Coding DNA Sequence Number=SeqID_37687
MACIPDKIKDINGSKETLKLVVRITDLWFVGTQDKFELTKLKIVVRPILTSRSQLSGSSQFSAKDRFFYKAEAKSLFEINKISKYRLEVMVYRKEECTKFLLWGRECTDLIDLMNTIIDLLPDAKAPCKVHFPLSDANNPPQYETDI

SEQ ID NO: 154466 - protein, 127 aa, Glycine max
  Coding DNA Sequence Number=SeqID_37688
MNPKEVGPLCPVITTKKLYPLLAMNPKDVGLLCPVINQEANPASCNEPKERWSLGFSVQPRRPSLENSHQEFENQHLETLGLDLNQEGEALTDSRPWGKDTRFECSFKPMLIPYGWSILSKQSDPDW

SEQ ID NO: 154467 - protein, 263 aa, Glycine max
  Coding DNA Sequence Number=SeqID_37689
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=66%, HitCoverage=37%, E-value=1e-42, Identity=44%"; Hit description =Protein kinase; Actin-binding, actinin-type
  Pfam annotation: Domain name=LRRNT_2; Domain location=106-152; Score =39.7; E_value=9.9e-09; Accession=PF08263.3; Description=Leucine rich repeat N-terminal domain
  Pfam annotation: Domain name=LRR_1; Domain location=156-178; Score =8.5; E_value=7.4; Accession=PF00560.23; Description=Leucine Rich Repeat
  Pfam annotation: Domain name=LRR_1; Domain location=180-202; Score =12.4; E_value=1.4; Accession=PF00560.23; Description=Leucine Rich Repeat
  Pfam annotation: Domain name=LRR_1; Domain location=204-226; Score =9.4; E_value=5; Accession=PF00560.23; Description=Leucine Rich Repeat
  Pfam annotation: Domain name=LRR_1; Domain location=228-250; Score =5.9; E_value=22; Accession=PF00560.23; Description=Leucine Rich Repeat
  Pfam module annotation: Pfam domain module=LRRNT_2::LRR_1::LRR_1::LRR_ 1::LRR_1; Domain location=106-152::156-178::180-202::204-226::228-250
MCLLLNTVLKYLKEKKRKKNCICKVVECLNKEYLDKINYKLICPSELPSSYNLPFPPLHSLFPAMKNATRLRGTKAKRTTTKMQSHLLFFFYCYIGLSLIFTKAAADDELSTLLSIKSTLIDPMKHLKDWQLPSNVTQPGSPHCNWTGVGCNSKGFVESLELSNMNLSGHVSDRIQSLSSLSSFNISCNRFSSSLPKSLSNLTSLKSFDVSQNYFTGSFPTGLGRAAGLRSINASSNEFRGFLPEDIGNATLLESLDFRGSYF

SEQ ID NO: 154468 - protein, 215 aa, Glycine max
  Coding DNA Sequence Number=SeqID_37690
  Gene Ontology: Mol. function=phosphogluconate dehydrogenase (decarboxylating) activity; Cellular component=mitochondrion; Biological process=valine metabolic process
  Homolog annotation: Hit_ID=Q1AYX9; Match level="QueryCoverage=95%, HitCoverage=70%, E-value=2e-39, Identity=44%"; Hit description=6 -phosphogluconate dehydrogenase, NAD-binding protein precursor
  Pfam annotation: Domain name=3HCDH_N; Domain location=4-166; Score= -100.1; E_value=0.0059; Accession=PF02737.8; Description=3 -hydroxyacyl-CoA dehydrogenase, NAD binding domain
  Pfam annotation: Domain name=ApbA; Domain location=7-124; Score= -24.9; E_value=0.026; Accession=PF02558.6; Description=Ketopantoate reductase PanEApbA
  Pfam annotation: Domain name=F420_oxidored; Domain location=6-186; Score=-37.2; E_value=0.0071; Accession=PF03807.7; Description=NADP oxidoreductase coenzyme F420-dependent
  Pfam annotation: Domain name=IlvN; Domain location=1-129; Score= -80.6; E_value=0.013; Accession=PF07991.2; Description=Acetohydroxy acid isomeroreductase, ca
  Pfam annotation: Domain name=NAD_Gly3P_dh_N; Domain location=5-147; Score=-38.2; E_value=0.0018; Accession=PF01210.13; Description=NAD -dependent glycerol-3-phosphate deh
  Pfam annotation: Domain name=NAD_binding_2; Domain location=4-165; Score=156.8; E_value=5.5e-44; Accession=PF03446.5; Description=NAD binding domain of 6-phosphogluconate dehydrogenase
  Pfam annotation: Domain name=UDPG_MGDP_dh_N; Domain location=7-143; Score=-87.8; E_value=0.03; Accession=PF03721.5; Description=UDP -glucoseGDP-mannose dehydrogenase family, NAD binding domain
  Pfam module annotation: Pfam domain module=3HCDH_N::ApbA::F420 _oxidored::IlvN::NAD_Gly3P_dh_N::NAD_binding_2::UDPG_MGDP_dh_N; Domain location=4-166::7-124::6-186::1-129::5-147::4-165::7-143
MSQQPVVAVLGLGAMGHAFAANLLKKGFTVRGWNRTRAKGEDLVDAGLTLSDSAAQAVEGADVVIAMLADGATTRATLNQVQNTLQQGATVAQMGTIGVEATDALIAGLAAARPDVVFIDAPVSGTKAPAENAQILVMASGDRQRAQAAEQVFAAIGKGTQWLGAAGASSRMKLVVNSWLIGLMQSLAESTRLAEQFGFTTDDLWQVLEGGPLAA

SEQ ID NO: 154469 - protein, 69 aa, Glycine max
  Coding DNA Sequence Number=SeqID_37691
MGLNQFRFFNMVHDILVKVKLEVTRTSTVLNVFGSKQSSDRKMKGSRMSKHENKRYAVCRTKSMLNAYA

SEQ ID NO: 154470 - protein, 123 aa, Glycine max
  Coding DNA Sequence Number=SeqID_37692
MTPAQSADPARHPPVMQDDTYVKPHIPEVPVAPAAALTHAAFDVEQPRHAVEACQAIGERLKHLLNLRIVTVGTKIHEVMEYCLRMARGVTAEGNVYVRSDEGDARINHRCHPFYISISGLCL

SEQ ID NO: 154471 - protein, 114 aa, Glycine max
  Coding DNA Sequence Number=SeqID_37693
MEHFLEQVAWHEAQLPLVRPNEASPPEPTPVQVDPKQGGPQSPVVNPPSSPKREVVPPSPPLIVISDASSDEAAAPPDSPVGETADPLTSPIEGIADLSDSSSGEVVAPTDSPV

SEQ ID NO: 154472 - protein, 449 aa, Glycine max
  Coding DNA Sequence Number=SeqID_37694
  Gene Ontology: Mol. function=transferase activity, transferring hexosyl groups; Biological process=carbohydrate biosynthetic process
  Homolog annotation: Hit_ID=Q6K1S5; Match level="QueryCoverage=98%, HitCoverage=86%, E-value=1e-104, Identity=43%"; Hit description =Putative glycogenin 1
MVVLVSDVVSDYANTLLQADGWIVEKISLLANPNQHSERLNSGVMVVQPSATIFNDMMSKVKTLPSYTGGDQGFLNSYYSGFPNAHLFEPNLSPDMLDTRPVPEMERLSTLYNADVGLYMLANKRLNELEEKLEGMEAIIEAWINVDEKLWMVDENELRVIHYTLGPLKPWDWWTSWLVKPVDVCSNISKTCLPNVREQLEESLPGTGGGQNPKDNYLVKFLFLLPFCAVLFCCCRSFLKEFRVPHNVVFSAESEGFGSCEALAYSSDDWLINGVQYKVPAYLGSISVCLLVAVVSLGLSIFIVPRQVAPWTGLLLMYEWTFTIFFILFGGYLNLIYHRGRIIASQMPSSLSHPESSDDDSEKVHQRQMSSCDAATWFYGLGMAFLAIATPSLPFLFGITALFLRLALMVVGGAILACFLTYSSERLAIRSFLKGLEERDVARNANFCC

SEQ ID NO: 154473 - protein, 256 aa, Glycine max
  Coding DNA Sequence Number=SeqID_37695
LHVLAFRGLHSLAFRGLHVLVFRGLHVLIFRGLHVLAFRGLHVLTFRGLHVLAFRGLRALAFIPEPPPDIGGRSTVQAELERKAIMQLLCIPGQDFTRAAAKRQRSQCRSPPADVSVGLCHPDIGKYAYGSTDFLYHPLFAGIVPARHPVDPEKSNRVLGFPALIMGFYQFYGVPVTPGKVIRSPTNQAFIKKYCTPRQAQGETPQQPGDGWQRATNAPPPPPEPLSSSTKRRPAQDVKEALLGGNLVPFESMLVI

SEQ ID NO: 154474 - protein, 502 aa, Glycine max
  Coding DNA Sequence Number=SeqID_37696
  Gene Ontology: Cellular component=cytosol
  Homolog annotation: Hit_ID=Q7V2V3; Match level="QueryCoverage=32%, HitCoverage=66%, E-value=6e-12, Identity=31%"; Hit description =TENA/THI-4 protein
  Pfam annotation: Domain name=Hydrolase; Domain location=203-444; Score=-4.1; E_value=0.1; Accession=PF00702.16; Description=haloacid dehalogenase-like hydrolase
  Pfam annotation: Domain name=TENA_THI-4; Domain location=2-184; Score= -42.1; E_value=0.1; Accession=PF03070.6; Description=TENATHI-4 family
  Pfam module annotation: Pfam domain module=Hydrolase::TENA_THI-4; Domain location=203-444::2-184
MHSLRYELAEECADDDDAKLGICELRKAVLEELKMHNLLVQERELDLAKEHGINSATVKYTEFLLATASGKIEGLKGPGKLATPFEKTKIAAYTLGAMTPCMRLYAVMGKKFQELLDSNESTHPYNKWINNYSSDGFQATTLQTEDLLDKLSVSLTGEELDVIEKLYYQAMKLEIEFFSAQPLFQPTIVPLTKGHKPVEDHLIIFSDFDLTCTVVDSSAILAEIAIVTAPKSDQNQPEDQIVRMLSSDLRNTWGFLSKQYTEEYEQCIESIMPPDRLNNFDYKELSMALEQLSKFENTANNRVIESGVLKGISLEDIKRAGERLILQDGCPNFFQSIVKNENLNANVHVLSYCWCGDLIRSTFSSADLNELNVHANEFTYEGSVSTGEIVKKVESPIDKVEAFRNILKNCNDDKKKLTVYIGDSVGDLLCLLEADVGIVIGSSSSLRSVGTQFGISFVPLYSGLVKKQKEYVEGSTSDWKGLSGILYTVSSWAEVHAFILGC

SEQ ID NO: 154475 - protein, 103 aa, Glycine max
  Coding DNA Sequence Number=SeqID_37697
MSIGDAQPIQIHNKENCGESIPEEFDIVKHHDGLKEMKKTIEDVRELVLKLTKNITIGTPTKTPKQGHRLLYAGGDAKRLEKKTGGKKLFSPLKKIMKPTKVL

SEQ ID NO: 154476 - protein, 193 aa, Glycine max
  Coding DNA Sequence Number=SeqID_37698
  Gene Ontology: Mol. function=DNA binding; Cellular component =mitochondrion; Biological process=DNA integration
  Homolog annotation: Hit_ID=Q1S3H4; Match level="QueryCoverage=68%, HitCoverage=23%, E-value=6e-46, Identity=63%"; Hit description =Integrase, catalytic region
MGCSKQMLTSPLAHEPKIYPKAHENPRAFSCISSPIFLESSIQCPWGVGLHHNFLRRCVTQGQPRSIIWNCHSSPYRGHYNGEMTAVKVLQSGFYCPTLCKDAHEYVQRCDKCQRTRGLSKRNEMPLQNILEVEAFDCWGTDFIGPFPSSYSHEYILLVVDYVTKWVEAVAVQHAYAKTIICFLKKISSQGLA

SEQ ID NO: 154477 - protein, 246 aa, Glycine max
  Coding DNA Sequence Number=SeqID_37699
  Gene Ontology: Mol. function=nucleic acid binding; Biological process= DNA integration
  Homolog annotation: Hit_ID=Q1RXW3; Match level="QueryCoverage=81%, HitCoverage=27%, E-value=2e-16, Identity=29%"; Hit description=Zinc finger, CCHC-type
  Pfam annotation: Domain name=zf-CCHC; Domain location=67-84; Score =25.3; E_value=6.6e-05; Accession=PF00098.13; Description=Zinc knuckle
MWDTPALMYEGSSQVKHNKLNMLTYKDYQLAFISRKIRNMWKKGNESKWKGSKKPYKERKDRDKSSIICYKCKKPGHFKSEYPDLEKTYHKKRYFKPKDNKVLMSTWEDQDDTSFDEEIEEEEEKANLFLMANTTSKGSDFESDEYVNINNIETLQSTYHELLSNSSILSKACQNLRKDFKSLSKDYEQLQGKHEENTNNSSKFSTQPCDGFETLKKTTKLHIENEKIYKEKSSLLKDLQKLKNQL

SEQ ID NO: 154478 - protein, 267 aa, Glycine max
  Coding DNA Sequence Number=SeqID_37700
  Gene Ontology: Mol. function=motor activity; Cellular component =myosin complex; Biological process=protein amino acid phosphorylation
  Homolog annotation: Hit_ID=UPI000034F472; Match level="QueryCoverage =97%, HitCoverage=19%, E-value=1e-113, Identity=72%"; Hit description= XIC; motor/ protein binding
  Pfam annotation: Domain name=Myosin_head; Domain location=1-266; Score=-197.3; E_value=2.3e-08; Accession=PF00063.11; Description =Myosin head (motor domain)
MISGIRFGKFVEIQFDKSGRISGAAIRTYLLERSREIEKYKLGNPRSFHYLNQSKCYELADVSDAREYLATRRAMDIVGISQKDQEAIFRVVASILHIGNIEFTKGKDIDSSVPKDDKSKFHLKTTAELLMCDADALEDALCKRVMITPEEVIKRSLDPQSAAISRDGLAKTLYSRLFDWLVDKINSSIGQDPNSKSLIGVLDIYGFESFKSNSFEQFCINFTNEKLQQHFNQAKSKNKLCTSSLFAISIINMMKPGGIIALLDEAW

SEQ ID NO: 154479 - protein, 1034 aa, Glycine max
  Coding DNA Sequence Number=SeqID_37701
  Gene Ontology: Mol. function=motor activity; Cellular component =myosin complex; Biological process=protein amino acid phosphorylation
  Homolog annotation: Hit_ID=UPI000034F472; Match level="QueryCoverage =99%, HitCoverage=66%, E-value=0.0, Identity=75%"; Hit description =XIC; motor/ protein binding
  Pfam annotation: Domain name=DIL; Domain location=852-959; Score =204.4; E_value=2.6e-58; Accession=PF01843.9; Description=DIL domain
  Pfam annotation: Domain name=IQ; Domain location=225-245; Score=25.3; E_value=0.00022; Accession=PF00612.17; Description=IQ calmodulin -binding motif
  Pfam annotation: Domain name=IQ; Domain location=248-268; Score=19.0; E_value=0.018; Accession=PF00612.17; Description=IQ calmodulin -binding motif
  Pfam annotation: Domain name=IQ; Domain location=273-293; Score=23.7; E_value=0.00067; Accession=PF00612.17; Description=IQ calmodulin -binding motif
  Pfam annotation: Domain name=IQ; Domain location=296-316; Score=19.9; E_value=0.0093; Accession=PF00612.17; Description=IQ calmodulin -binding motif
  Pfam annotation: Domain name=IQ; Domain location=321-341; Score=12.0; E_value=2.1; Accession=PF00612.17; Description=IQ calmodulin-binding motif
  Pfam annotation: Domain name=IQ; Domain location=344-364; Score=24.1; E_value=0.00051; Accession=PF00612.17; Description=IQ calmodulin -binding motif
  Pfam annotation: Domain name=Myosin_head; Domain location=1-209; Score=-365.8; E_value=0.0047; Accession=PF00063.11; Description =Myosin head (motor domain)
  Pfam module annotation: Pfam domain module=DIL::IQ::IQ::IQ::IQ::IQ::IQ ::Myosin_head; Domain location=852-959::225-245::248-268::273 -293::296-316::321-341::344-364::1-209
MFPKSTHETFANKLYQTFKNHKRFIKPKLSRTDFTIAHYAGEVLYQSDQFLDKNKDYVVPEHQDLLSASKCYFVSGLFPPLPEETSKSSKFSSIGSRFKLQLQSLMETLNSTEPHYIRCVKPNNQLKPAIFENVNIMQQLRCGGVLEAIRISCAGYPTRRAFFEFINRFGILATEAMEANCDEKAGCQKILEKMGLHGYQIGKTKVFLRAGQMAELDARRAQVLGNAAKVIQRCVRTHQARKHYLALRKKSIYVQSRWRGRLACKLYEHLRREAAARKIQKNVRRYESRKAYKELHVSALTLQTAIRAVAARKKFRFKKQTKASIIIQARWQCHKAALYHKRLKKGAIVTQCRWRGRIARKELRKLKMAARETGALQEAKDKLEKRVEELTWRLQLEKGLRTNLEESKAQEIAKVQNLLQEMQNKFEETNALLIKERENAKKVVEEAPPVIKETQVIVEDTQKIEKLNAEVESLKLILSDFALAVSTQTSLKSEKQKADDFERKYNETQVCSEERRKKLEDTEKKTRQLQESLTRLEEKITNLESENQVLRQQAVSMAPNKFLSGRSRSIIQRTESGHIVQEAKTTLPNQEMHSKSMHRREPSDGLDDKPQKSLNEKQQENQELLIRCIAQHLGFAGNRPIAAFIIYKCLLHWRSFEVERTSVFDRIIQTIGHAIETQDNNDVLAYWLSNASTLLLLLQRTLKASGAAGMAPQRHRSSATLFGRMTQSFRGAPAGVNVSLINGNTSRGVDTLRQVEAKYPALLFKQQLTAYVEKIYGMIRDNLKKEISPLLGLCIQAPRTSRASLVKGSSRSVANPEAQRALIAHWQGIVKSLGNFLNALKENHVPPFLVRKVFTQIFSFINVQLFNSLLLRRECCSFSNGEYVKAGLAELEHWCYKATDEYAGSAWDELKHIRQAIGFLVIHQKPKKTLDEISHDLCPVLSIQQLYRISTMYWDDKYGTHSVSSDVISNMRVLMTEDSNNAVSNSFLLDDDSSIPFSVDDISKSMEQIDIADIEPPPLIRENSGFSFLLPRPD

SEQ ID NO: 154480 - protein, 284 aa, Glycine max
  Coding DNA Sequence Number=SeqID_37702
  Homolog annotation: Hit_ID=Q8L8A5; Match level="QueryCoverage=45%, HitCoverage=40%, E-value=3e-22, Identity=50%"; Hit description=GRF1 -interacting factor 1
  Pfam annotation: Domain name=SSXT; Domain location=91-152; Score =21.6; E_value=7.1e-06; Accession=PF05030.3; Description=SSXT protein (N-terminal region)
MDRPIGTKAGASVSRSAPSDQCVREMQQHLMQMQPMMAAYYPNNVTTDHIQQRKTTKKVLLSSYPLFWWHPTFRLGVLKDFKLNKWFDYFVTLTHININYLDENKSLILKIVESQNSGKLSECAENQSRLQRNLMYLAAIADSQPQPSPLAGQYPSSGLVQQGAHYMQAQQAQQMSQQQLMASRSSLLYSQQPFSVLQQQQGMHSQLGMSSSGSQGLHMLQSEATNVGGNATIGTGGGFPDFVRIGSGKQDIGISGEGRGGNSSGHSGDGGETLNYLKAAGDGN

SEQ ID NO: 154481 - protein, 247 aa, Glycine max
  Coding DNA Sequence Number=SeqID_37703
MARETYHYCGVKWEKVGKWCESEMTGTTTLISFWGKMNREGNGRSEQGFGSMKRHSSPRPSTSAPSSSSLCFRANSWLLINYVSNGISSHSPPWSKATVRERNSDDGRSGGRKKFVQGGGNKKEQGGKETERHRSPFFFYFAFLSLDLLCLFDVHLCFLLCALSVVTVDSLAHSDEGGTRERSKVQSSVSLMRKRKTRRRKKVSGGGGSGSGSGSSSPLENDEVVVCSPNYYHCLKRAKKLVVSGIE

SEQ ID NO: 154482 - protein, 221 aa, Glycine max
  Coding DNA Sequence Number=SeqID_37704
  Gene Ontology: Mol. function=motor activity; Cellular component =myosin complex; Biological process=signal transduction
  Homolog annotation: Hit_ID=Q67VX5; Match level="QueryCoverage=86%, HitCoverage=12%, E-value=3e-93, Identity=84%"; Hit description =Putative myosin heavy chain PCR43
  Pfam annotation: Domain name=Myosin_N; Domain location=37-78; Score =27.2; E_value=5.7e-05; Accession=PF02736.9; Description=Myosin N -terminal SH3-like domain
MQQQTVIKLIFLQCGIQLVVRPIFLRIMGTPVNIVVGSHVWIEDPEVSWIDGQVLKINGKDAEIDATNGKKVVANLSKIYPKDMEAPPGGVDDMTKLSYLHEPGVLQNLKARYELNEIYTYTGNILIAINPFQRLPHIYGAHMMQQYKGAPFGELSPHVFAVADVAYRAMINEKKSNSILVSGESGAGKTETTKMLMQYLAFLGGRAGTEGRTVEQQVLEV

SEQ ID NO: 154483 - protein, 126 aa, Glycine max
  Coding DNA Sequence Number=SeqID_37705
MKDKRDEEEKLEKQKKKKDSKALSSKAKGKEKEEKDSSKKIVKKEKHFATKGDIKRAFLLKQSFYLLLSREASLSTAIPLELEVIPQVKELFDEGVVCKSLNPCALLVPKVGIIRHQIPMIGGVIP

SEQ ID NO: 154484 - protein, 343 aa, Glycine max
  Coding DNA Sequence Number=SeqID_37706
  Gene Ontology: Mol. function=protein kinase activity; Cellular component=nucleus; Biological process=protein amino acid phosphorylation
  Homolog annotation: Hit_ID=Q5H6Q8; Match level="QueryCoverage=100%, HitCoverage=57%, E-value=1e-131, Identity=71%"; Hit description=ABC transporter substrate binding protein
MPAFFACPCATVEQQCTGHDAKAEHHADEQQNQRNQRVAEQMPAGVDLHHHRGGHDQRGADDAGRDAVGDLLQVLHQPRFFQAGHLHLQAVFGQQGHDVRQLARPIAQQLLQLHRLAGEVGGRQRFLQACAHHVLQLALDDATCFQLWCQQPAHGFQVEQCLAQQAQFRRRAQPAGGGDAHHVQHHAAFGERAAGGVTRDQLAGLAQITFLVERLQPRADADQVVGHFLATAVDRGEQDLQQALAQARRHVRDHAQVEDRQPAIGHHPQVAGVRVGVDLAVHEDLVEVAADQRRRQRVHRLFGAAHIGDRIHAHAGGQFHGQHALAAVVPQRLRYPQAAERLQ

SEQ ID NO: 154485 - protein, 137 aa, Glycine max
  Coding DNA Sequence Number=SeqID_37707
MGSEIYPEVHENPRAFFSNSSSILLEPLAHGSSDCSLPREDCINDLLSENLGHNGLLVLHLSIPPEHFDKLWVYHLRVTEITMDSTEKRSSLYVEVEAFQHTDTEVVFNLNNRFSIDVNDGCVSGDNSGCKSSIFTG

SEQ ID NO: 154486 - protein, 88 aa, Glycine max
  Coding DNA Sequence Number=SeqID_37708
MLIGEIDFLVYSGGRLDGYGVGVHVTLLSNELESSDDGILMDSVGVKDLHPALVFLFFGKEEGIIVAFDSFLEWFADEFIETRLDERV

SEQ ID NO: 154487 - protein, 88 aa, Glycine max
  Coding DNA Sequence Number=SeqID_37709
MVPDRVYLRLPICDVGKKKGFKLYFNEDMPNRKIEDRARPHGTKQCGMTPREPALPTLHMYMLSNKGTPLRYYIKPKFTTLMMKTPAS

SEQ ID NO: 154488 - protein, 83 aa, Glycine max
  Coding DNA Sequence Number=SeqID_37710
MAKIWFNITRKSFMHKRLDEDSKHSIISKGTFIARQLHFSYVNLKAMKDSKRAARQASGQKACPTPRRGRRNRVEEATDQEKT

SEQ ID NO: 154489 - protein, 90 aa, Glycine max
  Coding DNA Sequence Number=SeqID_37711
MGSKSTLRLMRTLGPSLRSVAQSTRSLLANALAGVNSDFVGQTILEQCWCRAHVIELEVVVVNTCNLLKLMELSGLPRTGRSLSGRDEPV

SEQ ID NO: 154490 - protein, 52 aa, Glycine max
  Coding DNA Sequence Number=SeqID_37712
MSESIETENDSADTSYSVARMRSISKSESDKGFEVARSVRKTSELPEARKIL

SEQ ID NO: 154491 - protein, 189 aa, Glycine max
  Coding DNA Sequence Number=SeqID_37713
  Gene Ontology: Mol. function=RNA-directed DNA polymerase activity; Cellular component=chromatin; Biological process=RNA-dependent DNA replication
MRTAHSGQKSYQDKKRKDLEFEVVDHVFLRVTPWTGVGRALKSRKLTPYFISPFQILKRVDPAAYQIALPPSLSILHNVFHISQLRKYIHDPSHVVELDIVQANKAFEKEKDSVGQGNMEIRELDAISLSSLASVRLKLRDFNIYLNLFHYNRDPRVINHWIAFTFQLYACNPILHVLTIGIFTITFGV

SEQ ID NO: 154492 - protein, 129 aa, Glycine max
  Coding DNA Sequence Number=SeqID_37714
MPDHNTRQSTLERLEEAIAKLTQAQATLTQDHTTLAQTQTSMNTKMDAMLEHLAALTIQPSSPQLSPHHNPIPSPHTYKPHTKLDVPRFDGQDPVGWIFKICQFFDYQGLPDQERITVASFYMDGPALS

SEQ ID NO: 154493 - protein, 80 aa, Glycine max
  Coding DNA Sequence Number=SeqID_37715
MRRFPKHVTGIVFGNVIDFTENGAASVVVVLEEHDAVDYRLESEELGEGWVVGWWHDGGFGVLWSWSWHWVVAVDDGDVG

SEQ ID NO: 154494 - protein, 202 aa, Glycine max
  Coding DNA Sequence Number=SeqID_37716
  Gene Ontology: Mol. function=RNA-directed DNA polymerase activity; Cellular component=chromatin; Biological process=chromatin assembly or disassembly
MPTINELLDEIETTSWFSKLDLRQGFHQIRMNEEDIPKTAFCTHHGHFEFKAILDTLSQGSFYLCRSKCIFVEQQLTYLGHIVSSQGVAPDPEKIHAMIAWPTPTTPSELRSFLGLTGFYRKFIRNYTTTAAPLTALLCKDSFIWTPEAHTTFQHLKTLMTQAPILASPNFTVPFILETDAFGTAIGAVLLQKSRPIAFFSK

SEQ ID NO: 154495 - protein, 50 aa, Glycine max
  Coding DNA Sequence Number=SeqID_37717
MWDRHRLKRALKPGVFTLKAYTPKSLSGPLPPNSDIAHELYNIHDLTLMF

SEQ ID NO: 154496 - protein, 103 aa, Glycine max
  Coding DNA Sequence Number=SeqID_37718
  Gene Ontology: Mol. function=nucleic acid binding
MPEDAIRLSLFSFSLSGEAKRWLHSFKGNSLKTWDEVVEKFQKKYFPESKTTEGKAAISSFHQFPDESLSDALERFRGGKIKLKTSEEAMNLIENMVASDIAI

SEQ ID NO: 154497 - protein, 460 aa, Glycine max
  Coding DNA Sequence Number=SeqID_37719
  Gene Ontology: Mol. function=siderophore-iron transporter activity; Cellular component=outer membrane; Biological process=siderophore transport
  Homolog annotation: Hit_ID=Q4K9E7; Match level="QueryCoverage=96%, HitCoverage=55%, E-value=1e-148, Identity=56%"; Hit description=FecA- like outer membrane receptor
  Pfam annotation: Domain name=TonB_dep_Rec; Domain location=193-447; Score=111.9; E_value=1.9e-30; Accession=PF00593.14; Description=TonB dependent receptor
MPGGLSAAQYSQNPFQSTRPWDQFEGRRKDMSFKYKHQEDDKQFEVLTYFTDSYRGSNIESEGTGKNAGQRRMVSYPRHYSTWAIEPSYSQVFRFWDMAHEITLGYRYLNETMDEKASRSAWYNPADIGSTPETPDYYQHTSGGTAANAFYIDDTINVGNWTVTPGLRYESIRTHVDDAFNNISREKSYSEPLPSLNVMYHLSDAWKLFANANTSFGSMQYFQLTKGGNGNQPAPGLTAEKAHTYEFGTRYDDTVVKAEATLFYIDFDNQLQYISNDVGWTNMGATKHKGIELALSYDLSELNRALDGASVYTSYTYTKASTDKGDFAGKDLPFYSRQVYTVGTRYATGSWVWNLDGYAQSKQHSPGTGPEYVTQESADGQFGDIAGYMVWNMRGEYNFGPQLSNLTLGAGVKNLFDQRYFTRSNDNNFGKYVGEPRTFFVQGSIALNNRGPAGASVSPT

SEQ ID NO: 154498 - protein, 321 aa, Glycine max
  Coding DNA Sequence Number=SeqID_37720
  Gene Ontology: Mol. function=uroporphyrin-III C-methyltransferase activity; Biological process=cobalamin biosynthetic process
  Homolog annotation: Hit_ID=Q0WBS8; Match level="QueryCoverage=74%, HitCoverage=50%, E-value=7e-76, Identity=61%"; Hit description =Siroheme synthase
IARVDAANIALITHLAELLLQVVGGEQFGRAARHAAGEVSGDVAGLFGGETAHWRVFCGLCGTNAEDAAECEGQQAGLQAVVDYLPIFADLKQRPVLVVGGGDVAARKVDLLQRAGAEIRIVAQSLSPELEQQRQQGQLLWLGKTFDPQQLDEVFLAIAATDDNALNAAVFAEADKRRVLANVVDDQPRCSFIFPSIIDRSPLVVAVSSSGQAPVLARLLREKLEALLPASLGQMAQVAGRWRGQAKQRLASIGERRRFWEKAFGGRFATLVANGQTAQAERQLEQDLQSFAAGDEGAQGEIALVGAGPGDVGLLTLRGLQ

SEQ ID NO: 154499 - protein, 95 aa, Glycine max
  Coding DNA Sequence Number=SeqID_37721
MMRESRRAQESRPHAKRKISLLSEMFVSCRLSARLAPSLNPLTRAKRDDGTKENNTFIRAAYFCTEFEKSALEATERQQLRREARVHHFERLESV

SEQ ID NO: 154500 - protein, 130 aa, Glycine max
  Coding DNA Sequence Number=SeqID_37722
MNKMTIGTMQNSRVILRAESQHFARFMLVDQKKLGYHNDPFIMAEQARQVFYIQDPCDERWCVVLQGKTISVNVEDDDSYMDTYVIPLSTQITPNVVGEEEVDDVHANGSSCRGGSKFSIHVKHQLCLLR

SEQ ID NO: 154501 - protein, 114 aa, Glycine max
  Coding DNA Sequence Number=SeqID_37723
MMRSKMLQLVNYKSKAIKRALKHRRKNYQMKKLVPQIRATKGDLKHTRKNYQMKKLVPQIRATKGDLKHTRKNYQMKKLVPQMRVVQRIASKATIMKLVNLKIRTKNKAYRIQK

SEQ ID NO: 154502 - protein, 87 aa, Glycine max
  Coding DNA Sequence Number=SeqID_37724
  Subcellular localization annotation: CTP_CleavageSite=47; ConfidenceScore=5.08e-01
MIGGLDSLRNGTHLILVSISILPNRSSPTPCYSLLALFPFFMQALLSTSGKGSLEDVCDGKLETEAIETRTKQTDPKKQKLEKLGAE

SEQ ID NO: 154503 - protein, 139 aa, Glycine max
  Coding DNA Sequence Number=SeqID_37725
  Homolog annotation: Hit_ID=Q1T159; Match level="QueryCoverage=41%, HitCoverage=46%, E-value=5e-07, Identity=54%"; Hit description=Beta tubulin
  Pfam annotation: Domain name=DUF1723; Domain location=62-121; Score =27.6; E_value=4.4e-05; Accession=PF08330.1; Description=Protein of unknown function (DUF1723)
MLDEGIGAPMMDPLDQSGQVEALGRVEPVKVVEPQEPVQIIEQVKPTDHQELEVPVVFPGDPEDTSQLTSYADHEHGELKLRWDTETNTFHLPVGEMTMTITLDDMESLLHIPITREFYNFEHTDKEAAISVLVDLLGV

SEQ ID NO: 154504 - protein, 137 aa, Glycine max
  Coding DNA Sequence Number=SeqID_37726
  Homolog annotation: Hit_ID=Q1SMF0; Match level="QueryCoverage=95%, HitCoverage=35%, E-value=1e-13, Identity=30%"; Hit description =Tetratricopeptide-like helical
MVIDMTKSVVKPKNILRTLKEHNDKNVTTIKQVYSARTTYRRSLRGPRIEMQHLMYKLPLLEIVGVTCIGLTFSTAFAYMKAKHEKTVWALERFKGLFHRHDELPKVIITSKGLALMNAVKIMFHIIGCANFILIRM

SEQ ID NO: 154505 - protein, 101 aa, Glycine max
  Coding DNA Sequence Number=SeqID_37727
MSFSPTTHLLLVKDAFFLLRLKVEHPFLFHSSFAIEGFGGGLGSSLDGIEYGIGFRLPKWLLQKSHSVIAIGIVNDYYGMVVSDWLFQNSHFKSLCLFWNA

SEQ ID NO: 154506 - protein, 139 aa, Glycine max
  Coding DNA Sequence Number=SeqID_37728
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q41000; Match level="QueryCoverage=60%, HitCoverage=42%, E-value=1e-26, Identity=71%"; Hit description=ATP synthase delta' chain, mitochondrial precursor
MGGAEFSETERSDPNLAMLRRATSSLLTGASRRRLSSDVPATPAADSAFAEAWKKVSPNIDPPKTPLAYMKPRPPTPSALPSKLTVNFVLPYSSQLAAKELLFWMWFIVGFRFLHFKRADLVDVGFDSFEVNEVGLRVV

SEQ ID NO: 154507 - protein, 93 aa, Glycine max
  Coding DNA Sequence Number=SeqID_37729
  Subcellular localization annotation: CTP_CleavageSite=34; ConfidenceScore=5.24e-01
MGNFLDPQFKATSGFFKAKINFIHSTTYAIVTVMSIMVAAFGMAKHLPRRIPTYSIKPCLKNQGNRHGRIPEHPLKTTFSLDQVLDLVIKYLA

SEQ ID NO: 154508 - protein, 102 aa, Glycine max
  Coding DNA Sequence Number=SeqID_37730
  Subcellular localization annotation: CTP_CleavageSite=27; ConfidenceScore=5.50e-01
MNPMLLHPSSSSSSSSSSSSSSSSSLYDTMGGSFNQDIHAPALDSYILAPPSSLAVDYYISTLAIVHVLDNYIPALVIDPWLGQDICPLPTPTIDQNISFSF

SEQ ID NO: 154509 - protein, 112 aa, Glycine max
  Coding DNA Sequence Number=SeqID_37731
MVGIPAIEQHIHIHNNLIPTHDLHILIHTLSFNQDIPAPALYCYILSPSSDLVLDYYIPTPTNVHALDNYYYILALACDSCVGLKIFLLFLLLPLIKIFKLLILFSIKIMLI

SEQ ID NO: 154510 - protein, 80 aa, Glycine max
  Coding DNA Sequence Number=SeqID_37732
MSFSFIPKSQHIANPTPNSYLLGSCCCSGDEIKLLVEATVKGELSLIPWAPSSPPNQDPFALNLMSTTHGNSKVSKIYEI

SEQ ID NO: 154511 - protein, 89 aa, Glycine max
  Coding DNA Sequence Number=SeqID_37733
MAYSLVDDASSHLFSFVFRCISMDQELQPFGLANFLLRSQDNKYVTIAEEADEWKKEELQIYKESESTNKLETRSKSNQQLRESQKFKD

SEQ ID NO: 154512 - protein, 60 aa, Glycine max
  Coding DNA Sequence Number=SeqID_37734
MTTNSNQSHEDNEEEVEPDSLITTIPPYYIPPYTHNAEEFNFEDFECVVLGGAGHYTSLQ

SEQ ID NO: 154513 - protein, 168 aa, Glycine max
  Coding DNA Sequence Number=SeqID_37735
EFYANLYVPDEKFPKQVRVRGHLIKFDVDSLNTFLETLVVVEQGENLPSYSRFARLRPDPQELATQLCIPRRGFVLNVEGLPWKLLRKDLTVLKNCWNLDEPSVTFPGTQKSRARRSEAPSTSATPAPPTSASSTYALPSSQAVPVPPYPSAQSSKPSLWKQSFPSLF

SEQ ID NO: 154514 - protein, 199 aa, Glycine max
  Coding DNA Sequence Number=SeqID_37736
  Gene Ontology: Mol. function=nucleic acid binding; Biological process= DNA integration
  Homolog annotation: Hit_ID=Q1S1G2; Match level="QueryCoverage=92%, HitCoverage=14%, E-value=1e-32, Identity=37%"; Hit description =Integrase, catalytic region; Zinc finger, CCHC-type; Peptidase aspartic, catalytic
MDNARDIWKDLKSRYSQGDLLRISELQQEMASIKQGDQSIVNYFTKLRIIWDELESYRPDPTCSCDPKCICDAFTSMIERKQQDRIMQFSNISKVFSYVVQQERQINSNELIGSISLINAAGNNSSNSRPSYTYCGKDNHTIDKCYRKNGPPQNDPSKRGKGNFGAKGNKVSTNRGLSNHTIDDCYKKHGYPPGHKFYK

SEQ ID NO: 154515 - protein, 74 aa, Glycine max
  Coding DNA Sequence Number=SeqID_37737
HTPPLLGFAKNCLWREKYASHEALQNGGFNPFSFSLTFGNSIRAIRGKIEESQKIARDAAIAVGRHVIPLRGKG

SEQ ID NO: 154516 - protein, 63 aa, Glycine max
  Coding DNA Sequence Number=SeqID_37738
MTKGAEDDVGLFASTGSFSPWLTKCVGNHKGQYDKDYGVANKSEALAPTYPQFVMRNSDVHSS

SEQ ID NO: 154517 - protein, 411 aa, Glycine max
  Coding DNA Sequence Number=SeqID_37739
  Gene Ontology: Mol. function=sugar porter activity; Cellular component=integral to membrane; Biological process=ion transport
  Homolog annotation: Hit_ID=P22340; Match level="QueryCoverage=83%, HitCoverage=67%, E-value=1e-115, Identity=59%"; Hit description =Sucrose porin precursor
  Pfam annotation: Domain name=LamB; Domain location=166-411; Score =113.6; E_value=5.8e-31; Accession=PF02264.6; Description=LamB porin
MPSWRDCCGNWRSGVCRRMKRSWRPACARRSKIHCALKNGTAMMRCLNRFSKKIHLMIALPQGCKTVKKSIIAITLSTVLGSGSAWAADDMSSIEARLAAMEKRLAAAEQRASVAEQRAQAAEQQVQKLAAVQQQNPTPVAVAQTEPQAAQPVAPAASSESEGFEFHGYARSGLLMNSSAAKTQGGPTVTPAGETGGHVGRLGNEPDTYVELNLEHKQTLTNGATTRFKAMLADGQRTYNDWTAASSDLNLRQAFVELGQLPTFTGAFKDTTVWAGKRFDRDNFDIHWIDSDVVFLAGTGAGIYDMKWGDDARSNLSIYGRTFGDIENNDNTAQNYILSLNNFVGPLQLMVSGMRAKDNDQRTDIDGNRVKSDAASDGVHALVGLHNDSFYGLGEGSAKTALLYGHGLGAE

SEQ ID NO: 154518 - protein, 267 aa, Glycine max
  Coding DNA Sequence Number=SeqID_37740
  Subcellular localization annotation: CTP_CleavageSite=31; ConfidenceScore=5.38e-01
MAEPSKKRKGSSSRSQRRFGSQDTPIPPSISSSTLFSSEEQCIRYTTLFSSRSIIDPKFMDMEFFSDEMFECVQAFQNSGLILFVSLKIPVYPELVKVCYSNLGIQEGSLISEVYGIKMVIDQSLFFELTQLSSDGVPFEGTLDDDWKFDFSVFDARRLVCINQADMTRRLLAGSLTFDYRILHYLIVRILLPRSSKFAQFFEEDLIIMWAFLTVCQIDWAHLVRYCMNKALRSNTPLPNPHLISLFLHHFEWSPPSVIAKSVMALG

SEQ ID NO: 154519 - protein, 39 aa, Glycine max
  Coding DNA Sequence Number=SeqID_37741
MALYGSAFAYSNPLKDTRLPRNSAFHLSRARQGTTTHRS

SEQ ID NO: 154520 - protein, 308 aa, Glycine max
  Coding DNA Sequence Number=SeqID_37742
  Gene Ontology: Mol. function=phosphoric ester hydrolase activity; Cellular component=chloroplast; Biological process=carbohydrate metabolic process
  Homolog annotation: Hit_ID=P46276; Match level="QueryCoverage=99%, HitCoverage=99%, E-value=1e-150, Identity=79%"; Hit description =Fructose-1,6-bisphosphatase, cytosolic
  Pfam annotation: Domain name=FBPase; Domain location=13-307; Score =532.7; E_value=4e-157; Accession=PF00316.10; Description=Fructose-1 -6-bisphosphatase
MDHSADAQRTDLMTITRFVLNQQSNHPESRGDFSILLSHIVLGCKFLCSAVNKGEEQKKLDVLSNDVFIKALVSSGRTCILVSEEDEEATFVEASKRGKLLPIYSLVIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 154521 - protein, 46 aa, Glycine max
  Coding DNA Sequence Number=SeqID_37743
MTNQEKANHLTFSPSMTKKLARMGTNTDYPQQNGRWISIGYLFSIY

SEQ ID NO: 154522 - protein, 70 aa, Glycine max
  Coding DNA Sequence Number=SeqID_37744
  Homolog annotation: Hit_ID=Q8LF20; Match level="QueryCoverage=75%, HitCoverage=8%, E-value=3e-10, Identity=60%"; Hit description =Putative clathrin assembly protein At2g25430
MHLVEPLGNGDERSVDVASRKRRQCQDFSDIFFIGWDLFMVGGFDDEDFEVGGQIVGEYTTLDWGLGFPP

SEQ ID NO: 154523 - protein, 97 aa, Glycine max
  Coding DNA Sequence Number=SeqID_37745
YPSQMYRYPFEGHGTDMSASEYSFGGVAETHPHFSWPTMTLSQQHDAPMATPNAPLGPQWDVPGAIPDMGDLLGGINHVAHPCAITDTIMTDFDVSI

SEQ ID NO: 154524 - protein, 49 aa, Glycine max
  Coding DNA Sequence Number=SeqID_37746
  Gene Ontology: Mol. function=signal transducer activity; Cellular component=heterotrimeric G-protein complex; Biological process=G -protein coupled receptor protein signaling pathway
  Homolog annotation: Hit_ID=P49084; Match level="QueryCoverage=78%, HitCoverage=10%, E-value=9e-12, Identity=89%"; Hit description =Guanine nucleotide-binding protein alpha-1 subunit
DAEIERRIKLETKAEKHIQKLLLLGAGESGKSTIFKQARNCIFSTACEL

SEQ ID NO: 154525 - protein, 117 aa, Glycine max
  Coding DNA Sequence Number=SeqID_37747
  Gene Ontology: Mol. function=hydrolase activity, acting on ester bonds; Biological process=lipid metabolic process
MDLPGFMESLVKQMSVNLKRIHSLGIKKVAVGLLQPIGCLPVLNVIPFRTNCIGLLNVISKDHNKMLLKAVQELNKEAADKSVFITLDLYNSFLSAIETMQKKQFQHATDKIVEDSI

SEQ ID NO: 154526 - protein, 32 aa, Glycine max
  Coding DNA Sequence Number=SeqID_37748
MASSLVRGSPGRAGTGFIDDLKTSSNPSLASF

SEQ ID NO: 154527 - protein, 61 aa, Glycine max
  Coding DNA Sequence Number=SeqID_37749
MTLSSVDMAEAHALTLRKGSDLAFSLQLSSVSTPDVPPQLVGIKGEQISQCFGRLGGKASS

SEQ ID NO: 154528 - protein, 291 aa, Glycine max
  Coding DNA Sequence Number=SeqID_37750
  Gene Ontology: Mol. function=drug transporter activity; Cellular component=membrane; Biological process=multidrug transport
  Homolog annotation: Hit_ID=Q1PDX9; Match level="QueryCoverage=98%, HitCoverage=58%, E-value=1e-83, Identity=52%"; Hit description =Ripening-responsive protein
  Pfam annotation: Domain name=MatE; Domain location=154-291; Score =32.9; E_value=1.1e-06; Accession=PF01554.9; Description=MatE
MLGIYMQRSWVVLSITGVMFLALFLFVTPILKFFGQTSEIAELAGVISLWLIPTHLAYIFYLPMHFFLQSQLKNNVTTWVSLLGLLVHAYLCWLVVNKFHLGVIALVAFGNIAWWLLVLGYFGYVICGGCTLTWTGFSIEAFSGVWEFSKLSTASGIMICLEVWYDKALMLMTGNLQSAKTTIEALTICLTINIWELMFPLSFYAATAVRVANELGAGNGKGAKFASMVSVVTSIIISIFFWLLIMVFRRKLAYLFSSSEVVIKEVDKLSPFLGVTILLNSVQPVLSGDII

SEQ ID NO: 154529 - protein, 96 aa, Glycine max
  Coding DNA Sequence Number=SeqID_37751
MENNDGLWWLMVAVGDGESAWDKCSRERKLLAHSRQLLKDPNGQIMDNCLVMLQTEFRENPTVNEGWTTFLPRQLHVASSRSFIKRLPQEASSWLL

SEQ ID NO: 154530 - protein, 433 aa, Glycine max
  Coding DNA Sequence Number=SeqID_37752
MFACSPFAKRLLLAKRIIIHALSHEFQVLSAQPYHLRLINSAKLAKLSGLELGLAEIAANLTAKRKERNVLSGCNVSYNHFPKICALSTPSLPQTALCAFCFFFFASFCSHQSSQHKHFPEELAQRAYRAKRVYFLRMNAHLLGTFKIELERRNLHKRLANLQEGSIDVAVVKEFYANFYSPTDQAPKCAKIRGHLIKIDAESLNEFLQTPVLLEEGESLPTYSRFCRLRSDPREMEARLCITGMECFLRKDLTTLAQTWSVFSYSNLAPTSRTSYLNTDRARLVYGLITRMDMNIGGLISGQMTMIAQSNSSRLGFPALITALCRSRGVGSDALTSYENVRPTIDLAYIIRNFWNANDQIVNFPETKKTKLRAADIPSSFTPIVGISASSTLAPPPSLAELSAQSSQTSDAKFQSLFEGQVLIIQSLQELVQ

SEQ ID NO: 154531 - protein, 118 aa, Glycine max
  Coding DNA Sequence Number=SeqID_37753
  Subcellular localization annotation: CTP_CleavageSite=53; ConfidenceScore=5.49e-01
MHIDKWAYTYLMGPKSTLRLMRALGSSPASLAQSSWSLLAMVLVMSPFLGRIASRMKDKRRERAGIEMQISENNNLFEQSRGKEKISNLKCSWPLLSESSDGGSDSTFSHSDDCSGPS

SEQ ID NO: 154532 - protein, 99 aa, Glycine max
  Coding DNA Sequence Number=SeqID_37754
MEWRFYRISYPFMSVSQLSDPSRHPLVVHDDTFILPDPPMLPIQLEIMPQPYAHATVDADMPHHAVATCQRIAKSFENMINMMMVTVGIDAYTQTDHCL

SEQ ID NO: 154533 - protein, 296 aa, Glycine max
  Coding DNA Sequence Number=SeqID_37755
MYDYHEEERAPDLESILADFMTYQASSKGYCYFMQQQGTQFERNQSSAGYQWESYRQSDYHNKAEGILNLDDLLMKFKDIVESIQDAFRRTETQISKLVDDMTNAAARKEEERVEIEIHQENIHQVTSIYHQLTNEEEKPEVSSTPEYPYWATVGYVGGKDKGRLELSVEDQKISFDIFEATKHSDMGDACFDEEEEVEQEITLLASTMVLQSLLVKEHGYGRDCLPCDEELDDSKDSCVDQVVFEELEKLRPAKKPKAKLKTLPAHLKYVFLEEDETKPIIISNSLKKEEEDQLV

SEQ ID NO: 154534 - protein, 130 aa, Glycine max
  Coding DNA Sequence Number=SeqID_37756
QNPQEFKILEIGPGHPESGPPPYLSDGKIGESERATTSLDKESERSTASLVGDSGGAVASPDGESEMIIKGGDGGTTSSSGEEGGFTTRDCGSAGTGSTRAGVGSGEAASLGPPMEVELQAKLLAQGNAP

SEQ ID NO: 154535 - protein, 119 aa, Glycine max
  Coding DNA Sequence Number=SeqID_37757
MRIPFFTGQGSKRSKVVFRWGLSSWEPNLDIWGKTNLGDEVSVSGRTSTLFHKARVTMMIWKLRAKLVMATARWALKLPVYGIVILRLGIYTNRPNVSKLRSFISSMHSSILISVHSGK

SEQ ID NO: 154536 - protein, 100 aa, Glycine max
  Coding DNA Sequence Number=SeqID_37758
MVHLLWISSSGGYIHLVYQREPGRVHPLWIFGLPLDTTFKTRSVEAKRSKFILMMAKTQVKNQESNKFQESKSRSIKNQDSSEDSREDSRYARTSRKASR

SEQ ID NO: 154537 - protein, 69 aa, Glycine max
  Coding DNA Sequence Number=SeqID_37759
MASPWLSETQCHQAQFIAVRIEGHRAERVICWLSGYSCACALSGSLNRSTLASLHIKYMISAKRAQISA

SEQ ID NO: 154538 - protein, 217 aa, Glycine max
  Coding DNA Sequence Number=SeqID_37760
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q2KXN3; Match level="QueryCoverage=100%, HitCoverage=26%, E-value=5e-83, Identity=74%"; Hit description =Copper-transporting P-type ATPase
  Pfam annotation: Domain name=E1-E2_ATPase; Domain location=40-217; Score=209.7; E_value=6.5e-60; Accession=PF00122.10; Description=E1 -E2 ATPase
MNSLVAVGTAAAFGYSVVATFAPRLLPPGTVNVYYEAAAVIVALILLGRFLEARAKGRTSEAIKRLVNLQAKVAHVIRDGRTVDIPVNEVQSGDVVEVRPGERVPVDGEVVEGRSYIDESMISGEPIPVEKQPGSSVVGGTVNQKGALTVRATAVGAQTMLAQIIRMVEQAQGSKLPIQAVVDKVTLWFVPAVMLAALATFAVWLIFGPSPALSFAL

SEQ ID NO: 154539 - protein, 117 aa, Glycine max
  Coding DNA Sequence Number=SeqID_37761
MMIYTTGGCTTRIISFQQVRCALCQPRVVPQPPQTNIPHVPEPGAPSTSARPAVEEPRHAVEVCHWIAERLERHLSLGVVTPGSSTHEVIEECLRMARSVTQDQLAYIRFRRRRHTD

SEQ ID NO: 154540 - protein, 155 aa, Glycine max
  Coding DNA Sequence Number=SeqID_37762
MTLLLSNILPGDRNADPPCGRCPFPPARSRHHDIGKDRAGKIPSGPEEVQQGLGVASSGYGPLSILQGACSPQQGIAPARYPVDPKKSNRVLELPALITGLCQFYGVSVAPTRSSSPLLIELSSRSTAPPGRRRVKHPNSLGTADSGQQTHRHHL

SEQ ID NO: 154541 - protein, 64 aa, Glycine max
  Coding DNA Sequence Number=SeqID_37763
MPMTKNPPYKAKKESEVSSWCARCRKPFLLLTTRLPLNARIDKVAGNVRLRFTSQVSRNVQLNY

SEQ ID NO: 154542 - protein, 92 aa, Glycine max
  Coding DNA Sequence Number=SeqID_37764
MKLVAVVLSMNVKLMIAADTTETSWLRKIPFKDILSSRTHWTRPRYQIMLYPVTFCVLVQLAGNYTTCSVESSWTENRLKWGVQGKPWETLV

SEQ ID NO: 154543 - protein, 98 aa, Glycine max
  Coding DNA Sequence Number=SeqID_37765
MFMNYTPSYKKTRLAKQKALEMIHGNGKNHMPSCQKFLKLRNLVFMGLCHRASKWYMALLYGKYISTLLIATAQDDLIISSQLPMPFYTIVEGETTSS

SEQ ID NO: 154544 - protein, 146 aa, Glycine max
  Coding DNA Sequence Number=SeqID_37766
  Gene Ontology: Mol. function=3-oxoacyl-[acyl-carrier-protein] synthase activity; Cellular component=chloroplast; Biological process=fatty acid biosynthetic process
  Homolog annotation: Hit_ID=Q5ECI5; Match level="QueryCoverage=90%, HitCoverage=27%, E-value=4e-59, Identity=80%"; Hit description =Plastid 3-keto-acyl-ACP synthase II-B
  Pfam annotation: Domain name=ketoacyl-synt; Domain location=21-143; Score=-82.9; E_value=0.0067; Accession=PF00109.16; Description=Beta -ketoacyl synthase, N-terminal domain
MVVALQPTQDATIMRKPTKHRRVVVTGMSVVTPLGHDPDVFYSNLLEGVSGISKIDTFDCEEFPTRIGGEIKSFSTDGWVAPKLSKRMDKYMLYLLTAGKKALVDGGITQDIMDELNKQKCGILIGSAMGGMQKTDVVSVGQHRFF

SEQ ID NO: 154545 - protein, 440 aa, Glycine max
  Coding DNA Sequence Number=SeqID_37767
  Gene Ontology: Mol. function=nucleoside-triphosphatase activity; Cellular component=membrane; Biological process=ion transport
  Homolog annotation: Hit_ID=Q93KB6; Match level="QueryCoverage=49%, HitCoverage=40%, E-value=1e-111, Identity=90%"; Hit description =Putative ABC transporter
  Pfam annotation: Domain name=ABC_tran; Domain location=250-440; Score= 116.9; E_value=5.8e-32; Accession=PF00005.17; Description=ABC transporter
  Pfam annotation: Domain name=Histone_HNS; Domain location=41-151; Score=132.6; E_value=1.1e-36; Accession=PF00816.11; Description=H-NS histone family
  Pfam module annotation: Pfam domain module=ABC_tran::Histone_HNS; Domain location=250-440::41-151
MKSIPVPAGVYLTPLSKDIVMSDAFKVLNNIRTLRAQARELPLSDLEEILEKLTVVVTERRDEVEAEEAQNREKEEKLSKYREMLLADGIDPNELLGALETGKKRAKRAPRPAKYSYTDENGEEKSWTGQGRTPAAIKKALDAAGAGGVSVSGFFIGLAPGTGGGSFLAPWITCPARSQLFYLWQQGVLRLASAYPGAEVAHPGRFWHNARCFFLHCVTKVNAVLVSSNITMQFGSKPLFENISVKFGGGNRYGLIGANGSGKSTFMKILGGDLVPTNGNVSLDPNERIGKLRQDQFAFEQYSVLDTVIMGHQELWAVKQERDRIYALPEMSEEEGYKVADLEVAYGEMDGYSAESRAGELLLGVGIPVEQHYGPMSEIAPGWKLRVLLAQALFANPDILLLDEPTNNLDIDTIRWLEQVLNERDSTMIIISHDRHFLNM

SEQ ID NO: 154546 - protein, 55 aa, Glycine max
  Coding DNA Sequence Number=SeqID_37768
MSCAELGYNNFNRARAQNSTAHHSAYFGKRALESARGAAFAEIPTFLLKFCMLLV

SEQ ID NO: 154547 - protein, 78 aa, Glycine max
  Coding DNA Sequence Number=SeqID_37769
  Gene Ontology: Mol. function=hydrolase activity, acting on ester bonds; Biological process=lipid metabolic process
  Homolog annotation: Hit_ID=Q10MG0; Match level="QueryCoverage=55%, HitCoverage=11%, E-value=8e-10, Identity=65%"; Hit description=GDSL -like Lipase/Acylhydrolase family protein, expressed
SSAFFFLVVNNQMAKSIKELKKENQFLKSKSEKSDVTLRKLGTGFIPPYLAPSTIGTIVLKGVNYASGGGGILNFTGK

SEQ ID NO: 154548 - protein, 85 aa, Glycine max
  Coding DNA Sequence Number=SeqID_37770
MKKCGTKWFPACHRARRLWMKKGEKVWDQLVSRMSSGPPPLDDKGRRMTIICLCVPSDTTVVGWRKGVRNDHNSSPHVIGPTASG

SEQ ID NO: 154549 - protein, 116 aa, Glycine max
  Coding DNA Sequence Number=SeqID_37771
MAANNQQFGTRVVAPLRTTTSEVFVSMVADNQRLENKLKEFTSLVRQLAIGQQKNMMIANQPRLCGICCASDHSTDACSTIQETKQAADVSAMQPGQPFKPQQQQYNPYSNTYNSG

SEQ ID NO: 154550 - protein, 309 aa, Glycine max
  Coding DNA Sequence Number=SeqID_37772
  Homolog annotation: Hit_ID=Q2QNA4; Match level="QueryCoverage=63%, HitCoverage=81%, E-value=8e-48, Identity=56%"; Hit description =Expressed protein
MGGGWCGAVNHGDEGGGSGNREAGGEFVGEERARRRGSGALCGVVSGNGRGFRQVPNGAVGALLGVADFGVGHWNSDAALSSCEKVDWMVKEEGMRGKRWRVTRPVSFPCFGVLKKEKHVLLHSVADVVIEQGYLQSLFGVYSLRIENVGVRRPPSDDVKIQGVANPNAFRKAVMMRLSNMRNEILSRQVSTLEDVPHHLMMSPSMSLKHDPNPSGELLLMQKLEEVGSSVKVDAIEVSRKHSGELSQGSVLLSSNKATIGGVSLGIIWGNVAWQKGYKVFTVESDSKIAIDLPSKGCANCHPCYNLVG

SEQ ID NO: 154551 - protein, 149 aa, Glycine max
  Coding DNA Sequence Number=SeqID_37773
  Gene Ontology: Mol. function=hydrolase activity
  Homolog annotation: Hit_ID=Q1SPB9; Match level="QueryCoverage=66%, HitCoverage=19%, E-value=3e-11, Identity=33%"; Hit description =Transposase
MEVGSHGVVMLEQQDDTIRGVRSPRRRGGEAKQVFQEHEDLLNWVQCVRKEHKFVVVIQKSGANDVLPQVIVGDRDLAYMSALEKVFPSSTTLLCLFHITKNVSAKCKIHMDKTEEWKNVMDAWELLLQFSNEESYNEHLKRFTNWCTH

SEQ ID NO: 154552 - protein, 77 aa, Glycine max
  Coding DNA Sequence Number=SeqID_37774
MREVATNVYLRKTSKNPERCGLRTLIVKGSGVVFTHGEGCFPRSYVSSIAMRKSDLRSSFRTKRWLSCFDLFPQDRF

SEQ ID NO: 154553 - protein, 583 aa, Glycine max
  Coding DNA Sequence Number=SeqID_37775
  Homolog annotation: Hit_ID=Q2T0V7; Match level="QueryCoverage=35%, HitCoverage=76%, E-value=2e-15, Identity=26%"; Hit description =Response regulator receiver domain protein
  Pfam annotation: Domain name=HATPase_c; Domain location=211-288; Score=46.2; E_value=1.1e-10; Accession=PF02518.16; Description =Histidine kinase-, DNA gyrase B-, and HSP90-like ATPase
  Pfam annotation: Domain name=HisKA; Domain location=103-168; Score =2.7; E_value=0.099; Accession=PF00512.15; Description=His Kinase A (phosphoacceptor) domain
  Pfam module annotation: Pfam domain module=HATPase_c::HisKA; Domain location=211-288::103-168
FIKNVALLKQQYRTLDDLSTGLLVGQKNKADILSYMDDIEGTLVDIQEIIYRIQIKNFTEVKGIIQENSSKAEMFALFSLILVFLMMFLVLRNAFSLKEIIKNKNIFISSIYHEIAGSTQAIVIAADIMEHELAQEELKKEARLISYHGNKIAEQTREVMDYSRLEMGEVKINISTFRLNEVVDDAVTGIGAGRGNRLVIHRSSYAGLIGSDKYKLYRILANLLSNADKFTHRGAITLNVKGVERETRQGLGLGLTIIKNYVTTMKGTIKAKSVEGVGSSFLIRIPDHIADVFLVVIQLAGQNDDAGVRIEGVFNFLHDAFGGLAEIQQPVQNKRLKGLLFQRGQHGVRRLKGLSLDAVAAGDLLQQFENIPIIVQDRDTRGRQKVYLVDFVQRSLGGMFPIGVDDEKIVFFAGVGFVVVRLRDRALVNLNIAALVNAVHDKDGVMRPLAGKRLVEVLKYLFDFIEGDASFAIQLLFGAVVLKVQYVGHRGGMLSVANSFQSEQRADCIDAAKRSAANTRANGSTGDDHSNLSSSLYLLILAICPYALTGRDTPYARCRGRGPGVAQEKLRRDPGWDKAGPSR

SEQ ID NO: 154554 - protein, 69 aa, Glycine max
  Coding DNA Sequence Number=SeqID_37776
MVQPNHPKISSYFITNKAQDCNASQGWSWEGASSKWQPGGSSKWQPGTYKMERLWKSYGGNEKCRMTAS

SEQ ID NO: 154555 - protein, 239 aa, Glycine max
  Coding DNA Sequence Number=SeqID_37777
MDTLKASTSGYDGSDNVVHHNVIQVLRLVRKYHFNDACIYFTKDVDSYSFIQCLLQLPTIQYKGTYNLKKMSKELMIAHVIQLHNAQKKKKAKEKETLTVVAMKDKDAFVQAKAFTNGVDDTIVRGVIIDLTNTGIMDKTPEASNTTIVDEVIHHVLEPTSKDQVQDMIGQAMESFVECQCQENEQFRLSMQNAITTQFSNLGVFLLQNLQQAQASMLGAIATPAFVPIPAPQPLEPLP

SEQ ID NO: 154556 - protein, 163 aa, Glycine max
  Coding DNA Sequence Number=SeqID_37778
  Pfam annotation: Domain name=zf-CCHC; Domain location=91-108; Score =31.1; E_value=3.8e-06; Accession=PF00098.13; Description=Zinc knuckle
MSLATLFGKLQEHEMELQRLNQNEETDKKKRSIAFKDSLSMQEENEDEESEDEEDFSLFVKNFKKFVKKRRIVRRQNFNNGKRSQEDSQILRCYKCNQLGHIKANCPSNEEWPEKSDKKRYEERRNKKAYIAWDDNDSSNGSEKEINLLTKNYESDENISQED

SEQ ID NO: 154557 - protein, 76 aa, Glycine max
  Coding DNA Sequence Number=SeqID_37779
MEGLSLLIFSLKWRLLSLSSFSIPLPLIFQEAKESIDEEDPRPTSSNGAYIMWYQEHLHLGDVLLLPLSFCLVNSL

SEQ ID NO: 154558 - protein, 215 aa, Glycine max
  Coding DNA Sequence Number=SeqID_37780
  Gene Ontology: Mol. function=6-phosphogluconolactonase activity; Cellular component=microtubule; Biological process=carbohydrate metabolic process
  Homolog annotation: Hit_ID=Q69NG5; Match level="QueryCoverage=93%, HitCoverage=75%, E-value=4e-69, Identity=64%"; Hit description =Putative 6-phosphogluconolactonase
  Pfam annotation: Domain name=Glucosamine_iso; Domain location=1-215; Score=-76.1; E_value=0.0039; Accession=PF01182.11; Description =Glucosamine-6-phosphate isomerases6-phosphogluconolactonase
MNRVSSCFLCWDFRKLLEPPYIDSIEWSKWHVFWVDERVVPKDNLDSNYKLAYDGFLSKVTIPPVNVYAIDDALAADGAADVYETTLKRLVKSNVIDTSTRGFPKFDLMLLGMGPDGHVASLFPGHPLLKEDKKWVTFIRDSPKPPPERITFTIPVINSSSNIAMVVTGEGKANAVNSALEDHEKTDKLPVELVSPEGEWKWYLDVGAASKLFKE

SEQ ID NO: 154559 - protein, 199 aa, Glycine max
  Coding DNA Sequence Number=SeqID_37781
MAAQLIHDRVEMECLEGAWETLEGNTSSKIQPPWKFLKQAFIKDDIAAPKELQMSTPPSLAYCSFKNKGKFISLAINGKVNVQRREVHNQSEGRHKGQWVRDSARVNNGRNREWVSYKGRLRGRDNARVRGCNREWKSEHKDETRNSYLTKRGIGLVAVSPSARVVVGAGADALPKRQDLLIHGLCGQICGLHGQICDP

SEQ ID NO: 154560 - protein, 65 aa, Glycine max
  Coding DNA Sequence Number=SeqID_37782
ASSTSKPWIIFFPQRDIFSGPVCPMGKWDLLEGNIEVPDLFKCHEKEEKSKRVPLAQKAHWTLNG

SEQ ID NO: 154561 - protein, 90 aa, Glycine max
  Coding DNA Sequence Number=SeqID_37783
MWVSRERFSTDFRREEKEKSDFRKEEGKGDVGKIKASIKWEKGYKKVEISSKEHLAVSLAYDVAQLSNKFTRERGAFTVVLSGGSLIKYL

SEQ ID NO: 154562 - protein, 238 aa, Glycine max
  Coding DNA Sequence Number=SeqID_37784
MRGYLMVIRTFCLPEASEPIHTQRLTSSSAPLSSRDGESDDIQRYLMVIRTFCHLEASEPVGTQRLTSSSAPLSSKDGESDDMRRYLMVIRTFCQPEPSEPVDTQRLTSSSTPLSSRDSEFDDMRRYLMVICTFFQPEASEPTDILRLTSASAPFSSRDEASEPVDTQRLTSSYAPLSSRDGEFVDMQRYLMVICTLFQPEASKPTDTLRLTSSSAPLSSRDGEFDDIRRYLMVIHTF

SEQ ID NO: 154563 - protein, 83 aa, Glycine max
  Coding DNA Sequence Number=SeqID_37785
MLGFTSDSPQISASPHQLDLAPYASGPYNAQWNTPRLLHDKHMLCLSRILREMEVDEPWLGLWLPLNYQVDMGASQHRTSELG

SEQ ID NO: 154564 - protein, 115 aa, Glycine max
  Coding DNA Sequence Number=SeqID_37786
MARTKKTGEMTTEAAKKIAEKIGSFVPHGRQDVLAAAIGRPEHPGRVRATGAGVTIKQYFGSAPRTSRSASSLPPDELQQLTQQIRDQLEESITEKVTRQVMASFSQLQSQMQSH

SEQ ID NO: 154565 - protein, 71 aa, Glycine max
  Coding DNA Sequence Number=SeqID_37787
MKQRQMMHKLFIKEIATWRREGDIFGSDTLGMTPGGNRGHVRLKVTRRRITNTRQSSMGMMPLGYIKIVTG

SEQ ID NO: 154566 - protein, 435 aa, Glycine max
  Coding DNA Sequence Number=SeqID_37788
  Gene Ontology: Mol. function=carbohydrate binding; Biological process= carbohydrate metabolic process
  Homolog annotation: Hit_ID=Q1SPM1; Match level="QueryCoverage=99%, HitCoverage=86%, E-value=1e-103, Identity=49%"; Hit description =Glycoside hydrolase, starch-binding
  Pfam annotation: Domain name=CBM_20; Domain location=92-183; Score =28.2; E_value=1.9e-07; Accession=PF00686.10; Description=Starch binding domain
MMNALTSSCSKAMVETLGPFSPRVPLCVSDRPEFCFTLRSKNEKKGWNLLLLKLVRNNDLYPVHAVPPEDQVDLETVEPQAQQSEQTNESKFVRVSFQLQKTCDFGEQFLIVGGDPVLGSWDPLEALPMTWSEGHVWAVELDMPAGQSFQYKFILKGEGGDIIWQPGSDRLIHTWETMNRIVVLEDWENVELQKITEEDQLAEPIEEPQVDFEVPTLAEFLNNPQELDSKASEISSVEDTQIHAVDEPLAETVGQQITENISSSEDLISSISHKSNKKSILRPSEESADSPGNDDIIHDLGHNGNAASLENQEKTIVESSLFDLEEGPVLVPGLTIPPTEPTDEADQGEVQESTKKDISVEAFETQDQNIAEFSKEEETDDAIPQEINATINNEPELLYNKHEESHLSPEMEDGQTTSQMMTIPCKMTSNGAKTR

SEQ ID NO: 154567 - protein, 97 aa, Glycine max
  Coding DNA Sequence Number=SeqID_37789
  Gene Ontology: Mol. function=transporter activity; Cellular component= integral to membrane; Biological process=oligopeptide transport
  Homolog annotation: Hit_ID=Q9CAR9; Match level="QueryCoverage=95%, HitCoverage=20%, E-value=7e-17, Identity=39%"; Hit description =Putative peptide transporter; 43719-41173
  Subcellular localization annotation: CTP_CleavageSite=72; ConfidenceScore=5.07e-01
MVILTLTIWMPQLHPPSCTSPQQCIPPTSGIGPCTILFAINQFDTTSPVGRKGVNNFFNWYYTSQTMVQLISLTAIVYLQNKNWISGFGTLSVLMIC

SEQ ID NO: 154568 - protein, 92 aa, Glycine max
  Coding DNA Sequence Number=SeqID_37790
  Gene Ontology: Mol. function=RNA-directed DNA polymerase activity; Biological process=RNA-dependent DNA replication
  Homolog annotation: Hit_ID=Q1SYR3; Match level="QueryCoverage=66%, HitCoverage=2%, E-value=2e-20, Identity=70%"; Hit description=RNase H, putative
MPKWPLILYLTVLDESMGCMLGQHDNSEKREWAVYYLSKKFTACEMNYSLLERTCCALVWAVHRLRVVSRDMSRGSGDLGDVRWGAIAQNQA

SEQ ID NO: 154569 - protein, 107 aa, Glycine max
  Coding DNA Sequence Number=SeqID_37791
KKHALRCPYRMRAKARVKSEIAEVQKQMKADMEAMKEQMTTMMDAMMSMRKMMEVNTAIVVATSTATEVDLTHPSGHNQGQSKHPFPSYGLLSNYTPPNVAHAPDEN

SEQ ID NO: 154570 - protein, 234 aa, Glycine max
  Coding DNA Sequence Number=SeqID_37792
  Gene Ontology: Mol. function=DNA binding; Cellular component =mitochondrion; Biological process=DNA integration
  Homolog annotation: Hit_ID=Q0KIN0; Match level="QueryCoverage=54%, HitCoverage=7%, E-value=7e-41, Identity=61%"; Hit description =Integrase core domain containing protein
MANQNWQQAMLVDMIAPDDTIDYDKARLCTLLEFGMTHCEADLLVFSIHSPSGLCIYLVVYVDGIVITGVTFIYVLDIMIEIGMLDCRPNDTPMDPNVNIFPGNLISWRSKKWKMVVRSSAEAEYRTMVVAACEITWPRQLLQQPKCGDTQNTKLICDNQAVIHIASNPVFHERTKHNEIDCHFVTEKVLLGEIITDFVSSSYQLADIFTKSLKGSHVHNICNKLESYDIYALA

SEQ ID NO: 154571 - protein, 75 aa, Glycine max
  Coding DNA Sequence Number=SeqID_37793
MTYVSVMAITLTFVGNCCTTCIFSLALIFLRFRLLLNQSINNTNKLAKRAYRAKRVHLVRMNTHPPVEILVAKRG

SEQ ID NO: 154572 - protein, 83 aa, Glycine max
  Coding DNA Sequence Number=SeqID_37794
MERCIKLILAPKSMRAFPTATSLASHLKEVSLAIREHPLQASYPRHILGGEAPSSMAYSLVDGASSHLFSFVFRCISIVKNYH

SEQ ID NO: 154573 - protein, 102 aa, Glycine max
  Coding DNA Sequence Number=SeqID_37795
MACQVLDYNALDPSDLVHSKSIMLEGMFASYPMLLLVDSGDSHNSIVPLPQGLEVADSDSPTLEAILATRENKCQGSVALEWLTFLEIPTHGGGHMGVGSFK

SEQ ID NO: 154574 - protein, 424 aa, Glycine max
  Coding DNA Sequence Number=SeqID_37796
  Gene Ontology: Mol. function=aminomethyltransferase activity; Cellular component=mitochondrion; Biological process=glycine catabolic process
  Homolog annotation: Hit_ID=P49364; Match level="QueryCoverage=99%, HitCoverage=100%, E-value=0.0, Identity=84%"; Hit description =Aminomethyltransferase, mitochondrial precursor
  Pfam annotation: Domain name=GCV_T; Domain location=80-312; Score =351.0; E_value=2e-102; Accession=PF01571.11; Description=Glycine cleavage T-protein (aminomethyl transferase)
  Pfam annotation: Domain name=GCV_T_C; Domain location=321-413; Score =133.7; E_value=5e-37; Accession=PF08669.1; Description=Glycine cleavage T-protein C-terminal barrel
  Pfam module annotation: Pfam domain module=GCV_T::GCV_T_C; Domain location=80-312::321-413
MRWGLWKLGQSIPRRLAHGNNKAVACRYFASDAELKKTVLYDFHVANGGKMVPFAGWSMPIQYKDSIMDSTLNCRENGSLFDVSHMCGLSLKGKDSVPFLEKLVIADVAGLAPGTGSLTVFTNEKGGAIDDSVITKVKDDHIYLVVNAGCRDKDLAHIEEHMKAFKAKGGDVSWHIHDERSLLALQQGPLAAPVLQHLTKEDLSKMYFGEFRVLDINGVQCFLTRTGLGSTVHNNTLFTETFRYTGEDGFEISIPSESAVDLAKAILEKSEGKIRLTGLGARDSLRLEAGLCLYGNDLEQHITPIEAGLTWAIGKRRRAEGGFLGADVILKQLEEGPKIRRVGFFSSGPPPRSHSEIQDEGGNNIGEVSSGGFSPCLKKNIAIGYVKSGLHKAGTKVKIIIRGKSNEGVVTKMPFVPTKYYKPS

SEQ ID NO: 154575 - protein, 64 aa, Glycine max
  Coding DNA Sequence Number=SeqID_37797
MKGFSGFAARPGKLMLHSKVTTLEFDEDGGFLMFVMVVGSSAGKMFNIFMLTMKPRQIIVVAIP

SEQ ID NO: 154576 - protein, 433 aa, Glycine max
  Coding DNA Sequence Number=SeqID_37798
MDQVRRQAFSKAYRKIWDLAMIEVSVEAITSLAQYYEQSLRCFMFRDFQLVPTIEEFEGILGCSQEEGSHIFFLDSTLPWQKDTKEAPGGEGRSFGRMKENMLIIIDQYKEKVNLAISHRQRLEDEHAKVSALQIEREARERMIESLHVEAMKWMDRFALTLNGSHELPRLLARAKTMANTYSALDKVHGLFDYCVDSILRQLIIIMHSCLFSCRITHWILFFSSRCQKVNIITKKNEHTLRHPYQTRAKAKIMSEIEEVQEQMKADMEAMKDQMTSMMEDNAAAVATTSATAEVDTTHISGINQISCPIPDVVGQGRKVLGSTCGPHVLQSKNSFPPYGLPPNYTPPKAVHVPDENANHFAVVLLESQCHTLISSGDLHFLMFKLLLAELSYLTSVVVRSVRVEVNSSSGRARLLLEEATNLLGRAELAWAS

SEQ ID NO: 154577 - protein, 85 aa, Glycine max
  Coding DNA Sequence Number=SeqID_37799
  Subcellular localization annotation: CTP_CleavageSite=18; ConfidenceScore=5.46e-01
MAGSGQQTHRRHLQKPLNSSTKAGALPTNRGRPAGGQVQSQRNKCGTSPLSLYRWPNQHPDIHHGRPFCKPFDPRPQTTINLEPR

SEQ ID NO: 154578 - protein, 50 aa, Glycine max
  Coding DNA Sequence Number=SeqID_37800
MEETYINDDKEKSVSSRETSLASGPVWLRFKNECEEGLELIERDSVSWNL

SEQ ID NO: 154579 - protein, 197 aa, Glycine max
  Coding DNA Sequence Number=SeqID_37801
  Gene Ontology: Mol. function=DNA binding; Biological process =regulation of transcription
  Homolog annotation: Hit_ID=Q1SMM7; Match level="QueryCoverage=49%, HitCoverage=22%, E-value=2e-25, Identity=58%"; Hit description =Homeodomain-related
  Pfam annotation: Domain name=Myb_DNA-binding; Domain location=81-132; Score=46.1; E_value=1.2e-10; Accession=PF00249.21; Description=Myb -like DNA-binding domain
  Subcellular localization annotation: CTP_CleavageSite=49; ConfidenceScore=5.68e-01
MKKGEKAQSESSLKRSPPSTMSSSSSSLITTVVVHNNNNNNPSQPSELRATTRCCFGSHHLPDISLKTPMARPYVRSKMPRLRWTPDLHRCFVHAVQRLGGENRATPKLVLQLMNVKGLTISHVKSHLQMYRSMRHEQMSQGAKKNDMAPDFLASTLSTLGQRQQNPHKRSCTEELVPTQAQWTLLQQALGSSVSVK

SEQ ID NO: 154580 - protein, 220 aa, Glycine max
  Coding DNA Sequence Number=SeqID_37802
  Gene Ontology: Mol. function=transporter activity; Cellular component= integral to membrane; Biological process=siderophore transport
  Homolog annotation: Hit_ID=P24077; Match level="QueryCoverage=84%, HitCoverage=44%, E-value=5e-60, Identity=62%"; Hit description =Enterobactin exporter entS
  Subcellular localization annotation: CTP_CleavageSite=75; ConfidenceScore=5.06e-01
MNKPSHFIDLSLLKTHAAFRAVFIARFISIVALGMLAVAVPVQIQQMTHSPLLVGLAVTLSAAGMFTGLLTGGVLADRYERKKLILFARTTCGLGFVALAINAALPAPSLLAVYLLGLWDGFFGAIGVTALLAATPALVGRENIMQAGAITMLTVRFGSILSPAIAGVVIAHGGVLWNYGLTAFGTLLTVLTLLQLHALPPPPQPREHPLRALATRRAVP

SEQ ID NO: 154581 - protein, 472 aa, Glycine max
  Coding DNA Sequence Number=SeqID_37803
  Gene Ontology: Mol. function=oxidoreductase activity; Cellular component=cellulose and pectin-containing cell wall; Biological process=lignin catabolic process
  Homolog annotation: Hit_ID=Q1RXS8; Match level="QueryCoverage=95%, HitCoverage=94%, E-value=0.0, Identity=68%"; Hit description =Multicopper oxidase, type 1
  Pfam annotation: Domain name=Cu-oxidase; Domain location=131-239; Score=59.8; E_value=9.2e-15; Accession=PF00394.12; Description =Multicopper oxidase
  Pfam annotation: Domain name=Cu-oxidase_2; Domain location=316-453; Score=109.3; E_value=1.2e-29; Accession=PF07731.4; Description =Multicopper oxidase
  Pfam annotation: Domain name=Cu-oxidase_3; Domain location=35-131; Score=83.5; E_value=6.5e-22; Accession=PF07732.5; Description =Multicopper oxidase
  Pfam module annotation: Pfam domain module=Cu-oxidase::Cu-oxidase _2::Cu-oxidase_3; Domain location=131-239::316-453::35-131
MRLCEALSSLILVLALAFLYNDVNCEDPYRFFTWKLTYGDIYPLGVKQQGILINGKFPGPLIDPVTNDNLIINVHNYLREPLLISWNGLQQRRNSWQDGIHGTNCPIPPGKNYTYVLQSCPLIPVPFPPAGDFTLLAGDWFKTHYCRLNKILNDGHNLPFPHGLLINGRGWNGTTFTVDKGKTYRFGISNVGLTTSINFRIQGHKMKLVKPAKNYYIDVSTRFTKQILTTTSILHYNNSSNRVSGPIPQDVIASSLFQARTIRWNLTASRPRPNPQGSYQYGLIKPIRTIILENSAPIINGKQRYAINGVSYVAPDIPLKLADYFNISGVFSVGRIPTNTNKGKSLLQTSVMGANFHEFVEIVFQNWENFLQSWHIDGYSFFGVGGQWTPTSRAYYNLRDAIPRCTTQVYPKSWAAIYIALDNVGMWNVRSENWARQYLGQQFYHRVYTSSKSYGEMNIRSQRMHFFVAGPE

SEQ ID NO: 154582 - protein, 88 aa, Glycine max
  Coding DNA Sequence Number=SeqID_37804
MLSQDGGGGDNTNLVHHKFVARGHKSFGEEVNMLMTRWNKFVNDGLLLAAPGDDTQAKVNYVSTRGPYVRSVVNPVSIIKGTKMLIWR

SEQ ID NO: 154583 - protein, 175 aa, Glycine max
  Coding DNA Sequence Number=SeqID_37805
  Gene Ontology: Mol. function=nucleic acid binding; Biological process= DNA integration
  Homolog annotation: Hit_ID=Q1RWP6; Match level="QueryCoverage=61%, HitCoverage=12%, E-value=3e-20, Identity=44%"; Hit description=Zinc finger, CCHC-type; Polynucleotidyl transferase, Ribonuclease H fold
MEGLVKLTNMVWELRISEAKRLRHIDVLRDGVDQCDCLWLYHWTKGFMVINATPLVVAFGNKASWTSVQVPLAMSALSSSNMVFFHSRCFMACVTHVGSTREGKGNLVASMGEEHLHLQEVMSMCTDMVKLRLEKVGLIREVGLDLNVVEVIRFAGRNWSLVGSVIKQLPIKDRN

SEQ ID NO: 154584 - protein, 53 aa, Glycine max
  Coding DNA Sequence Number=SeqID_37806
MAAFMVVLQNINGKAFNIFNDVGEDRGLGTLAGLQLNNPTCGGSTSSTRSSNL

SEQ ID NO: 154585 - protein, 200 aa, Glycine max
  Coding DNA Sequence Number=SeqID_37807
  Gene Ontology: Mol. function=sequence-specific DNA binding; Cellular component=nucleus; Biological process=regulation of transcription, DNA-dependent
  Homolog annotation: Hit_ID=O82632; Match level="QueryCoverage=80%, HitCoverage=54%, E-value=3e-36, Identity=46%"; Hit description=GATA transcription factor 11
  Pfam annotation: Domain name=GATA; Domain location=87-122; Score =64.5; E_value=3.5e-16; Accession=PF00320.17; Description=GATA zinc finger
  Subcellular localization annotation: CTP_CleavageSite=62; ConfidenceScore=5.40e-01
MGAKPQTPESSSSTDTLPPFASDGTLRNAPFLHSETPRPGKARSKRSRAAPGDWSTRLLHLVAPEKEKPPQAKKREGTNVECSGRKCLHCGAEKTPQWRTGPMGPKTLCNACGVRFKSGRLVPEYRPAASPTFMSTKHSNSHRKVLELRRQKEMQRQQHHQQLMSQSSIFGVSNGGDEFSIHHHHHNHHLHCGPDFRHVI

SEQ ID NO: 154586 - protein, 197 aa, Glycine max
  Coding DNA Sequence Number=SeqID_37808
  Subcellular localization annotation: CTP_CleavageSite=31; ConfidenceScore=5.39e-01
MAQHDISRLGFPALIKALLTLRGLRKARGKRSEAPSTSALETGSPFSSTLPPSSSTEIPMIPPAPSKMPFPTLVFAGLAYFIFTPQMLHSMLQSIHMGQSIIMQNLQGLGLPSIMSMEEFDAQVAWPGDQPSSSGGGGASIAQELVTEEPPAAAAAEEETTLDQTPQPSPSSAPAPEETQPAALDLNEDQPQKEQDV

SEQ ID NO: 154587 - protein, 551 aa, Glycine max
  Coding DNA Sequence Number=SeqID_37809
  Homolog annotation: Hit_ID=UPI0000E44EC9; Match level="QueryCoverage =46%, HitCoverage=76%, E-value=3e-87, Identity=65%"; Hit description =ferric enterobactin transport ATP-binding protein
  Pfam annotation: Domain name=ABC_tran; Domain location=288-475; Score= 185.4; E_value=1.4e-52; Accession=PF00005.17; Description=ABC transporter
  Pfam annotation: Domain name=SMC_N; Domain location=272-479; Score= -132.3; E_value=0.064; Accession=PF02463.9; Description=RecFRecNSMC N terminal domain
  Pfam module annotation: Pfam domain module=ABC_tran::SMC_N; Domain location=288-475::272-479
MALLIGAALGVSGAIFQSLLRNPLGSPDILGFNTGAYSGYYRDDRGRADRRYRDGCAGVSVCLAQRGGNVSVNHRGHQRACAADGAQCLADYQRFAGVGAQRRAVERRLAQRHHLGENAAGGDGAAAVAAAGGAVNAPHASAGDGRRHRLRARRAGGAQPPVADAAGRAADRGLHRAGGADLVRGAAGAADCAPAERRGKRRIMAGGAVRRAAVVRRRLCRAASVPALSTAGWRDYRQPGRTLSDCVTGAGGATPMIDITSRLYGEGLTLGYDKKVVAENLSVAIPQGELTVIIGPNACGKSTLLRTLSRLQAPLKGDVLLDGEAIARYPTKEVARRLGLLPQSSNAPAGISVSELVARGRYPHQSLFGRWRAEDEAAVQQAMLATGVADLAQQAVDTLSGGQRQRVWIAMVLAQQTPLLLLDEPTTWLDITHQIELLELMQTLNQQHGRTLVVVLHDLNHACRYATHLIAMRSGGAYANDCAAGARALRRERGCGVNVFCHTVPSPAGRGLGQNRYASNCCNSGPICSNMRGEIISTWAQSIGHTVSSPT

SEQ ID NO: 154588 - protein, 457 aa, Glycine max
  Coding DNA Sequence Number=SeqID_37810
  Gene Ontology: Mol. function=iron ion binding; Biological process =iron ion transport
  Homolog annotation: Hit_ID=Q3ZV02; Match level="QueryCoverage=61%, HitCoverage=95%, E-value=7e-46, Identity=48%"; Hit description =Strongly similar to enterochelin esterase fes
MVIALIPEPVLLAEAGTDDGATTINDVWQAEGLRLRPLQRLAVDFAERHIQGIGFLHAVDNGLRQQRAVDVAAQFDKVRDRVGVVMAAELVGDPDARLRCHQRQSLLTVEQATAPAQRVMAALYRLNQAFTLACLQPETQRLARFQAMVQRLQQPAMRVTALGPPEGAGQAERITKGVGKVQRGKHRGQTAEALSGNQRRPPAAACPRRSAAAAGRRSASAAPRTDHRAVSPADAGRAAPRLWRTATPGDDCRAARCPTAAPAASAPGRGPHPPHATPAGRARQAVAQRMHVRLAAEIAGLPIRHQAHGLPVPDIATGDAHQRLRRAPLVVIGHAGDVDPHALGVGGGFTALRIAPEEGHQTGAILLRLNARNALSLLLLPPGFATNSIISPGHRGCQSPSGDCAQNEHARSVWHPVSHGIQQRMALPGVNGCAIKTGIFSPARQSLRCGAELAFQE

SEQ ID NO: 154589 - protein, 267 aa, Glycine max
  Coding DNA Sequence Number=SeqID_37811
  Gene Ontology: Mol. function=rRNA (uridine-2'-O-)-methyltransferase activity; Cellular component=nucleus; Biological process=rRNA processing
  Homolog annotation: Hit_ID=P0C0R7; Match level="QueryCoverage=61%, HitCoverage=78%, E-value=7e-83, Identity=92%"; Hit description =Ribosomal RNA large subunit methyltransferase J (EC 2.1.1.-) (rRNA (uridine-2'-O-)-methyltransferase)
  Pfam annotation: Domain name=FtsJ; Domain location=99-267; Score =236.6; E_value=5.2e-68; Accession=PF01728.9; Description=FtsJ-like methyltransferase
  Pfam annotation: Domain name=Methyltransf_11; Domain location=114 -221; Score=1.4; E_value=0.04; Accession=PF08241.2; Description =Methyltransferase domain
  Pfam module annotation: Pfam domain module=FtsJ::Methyltransf_11; Domain location=99-267::114-221
MALSLPVGRAVTVRLTWQSNFALFGRAIQHQHVADNLNVVCLSFTHDSVNDQLLGFTIFRGNFYLDQFVMFERLFDLGEHAFSQAIAAQHDHWLQWMGKAFQGDKLFKPGMTVVDLGAAPGGWSQYVVQQIGSGGRIIACDLLPMDPIVGVDFLQGDFRDEAVLKALLERVGDQKVQVVMSDMAPNMSGTPAVDIPRSMYLVELALEMCRDVLAPGGSFVVKVFQGDGFDEYLREIRSLFTKVKIRKPDASRSRSREVYIVATGRKL

SEQ ID NO: 154590 - protein, 158 aa, Glycine max
  Coding DNA Sequence Number=SeqID_37812
  Gene Ontology: Mol. function=transcriptional elongation regulator activity; Cellular component=cytoplasm; Biological process =regulation of transcription, DNA-dependent
  Homolog annotation: Hit_ID=Q7MYX8; Match level="QueryCoverage=99%, HitCoverage=100%, E-value=2e-71, Identity=83%"; Hit description =Transcription elongation factor greA
  Pfam annotation: Domain name=GreA_GreB; Domain location=80-157; Score= 147.8; E_value=2.8e-41; Accession=PF01272.10; Description=Prokaryotic transcription elongation factor, GreAGreB, C-terminal domain
  Pfam annotation: Domain name=GreA_GreB_N; Domain location=1-74; Score= 155.9; E_value=1.1e-43; Accession=PF03449.6; Description=Prokaryotic transcription elongation factor, GreAGreB, N-terminal domain
  Pfam module annotation: Pfam domain module=GreA_GreB::GreA_GreB_N; Domain location=80-157::1-74
MNQIPMTLKGAEKLREELNELKTVKRPRIIASIAEAREHGDLKENAEYHAAREEQGFCEGRIQEIEAKLSNAQVIDVTAMPKTGRVIFGATVTVLNVDTDEEFTYRIVGDDEADFKQNLISVNSPMARGLVGKEADDVAIVKTPGGDVEYEVLKVEYI

SEQ ID NO: 154591 - protein, 91 aa, Glycine max
  Coding DNA Sequence Number=SeqID_37813
MSLKSTRSRNASNVGDLLRQSNEKIAPEAIQAHGQGNRNIVRARCATHGSCGCGHVHCGDLISGKGWCTIVMEVRGEKFEGKKNVVHGKVE

SEQ ID NO: 154592 - protein, 64 aa, Glycine max
  Coding DNA Sequence Number=SeqID_37814
MANGINNANQGIRGEQCKNKLSLLMPPSPSMDLSPTKPMPPTLLPNKGMECDDAKRMGVVLVYE

SEQ ID NO: 154593 - protein, 37 aa, Glycine max
  Coding DNA Sequence Number=SeqID_37815
MEVGNLLEAPNTLPMKEAFLLQNLKAMKVIHSIWSAS

SEQ ID NO: 154594 - protein, 59 aa, Glycine max
  Coding DNA Sequence Number=SeqID_37816
MEKSKRKWKRKTSSLEQTMFEPYETRACVKLYTPCAVFLYSVSLPWFSPVAGQIARSLE

SEQ ID NO: 154595 - protein, 119 aa, Glycine max
  Coding DNA Sequence Number=SeqID_37817
MECLPWSLPEWVSTFALALLNNINILMFFVFNTALKGLDDTPQPKSKAGARWIVFKCNRQKGSTECGYYVMHWMSTIILGSFRNNCETYFNDVSPLEAKRLKALRIQWAQYYLKVRNQT

SEQ ID NO: 154596 - protein, 66 aa, Glycine max
  Coding DNA Sequence Number=SeqID_37818
MAKKLKSLELEKKGSQKWRLCLLNGNMRINRVPISPDPTVCVASLAVLKVPDAGFLTGVVDLDLKC

SEQ ID NO: 154597 - protein, 62 aa, Glycine max
  Coding DNA Sequence Number=SeqID_37819
MASEAPSWADNGVRVVLVQWRRMALDPKKTSARTRIRVLRAVLPDSKATAMIECALADEDSH

SEQ ID NO: 154598 - protein, 589 aa, Glycine max
  Coding DNA Sequence Number=SeqID_37820
  Gene Ontology: Cellular component=endoplasmic reticulum
  Homolog annotation: Hit_ID=Q6KA74; Match level="QueryCoverage=83%, HitCoverage=85%, E-value=1e-101, Identity=41%"; Hit description =Ankyrin repeat protein-like
  Pfam annotation: Domain name=Ank; Domain location=80-112; Score=23.2; E_value=0.0009; Accession=PF00023.20; Description=Ankyrin repeat
MAKSSKDPTTSYPAIKSEQYLHSPVHYAVAIRDHTKLSRIISSLPRVPDPARVITESDSLTQERVAEKISAVLDRRDVPFRETPLHLAVRLNDVSAARAIASAGADISLHNAAGWNPLQEALCRRASEIAQVLVRLHHRAAWAKWRRRLPRLVAALRRMRDFYMEISFHFESSVIPFVGKIAPSDTYKIWKSDGNLRADTTLAGFDGLKIHRADQSFLFLGDGDSVAGVPAGSLLVLNRDDKKIFDAFENAGTPMSDSDAAGFCSQSSVYRPGMDVTKAELVGRTNWRRQEKMENVGEWKARVFEVHNVVFSFRSRKVAAGESDVAGSEQVLPLELDEDEDGFLVAENPSFGMPLSSNNNADKRRHSSFVREEREWVPMGRKSVDLPSVSVAPPRRSSAAAVAPPPAAPPTKEKEYLRSLRPAVWLTEQFPLKTEELLPLLDILANKVKAVRRLRELLTTKFPPGSFPVKVAIPVVPTVRVVVTFTKFVELQPVEKFYTPLSSPTHLLNAEDDDDPQKLRRQGSSSSGRSTWLRRSTSSSSSSQHQQRCSSSGALDSDPFAIPVGYTWTNSGNDSSRKMKKSRSVRKSK

SEQ ID NO: 154599 - protein, 56 aa, Glycine max
  Coding DNA Sequence Number=SeqID_37821
MPCTKKSGQMTFEATKEITERIDSLEEQALQGSFVAHGHQDILIVRDRGSNMKTKS

SEQ ID NO: 154600 - protein, 118 aa, Glycine max
  Coding DNA Sequence Number=SeqID_37822
MFEHKLQEDGDNVACPIASEHNLGLRPFHSNPQFKKTRTKANQNCLTNISMFSQFKAPKDEESTSMESKNTKDGILTCWNELKYQKRKQNAIKNGLGEQEPGTLTMSPPFLWASVCLT

SEQ ID NO: 154601 - protein, 1229 aa, Glycine max
  Coding DNA Sequence Number=SeqID_37823
  Gene Ontology: Mol. function=DNA binding; Cellular component=nucleus
  Homolog annotation: Hit_ID=Q75LX0; Match level="QueryCoverage=39%, HitCoverage=72%, E-value=1e-64, Identity=35%"; Hit description =Expressed protein
LQETDDDDDLQNADDEEEYKKFLAAVLQGGEGDGLSTHENENLDDDEDNDADFEIELEELLESDADDNATVKTRKEYDGAGRRPETRQNKRQKVSAQCEKKTLGEVKRPLRPILPWLNGPLPSGKGLIPDATLSFQSSTSGNGLVNGFTPQQIGQLHCLIHEHVQLLIQVFSLSVLEPSQKQVASQVQGLLFEMLHKRDEILALKRVPYPSVCFTPSFACSSVSDGGSKFVQDQCNIEYSPPQDAQNVWFSQSNQRSSEGLNRQRGFQATESSFWVPFVRGPVQSILEALCEIPFTAAQEFRKRYIESGSDSPVEKEPLFTFSSPVAEANGEISRGTISRAVNAVSTSTRQQRPKKTLAAMLVESTKKQSIALVQKEVAKLAQRFLALFNPALFPHKPPPAAVVNRILFTDSEDELLALGIMEYNTDWKAIQQRFLPCKSKHQLRKLVFELKWSVQLNNLVQQFQYGGEGCYLSNMKGNGLAVRRMKTSPLTAEEIACIQEGLKIYKCDWTLVWQYIVPHRDPSLLPRQWRIALGTQKSYKIDASKREKRRLYESNRRKLKALESWRAISDKEDCDAEIAGSECMDYSEVVPYVHQAFLADWRPHTSTLTYPECISTTSREGNVAHNAFSQKDIQFYRGTHDYGLSGKVPLENGNQSALPSVSKLPQLFHTTSDLRNGMKGAPSTINPKKPVFDVTSSSKYYCRPYRSRRAHNAHLVKLAPGLPPVNLPPSVRIVSQTAFKGFQCGTSKVHLPGAGVAACRKDNSSSQTPHGEKSENVHPVKGARPTLEDSVTGSQLGRSDTVEDGSLVAEKGTSSDLQMHPLLFQVTEDGNVPYYPLKFSSGTSSSFSFFSGSQPQLNLSLFHSSQQQSHIDCANKSLKLKDSTLRSGGIDFHPLLQKSDDTQSPTSFDAIQPESLVNSGVQAIASRSSGLNDKSNELDLEIHLSSVSGREKSVKSRQLKAHDPVGSKKTVAISGTAMKPQEDTAPYCQQGVENLSAGSCELASSAPLVVPNDNITRYDVDDIGDQSHPEIVMEQEELSDSEEDIEEHVEFECEEMTDSEGEDGSGCEQALEVQNKEVPISSEENVVKYMDCMKKPCEPRGNYGTEVDGGLLTNSTALNIALTNDGQDDRSSSSWLSLDSCTADNPVLSKAILQQSTIGEASASKIFSIGKAVREERHTVDMIQQPSLGPHVSITSRKLRKRSGKSNANLNVGLTVERSSRDGNHENG

SEQ ID NO: 154602 - protein, 1052 aa, Glycine max
  Coding DNA Sequence Number=SeqID_37824
  Gene Ontology: Mol. function=transferase activity, transferring glycosyl groups; Cellular component=chloroplast; Biological process =glucan biosynthetic process
  Homolog annotation: Hit_ID=Q9XGC0; Match level="QueryCoverage=94%, HitCoverage=95%, E-value=0.0, Identity=66%"; Hit description=Starch synthase isoform SS III
  Pfam annotation: Domain name=Glyco_transf_5; Domain location=704-859; Score=93.9; E_value=4.8e-25; Accession=PF08323.2; Description=Starch synthase catalytic domain
  Pfam annotation: Domain name=SSIII; Domain location=209-352; Score =241.3; E_value=2.1e-69; Accession=PF07036.2; Description=Starch synthase III
  Pfam annotation: Domain name=SSIII; Domain location=378-533; Score =288.1; E_value=1.7e-83; Accession=PF07036.2; Description=Starch synthase III
  Pfam annotation: Domain name=SSIII; Domain location=546-693; Score =285.1; E_value=1.3e-82; Accession=PF07036.2; Description=Starch synthase III
  Pfam module annotation: Pfam domain module=Glyco_transf _5::SSIII::SSIII::SSIII; Domain location=704-859::209-352::378 -533::546-693
  Subcellular localization annotation: CTP_CleavageSite=55; ConfidenceScore=5.39e-01
MSLQLNCKTVFPYRGGDCVSGVLPRRHSVTVHRAKQVGVFRSSVPVQRQQKKVPVARTKGTAGKGFVPSKKSTRVKKGDTLTSVVSEVSGGDKKQTVDVNVDADKEGELEFSQEEKFEAVDRIDEIVRDVGELSLLDETAGELLLLDESNEANISVIDEDDEVLELRKEEIPYNGGVGIVEGSSEEGLFDRARIDENVKETDTDGEITEEAVEESSSAADDRINEEAARLLKLELEANQRRQEIERIAEEKLSQGMKLFVYPPVVKPDQDIELFLNKNLSTLSEEPDILIMGAFNDWKWKSFSIRLNKSHLKGDWWSCQLYVPKEAYKVDFVFFNEQNVYDNNDQKDFCIPVDGGMDALAFEDFLLEEKRKELEELAWAQAERERQAEEQRRMEADRAAKEEDRARAKAEVGRMRETLPQLLKNAVKSIDNVWYIEPSEFKGNELIRLYYNRSSGPLANANEIWIHGGHNNWKYGLSIVERLVKSVLKGGEWWYADVVVPDQALVLDWVFADGPPKKAVVYDNNRKQDFHAIVPMAIPDEQYWVEEEQQIYRKFQEERRLREEAIRAKAGKTAQMKAETKERTLKRFLLSQKHIVFTDPLDVQAGSTVTVFYNPSNTNLNGKPEVWFRCSFNRWSHRNGPLPPQRMLPAENGTHVKASVKVPLDAYMMDFVFSESEHGGVFDNKFGMDYHIPVFGGIVKEPPLHIIHIAVEMAPIAKVGGLGDVVTSLSRAVQDLNHNVDIILPKYDCLNLSNWLLCGNGWFVESVSSHLTAEHQHHWHAWLPMQDIIHCHDWSSAPAAWLFKDNYAHYGLSKARVVFTIHNLEFGAHSIGKAMAHADKATTVSPTYSREIAGNPLIAPHLHKFHGIINGIDPDIWDPYNDKFIPVVLLGSAPDPRIQNDFVNLANELHSAHHDRARLCLAYDEPLSHLIYAGADFILVPSIFEPCGLTQLTAMRYGSVPVVRKTGGLYDTVFDVDHDKDRAQAQGLEPNGFSFDGADTGGVDYALNRAISAWYEGRDWFNSLCKRVMEQDWSWNRPALDYLELYHAARKAE

SEQ ID NO: 154603 - protein, 66 aa, Glycine max
  Coding DNA Sequence Number=SeqID_37825
MEKSNRKIFKDKKAKKAYITCEDNNMNSSGDSENEVMNLSLIAKNYESEEEMHSVTYIKNQSNLPN

SEQ ID NO: 154604 - protein, 268 aa, Glycine max
  Coding DNA Sequence Number=SeqID_37826
  Homolog annotation: Hit_ID=Q5N7G7; Match level="QueryCoverage=70%, HitCoverage=98%, E-value=2e-16, Identity=33%"; Hit description =Prolyl 4-hydroxylase alpha subunit-like
  Pfam annotation: Domain name=DUF584; Domain location=104-268; Score =115.1; E_value=1.9e-31; Accession=PF04520.4; Description=Protein of unknown function, DUF584
MAKTFSCAPEMAELPKIESFVEDAHIRLRWGHSFSPPTKSASHATPHRSRVPSTTTHFGTSDHFSAAAQPIPPPPMAKGRKLTTSRSERFLGTYAYSQGSAALNPSELREEDVWGAGDDAGDREWEPHAAALNNSGVSRRRIPRDTEEHRRVGGLSLAFEAPASGSSPRMVHQFRAREEMTSTPRGRHMATSAPVNVPDWSKILRVDSVESINDEDGDESEMMPPHEYLARSQKMVANSVFEGVGRTLKGRDLSRVRDAVWNQTGFDG

SEQ ID NO: 154605 - protein, 106 aa, Glycine max
  Coding DNA Sequence Number=SeqID_37827
MPLGSNSESVKVGLAMNQNALSSPDSHGRTLKPEEDKEVGEEEEDEDADFNPFLKETLSQEASSSLSSEVDGLDGNVVTSGPSGGSELSKVTTKEAICTVVLNEPW

SEQ ID NO: 154606 - protein, 92 aa, Glycine max
  Coding DNA Sequence Number=SeqID_37828
  Gene Ontology: Mol. function=receptor activity
  Homolog annotation: Hit_ID=Q1SYV0; Match level="QueryCoverage=70%, HitCoverage=65%, E-value=2e-19, Identity=79%"; Hit description =Lectin receptor kinase-related
MMGSLMYTVICTRPDIAQVVGAIKYLSHCKESNLPFQDKAHRCSISLCQRNCIGSVDMQKIHTKDKLTDAMIKPINANKFAWCKSSFGLSDM

SEQ ID NO: 154607 - protein, 84 aa, Glycine max
  Coding DNA Sequence Number=SeqID_37829
  Homolog annotation: Hit_ID=Q1SRR6; Match level="QueryCoverage=99%, HitCoverage=7%, E-value=2e-16, Identity=44%"; Hit description =Integrase, catalytic region; Zinc finger, CCHC-type
MATVDITGSNNNDLNKPFRFEGYHFKRWKQKMMFYLTMRKVAYVLNTDIPMVLEDAEKEVKDKMTMELALWNENDYLCKNFILN

SEQ ID NO: 154608 - protein, 95 aa, Glycine max
  Coding DNA Sequence Number=SeqID_37830
MSRLARVSGFGLGASRALSLQETNISLSKLISRLTRDLDSCVSYPNFVRELLLDGMQPVIDYFKILPPEGGCFWRKQPGSPGQAGLQAPPLFFYK

SEQ ID NO: 154609 - protein, 449 aa, Glycine max
  Coding DNA Sequence Number=SeqID_37831
  Gene Ontology: Mol. function=hydrolase activity; Cellular component =membrane; Biological process=metabolic process
  Homolog annotation: Hit_ID=Q0SZ18; Match level="QueryCoverage=58%, HitCoverage=91%, E-value=1e-129, Identity=86%"; Hit description =Predicted hydrolase
  Pfam annotation: Domain name=Hydrolase; Domain location=1-232; Score =19.0; E_value=0.0013; Accession=PF00702.16; Description=haloacid dehalogenase-like hydrolase
  Pfam annotation: Domain name=Hydrolase_3; Domain location=2-257; Score=273.0; E_value=5.9e-79; Accession=PF08282.2; Description =haloacid dehalogenase-like hydrolase
  Pfam annotation: Domain name=S6PP; Domain location=1-257; Score= -77.2; E_value=2.9e-05; Accession=PF05116.4; Description=Sucrose-6F -phosphate phosphohydrolase
  Pfam module annotation: Pfam domain module=Hydrolase::Hydrolase _3::S6PP; Domain location=1-232::2-257::1-257
VVASDLDGTLLSPDHFLTPYAKETLKLLTARGINFVFATGRHYIDVGQIRDNLGIKSYMITSNGARVHDSEGKQIFAHNLDRDIASDLFEMVRNDVKIVTNVYREDEWFMNRHRPEEMRFFKEAVFNYKLYEPGELDADGISKVFFTCEDHEHLLPLEQAINARWGDRVNVSFSTLTCLEVMAGGVSKGHALEAVAKMLGYSLKECIAFVDGMNDAEMLSMAGKGCIMANAHQRLKDLHPELEVIGSNADDAVPHYLRKLLIGEYLAGSVDSYFSVLMRVGLAALVFLPFLHTRGQSPRTIVLYMLVGAMQLGIIGRKLRWGYLLSAALAVLGAAIIRYDKVSDHFWTGLLLVQLSNICFAIGMVGYKRLMEVRPMPQHNAFAWFYAGAFIVAVAAWFMLSNPQRLPTTDLQWGILDWLGVVASGLGYFMWNYGATHVDAVTLGIMITF

SEQ ID NO: 154610 - protein, 414 aa, Glycine max
  Coding DNA Sequence Number=SeqID_37832
  Gene Ontology: Mol. function=hydrolase activity
  Homolog annotation: Hit_ID=Q0SG62; Match level="QueryCoverage=52%, HitCoverage=65%, E-value=4e-22, Identity=32%"; Hit description =Probable phosphoesterase
  Pfam annotation: Domain name=Metallophos; Domain location=128-328; Score=74.6; E_value=3.2e-19; Accession=PF00149.18; Description =Calcineurin-like phosphoesterase
  Subcellular localization annotation: CTP_CleavageSite=8; ConfidenceScore=5.27e-01
MPARFRLRSEMSKPAGSMMSTPRPRQAASRRMVPGDSDFGRGAGHGDLTAVAVLVRLSRAGKGRQAVCEKSLSGAIPDRIFMRVTHWAATHSPVHHQACPNHRERLTSAYLSRIFCTQQQGDSMSERVNFVHLTDLHVGNPQVQDDDLYSETSATLSTTLAQIKALVPPPEFIVVSGDLTNRGDAGSYEELKRLIKEAELGMPVLFALGNHDRRDGFYPVMLDRHEDLDEPYDHAEVIAGIHIIVMDTSVPGKVGGAFEPGQVEWLEDELENHPELPKLLVMHHAPALDFDRPDAEWESLSFDDTEILDELLFEHDIIGILAGHIHYDRMSHWQGIPIVVGIGQHFATDPLWLHEGVRMLSGASFAIGTIRDTGLTVTFAPQPSDRRELKRHTQAGMIELITEYESGQAQDAAE

SEQ ID NO: 154611 - protein, 125 aa, Glycine max
  Coding DNA Sequence Number=SeqID_37833
  Subcellular localization annotation: CTP_CleavageSite=70; ConfidenceScore=5.21e-01
MSTPPLDPHNHSQTHFKLSGRLPLIALFSAGLIGGLDGVFALRATRHRSTLISGFRLSACFWRSADGLKRCASLDDPSLSKHAHVILLPNSSSCSAEGVLHSADGSLSQQIGLVRGWKSELHKLA

SEQ ID NO: 154612 - protein, 40 aa, Glycine max
  Coding DNA Sequence Number=SeqID_37834
MDPIKYIFEKPALTGRIAWWQAIKGSALADYLAQQSLNDY

SEQ ID NO: 154613 - protein, 169 aa, Glycine max
  Coding DNA Sequence Number=SeqID_37835
  Subcellular localization annotation: CTP_CleavageSite=41; ConfidenceScore=5.39e-01
MAESLKKRKGSSSTTTVAGHRRHGPSEAPTTPIHPSLSSPRSSTLFSSDDQRLRYLSQFSSRIILDPKYLDIDFFNDETFDCYQVFQNSGLVDFMSLKLPYYLELVKVFYCNLKIQDGIISSEVHGISMIIDQSLFFSLTKLPSQGAPFEGTIVDDWKFDYSSHDAHRM

SEQ ID NO: 154614 - protein, 58 aa, Glycine max
  Coding DNA Sequence Number=SeqID_37836
MARGCHRWSWTVEEEVWGIASILESHSSNADQSNSAQPNIHIKQLYKDNSYNTSTIPN

SEQ ID NO: 154615 - protein, 132 aa, Glycine max
  Coding DNA Sequence Number=SeqID_37837
MAQEEVPSPDPMPEPSLAPISEYTMPSLPAMELEQPILQNVPAAPVLDLNEDQPQDDQDESIIHRKLGSKKICPKFGEDIGLSVEVLKVVVALSVHPSLSAALARQKNLEELKYQGHVLSATVVFSQAQHMT

SEQ ID NO: 154616 - protein, 114 aa, Glycine max
  Coding DNA Sequence Number=SeqID_37838
  Homolog annotation: Hit_ID=Q1SAJ3; Match level="QueryCoverage=33%, HitCoverage=8%, E-value=1e-10, Identity=84%"; Hit description=WD-40 repeat
MGLSSKHSAPSPSFPEHNLNDFSSALLKYTYRYAANLLEGFSQTQISTLAVKDNLLVAGGFQGELTCKHQLSGFDYSALSFSDIFYFWSCHGHQASWLATGTRKEKERNKAKFG

SEQ ID NO: 154617 - protein, 86 aa, Glycine max
  Coding DNA Sequence Number=SeqID_37839
MDDLHSTLGYGVLRSSKNLGELASDDYPAFGTLIWREKLTSLTLLLLTGSETVLFGVGSLGSIYIILVYGDHSQLSSMWLCKNTNT

SEQ ID NO: 154618 - protein, 88 aa, Glycine max
  Coding DNA Sequence Number=SeqID_37840
MKMEALSSSKTQPKTKEKSGTEEDTKMKKKEWKQRKQIGGQMTQMKEAAGDFEFVPPLEIVEYPNPRLRARNKRIVAFDDCLSTKCLM

SEQ ID NO: 154619 - protein, 66 aa, Glycine max
  Coding DNA Sequence Number=SeqID_37841
  Homolog annotation: Hit_ID=Q338L7; Match level="QueryCoverage=70%, HitCoverage=4%, E-value=6e-10, Identity=70%"; Hit description=F-box family protein, putative, expressed
MVWKMSINGRVGMLHFSMAAIAHSYMLEVLELDNCSLLTSVSLDLPRLQTIRLVHCRKQVYHSYVG

SEQ ID NO: 154620 - protein, 302 aa, Glycine max
  Coding DNA Sequence Number=SeqID_37842
  Gene Ontology: Mol. function=transporter activity; Cellular component= integral to membrane; Biological process=transport
  Homolog annotation: Hit_ID=Q82MF2; Match level="QueryCoverage=99%, HitCoverage=67%, E-value=8e-78, Identity=50%"; Hit description =Putative integral membrane transport protein
  Pfam annotation: Domain name=MFS_1; Domain location=22-301; Score= -13.1; E_value=0.0013; Accession=PF07690.6; Description=Major Facilitator Superfamily
  Pfam annotation: Domain name=Sugar_tr; Domain location=17-301; Score=- 119.4; E_value=0.0039; Accession=PF00083.14; Description=Sugar (and other) transporter
  Pfam module annotation: Pfam domain module=MFS_1::Sugar_tr; Domain location=22-301::17-301
MGTGMNQQTLDARRSRQALLAGSVGNFIEWYEFGVYGFLATVIAANFFTLQGENEITSLILTYAAFALAFFCRPIGAVIFGRIGDRIGRRPTLIAVLLLMTLATALIGVMPTYASIGVAAPLLLTLLRMLQGLFAGGEFGGAVSLMTEFAPKGKRGLFGAWQSLTVALGLLAGAGLVALLAALLSVQQLHDWGWRIPFLLALPLGAVALWLRLKLEETPTFTQAQQHAEHAAAPPEAKLGGVVKTILIGIGRMMGWSAAGYTFLVVMPSYLQTSLHATFQQALVATVLANVGFALTILPAGI

SEQ ID NO: 154621 - protein, 123 aa, Glycine max
  Coding DNA Sequence Number=SeqID_37843
LRAIEGGEDYAFANLEELFLVPNIITPPQFKVLDFDKYKGTTCPKDHLKKYCRKMGAYAKDEKLLIHSFQESLTGVAVTCVSIMASDRMQLQNMCNASRHIASVLLWKMVGYTPSSIADLVFT

SEQ ID NO: 154622 - protein, 72 aa, Glycine max
  Coding DNA Sequence Number=SeqID_37844
  Homolog annotation: Hit_ID=Q6Q2Z9; Match level="QueryCoverage=71%, HitCoverage=5%, E-value=1e-15, Identity=75%"; Hit description =Phosphoenolpyruvate carboxylase
MTDITDDIAEEISFQGFEDDCKLLGNLLNDILQREAGSTFVDKLEKIRVLSQVYTLMGFASLPFPRMIGVCC

SEQ ID NO: 154623 - protein, 133 aa, Glycine max
  Coding DNA Sequence Number=SeqID_37845
  Subcellular localization annotation: CTP_CleavageSite=31; ConfidenceScore=5.43e-01
MNVGALISGQITSMAQSNSSRIGFLALITTLCRSRGVAFDSLVFERLSPLVAPPDSISTVEQFNEWLAWPGTQPPLHREDEDPATQVPHQPKDESSESSTPEPLIKKRRVVVTQEAATTSEKSLEATLELPAP

SEQ ID NO: 154624 - protein, 154 aa, Glycine max
  Coding DNA Sequence Number=SeqID_37846
TYQGNPCGVYPDLSSFTGSGVIQTSIACIKRSAPTQNKVEDERKERITLSGEGNTQRLRANVFQEGGNDENPKTVQIQGPMTRSRTKQSVDTLQQMVAGILSKAQVEKDKSPNGEGRRPKWKRTKPQVKRRMKAQVEKDEGLSGEGRKTQVEKD

SEQ ID NO: 154625 - protein, 146 aa, Glycine max
  Coding DNA Sequence Number=SeqID_37847
  Homolog annotation: Hit_ID=O04892; Match level="QueryCoverage=44%, HitCoverage=12%, E-value=2e-13, Identity=87%"; Hit description =Cytochrome P450 like_TBP
MSRRARRSLQNPGREPGRSGRRCRSWCLPTLETAQPEVGSSGWKSTARRVVSGAPPAALENPEDRVPPTPGRTHNRIRSPRQGKSAKWIRNLGKRIGSEGWARGSQSRTRRLSVTARAASAARAGRRVPVGDGLGTGPSGLFPGRR

SEQ ID NO: 154626 - protein, 267 aa, Glycine max
  Coding DNA Sequence Number=SeqID_37848
  Gene Ontology: Mol. function=phosphomethylpyrimidine kinase activity; Cellular component=cytosol; Biological process=thiamin biosynthetic process
  Homolog annotation: Hit_ID=Q3SUB9; Match level="QueryCoverage=79%, HitCoverage=96%, E-value=1e-39, Identity=40%"; Hit description =TENA/THI-4 protein
AGDDLQQAGFAGAAGSEQGDEAAAGDVEAQPPHLPKCRFQLGGGGENLRQLGEAALCAALVADGFQQLDGGAHAGQIALVAVVADPGGVRIALHLGGGIVQQPQADFGIAGHAGQQASQQIEGVAGMADIQHVAGIVHGFRRFRLGGDLRFAQPPFGAVGHVQRQFGDDAVERGGSGAHLRQGAQLADQQRVGAGEVQQEQIVLGQVAAKRAFGQGAGGQLLQKRVINVILPVAAGMLAQPAVKTAFEQGGDGHGTSLSQWRSGHAG

SEQ ID NO: 154627 - protein, 171 aa, Glycine max
  Coding DNA Sequence Number=SeqID_37849
MTNANKSHIILLSHTLPIDTQSMTFLGETSSQTIVNSRLGFIFPNGSIIHNDSGVYFQTFTLVPIRVPNSCDFASLKTIIHNTLQLTDKQFLDEIHYRQPFTHTSNQIRFQCMQLINEDDFNTMLMCNDQFLCVGPIELLCTVGRTPDEVINLLERITIPTHDALLYYNGR

SEQ ID NO: 154628 - protein, 198 aa, Glycine max
  Coding DNA Sequence Number=SeqID_37850
MRSWVRGQWIPFDADAIGQLLGYPLVLEEGQECEYGQRRNRSDGFDEEAIAQLLCIPGQDFARTAAGRRVRIMCTNMTTLTQIWMTLLLSNILPTDHNSDLRLPKCQLVYAILTRMSIHVAQLIADAIYIFAASRVRALLLFRALLRTSSRAEVAWPGDWPEAQAGEAPAEAPDEADEARKDEEMTDLLDFLGGSGAA

SEQ ID NO: 154629 - protein, 291 aa, Glycine max
  Coding DNA Sequence Number=SeqID_37851
  Gene Ontology: Mol. function=chitin binding; Cellular component =extracellular region; Biological process=chitin metabolic process
  Homolog annotation: Hit_ID=UPI000044A8F0; Match level="QueryCoverage =44%, HitCoverage=99%, E-value=1e-13, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
AHALTFRELHAFTFKGLHVLALRGLHALAFKVLHALAIRGLDVLSFVGLHALTFRGLHVLAFRGLHILAFRGLHVLTFRGLHFLTFRGLHVLTFRGLNALAFRGLHVLAFRGLVARPLAFRGLHVLTFSGLHICTLRKFKVLCPEMLNRDLHSWEAITQLLCIPRQDFTRATAKRRVRIMHTNMTTLTQIWMTLLLSNVPSSDHDADLPLRKHQGRAHKTPSGPRGAQQGPGVSSSGYGPLSVLQSARPPQQGIAPARHPVDPEKSNKVLGFPALITGLYQFYGVPVTPNK

SEQ ID NO: 154630 - protein, 118 aa, Glycine max
  Coding DNA Sequence Number=SeqID_37852
MKTEKSKVNTLIAISPKIWNASKFIDIFPKISGYVIYEDNKLSQPTLRRESDTGLTSASSKGERRAESPPTFIQGKRQKNRKRCGLRTLSVKGSGVVFTHGEGYFPCSYVFLNCDEEI

SEQ ID NO: 154631 - protein, 98 aa, Glycine max
  Coding DNA Sequence Number=SeqID_37853
  Homolog annotation: Hit_ID=Q1T1Y0; Match level="QueryCoverage=55%, HitCoverage=13%, E-value=5e-10, Identity=56%"; Hit description =Ankyrin
  Pfam annotation: Domain name=DUF1723; Domain location=1-44; Score =38.4; E_value=2.5e-08; Accession=PF08330.1; Description=Protein of unknown function (DUF1723)
MFAFLEHWHKETSSFHLPVGEVTVTLEDVASLLHLPIIGTFLSFEPLHVDDVVYMLVELLEVSAAKARAETIECQGSYVQLSWNETCIRQKLMHVTGS

SEQ ID NO: 154632 - protein, 135 aa, Glycine max
  Coding DNA Sequence Number=SeqID_37854
  Gene Ontology: Mol. function=nucleic acid binding
  Homolog annotation: Hit_ID=Q1SDY9; Match level="QueryCoverage=79%, HitCoverage=30%, E-value=1e-10, Identity=30%"; Hit description =Peptidase S8 and S53, subtilisin, kexin, sedolisin; Zinc finger, CCHC- type
MKMRGQLKAYDLSEVVETVEPPALEENPIVAQIRFRSELVAKRANGHTILHSVMNDDEKLQDEFFGNEKTKKMQFINLKRFVLPKRFESKISSLEESKDLSTLSLIELENVNEIEDGEDLSFMANTTRSLEDEST

SEQ ID NO: 154633 - protein, 164 aa, Glycine max
  Coding DNA Sequence Number=SeqID_37855
MDKIEPEVVDVGLLGQLDLCVHARECHRIRRRTRVWMSRVKPLNKPVATLYWQRKFVCGRHDCPFTSGVKMLSLPCFVAMLPNLYVFNVPGCTASMRSFNGDFPPWRCSGRQRRRGEMRRHPLGNKPWKKELHHQDEPWITSLERMLQWRKRNRERKREGGAQN

SEQ ID NO: 154634 - protein, 218 aa, Glycine max
  Coding DNA Sequence Number=SeqID_37856
MDKLAYICPILGNVDILVNYMELPYEPVSVNEPKKEPKLICLLMNIVILGPNLSMYLLSESSEAEHDDIEDDVDLVNGNESDKLSGFEKNVNVIGEVNLDDDINEIYVERGILGKPFERQPDSKIKFIKGQLFSNVSHFREIQSDFSIQEGFELYGGPFGGVLLSVVELDGNKGMFHISFTMVEIENTNLWKFFLTLLRESLQSVPEWKDDFVTIMSD

SEQ ID NO: 154635 - protein, 524 aa, Glycine max
  Coding DNA Sequence Number=SeqID_37857
  Gene Ontology: Mol. function=protein dimerization activity; Biological process=DNA integration
  Homolog annotation: Hit_ID=Q1S735; Match level="QueryCoverage=65%, HitCoverage=74%, E-value=7e-96, Identity=47%"; Hit description =Probable transposase [imported]-Arabidopsis thaliana-related
  Pfam annotation: Domain name=DUF659; Domain location=95-249; Score =176.0; E_value=9.5e-50; Accession=PF04937.6; Description=Protein of unknown function (DUF 659)
MKQNLDERNTKRSKVREEYVYSGQFGKDRMRIIVDEVQEPIRVCNVNQPQKGKNINRLGQYFMPTTTPRAQPTLKAYYQPMIDTISSMGPSYEAPNFHRVCGYLLNKWVDDVRKLVDGYRIVWKQIGCTLMADGWTDCCRRTFINFLVYCPKGTVFLRYVDASHVSKSAEMLHKLFREKVLLVGPENVVHIVTNSAENYVVAGRLLEVDFSKLYWSPCATQCINLMLDDIGKLEEVSGRDILRPAPTLSATNFIVLQNILAHKDALRAMVTSRDWTSSAYAKESRAKKFAEQILDSRFWKKCVDIVKLMESLVCVLYIVDGKDKPAMDCFCQAMYKAKEEMIMRILEESPPFLTNKEVEALHNDLANMSIQPISDDIGMFLCYTVLIISLSDIWYHHSSQSCTIVLRSSGCRAAPYCSKDTRCGAPGSSGCRDAISGANSEESQQFVGFACDPHRRWTRRCDIHRCQRQLLLLPSCRRWPFTHPSALSSSSIGALHDDDEDGAQDNTMDNDDDAQENTMQNVNM

SEQ ID NO: 154636 - protein, 393 aa, Glycine max
  Coding DNA Sequence Number=SeqID_37858
  Gene Ontology: Mol. function=protein serine/threonine kinase activity; Cellular component=membrane; Biological process=protein amino acid phosphorylation
  Homolog annotation: Hit_ID=Q9FLW0; Match level="QueryCoverage=85%, HitCoverage=46%, E-value=1e-106, Identity=58%"; Hit description =Receptor-protein kinase-like protein
  Pfam annotation: Domain name=Pkinase; Domain location=110-325; Score =34.4; E_value=1.3e-10; Accession=PF00069.15; Description=Protein kinase domain
  Pfam annotation: Domain name=Pkinase_Tyr; Domain location=110-325; Score=17.2; E_value=1.6e-13; Accession=PF07714.7; Description =Protein tyrosine kinase
  Pfam module annotation: Pfam domain module=Pkinase::Pkinase_Tyr; Domain location=110-325::110-325
MLRFFLKLVNVVDSHVVPRKKRLWVLVSSVVGGIVVLLFVIAALLLSLKCRKKKKTQRTMESVEWTLLCVFGGSSLSRMSEGTTFASLGSYGYFGLTIPFADIQSATNNFDRSLIIGSGGFGMVYKGLKDNVKVAVKRGMPGSRQGLLEFQTEITIFSKIFHRHLVSLVGYCEENSEMILVYEYMEKARGLHYLHTGFVQGIIHCDIKSTNIFLDENYVAKVVDFGLSRSGPCLNEIHVSTGVKGSFGYLDLEYFRRQQLTDKSDVYSFGVVLFEKKGMLEHIIDPYLVGKIKQSSLKKFGETTEKRLAKYGVDRPTMGAVLWNLEYALQLQESEQEGEPYDDSNAQETVNVTTTIIPGSPSSNVIREGDNGNVYSDISATEVFSQLMNSEGR

SEQ ID NO: 154637 - protein, 115 aa, Glycine max
  Coding DNA Sequence Number=SeqID_37859
MTCGDTQVVIRTNQLLLISTREVRWQAEIPQVVIRTNALLLILTREVRCQAEIPQVVIRTHTVLLPRPVRSQEFQYLHVVNGFTAWICASGRSGKDSARTKFVSYLYFPFISNKR

SEQ ID NO: 154638 - protein, 257 aa, Glycine max
  Coding DNA Sequence Number=SeqID_37860
GRPDDTRRYLTVIRTLLSFRHSRVRWYAETKFGHSAPLCHPEAAGPMTHGDTLRLSAPFCHPEAAGRMTHRDKIWSFCTLVSSRGGRPDDTRRYLTVIRTLVSSRGGGPDDTRRYLTVIRTLLSSRGGGPDDTQRQNLVILHPCPMTRGDTLRLSAPFCHPEATGPMTRRDKIWSFCTLVSSRGSRPDDTRRYLTVIRTLLSSRGGGPDDARRHLTFIRTLLSSRGGGPDDARRHLTVICTLLSSRGGGPDDKQRPM

SEQ ID NO: 154639 - protein, 175 aa, Glycine max
  Coding DNA Sequence Number=SeqID_37861
FDEFKGELERCHWDEELTDFVDDNIDVAIVKEFYANLSDPEDISPKQDTLNTFLKTPVVVEEGETLCAYSRFALLRPDPQELAVKLCIPWRGFKLNADGYPLKILRKNMTTLAQTWSVLSFSNLIPTSYTSDVTLDRAKLIYGIIMKMDMNLGYLISHQISLIAQHDNPDLDIVP

SEQ ID NO: 154640 - protein, 63 aa, Glycine max
  Coding DNA Sequence Number=SeqID_37862
YNRQKGSTECGYYVMHWMSTIILGSFKNNWKTYFYDARPLEPERLKALHIQWAMYYLKVRNET

SEQ ID NO: 154641 - protein, 520 aa, Glycine max
  Coding DNA Sequence Number=SeqID_37863
  Homolog annotation: Hit_ID=Q1GZN3; Match level="QueryCoverage=48%, HitCoverage=84%, E-value=3e-75, Identity=61%"; Hit description=Von Willebrand factor, type A
MDQFAGYAITTENLPRLLTMHPALDTYSESLRQFYQAVQHTIIAGDGIWGTLGADTALALAAAATGDVAMAVAGAAEFCPSGVARVAGRPFVCLVGPAMEDGAEPADTLTQPGIGRTLPEGDAQARVPKMEVARNVLKTLVAQGHDDLMGMVTFSTSPILAAPLGNDRAFVQAALDATEAGGMGFTAVARGLGMALDYFADQPVTGARAMVLVSDGGAHLDGKTQDMLRAMFMRQQASLYWIYLRSESGVSLKQSLAEGENIDAYPEYALHEYFQTLNVPYRIYEAENPEAVMAAVRDISTLKNKPTRYLEPVARQDLSHYAYFLACGSHECKTGRCHAARAALGKRDHRDFTGHAGQATPQALFATAVLYDNQLKPEQALAQYAAVASRRGLPAWDEAGPLVALAKESYQKALRIAPDCNTKMSKSRPSKSPAAGQPCLAIHEECPDGEAFFGATGCASQTLDASLVDGREATGGLAPALPVPDAGIAHIDFVQTTLGAAQPRLRLVFCGGYYPEHECA

SEQ ID NO: 154642 - protein, 156 aa, Glycine max
  Coding DNA Sequence Number=SeqID_37864
  Gene Ontology: Mol. function=RNA-directed DNA polymerase activity
MELLFLRAGLREEERTSIARFLSGLNMEVKDKVELHPYRDLDELVQLCIRVDQQLKRKSSLKSYGFHCYPRKDQAQGILEVAPSKPKEDKGFFLLTPARYFRPTSGMTIFSRHRLVCRPKKRRCKKLFMNSLSEEDWLSEPYPLSEAGCSLRGWEP

SEQ ID NO: 154643 - protein, 101 aa, Glycine max
  Coding DNA Sequence Number=SeqID_37865
MVFIFCGKFGFECLGLFLLCFCLVRGEKVASAQDFGWRPHHSFFRGKEWKFSSWVKVHGELGFWLKACRIAGHDVCQGVGLASGSGIKGMSHIISMTHMQQ

SEQ ID NO: 154644 - protein, 91 aa, Glycine max
  Coding DNA Sequence Number=SeqID_37866
MIQPRDLHFQKLHLTGVMHALMLVPYNACTFQTLHLFQTHALDRKGHRQRQQMRRNSRRRRSRGRRDACSFESEGVEAALALWRLKEREEE

SEQ ID NO: 154645 - protein, 254 aa, Glycine max
  Coding DNA Sequence Number=SeqID_37867
  Gene Ontology: Mol. function=phosphoinositide binding; Biological process=cell communication
  Homolog annotation: Hit_ID=Q1S2J1; Match level="QueryCoverage=64%, HitCoverage=32%, E-value=2e-63, Identity=63%"; Hit description=Phox -like
  Subcellular localization annotation: CTP_CleavageSite=47; ConfidenceScore=5.44e-01
MPWFLRDFGCVLSNGIFHSGHTGQVRASGTSAASGTCMHCMAPASARASHRSSAASGSEVALRHHMFAMKYVAEKVVAHVRKLSNESVGSNGSSIRGSDMSNFGIPNSSGYSSHDLPGSAMRRLGTAKTDMEDLIVRLNQEIAAKDFLATKVKDLEVELETTKLKNKENLQQAILIVRERFTQMQWDMEELRRQSLEMQNDVLLENLDATKEQLEILLKQYGELEAKSKADVKVLVKEVPPAICPRILGHEVVG

SEQ ID NO: 154646 - protein, 94 aa, Glycine max
  Coding DNA Sequence Number=SeqID_37868
  Gene Ontology: Mol. function=protein-tyrosine kinase activity; Cellular component=chloroplast; Biological process=protein amino acid phosphorylation
  Homolog annotation: Hit_ID=Q1RVG1; Match level="QueryCoverage=63%, HitCoverage=55%, E-value=3e-17, Identity=71%"; Hit description =Protein kinase
MVSNLKAATKSFKSDALLGEGGFRKVYKGWLDEKTLAPTKAGSGIMVPIKKLNPKSMQGLREWQNAKGKSLFKWRYIGTVDNAYAYSKEWSWGY

SEQ ID NO: 154647 - protein, 278 aa, Glycine max
  Coding DNA Sequence Number=SeqID_37869
  Gene Ontology: Mol. function=hydrolase activity, hydrolyzing O -glycosyl compounds; Cellular component=periplasmic space; Biological process=metabolic process
  Homolog annotation: Hit_ID=Q8CZP1; Match level="QueryCoverage=96%, HitCoverage=41%, E-value=7e-84, Identity=55%"; Hit description =Soluble lytic murein transglycosylase
MKGVRHKLERSNEESGVEKWRNWMIGICLVSTAGSVWADSLDQQRQRYAQIKQAWDNKQMDQVEQLMPTLQDYPLYPYLQYRLLAQDLDQETGLAVKNFIQQYPTLPPARSLQTRFVNVLAHRQDWPGVLSFSPDEPKPVQARCNWYYAKWATGQQQAAFDGAKAIWLRGTALPNDCDKLFSVWQASGQLSPITILERIRLAMKAGNDSLVNYLAKMLPADYQTTASALIALQQNPQTVTTFASTLGPTDFTRMATSYAFARVARQDMDNARMMIPQL

SEQ ID NO: 154648 - protein, 316 aa, Glycine max
  Coding DNA Sequence Number=SeqID_37870
  Gene Ontology: Mol. function=hydrolase activity; Cellular component =cytoplasm; Biological process=metabolic process
  Homolog annotation: Hit_ID=Q6D599; Match level="QueryCoverage=97%, HitCoverage=51%, E-value=1e-104, Identity=62%"; Hit description =Probable amidase
  Pfam annotation: Domain name=Amidase; Domain location=25-313; Score =78.9; E_value=1.6e-20; Accession=PF01425.11; Description=Amidase
MASTFGFTLQDWQRCAQQDAQQIPALLAAHLDALDNQDNAWLYLASPAQLLAQVEPLLAAYQRNPAALPLFGVPFAVKDNIDVAGWPTTAACPALTYQAAADAFVVARLKAAGAIVIGKTNLDQYATGLVGTRSPYGAVSNTFNPAYVSGGSSSGSASVLARGLVGFSLGTDTAGSGRVPAGFNNIVGLKPTKGWFSASGVVPACRLNDTISVFALTVADAFSVASIAGGYDADDAYARQSPRSAPASFQPQPSLAIPAAPQFYGDQQAEAAWHSALEQLTASGATLHPIDFAPFHQLAEQLYYGPWVAERFLAVI

SEQ ID NO: 154649 - protein, 129 aa, Glycine max
  Coding DNA Sequence Number=SeqID_37871
  Homolog annotation: Hit_ID=Q5QIT3; Match level="QueryCoverage=34%, HitCoverage=8%, E-value=5e-16, Identity=88%"; Hit description =Protein phosphatase 2A beta
MAFETRDPFFICQEGENPTLIEWDRFAHREYIRLSMEEDVEDASNGSLELLGLGSSSPTDFFASWKMNGSGMEKEEREERCHFKEKMSLEEAHHHRRPWIRAWRKKEMNEGRGREEHKILCSKRALKSE

SEQ ID NO: 154650 - protein, 57 aa, Glycine max
  Coding DNA Sequence Number=SeqID_37872
MDILTLGQGLCQGFGDKGDVPHYFLDTQAIMMIRKFHAKLVMHAHMWTLKPQVFMVM

SEQ ID NO: 154651 - protein, 90 aa, Glycine max
  Coding DNA Sequence Number=SeqID_37873
MMLLAHSRHLLEDPNGQIMDNCLVKFQTKFREDPTVNKGWTAFLPRQLHVAFSRSFIKRLPPEASLRGFFQKLPRGFFEKLDPYLSTLLY

SEQ ID NO: 154652 - protein, 123 aa, Glycine max
  Coding DNA Sequence Number=SeqID_37874
  Gene Ontology: Mol. function=carboxypeptidase activity; Biological process=proteolysis
  Pfam annotation: Domain name=Transposase_21; Domain location=48-123; Score=-73.0; E_value=2.2e-08; Accession=PF02992.5; Description =Transposase family tnp2
MDYVIWEHHGEVISEPNEFDDDDQNNCNDGVYDVIHDFTNCYRDEVAKDRKTEDGQLRHPTDSITWQTLDSKYSSFAANPRPMALGNDIDVYLQPLIEELKELWEKGVVTYDASTKETFRLYA

SEQ ID NO: 154653 - protein, 91 aa, Glycine max
  Coding DNA Sequence Number=SeqID_37875
MEDLGELTLVQLAPLEQHDIEEFLKVEELECTTLAIEEKLWMSIDELLEENLDFWTKFKITMALKASAEDDDFKFTSYQAAKFQDEVLNMK

SEQ ID NO: 154654 - protein, 310 aa, Glycine max
  Coding DNA Sequence Number=SeqID_37876
  Gene Ontology: Mol. function=kinase activity; Cellular component =cytoplasm; Biological process=phosphoenolpyruvate-dependent sugar phosphotransferase system
  Homolog annotation: Hit_ID=Q94CG5; Match level="QueryCoverage=84%, HitCoverage=27%, E-value=3e-58, Identity=47%"; Hit description =Kinase interacting protein 1
  Pfam annotation: Domain name=KIP1; Domain location=1-52; Score=68.5; E_value=2.2e-17; Accession=PF07765.3; Description=KIP1-like protein
MEEKVHTVLKLLEEEGDSFAKRAEMYYKRRLELINFVEESFRAYHSLADRYDHISTELQNANNTIASVCPDQVPYMDDDDQDSHRAKTPIKMPEGYKPNIPKVLKPPLRDLKSVITATKKLNPKKVASTAGANKVQKSGLSRKEALTEVDKLHIEILELQTAKEFVKSTYDNAITRHWDTEQQIQGLQEKVSNLQDELGEGVVMDDEEARCLMAAAALKSCQETLLQLELKQAISLDETKIETKRVTEAREKLISLMNEFHYDQTNSKDPRAKRGVKEIAGTKDLDVDVDNLNQQRQELQQLQEKNKRTL

SEQ ID NO: 154655 - protein, 147 aa, Glycine max
  Coding DNA Sequence Number=SeqID_37877
MAIPLIRLAWSMWGGRRKEKKAVSKASTLNSKQSSEWGLAKETKMAPPQRKVGRSKEERRVHIEYDDVVLVASDDDCSSDWCLSGSESDDSDWSIGWSEPLASDFRSNGDGFAVLVPCYKPSCKVVEASNKALLGLIKNLSNEFSSG

SEQ ID NO: 154656 - protein, 227 aa, Glycine max
  Coding DNA Sequence Number=SeqID_37878
  Gene Ontology: Cellular component=integral to membrane
  Homolog annotation: Hit_ID=Q5PHK8; Match level="QueryCoverage=96%, HitCoverage=99%, E-value=2e-62, Identity=58%"; Hit description =Hypothetical protein yebE
  Pfam annotation: Domain name=DUF533; Domain location=25-220; Score =254.7; E_value=2e-73; Accession=PF04391.3; Description=Protein of unknown function (DUF533)
MRNVMAYWLNQLQSMMAQQGNPVSAEKSSSAKNLLPGALGDIAGLLVASKSSRKLLAKYGTGALLVGGGTVAGSVLWNKYQQKMRGQQADIATQTSTASTQEPVVLDARSERLITALVFAAKSDGHIDERERQHIEEQLRAANIDVQGRVLIDRVLTQPLDPQRLAQSVRDGQEALEIYYLSCAVIDIDHFMERSYLDALGDALKLPEDVREEIERDVQAQKQALDS

SEQ ID NO: 154657 - protein, 154 aa, Glycine max
  Coding DNA Sequence Number=SeqID_37879
  Gene Ontology: Mol. function=hydroxymethyl-, formyl- and related transferase activity; Cellular component=membrane; Biological process=purine nucleotide biosynthetic process
  Homolog annotation: Hit_ID=P33221; Match level="QueryCoverage=92%, HitCoverage=36%, E-value=4e-64, Identity=86%"; Hit description =Phosphoribosylglycinamide formyltransferase 2
  Pfam annotation: Domain name=ATP-grasp; Domain location=1-57; Score= -71.7; E_value=0.0099; Accession=PF02222.12; Description=ATP-grasp domain
MSDLALQRAQEIARKVVLALGGYGLFGVELFVCGDEVIFSEVSPRPHDTGMVTLISQDLSEFALHVRAFLGLPIGAIRQYGPAASAVILPQLTSENVTFSNLQAAVGASLQLRLFGKPEIAGARRLGVTLAVADNVDEAISRAKTAAAAVVVKG

SEQ ID NO: 154658 - protein, 299 aa, Glycine max
  Coding DNA Sequence Number=SeqID_37880
MDEFKAELERRNFHKRLTNLFDNNIDLALVNKFYANLYSSEGPSPKQVRVRGHVVKIDADSLNTFLETPVVLAKGETLLAYSRYCRLLADIREIEAALCIPGQGSVLNVEGHLGKILRKDLTTLAQVWSVHSYSNLAPTSHTSDLIVDQARLIFGLVSQMDMNVGAFISGQITSMAQSNSSRLGLLLTAWKNCWNPDDLTITIRGARRARTRPVEAPSISIAPSPACTLVAPSASAPADFQRFEAMLQSIHQGQIILLQSLQMVAPPDFIPSVEQFNEWVVWPGTQSSLHREDEGPTTQ

SEQ ID NO: 154659 - protein, 81 aa, Glycine max
  Coding DNA Sequence Number=SeqID_37881
  Subcellular localization annotation: CTP_CleavageSite=13; ConfidenceScore=5.15e-01
MLLNNNVIHIHVRVVMLVRMIRTRLFAVARVKSCPSMHTRCVIASLSGCARTVGRPPISGGGPGTDKRKLTGPLTGSASLS

SEQ ID NO: 154660 - protein, 176 aa, Glycine max
  Coding DNA Sequence Number=SeqID_37882
MDPKKSNRVLGFPALVTGLCQSYRVPVPPARSCHRDIGKDRAHKTPSGPKEVQQGPGVSNSDYGPLSVLQGARPPASSCHRDIGKGHARKTLSGLEEVRQVLELPALITGLCQFYGVPVIPSKVISPPTNRAFIKKYCVPKQAQGETPQQPGDGRQRATDASPSPLEFTSAHPQKG

SEQ ID NO: 154661 - protein, 127 aa, Glycine max
  Coding DNA Sequence Number=SeqID_37883
MDNIRFTAPFRVQKNLLQVPFTYHRQWLHNYPKYVLFHYDGEIHFIRVRTLGTKCFFADGLNDFRRAHNLHESVILRLVAGDKNTTFTVHIDGLAHHHSNLKPIIYRRRYIFTVDITDDMQQQNLPL

SEQ ID NO: 154662 - protein, 179 aa, Glycine max
  Coding DNA Sequence Number=SeqID_37884
  Gene Ontology: Mol. function=arsenate reductase (glutaredoxin) activity; Biological process=response to arsenic
  Homolog annotation: Hit_ID=Q6D6S8; Match level="QueryCoverage=79%, HitCoverage=97%, E-value=6e-66, Identity=86%"; Hit description =Arsenate reductase
  Pfam annotation: Domain name=ArsC; Domain location=7-117; Score =165.3; E_value=1.6e-46; Accession=PF03960.6; Description=ArsC family
MSNITIYHNPACGTSRNTLEMIRNSGNEPTIIYYLDTPPTRDELSKLISDMGISVRALLRKNVEPYEQLGLDEDKFSDEQLIDFMLQHPILINRPIVVTPLGTRLCRPSEVVLDILPDAQKGAFAKEDGEKVVDDAAPYHDGNEFIPFIMQQQIMKPMYQADRPFRRFAIVHSSGPVVA

SEQ ID NO: 154663 - protein, 128 aa, Glycine max
  Coding DNA Sequence Number=SeqID_37885
MAKEGEEMTFFQSYLDYKAQNAQVSNALRNGNVVHTPDIFSNIPTIYIRVLHDTVARFKKTRQRVKEPMILFSSVSRPHFATLEGLRDYAFLSWEMRGWYTMYLYVVIAPDCHPDDFCKTIKTWKDWW

SEQ ID NO: 154664 - protein, 124 aa, Glycine max
  Coding DNA Sequence Number=SeqID_37886
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=98%, HitCoverage=13%, E-value=1e-17, Identity=45%"; Hit description =Plasma membrane ATPase 1
  Pfam annotation: Domain name=Cation_ATPase_N; Domain location=1-45; Score=-2.8; E_value=0.007; Accession=PF00690.16; Description=Cation transporterATPase, N-terminus
MDLFGHNKLEEKKKNKFLKFWSFMLNLFSWVIEAAMVMAITLANARGKFLDWEDFVGIFMLLLLKSNFIEEYNVASIMACLASKAKFLCDKKWIKEFACINVSNDIIYAKQEDANVCLLECDPP

SEQ ID NO: 154665 - protein, 398 aa, Glycine max
  Coding DNA Sequence Number=SeqID_37887
  Homolog annotation: Hit_ID=Q0KIN0; Match level="QueryCoverage=44%, HitCoverage=10%, E-value=4e-29, Identity=35%"; Hit description =Integrase core domain containing protein
MGNPPLKPSFQGGKTKPLKYFTERPILLDVELGTHNTYVPIITLPLRVDESVANFQVGTTAGSDRRPPPLAAIISGGFFRRDQGSDRLEKRNPPLELAPPSDAPRAASSSHAFRRVQLTRRRAGVGSCPFRSRQLRHRLLGAFQASPPSSNKPFGQLLCVFLSCVLGFALNWKNYPSWSASVELWFLGQGHHDHLEKTSDSVSDDERPEWEKLDYQLCVMLWQSVEPDILEILRSFKSCRSFWKKAQEIFANNIQSLFDATMKVTALKQISHDMIAHVGKARAAVEELKKFLVADSLEEVNRKLDKFYMVLILRSFHSDFDHVRDQVLAGDQIPSMDSLITRLLRVPHLLKDENPTDGVETSAMVASRGRRSSRNNRGGRSGRGGRPHCTLLNIFWGF

SEQ ID NO: 154666 - protein, 97 aa, Glycine max
  Coding DNA Sequence Number=SeqID_37888
  Gene Ontology: Mol. function=DNA binding; Biological process=DNA integration
  Homolog annotation: Hit_ID=Q1SUE2; Match level="QueryCoverage=76%, HitCoverage=9%, E-value=5e-20, Identity=57%"; Hit description =Integrase, catalytic region
MAKTMLCKNSLPKHFLEETANTTCFVQNRILIRPLIKKTPYELWRGRRPNTSNFHPFKCECFILSTIELVKFDSKIGSYVAPKVDEVKQSDEILPQT

SEQ ID NO: 154667 - protein, 118 aa, Glycine max
  Coding DNA Sequence Number=SeqID_37889
VYHETHKCKDLLEKENPSKGWSSACQHPQANKEKGPKKIWVPKIKIIPIADLLHRRKETPLMQQATTARGSHRWSWVVEDKFLGWFGWCFERERRKIMFFALKNIFIIYRSRLASSSR

SEQ ID NO: 154668 - protein, 210 aa, Glycine max
  Coding DNA Sequence Number=SeqID_37890
MVPGQPPDPGGGPTMQVQPEEEAIALLLCIPGQDFTCVATGRRVRIMRTSMTTLTQTWMTLLLSNILPSDHNFDLPQPKCQLVYAILTRMSVHVAQVIADAIYLFAGMAPTRHPLDPDKSNRALGFPALIMGLYQSFGVPVAPSKVIRPPITRAFIEKYCTARQAPGDAPQAAGAPPPPHQADPAGSFDTERYLRHSIRQHTANHRGLGQ

SEQ ID NO: 154669 - protein, 96 aa, Glycine max
  Coding DNA Sequence Number=SeqID_37891
MVLEVQTQEHRSLEQTDQWLAPTSGLARDSPQISAGPYQLDLAPYASEPYNAQWNAPGLLRDKHTLRSSRILGEMEIDEPVMATIELSSRYGSKSA

SEQ ID NO: 154670 - protein, 51 aa, Glycine max
  Coding DNA Sequence Number=SeqID_37892
MERSGSSSSALDDGERDDNNDNGHTVGFADLVFAGEKIEVGLRKRCRCNWL

SEQ ID NO: 154671 - protein, 233 aa, Glycine max
  Coding DNA Sequence Number=SeqID_37893
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=100%, E-value=1e-34, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RDYTVLANRGPHALTFIGLHVLAFIGLHVLTFRRLHALAFRGLHVLTFRGLQVLSFRGLYLFTFKGLHALAIRGLHALAFRGLHILTIIGLHVLYFRGLHALTFRGQHVLTIEGLHLLAIRGLHALAFIGLHILTIRRLHVLAFRGLHVLAKRGLHALTFRGLHVLTFRGLHVLTFRGLHALTNRGLHGPAFRGLHVLTFIGLDVLAYIGLHFLAIKGLHVLAIRRLHTLAFG

SEQ ID NO: 154672 - protein, 385 aa, Glycine max
  Coding DNA Sequence Number=SeqID_37894
  Gene Ontology: Mol. function=protein binding; Cellular component =nucleus; Biological process=regulation of transcription, DNA -dependent
  Homolog annotation: Hit_ID=Q8GV45; Match level="QueryCoverage=93%, HitCoverage=96%, E-value=1e-162, Identity=70%"; Hit description =Fertilization independent endosperm development protein
  Pfam annotation: Domain name=WD40; Domain location=105-146; Score =0.2; E_value=35; Accession=PF00400.22; Description=WD domain, G-beta repeat
  Pfam annotation: Domain name=WD40; Domain location=172-211; Score =34.9; E_value=2.8e-07; Accession=PF00400.22; Description=WD domain, G-beta repeat
  Pfam annotation: Domain name=WD40; Domain location=238-274; Score =10.4; E_value=2.3; Accession=PF00400.22; Description=WD domain, G -beta repeat
  Pfam annotation: Domain name=WD40; Domain location=287-327; Score =2.4; E_value=19; Accession=PF00400.22; Description=WD domain, G-beta repeat
  Pfam annotation: Domain name=WD40; Domain location=335-373; Score =17.1; E_value=0.065; Accession=PF00400.22; Description=WD domain, G -beta repeat
  Pfam module annotation: Pfam domain module=WD40::WD40::WD40::WD40::WD4 0; Domain location=105-146::172-211::238-274::287-327::335-373
MVTRVEKGGKSFGLGCDPVVGSLIPAKKKDYKVTNRLQEGKRPLYAIVFNTIDFRYRDIFATVGGNKPLSILFVGGGGADPRLATWSIGSSVTVYQCLDEGDIAVLQSYADEDKNESFYTVGWACNVDGTPLVVAGGLNGVIRVIDAGSEKIHKVYQDESIRLWNAHTGICILIFAGGGGHRNEVLSVDFHPSDMYRICSCGMDSTVKIWSMKEFWTYVEKSSTWTDLPSKFPTKFVQFPVYTASVHINYVDCNRWLGDFILSKSVDNEIILWEPKVNEQTPGKGVVDVLHKYPIPDCNIWFIKFSCDFHFNIVTVGNREGKIFVWELQSSPPVLAAKLSHPQSKSPIRQTATSFDGSTILSCCEDGTIWRWDVSKPSTSTSTAA

SEQ ID NO: 154673 - protein, 1252 aa, Glycine max
  Coding DNA Sequence Number=SeqID_37895
  Homolog annotation: Hit_ID=Q9LT50; Match level="QueryCoverage=28%, HitCoverage=98%, E-value=1e-135, Identity=70%"; Hit description =Arabidopsis thaliana genomic DNA, chromosome 3, P1 clone: MOE17
MESILGRALEYTLKYWLKSFSREQFKLQGRTVHLSNLDIDGDALHSSVGLPPALNVATAKLPSVSNVQTEPIVVHIDRLDLVLEESSDSDESLSSNCSTPSAASVKGSGYGFADKFILTAGDCQIADGMTIQIQTVNLLLETRGGSRRQVGATWAPPMASITIRNLLLYTTNENWQVVNLKEAREFSSNKYIYVFKKLEWQSLSIDLLPHPDMFTEAALGHSQEGSNFRDDDGAKRVFFGGERFIEGVSGEAYITIQRTELNSPLGLEVQLHINEAVCPALSEPGLRALLRFMTGVYVCLNRGDVDSKIQQRSTEAAGRSLVSIVIDHIFLCIKDTEFQLELLMQSLCFSRASLSEGDNDNNLTRITIGGLFLRDTFCSPPCILVQPSMQAVTKDAFHVPEFARSFCPPIYPLQEQEWQLIEGTPLICLHALKIMPSPLPPSFASETVIDCQPLVIHLQEESCLRISSLLADGIVVNPGDILSDFSVKSFIFNLKGLDLTVPFDKTKLDISKSDMDNTVQTSFAGARLHIESLCFLNSPSLKLRILNLEKDPACFSLWEGQPIDASQEKWTARASQLTLSLEACTDRTGCQNSLEQTSGLWRCVDLKDACIEVAMVTADGSPLLQVPPPGGIVRVGVACEQYLSNTSVEQLFFVLDLYGYFGRVSEKIAKAGKRKQLEDIRDTSFSGKLMDKVPSDASVSLSVKNLQLRFLESSSVNIEGMPLVQFVGDDLFTSATHRTLGGAIIVSSILRWESVVIGCVDDEGHLPCENGSFLSSKENALLLSDNGYPQLRTVFWVHKNEKHLLNGNAHSVPFLDISMEHVIPLYEQDLESHSLNVSASVSGVRLAGGMNYAEALLHRFGILGPDGAPGIGLCKGLENLQKGPLSKLFKATPLIVDNSEDVGSGREGKETGFPQLKKPGDVDVTVELRDWLFALEDAQETAERWWFSSHVDEDREERSWHASFHGLRVNAKSSPTNIPDGKGQLQRIKQHPVELITELSNLKNTPFLSLGGCGGSLDGSLDLLPFSFCSQVGIQGLQILKPHLQKDIPSSTPIANGGKGFTNTVGGIGVEVRLILGGENVDDEMVNWEVENLKFSVKQPIEAVVTKDEVQHLTFLCKSEIDSIGRITAGIIRLLKLEGSVGQSVIDQLGHLGSEGIDKIFSSEKYSRDGSVGSRGLSPLPNLTINEESHKTSEQTLTLLEEALVDSQAKLNDLISDIGTSESSSSQHLTVIRLSQKIETMHDLLMQLRNQI

SEQ ID NO: 154674 - protein, 213 aa, Glycine max
  Coding DNA Sequence Number=SeqID_37896
  Subcellular localization annotation: CTP_CleavageSite=41; ConfidenceScore=5.07e-01
MASTVFSYPSPLHLKTYPHKTSSNPSEFSIHIQPKKHFSIRCTSLDSIPEAEFPTPDPSSSTVNSAESFPIEKRRRSEIVRERRGEKLVQPEPPNFEIGWKRTKEINLERPIGHVIADFLEKLETLMEKEFGSTELLAKVGEIVAERAREEAEILMDEGKVEERMVTELFRVLKLMEMDLAMVKAAVKEETLGERLELAKARCRQAILVAYSF

SEQ ID NO: 154675 - protein, 88 aa, Glycine max
  Coding DNA Sequence Number=SeqID_37897
MKEILKLLEIIDIKNLSSAESVAKVFQALGRLLLEPLAEKFLLDFKTSDHEADNITNFIASYAVSIPDLSIRNISQMVLIISVRPQYY

SEQ ID NO: 154676 - protein, 419 aa, Glycine max
  Coding DNA Sequence Number=SeqID_37898
  Gene Ontology: Mol. function=catalytic activity; Cellular component =mitochondrial matrix; Biological process=metabolic process
  Homolog annotation: Hit_ID=Q10BT3; Match level="QueryCoverage=91%, HitCoverage=52%, E-value=1e-123, Identity=54%"; Hit description=Acyl- activating enzyme 18, putative, expressed
  Pfam annotation: Domain name=AMP-binding; Domain location=3-386; Score=29.8; E_value=7.3e-09; Accession=PF00501.18; Description=AMP -binding enzyme
MGVNFVANCGVIVIYFSCLILPFPSSCFINQDLIMRGDKSIPLYSRVVDAQSPMAVVIPTKGSEFSMKLRNGDVSWHDFLEKVNNLKGKEFIATEQPIETFTNILFSSGTTGDPKAIPWTNITPLKAAADAWCHMDVRKGDVVCWPTNLGWMMGPWLVYASLLNGASVALYIGSPLGSAFAKFVQDAKVTMLGVIPSIVRSWRSTNSTSGYDWSSIRCFGSTGEASNVDEYLWLMGRALYKPIIEYCGGTEIGGGFVCGSLLQAQSLAAFSTPAMCCSLFILDDEGLPIPQNVPGIGELALGPLMLGASNTLLNADHYGVYFKGMPLLNGKVLRRHGDVFERTARGYYHAHGRSDDTMNLGGIKVSSVEIERICNGVDSSILETAAIGVPPSGGGPELLTIAVVFKDSNSTKQDLHQLR

SEQ ID NO: 154677 - protein, 138 aa, Glycine max
  Coding DNA Sequence Number=SeqID_37899
MFELGQLAQASKILPERAFQVANTTNNEKIHIFHSLSLSLSKTLTQTLKPPPPPLTTTGDCHEPLPLATRTPHREDHFNRSRISKTQLEDSVENKAFNPPFGLLRELCVWTKGREPKRYQNRHKELTREYTQVRGVYG

SEQ ID NO: 154678 - protein, 39 aa, Glycine max
  Coding DNA Sequence Number=SeqID_37900
MSGAEQGEVGKTRLPSGARMEAREKWEIGDGGEISKNIS

SEQ ID NO: 154679 - protein, 149 aa, Glycine max
  Coding DNA Sequence Number=SeqID_37901
  Homolog annotation: Hit_ID=Q1S6A6; Match level="QueryCoverage=60%, HitCoverage=15%, E-value=2e-20, Identity=52%"; Hit description=FAR1
MDNSNDEWFVNLEDDNDVNSSDTNSSNGSDAEVDIDVDNEEGVEDVDNEEEAKDVDCIGFKLKNLKDVTTDDITPIEFSCEHNAYKFYIAYTKSHGFGIRKDYVDYDMNHNIIMRQFVCNKKGLRDKKHLMRDNRKKDHRSLTRTNCKA

SEQ ID NO: 154680 - protein, 45 aa, Glycine max
  Coding DNA Sequence Number=SeqID_37902
MYENPKDDGQHILKIRVRELFTHGEVDKGVPLAPTYSSIEEIRPM

SEQ ID NO: 154681 - protein, 239 aa, Glycine max
  Coding DNA Sequence Number=SeqID_37903
  Homolog annotation: Hit_ID=Q9FMZ6; Match level="QueryCoverage=79%, HitCoverage=77%, E-value=6e-37, Identity=42%"; Hit description =Arabidopsis thaliana genomic DNA, chromosome 5, P1 clone:MJB21
  Pfam annotation: Domain name=DUF617; Domain location=84-238; Score =307.3; E_value=2.9e-89; Accession=PF04759.4; Description=Protein of unknown function, DUF617
  Subcellular localization annotation: CTP_CleavageSite=32; ConfidenceScore=5.25e-01
VRESQPMGEPRSSATSSPPPPPPQPPPISLVQPSHKKRHKPKVIRVFRSVFRSLPIITPSCKFPIDPTHHHHQKTVAAVNNAAKISGTLFGHRNGRVSLSIQENPRCLPSLVVELSMQTTTLQKEMAAGMVRIALECEKRSEKDKTKIIEEPLWTMYCNGKKSGYGVRREATEEDLHVMELLKAVSMGAGVLPVRADVDDADGGGELAYMRAPFEHVVGSRDSETLYMLSPDQGNSGPD

SEQ ID NO: 154682 - protein, 113 aa, Glycine max
  Coding DNA Sequence Number=SeqID_37904
NEDKGYVGVRELSWRWATGDGGLYVIYGYGELSCTIARPPPSTTLVPGDMSRGSGDLGDVRRAPGSQQIKGTKTTKQGGLCGGWPAVNLASGNRLPVCVIDYTEEWVTGNRLP

SEQ ID NO: 154683 - protein, 136 aa, Glycine max
  Coding DNA Sequence Number=SeqID_37905
MELLNTKLVHELAEANLLAKQFMTNCEKEKKERELMEEMCEELAMQIGEDKAKFTVVLSESMRICEKVEEERNMMQMAELWREERVQMKLADAQLVLEDKYNQLVQLYASLEMFFMSRGTELETTELEDAESIKQE

SEQ ID NO: 154684 - protein, 83 aa, Glycine max
  Coding DNA Sequence Number=SeqID_37906
MHGATRIRKRCNEGFHEFTAETNSEEGTVKKRRNEEGEDNVKGTKDAGTLRGGKHSPRPRISCGGFFIPILIPSGNFSPTTGP

SEQ ID NO: 154685 - protein, 108 aa, Glycine max
  Coding DNA Sequence Number=SeqID_37907
  Subcellular localization annotation: CTP_CleavageSite=45; ConfidenceScore=5.16e-01
MASSNNIQAIPRHRRRGTQTKHSGDGSCSSPVNSWELGSKKNEVSARKLAAGLWQMQCMQVSRDHAAAFGRSSLPSSVSQLVQYVISHHGLNLKLVQQLNYLYPKSHF

SEQ ID NO: 154686 - protein, 91 aa, Glycine max
  Coding DNA Sequence Number=SeqID_37908
MQFRSKIKSLVTREHTIKYVSLGNKRQCKHNCYGIYATEAIGHNNKHNVHSEAKIPATVLLARHRTVGGRKFRIWVAAKGGMQTLVLQIES

SEQ ID NO: 154687 - protein, 179 aa, Glycine max
  Coding DNA Sequence Number=SeqID_37909
MKTTYRPEYKRIGCLSSGRVVNIRFSLQRKMSRKLILGNKEKRFGRDSLGGASSATVVSSLLLLIVQGATTDDDMHNPLVLGLGRGRGTSHDGLENAMALLGFFHAFECQETPQCVDKSVRYRRRQAEGGDTIWRTRSLQSQLKENIKDHLKRCNLLSTSDRKWESVSMDFITTLPRTP

SEQ ID NO: 154688 - protein, 176 aa, Glycine max
  Coding DNA Sequence Number=SeqID_37910
  Homolog annotation: Hit_ID=Q2QS62; Match level="QueryCoverage=28%, HitCoverage=33%, E-value=1e-08, Identity=54%"; Hit description =Microsomal signal peptidase 12 kDa subunit family protein
  Pfam annotation: Domain name=SPC12; Domain location=48-113; Score =41.0; E_value=3.9e-09; Accession=PF06645.4; Description=Microsomal signal peptidase 12 kDa subunit (
MHDETSDTSSLNKWRRCRCSFQGNQSDDVRICCTKTLHKLQDHYNWKMDWQGQKITEQLMQLIIVAFAVIAFATGYLMASFQMMILIYVGGVVLTTLDPHICWWCGLSSDGFNISMGLPGAYTQTFCHKKMLTDLGIAKISVDDTAATAKAVLLKGRKDIGAIAGQGQQICMALTF

SEQ ID NO: 154689 - protein, 84 aa, Glycine max
  Coding DNA Sequence Number=SeqID_37911
  Subcellular localization annotation: CTP_CleavageSite=64; ConfidenceScore=5.52e-01
MIRFFRKIFNGSPSAFNSNPLLGMHNRAAISCGSGFERQNLEYTGKFSPSSSITRVFRNEFKVSASNFTKRPLTLTCLGLSSGS

SEQ ID NO: 154690 - protein, 128 aa, Glycine max
  Coding DNA Sequence Number=SeqID_37912
MASYGVASPFIFLLLHSAAIRPQEAKESIDKEDPRPTSSTWSYIRRRRHTILPRKWRPHAIALRALKNHDTMSFEELLGTLKFMNKNFRKMKDLRKRSLWLLASRRPRKHHPPRIHLQNQHLEARPKL

SEQ ID NO: 154691 - protein, 201 aa, Glycine max
  Coding DNA Sequence Number=SeqID_37913
MVTTLGTFFSLDVALCEVLVDDTGVSEINDDLINNVFIHKLSSSFRLCVTTYPSAGGLGEIKSASSKKGENARESPPTFIRGKWVDKGVALAPTYPQASQKLAWVSQGPEKAKNDPSAPPLGLRGNGGGRCLDVEDGRLHDGDKGASSVVSLLDDEGGEGGAHSFSTILGLALVALNRVPYPNFVWGLSFTDVLILASQTA

SEQ ID NO: 154692 - protein, 141 aa, Glycine max
  Coding DNA Sequence Number=SeqID_37914
MKKKVRREHNNNERSAHKSALMQSYPARALDRRLQVEWAKDAREGPRVLMSLRISKLIWSTKFRALLSLSLHSSPSSSKLLSMASYGGASPLSLPSPFRCHSSSKKQRNPLMKKILGLQAPMELTSRLVGGNPGFLTLSLF

SEQ ID NO: 154693 - protein, 263 aa, Glycine max
  Coding DNA Sequence Number=SeqID_37915
  Gene Ontology: Mol. function=chromatin binding; Cellular component =chromatin; Biological process=chromatin assembly or disassembly
  Homolog annotation: Hit_ID=Q1SAV4; Match level="QueryCoverage=59%, HitCoverage=39%, E-value=4e-39, Identity=53%"; Hit description =Integrase, catalytic region
  Pfam annotation: Domain name=Chromo; Domain location=104-154; Score =22.3; E_value=0.0018; Accession=PF00385.14; Description='chromo' (CHRromatin Organisation MOdifier
MKATTDKHRRDQEFEVGNWVLVKLRPHRQTSVTGSAYSKLAKRYYGPFQIIARMGKVAYKLLLSDHSRIQPIFHVSLLKPYVASTNSSVVAELPPGAIDNHPVITPLDILASKIIPSETGPKRMVLVQWAGLTPEDTSWEEWSEFKSLHHLEDKVLSNGQGSVTQNTEGVSLARKQQETNSSEGVPVARPKRRTAIPTYLDDYVQTPLRVVRPLGSREKAAKLNVENNKRDICRIEESFCKAWDEGGGDPEGDKMVLQCSYKA

SEQ ID NO: 154694 - protein, 194 aa, Glycine max
  Coding DNA Sequence Number=SeqID_37916
MAYARSHALAQSSQRCSPLPPFHTRPSLDPINATESSSMDWGGDDWGSLSSSKKRRKNKVFDEVHGESLGNVEKEKLLGEDKDLKEELEKLLGSEKEINNKQLGEGHASAEQVLARLIHARDHDDVHHRPWRLVLQSIPELVRLGMCDLYIRHSASKTSKLGNQEETKSKKFRVLYRYSSNHDANRPVQKIYII

SEQ ID NO: 154695 - protein, 135 aa, Glycine max
  Coding DNA Sequence Number=SeqID_37917
  Gene Ontology: Mol. function=ribonuclease H activity; Biological process=RNA-dependent DNA replication
  Homolog annotation: Hit_ID=Q1S700; Match level="QueryCoverage=58%, HitCoverage=24%, E-value=8e-13, Identity=41%"; Hit description =Ribonuclease H
MQKLQKIQQQIYMQSSIALILAKLRITGQSEKKSDYQISELEPLIQGWTKCNTDGAVKGNPGTAGCGDIFKNERTCVLGCFVLNLGTQNSLFVELTSVILAIGLTAKKNWNKLWLECDSELVAKHSETPLWFLEC

SEQ ID NO: 154696 - protein, 81 aa, Glycine max
  Coding DNA Sequence Number=SeqID_37918
MKSEKRGLTERQEEEEEEEEEVGHGAEKGKQHSRRERKAVCRFPVFYFGANCVMWQLVDGVINRIWYNSKHIDLDTPLPRE

SEQ ID NO: 154697 - protein, 378 aa, Glycine max
  Coding DNA Sequence Number=SeqID_37919
  Gene Ontology: Mol. function=GPI anchor binding; Cellular component =anchored to membrane
  Homolog annotation: Hit_ID=Q8GUI4; Match level="QueryCoverage=77%, HitCoverage=65%, E-value=1e-106, Identity=62%"; Hit description =Uncharacterized GPI-anchored protein At1g61900 precursor
  Subcellular localization annotation: CTP_CleavageSite=87; ConfidenceScore=5.19e-01
MYTKARILSYSCFGVGALESLSSNHRQGPVRLDSRVGSMFIKPSPLGSPQPFLPLAPSPLAPFTNTTIPKLSGLCTLNFTTAESLISVTAIDCWEVFAPFLANVICCPQLEATLTILIGQSSKLTNVLALNGTVAKHCLADVEQILMGQGATNNLKQVCSIRSSNLTEASCPVKNVNDFYDTVDTTKLLTACEKIDPVKECCYQICQNAILEAAKAIASKGSDILAIDAPHVQPEHSNRVNDCRNVVLRWLASKLEPSHAKKVLRGLSNCNVNKACPLVFPNTKQVAKGCVDEISNKTACCNAMESYVSHLQKQSFITNLQALDCAEALAMKLKRSNITADVYGLCHISLKDFSLQGSVFSFLVSMLSSHSIPIIFCT

SEQ ID NO: 154698 - protein, 134 aa, Glycine max
  Coding DNA Sequence Number=SeqID_37920
  Homolog annotation: Hit_ID=O21999; Match level="QueryCoverage=37%, HitCoverage=33%, E-value=2e-22, Identity=100%"; Hit description=LacZ- alpha
MTGTKRKAVFPVKLILRECPQQLTKLFASQPAILGPNCPGLYNSASACFVRLKERYSNSRIDESLRVLVYRNEIDVKSRPAGMQAWHWPSFYNVVTGKTLALPNLIALQHIPLSPAGVIAKRPAPIALPNSCAA

SEQ ID NO: 154699 - protein, 138 aa, Glycine max
  Coding DNA Sequence Number=SeqID_37921
  Gene Ontology: Cellular component=integral to membrane; Biological process=autophagy
  Homolog annotation: Hit_ID=Q1RSF3; Match level="QueryCoverage=92%, HitCoverage=49%, E-value=2e-25, Identity=46%"; Hit description =CD9/CD37/CD63 antigen
MCKFEFFRDIVHGEAVTHALLHQATLGHVPVSLVGDVVLQPGREIPYSIPHRRPRPIRRVVSGDEERYNGERREGEDDEERCEEVEVEGGVDAAQHADEAEGGDDEYEEAAEEERVLEHLLAVAVDADVGGVAHGGDT

SEQ ID NO: 154700 - protein, 84 aa, Glycine max
  Coding DNA Sequence Number=SeqID_37922
  Gene Ontology: Cellular component=integral to membrane; Biological process=autophagy
  Homolog annotation: Hit_ID=Q1RSF3; Match level="QueryCoverage=77%, HitCoverage=24%, E-value=1e-25, Identity=74%"; Hit description =CD9/CD37/CD63 antigen
MRKRMYGFNGQITVEVGVLQPIVPDGVAAQDIDGGDEHEHACIEYGEMSPLASDVGQHSSFARIAVETQFVLSVAPCPAISVIR

SEQ ID NO: 154701 - protein, 130 aa, Glycine max
  Coding DNA Sequence Number=SeqID_37923
MEKKPTRMRRWPICLTSWEGVEIRDWEIPRFMLSFQKGREGKFPIKEWEKAKRKERKFPIKEWEQAKRKERKFPIKEWEKEKKRKEGKKAPDQGSKENRRNVQRGLWTGQYLNNTELSPNEQKEGKESTT

SEQ ID NO: 154702 - protein, 159 aa, Glycine max
  Coding DNA Sequence Number=SeqID_37924
  Homolog annotation: Hit_ID=Q84NN3; Match level="QueryCoverage=42%, HitCoverage=33%, E-value=2e-21, Identity=69%"; Hit description =Putative DNA-directed RNA polymerase III subunit 22.9 kDa polypeptide
  Pfam annotation: Domain name=RNA_pol_Rpb7_N; Domain location=98-159; Score=31.7; E_value=2.6e-06; Accession=PF03876.7; Description=RNA polymerase Rpb7, N-terminal domain
MGKPKMKFRKTQPIMQVRNPNAKLVVAAIPLSDESAQVEESRGQLPVKNRAICLEVAIHPRYRDSTTIQEQKRDNLLFVSVAAGIVSNRSMFYLSKIEHELPLPPSRLVLPIREAIHMELEKLFLDKVIANLGLCISVYDIRSIDGGFIFPGDGAPTYT

SEQ ID NO: 154703 - protein, 141 aa, Glycine max
  Coding DNA Sequence Number=SeqID_37925
  Gene Ontology: Mol. function=DNA binding; Cellular component =mitochondrion; Biological process=DNA integration
  Homolog annotation: Hit_ID=Q1SFD6; Match level="QueryCoverage=94%, HitCoverage=9%, E-value=9e-52, Identity=68%"; Hit description =Integrase, catalytic region
  Subcellular localization annotation: CTP_CleavageSite=31; ConfidenceScore=5.20e-01
MDSRKSISGYCFFIGKSLVSWRAKKQATVSRSSSEAEYRALSSAAYLRVQLTRTPTLYCDNQSAVHIASNPVFHERTKHLEIDCHLVREKLLKGTLKLLPVSTSDQVADFLTKALAPPKFHDFVSKLSMINIYHDKLEGGC

SEQ ID NO: 154704 - protein, 129 aa, Glycine max
  Coding DNA Sequence Number=SeqID_37926
  Gene Ontology: Mol. function=DNA-directed RNA polymerase activity; Biological process=transcription
  Homolog annotation: Hit_ID=Q84NN3; Match level="QueryCoverage=49%, HitCoverage=31%, E-value=1e-10, Identity=46%"; Hit description =Putative DNA-directed RNA polymerase III subunit 22.9 kDa polypeptide
  Pfam annotation: Domain name=RNA_pol_Rbc25; Domain location=2-121; Score=23.2; E_value=2.9e-09; Accession=PF08292.2; Description=RNA polymerase III subunit Rpc25
MIKGFLMSSPVRPRGLTIGFYDDIYIPASRLPDPNHFVETEPKKRVSSGQESTANPSSKKGMWYWDYDEQEYPITDVIKFRVTNVSYPQIPVEQPKESKPFAPMLVSGAIDDDGLGPISWWFGDEDEDE

SEQ ID NO: 154705 - protein, 76 aa, Glycine max
  Coding DNA Sequence Number=SeqID_37927
MKESHTFVITHMQRISLACRTRHTLFNVITYFILVIQKLGEPLWEARASWMENHVEMVTHVELRLCQPIVIKSCVA

SEQ ID NO: 154706 - protein, 755 aa, Glycine max
  Coding DNA Sequence Number=SeqID_37928
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6RXY3; Match level="QueryCoverage=99%, HitCoverage=95%, E-value=0.0, Identity=66%"; Hit description=Beta xylosidase
  Pfam annotation: Domain name=Glyco_hydro_3; Domain location=50-329; Score=134.9; E_value=2.2e-37; Accession=PF00933.12; Description =Glycosyl hydrolase family 3 N terminal domain
  Pfam annotation: Domain name=Glyco_hydro_3_C; Domain location=379 -611; Score=278.8; E_value=1.1e-80; Accession=PF01915.12; Description= Glycosyl hydrolase family 3 C terminal domain
  Pfam module annotation: Pfam domain module=Glyco_hydro_3::Glyco_hydro_ 3_C; Domain location=50-329::379-611
AREPFACDPKNGGTKKMAFCKVSLAIAERVKDLIGRLTLEEKVRLLVNNAAAVPRLGMKGYEWWSEALHGVSNLGPAVKFNAQFPAATSFPQVITTAASFNASLWEAIGQPCAHSHSYGTPCNVHGEAAMHLIVLLDFSCSRARVVSDEARAMYNGGTAGLTYWSPNVNIFRDPRWGRGQETPGEDPVLAGTYAATYVRGLQGTHANRLKVAACCKHFTAYDLDNWNGMDRFHFNAQDIEDTFDVPFKMCVSEGKVASVMCSYNQVNGVPTCADPNLLKKTVRGLWQLDGYIVSDCDSVGVFYDNQHYTPTPEEAAADAIKAGYEADVNGALVNTLTVQMRLGMFDGEPTAHPYGHLGPKDVCKPAHQELALEAARQGIVLLKNTGPVLPLSSQLHRTVAVIGPNSKATITMIGNYAGVACGYTNPLQGIGRYARTVHQLGCQNVACKNDKLFGPAINAARQADATVLVMGLDQSIEAETVDRTGLLLPGRQPDLVSKVAAASKGPTILVLMSGGPVDITFAKNNPRIVGILWAGYPGQAGGAAIADILFGTANPGGKLPVTWYPEEYLTKLPMTNMAMRATKSAGYPGRTYRFYNGPVVYPFGHGLTYTHFVHTLASAPTVVSVPLNGHRRANVTNISNRAIRVTHARCDKLSITLQVDIKNVGSRDGTHTLLVFSAPPAGFGHWALEKQLVAFEKVHVPAKGQHRVGVNIHVCKLLSVVDRSGIRRIPLGEHSFNIGDVKHSVSLQAAALGII

SEQ ID NO: 154707 - protein, 317 aa, Glycine max
  Coding DNA Sequence Number=SeqID_37929
  Gene Ontology: Mol. function=drug transporter activity; Cellular component=membrane; Biological process=multidrug transport
  Homolog annotation: Hit_ID=Q1T297; Match level="QueryCoverage=95%, HitCoverage=93%, E-value=8e-98, Identity=57%"; Hit description=Multi antimicrobial extrusion protein MatE
  Pfam annotation: Domain name=MatE; Domain location=61-221; Score =157.0; E_value=4.9e-44; Accession=PF01554.9; Description=MatE
MMESQNQNLLRQPLINSTHHHHHSADSRLEEVLSDPTLPWSKRILSATWIELNLLFPLAAPAILVYVFNNLMSNVTRAFAGHLGNLELAAANLGNSGIQLFAYGLMLGMGSAVETLCGQAYGANKYEMLGIYMQRAIIVLTITGIPLTVVYIFCKPILLLLGEPPEVASVAAMFVYGLIPQIFAYAVNFPIQKFLQAQSVVAPSTYISAATLVLHVALSWVVVYKLGFGIMGSSLMLSLSWWIIVGAQFLYVVSASKFKDTWSGFSVEAFSGLWDFVKLSAASAVMLCLETWYFQVLVLITGLLDNPQLSLDSISVW

SEQ ID NO: 154708 - protein, 90 aa, Glycine max
  Coding DNA Sequence Number=SeqID_37930
MEQLKGFAKDNKRYDEFMMMMGFLRIGAGSRKENIKKLKFEFVYEFEMKELKIVERFRMHMSKPVATPLGKLDLDHGVSVRTSSRLCGLE

SEQ ID NO: 154709 - protein, 101 aa, Glycine max
  Coding DNA Sequence Number=SeqID_37931
  Gene Ontology: Mol. function=calcium-dependent phospholipid binding
  Homolog annotation: Hit_ID=Q9ZR53; Match level="QueryCoverage=96%, HitCoverage=30%, E-value=1e-18, Identity=54%"; Hit description =Annexin-like protein
  Pfam annotation: Domain name=Annexin; Domain location=3-55; Score= -2.7; E_value=0.079; Accession=PF00191.10; Description=Annexin
MVFTGLGCDTSAVIKLLADPDATQRAYTQEAYKKHIPGTLLKELSGKLKTGVLLWMHDPAERDAIILKESLCGAKNLDAATEVMMLAIFIPAARFKADVPF

SEQ ID NO: 154710 - protein, 151 aa, Glycine max
  Coding DNA Sequence Number=SeqID_37932
  Homolog annotation: Hit_ID=UPI000060F53F; Match level="QueryCoverage =73%, HitCoverage=63%, E-value=3e-11, Identity=29%"; Hit description =UPI000060F53F related cluster
MEEKDWNDDSLTMTTVSHHCFSDDSKAPSFSISIIENMKDEYGLFLWPCNVVLVEYVWQHNHRFSGANVVEGSLPLISDYIGHVVLGLTWGVWDSSIFSLQSTIILGADVLYDSNAFDNLFATVTFLFRNSPGSTYITSYHNRRDSSYLKR

SEQ ID NO: 154711 - protein, 63 aa, Glycine max
  Coding DNA Sequence Number=SeqID_37933
  Gene Ontology: Mol. function=phosphatidylinositol phosphate kinase activity; Biological process=phosphatidylinositol metabolic process
  Homolog annotation: Hit_ID=Q1S1T3; Match level="QueryCoverage=86%, HitCoverage=12%, E-value=1e-08, Identity=69%"; Hit description =Phosphatidylinositol-4-phosphate 5-kinase
MAQWERVRRRVEERCHLGNSNNKSVSFPRICIWELDGEAGDITCDIVEASMIYGGGGVCGSDV

SEQ ID NO: 154712 - protein, 86 aa, Glycine max
  Coding DNA Sequence Number=SeqID_37934
  Gene Ontology: Mol. function=calcium-dependent phospholipid binding; Cellular component=plasma membrane; Biological process=cell differentiation
  Homolog annotation: Hit_ID=Q6H450; Match level="QueryCoverage=94%, HitCoverage=29%, E-value=4e-25, Identity=64%"; Hit description =Putative annexin
  Pfam annotation: Domain name=Annexin; Domain location=27-81; Score =60.6; E_value=5.3e-15; Accession=PF00191.10; Description=Annexin
AVKNETSGNYAHALLTIVQCAENPAKYFAKVLRKAMRVIVTRAEIDLQYIKAEYLNNYKKPLDGAVHSVTSGHYRAFLLALLGPDQ

SEQ ID NO: 154713 - protein, 581 aa, Glycine max
  Coding DNA Sequence Number=SeqID_37935
  Gene Ontology: Mol. function=zinc ion binding
  Homolog annotation: Hit_ID=Q3TAD1; Match level="QueryCoverage=59%, HitCoverage=64%, E-value=5e-26, Identity=26%"; Hit description =Activated spleen cDNA, RIKEN full-length enriched library, clone:F830020B15 product:...
  Homolog annotation: Hit description=chemokine (C-X-C motif) ligand 16, full insert sequence
  Pfam annotation: Domain name=zf-MYND; Domain location=237-278; Score =36.7; E_value=7.9e-08; Accession=PF01753.9; Description=MYND finger
LYRAEPWKRLRPGHLFGVRVGKDSDWPGKKQPFPCVQFIGGDGGDVGFYMFRSENDAKKMTGSRETIHVPNVELLRVTYEVESLMFPSNRKMIKSLSLEASGSDRFPVIDVARCTPSGDLRFRNPNLEELRFVYAFMKAISLVHSLLQVDRESGPKYSTVVCFEPFIETVDVQWPPEVAKGGYDLVAVTVSHPPGQAYDEKSNSASAGSTPTKYVEPPREDIFNDTKAYSSTGLRQCAICEKEVNGEQSLCCGRCRAVVYCSSICQKQHWNDTHKSMCGLYKAMMEREEELAIMIFMFPCSADQPCKWLESLGVHQKGMWRRKCSCYSHCPFGLLPVKGGLQELWGGIDEFEYPHDSPFNNHFISSPFLLSGWSEYYNLRSLPLSSPVADILSHPLTVYHILTTLNISSKNLILKGKEVIVHYLGPEGELDWMPAFAEVGHLLNGLGNVQIVMVGPEVPTNLSGTTSGIGSRVRVNLVRGVYQVEASYLPTPHVVIALNSRLAIYSSWGGALDVIKSIGVPAFFTDQSEVSCVNAKQVLRNAGLHITHPVTPNPFRSPVKNLTASSNLPSYSNGFVFGVNT

SEQ ID NO: 154714 - protein, 316 aa, Glycine max
  Coding DNA Sequence Number=SeqID_37936
  Gene Ontology: Mol. function=protein binding; Cellular component =endoplasmic reticulum; Biological process=retrograde protein transport, ER to cytosol
  Homolog annotation: Hit_ID=UPI0000584D6E; Match level="QueryCoverage =97%, HitCoverage=88%, E-value=1e-41, Identity=50%"; Hit description =PREDICTED: similar to Der1-like domain family, member 2
  Pfam annotation: Domain name=DER1; Domain location=12-284; Score =274.5; E_value=2.1e-79; Accession=PF04511.5; Description=Der1-like family
MAQAVEEWYKQMPVITRSYLTAAVVTTIGCSLDIISPYHLYLNPRLVVKQYQFWRLVTNFLYFRKMGKISAVHHLVNCYSSDTEGALVKKGYCYRWVWYAIQIATYPLRSKIRGRLKFAVMKIVHLLNLTWYFLIEWADLDFLFHMFFLARYCKLLEENSFRGRTADFFYMLLFGATVLTGIVLLGGMIPYLSESFAKIIFLSNSLTFMMVYVWSKQNPFIHMSFLGLFTFTAAYLPWVLLGFSVLVGASAWVDLLGMIAGHAYYFLEDVYPRMTGRRPLKTPSFIKALFADDPVVVARPANVRFAPPPAEELHQD

SEQ ID NO: 154715 - protein, 124 aa, Glycine max
  Coding DNA Sequence Number=SeqID_37937
MSDGFCGTHLQIMVRTRGLGRALGQVDEPVIPDPDVQDDPMEAPAAVEDIPLDIPADAGAEAVEDQNQGFPGGPSDPSVLTAYANHVACNIWTGQERPKLKLSSHGRKVHSLGRSVPAIEGLIT

SEQ ID NO: 154716 - protein, 38 aa, Glycine max
  Coding DNA Sequence Number=SeqID_37938
MIQIESPDRSLHDHIIEALGKLTVEQGIPYVTKKVMRN

SEQ ID NO: 154717 - protein, 39 aa, Glycine max
  Coding DNA Sequence Number=SeqID_37939
MKICYKEAKPCHNNSTKLKTLELKGTHPTNYAFAVVKII

SEQ ID NO: 154718 - protein, 159 aa, Glycine max
  Coding DNA Sequence Number=SeqID_37940
MVWPTTMPEHSTRQTSLERLEEAVNKLTQHQATLAQNHQTLTQANADLNSKLDSILDRLATLTTTRVFDAERLTVASFYMEGPALCWYQWISRNGFLTSWQAMLQALESRFAPSYYDDPYGALFKLQQRDTVNEYLSEFELLTNRIAGLAPPLLLSYFI

SEQ ID NO: 154719 - protein, 130 aa, Glycine max
  Coding DNA Sequence Number=SeqID_37941
  Gene Ontology: Mol. function=catalytic activity; Cellular component =nucleus; Biological process=regulation of transcription
  Homolog annotation: Hit_ID=Q6K7P2; Match level="QueryCoverage=55%, HitCoverage=30%, E-value=7e-33, Identity=94%"; Hit description =Transcription factor PCF3-like
GEARRSGAGAGSGDDGGFRLAEEPLDGLAVGLVAELARELEDAGGADDRHANAAPAAVDLAVAVLGRRFLDGEGGGGGGGGGGSLLYLNTLRRRRWNWAVVGGTMAATTIAKLVLLEFSESHGLRPAHRL

SEQ ID NO: 154720 - protein, 452 aa, Glycine max
  Coding DNA Sequence Number=SeqID_37942
  Gene Ontology: Mol. function=peroxidase activity; Cellular component =membrane; Biological process=response to oxidative stress
  Homolog annotation: Hit_ID=Q1RUM5; Match level="QueryCoverage=63%, HitCoverage=87%, E-value=1e-106, Identity=68%"; Hit description=Haem peroxidase, plant/fungal/bacterial
  Pfam annotation: Domain name=peroxidase; Domain location=43-292; Score=456.5; E_value=3.4e-134; Accession=PF00141.13; Description =Peroxidase
  Subcellular localization annotation: CTP_CleavageSite=24; ConfidenceScore=5.24e-01
MDNTSMLQMVSSLVLILSVSSLASASLKVGFYSSTCPSAEEIVRSTVNKAISDKAGIAAGLIRMHFHDCFVRGCDGSVLLASTPGNPVAERDNFANNPSLRGFEVIEEAKTQLEAACPQTVSCADILAFAARDSALKVGGINYDVPSGRRDGRISIADEVPRNLPAPTSTADELVSNFSRKGLSADEMVTLSGAHSIGVSHCSAFSKRLYSFNDTVTQDPSMDSSYAETLKSICPAPPSTTDSTVSLDPSTPIRLDNKYYEGLINHRGLLTSDQTLHTSQTTREMVQSNANNGASWAEKFAKAMVQMGSIEVLTGSDEREFFPLAAAMSNLCESGTPISNVQTLSFAPEPTAILYGVKLNGANYPLWSQVVEMFVAGRGKLGYLTGKTQDPSTNDASYERWTVENAIVKGWLIGAMETDVMNLFVCLRTTKSIWTDVSQTYYEGADRSVIYL

SEQ ID NO: 154721 - protein, 73 aa, Glycine max
  Coding DNA Sequence Number=SeqID_37943
  Gene Ontology: Mol. function=nucleic acid binding; Biological process= DNA integration
  Homolog annotation: Hit_ID=Q1S1E3; Match level="QueryCoverage=97%, HitCoverage=19%, E-value=2e-09, Identity=39%"; Hit description=Zinc finger, CCHC-type
MREGTTLEEHLDELNFVLIELCDIDVNMEDKDLAMILLATLPPSYKKFVSFVSVGKDYITLEEVKYNLYSREL

SEQ ID NO: 154722 - protein, 75 aa, Glycine max
  Coding DNA Sequence Number=SeqID_37944
MSRNFTDCLTMGVKYRSGQARVAPQQIDGPQTKLGCGMSIICLCVPSDTIVSERRKGVRNDHNLSLHVIGLAASG

SEQ ID NO: 154723 - protein, 90 aa, Glycine max
  Coding DNA Sequence Number=SeqID_37945
MQNPWVFAFLNEGGEFWVERNSPSPRFYVSRCRGARPSELSSPWRANPVFFFREDTGCLPAALPACPELGMGRRSIDHGPSLYSRPSLST

SEQ ID NO: 154724 - protein, 199 aa, Glycine max
  Coding DNA Sequence Number=SeqID_37946
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=3e-25, Identity=34%"; Hit description= UPI00006A17C9 related cluster
RTTLPPLLRVVCPCLQRTTRPPFQRATRPYLQWATRPPFRGLHGLTFKGLHALAIRGLHALAIRGLHILAFRGLHDLPFRGLHVHLFRGLHALAFKGLHIFTFRGLQVLIFRGLHAITFRWLHALTFRGLHVLAYIGLHILAFRGLHVLAFRGLHVPAFRGLHALSFRGLHALAFVGLHALSFIGLHICAFRELKVLRP

SEQ ID NO: 154725 - protein, 270 aa, Glycine max
  Coding DNA Sequence Number=SeqID_37947
  Gene Ontology: Mol. function=transferase activity; Biological process= metabolic process
  Homolog annotation: Hit_ID=Q1VUH4; Match level="QueryCoverage=45%, HitCoverage=43%, E-value=1e-35, Identity=55%"; Hit description =Inorganic polyphosphate/ATP-NAD kinase
  Pfam annotation: Domain name=NAD_kinase; Domain location=89-270; Score=7.5; E_value=5.8e-06; Accession=PF01513.11; Description=ATP -NAD kinase
MDSIRLFYTFNSNVIPVINKTEKYLGYIMCEDVFQDLSRYPLFSESGAILTVEAPARKYSMTEIANIVESNNSKFYGGFISFMSEEVVRVTIKISNENLASIDATFDRKFVSELESRGVKSVLYDEMAEALQFSKIFETFNNKQDLVEKEVDLFFTFGGDGTIVNSLTFIEDLEIPIVGVNTGRLGFLASFTKEEAFKELDAILKGDVKTSRRSVIEVVSPRSEEFFPYALNDVTVSRKETTSMITVDSFINDEFLNVFWGDGVIVSTPT

SEQ ID NO: 154726 - protein, 199 aa, Glycine max
  Coding DNA Sequence Number=SeqID_37948
  Gene Ontology: Mol. function=carbohydrate binding
  Homolog annotation: Hit_ID=Q1XWT9; Match level="QueryCoverage=85%, HitCoverage=37%, E-value=9e-19, Identity=34%"; Hit description =Hypothetical protein precursor
MKNLLVFGMLTSAFILSKAQNTYYPQAFFDKKLAQNMIGFGNSTIEGVASTKQKNNWGIKPLLGEKHYAPKGTVVMLFPVTPYFEEFYKMRKKYENKKTTVYMSDEAFKYRIEALTDDHGRFKFEKLKPGNYYLETIVNFTATASYQQQTGQSDAYNAYGGYLYSTPIYQTFFYNYSSANRESKFVEIKQDGELKEINL

SEQ ID NO: 154727 - protein, 311 aa, Glycine max
  Coding DNA Sequence Number=SeqID_37949
  Gene Ontology: Mol. function=deaminase activity; Cellular component =cellular_component; Biological process=purine ribonucleoside monophosphate biosynthetic process
  Homolog annotation: Hit_ID=Q1RV97; Match level="QueryCoverage=93%, HitCoverage=89%, E-value=1e-113, Identity=64%"; Hit description =Adenosine/AMP deaminase
  Pfam annotation: Domain name=A_deaminase; Domain location=4-289; Score=-8.8; E_value=2.2e-08; Accession=PF00962.12; Description =AdenosineAMP deaminase
MECELTKALIGKGVMNFSEVEHIILKYNRSLKEVFKLFDLIHILTTDHNTVTRITREVIEDFASENVVYLELRTTPKKNDSVGMSKHSYVEAVLKGLRSITSVDVDFIPHCEDSKTLFTPAPVINGHVRKKIFVRLLLSIDRRETTEAAMETVKLALEMRPYGVVGIDLSGNPSIGDWTTYLPALKFAREQGLYVTLHCGEVEICLTSNVRTMTVPSIDVHHFAHLYNAKHPLALCTDDSGVFSTCLSKEYKIAADSFGLGRREMFELSRNAVEHIFADSKVKEDLRKIFNSVAKKYGSVTTVSSLENICI

SEQ ID NO: 154728 - protein, 190 aa, Glycine max
  Coding DNA Sequence Number=SeqID_37950
  Gene Ontology: Mol. function=protein serine/threonine kinase activity; Cellular component=membrane; Biological process=protein amino acid phosphorylation
  Homolog annotation: Hit_ID=Q9LJU5; Match level="QueryCoverage=84%, HitCoverage=48%, E-value=6e-65, Identity=67%"; Hit description =Receptor protein kinase-like protein
MKIAEGAARGLEYLHNSAEPAIIYRDFKSSNILLDENFNPKLSDFGLAKIGPKDGQDHVSTRVMGTFGYCAPEYAASGRRVFDASRATEEQNLIEWAQPLFKDRTKFTLMADPLLKGQFPVKGLFQALAVAAMCLQEEADTRPYMDDVVTALAHLAVQRVEEKDTAGESVKCAGHVEYFKAISSAGSERA

SEQ ID NO: 154729 - protein, 105 aa, Glycine max
  Coding DNA Sequence Number=SeqID_37951
  Gene Ontology: Mol. function=ATP-dependent helicase activity
  Homolog annotation: Hit_ID=Q1SC30; Match level="QueryCoverage=67%, HitCoverage=10%, E-value=7e-19, Identity=66%"; Hit description =Helicase, C-terminal
  Subcellular localization annotation: CTP_CleavageSite=55; ConfidenceScore=5.34e-01
MYEATCRRGRRQPPCSVGRQSPQVFPPRHLSCGFGCACPTCSWQRASSTRDGPCRCGTRGQREAGPCGGYSKGSFANRARSRVGGNPPSPTHPIPLDVTNCVLRL

SEQ ID NO: 154730 - protein, 126 aa, Glycine max
  Coding DNA Sequence Number=SeqID_37952
MSEIEEIHEQMKADMKAMKKQMTIIMEAMISMRKMMEVNTATIIAARRQSVGKYGCPPFFCRFKTSIPSHHVDCLPTIHYPTLYTLSMIMSTTPHPYPLGANNPNLIMNMSLNLWGRHMKYPKATL

SEQ ID NO: 154731 - protein, 104 aa, Glycine max
  Coding DNA Sequence Number=SeqID_37953
VHPLWCKWRVHLLGLLAENKRGYISCGSVLVEGTSTRFKENKGGFSLNKAKRNYCTKPLLCVEEVEAKRALCAKLECHSDEAELSAACCAKLKLSSVLKIVDSG

SEQ ID NO: 154732 - protein, 47 aa, Glycine max
  Coding DNA Sequence Number=SeqID_37954
MELDLMGRVLVNSKVFLFVESSWRGSANQGAYFVAAKTHLMVARSSL

SEQ ID NO: 154733 - protein, 54 aa, Glycine max
  Coding DNA Sequence Number=SeqID_37955
NLMERIQKSTSSNNSQVWFHATSLASRDIILLGNNIVAVGTTNDNASPNEENSR

SEQ ID NO: 154734 - protein, 146 aa, Glycine max
  Coding DNA Sequence Number=SeqID_37956
MAQASGMLTWASWGLEKLRKRPFCPLPWYPFVFLIKTLRDHLLCAMITKDDDKGDDKKLKGQSKNEFKMFKIESITLQDSRGRLNSRIKNQDSRLKIQESRKGLIKISMKRFFQKLSSTWIFLKTCLPKSFYSLVIDYQIIVIDYQ

SEQ ID NO: 154735 - protein, 156 aa, Glycine max
  Coding DNA Sequence Number=SeqID_37957
MENEKKKCGCWAVLKRGIRGFKEIWKKPCTPVVSEKAMQGNLEKARPFWLLGGRVSFTFQIALLQGTEAKEEEGPCHMGAYMDKDLSHRHMTNSGNWILTVKTYLHNGCKDRDYFLHFNKIETNLKNGYKDKDQNAYSLFYFIKILNAFPQTVVVD

SEQ ID NO: 154736 - protein, 188 aa, Glycine max
  Coding DNA Sequence Number=SeqID_37958
MKDDEKRNVQDDQKAKNILTSGLSSDEFFCTARRYRKERKGIALKASSSKEDHKEGSIDDEDAENLNLIVKKIGKFLKRSKDKKISKPSKKVETNNNTFKCFECRKQGDASSIGACRPRIFFINGFLCFLEDEWQRNGERKRERRCHFKEKMSLEEAHHHRRPWIRAWRKKEMNEGRGREEHEILCSK

SEQ ID NO: 154737 - protein, 75 aa, Glycine max
  Coding DNA Sequence Number=SeqID_37959
MMLQTLDPLANVAPCRACRPWIFFINGVICFLKINDNGMEKEERDKLGAIDGPICIFARSSLRFDSFLSNVKSMY

SEQ ID NO: 154738 - protein, 264 aa, Glycine max
  Coding DNA Sequence Number=SeqID_37960
MTINWRTIQALENDFYTKDDIEEEVGFIAYVEVFSREEHKKKLDEDARLGALVGKVSKEIPKVVILESLKTLSIEEVHKKAANKAIMVDGELVFEEHGAKLIFADVVARQVEVEMDIILEDLDPEKKKALEEAMVWSIIEASLNEIEDSIIETNLGVAPVRPIPLSKTDERKKYKLDQQHAIKWLLPSRSLPPPSPLRVVPIEPDVNVRYYPCFKGYKVLEWHTCNRVWKENVDIGTHSSSRDATIGVRKTQSHQALEDRFSMY

SEQ ID NO: 154739 - protein, 237 aa, Glycine max
  Coding DNA Sequence Number=SeqID_37961
MVEHGRRPKFCHINMSLCVMVPPWWASLHKLPMAVGKKSATAFCHGGAMLQLRSCWKYANWDYVFPMNVKVEDLMKAGANLRAKLGLRPRTQNKKKFLTSWSDLPDHQLGWSIGEKAVSEQGLQLVELKFDMNYIKDFLLQMKNKKSSYIEEDNSVNKNEKPVEELEEIGESKEEKNFPLRSWVKKVELPAFEGNDPLGWLARQEKFFEVQKIEPSDKLKLASSTWRVTDRRGKGVC

SEQ ID NO: 154740 - protein, 198 aa, Glycine max
  Coding DNA Sequence Number=SeqID_37962
  Homolog annotation: Hit_ID=O82047; Match level="QueryCoverage=76%, HitCoverage=59%, E-value=4e-40, Identity=55%"; Hit description=PRIB5 protein
MVLPLSLPKSRQNVKKNVEYRAIRTHRKSIKLLTKKKVSVEYGLCEMMNSKAIRPNVAPKDGNMGFDVAVCEAMLPAEIVDKNVERMCKELPQWEESVLQAGARYQQLIKDLADKYPTENLLLVTHGEGVKVAVSSFKKDAEVNEVDYCGYVELRRPMFMKDHTFAAGEFDLLTTSGQTGVSYFLPRPLGSDTNQTLP

SEQ ID NO: 154741 - protein, 113 aa, Glycine max
  Coding DNA Sequence Number=SeqID_37963
MVILCLFSSRGGEPNDMRRQIMVIHTPFRHPETIKSDGMQRKIMVILCLLSSRGGEPDDMRRQIMRLTLSSAPFVIQGQRVGWWAEIPYGHLRISSTVRNEFGSVRMMLVVRC

SEQ ID NO: 154742 - protein, 399 aa, Glycine max
  Coding DNA Sequence Number=SeqID_37964
MGDFPWMPLVKQVEPTGGTVPSSTIAPVAREGGQPTVEVGLVIGAAEVAPSSPSSILAKMMRDDGARVSGRKKSRAPLSLRALRQATGLTPPTSTEVYAHVVATIVFLVAIIIVTLSPPSPHVVPIQVVTPAAKVRMLVASAGFVVAPSSIIVAPLLSVGVMTMSAHVMPPPSSLASPTLPFSVLVAVSPSSSSCPYLFGSPNAANSTKVFLKRSLAILKENAQRHQEALRKVASLEAKVTKWMATARMVWRQERPKVARATIAFIEVVKSNHQLSSKEQKDLDSQVEGIMAKQDELAKLVVDLEARLKESKSELRVAKERETKKKLEAKVIMYKKEAVEKHEKGFNKAIRQARFFTKDLDLGLFDPFKDVKNGVLLDKEDIATEEEAIEEQDADDANV

SEQ ID NO: 154743 - protein, 45 aa, Glycine max
  Coding DNA Sequence Number=SeqID_37965
MELASATSINRHLVPDAKKDVLYLAMLMHSYVVSGTARPRFLMIA

SEQ ID NO: 154744 - protein, 235 aa, Glycine max
  Coding DNA Sequence Number=SeqID_37966
  Subcellular localization annotation: CTP_CleavageSite=21; ConfidenceScore=5.03e-01
MLSIFSIYFPFIDESSDNQPRCFLVQMGSQNPRSTLGEFYWSFLQRARKTQGPPLVSPTGCFSKGLAKCKVCPSTRAPLQYVSLQEVTHMQEHSSCTTHTMLVKLKVLPCESYARARRVRCTHQARKTQVPPLVSLTGWLSKGSLNLRNSWYTRSSLVKPKVYPWPAYSSRTMMKTIKGPGSIRRTITRLIDKTFNQGKITLTPHEHQRRSSTKRKGSTIAGVTRPLIKLKSNMR

SEQ ID NO: 154745 - protein, 125 aa, Glycine max
  Coding DNA Sequence Number=SeqID_37967
MTGMEIVLSNEVKDNFQPFKELALNTVNIKRPLTNLEFNLKASNCWMSLGQILDEYMCLKEQKAMLDEQVEVTQEKTGFTCLGKAYKRLWMFTILFRSHPHPRSQRNKPFLINDRCCWIEWPQNN

SEQ ID NO: 154746 - protein, 577 aa, Glycine max
  Coding DNA Sequence Number=SeqID_37968
  Homolog annotation: Hit_ID=Q1SKD7; Match level="QueryCoverage=37%, HitCoverage=56%, E-value=2e-08, Identity=24%"; Hit description =Ankyrin
MHETLGFSSPGDIIEHKNIVSGPGSAKRQSLTGFEFLEKALSAACCAKSQMLTGLYNFKLGVKTPVVLSGIRDECTKCAYALSLFIATVKILDFQMNALSGPCCALSLTCTAKRHFACVSFPLNKAKRAKRTLCTKPECYSIEARERYTDIVVPQKLLPKRNVVVYYTEFDEFKEELERRHWDEKLTDFADSIIDIAIVKEFYANLYDPEDKSPKQVKVRGHLVKFDEDTLNTFLKTPVILEEGENLCTYSRFALLRPDPQELAAKLCIPGKGFKLNADGQPLKMLRKNMTTLAQTWSVLSFSNLIPTSHTFDVTLDRAKLIYGIIIKMDMNLGYLISHQISLIAQHDTSRLGFPALITTLCKARGVPTTSAPPETPAPSSSTAPVPSSAPVAWLGAQPSPSGGVGASTAQEPTLEEPEAVAEGEDELTPPKPFYFDADARMAQKEGTSTDQIHEPSPTPIPDDAIPSAPASELEHPISQDSPAAQPLEENEHVIGSMTENVSQFVRLIVKECINRILWAKRASTAKHSFSMLSTTEDSGRASISKSRAKREISALSAKVVFNQGGAKRSDTDSEPI

SEQ ID NO: 154747 - protein, 218 aa, Glycine max
  Coding DNA Sequence Number=SeqID_37969
  Gene Ontology: Mol. function=protein serine/threonine kinase activity; Biological process=protein amino acid phosphorylation
  Homolog annotation: Hit_ID=Q1RYW1; Match level="QueryCoverage=35%, HitCoverage=17%, E-value=6e-14, Identity=53%"; Hit description =Protein kinase
MKDGMQVAMKIQYTGVADSIDSGIENVKLLLNYTNLMPKGLYLDRAIKGTLPGGQDVVVKRISGISTQGLHEFKNEVILIAKLQHLNLVRLRGYCIKGDKDIKLWPCRVYNNLGEDFLDLNSFKKGVIIQYVKELDELRTQLVATRATADASVVSAQSVQLQCLQLLKTKELAQEWLHAEEWLQLKLKTKEFEANFYHKNIDIKIISNHISNVILLAV

SEQ ID NO: 154748 - protein, 80 aa, Glycine max
  Coding DNA Sequence Number=SeqID_37970
MKRVEKDAIGINLIDQRIKKEGGSLVAEGRVRLRKIVVVKVLVNNQDNMNRADLTHSKRLCRIGNQEEEEEGGGGGGGGV

SEQ ID NO: 154749 - protein, 71 aa, Glycine max
  Coding DNA Sequence Number=SeqID_37971
MPLRTLFLLPHQALIPEVSGIGSNGQIGSKNAISRSHRRPAYKTQVFINKETEAAAEPHRIGEGRREKDEK

SEQ ID NO: 154750 - protein, 311 aa, Glycine max
  Coding DNA Sequence Number=SeqID_37972
  Gene Ontology: Mol. function=DNA binding; Cellular component=nucleus; Biological process=DNA integration
MRISASIRGSILECYKVNDFMKAIDEQFERSKKALASNLMSKLSPMRLIESQEEGRLAQEISEGALTMTLDKGEKERKEKNRIPPIAKIKECLKGYRFYRPTHNTRIVESRNAKFIENDVASGSDLTQGIGLEKNQCEETVATSSYKLVVFCDTRQNRVTQAPHQVDPILEDQVEQHQTQNVEQPIEQHQTQDVKQPTKQQPKGVDVTLGRSTRIKKPTIPSYYQVYLQESEYDFGVENDPESFLQVINSCNCKLWCDAMKDELESMANDKVWDLVELLNGIKPIRCKWVFKTKKDSLGNIKRHKARLVTK

SEQ ID NO: 154751 - protein, 75 aa, Glycine max
  Coding DNA Sequence Number=SeqID_37973
  Homolog annotation: Hit_ID=Q9FGR0; Match level="QueryCoverage=65%, HitCoverage=3%, E-value=2e-07, Identity=69%"; Hit description =Probable cleavage and polyadenylation specificity factor 160 kDa subunit
MASSEKRKRTICKRAVVKVDPQGKCGGVLIYDLQVIILNATQINLSGCGLAVYGESNEGLLWEFCNPHKGGGLGL

SEQ ID NO: 154752 - protein, 48 aa, Glycine max
  Coding DNA Sequence Number=SeqID_37974
MASGASVKFLKTLEISSRNVSVTLSRHFREQICEDFPPFFIRSSFFNR

SEQ ID NO: 154753 - protein, 54 aa, Glycine max
  Coding DNA Sequence Number=SeqID_37975
MNREQICARKFISSPFDEVEIFVAFTMSRATTIMVPCVITVWPRWSWWQREKST

SEQ ID NO: 154754 - protein, 58 aa, Glycine max
  Coding DNA Sequence Number=SeqID_37976
MTEIPLATAAFNDVKCILHHRLKKLFLTANTLHKLHFAFLSQDSPSRIQISEVVFDDF

SEQ ID NO: 154755 - protein, 89 aa, Glycine max
  Coding DNA Sequence Number=SeqID_37977
  Subcellular localization annotation: CTP_CleavageSite=61; ConfidenceScore=5.47e-01
MSTAARSIQSIMLGKNTTSFLFTSFSLSSVTGIPNTSDNLGMDGECPEGKKGLVPPRGHPRIFSKSSSMSTSWKSLKALPSWISQTSKL

SEQ ID NO: 154756 - protein, 342 aa, Glycine max
  Coding DNA Sequence Number=SeqID_37978
FQLVLMLEDFEKILGCPLGGTKPFFPSGHSPSIPRLSEVLGIPVTELREKEVNRNEVVFFPSMIDWIDLAAVDMFLAYYYRRESPMVSILADVYCTLDSSWEKKSTRVICCFPALYVWMVSHFVMHNGMPTCPLEDFCMVPDKRKINWEELLASTTEVKLPKKTNGERVEIDVPIEQRRKECNRLRDVNMSKTEALEREMRRAKGEETNRRRYQGALSGNSNELKLRSAERDQTIAENVTLRDELKDCWESKESLKERLGMMEKSMLVIVDQYEVKMVRERQVLATIHGQAEVLALQGEREAGEEVIELLHQEKPLKLLARAKARADIYSALDEIHSLFDNY

SEQ ID NO: 154757 - protein, 85 aa, Glycine max
  Coding DNA Sequence Number=SeqID_37979
MASSLRIGHVERKPPTVLATSLNVAYRHFHWRHSQWTAAGVQATGVQDVQVQAAAFDFLGLGELPLALASYAKGDSPVALAIWAK

SEQ ID NO: 154758 - protein, 717 aa, Glycine max
  Coding DNA Sequence Number=SeqID_37980
  Gene Ontology: Mol. function=protein serine/threonine kinase activity; Biological process=protein amino acid phosphorylation
  Homolog annotation: Hit_ID=Q5N7S6; Match level="QueryCoverage=36%, HitCoverage=28%, E-value=5e-85, Identity=58%"; Hit description =Receptor serine/threonine kinase PR5K-like
  Pfam annotation: Domain name=Pkinase; Domain location=294-537; Score =107.5; E_value=3.8e-29; Accession=PF00069.15; Description=Protein kinase domain
  Pfam annotation: Domain name=Pkinase_Tyr; Domain location=295-540; Score=49.3; E_value=1.7e-15; Accession=PF07714.7; Description =Protein tyrosine kinase
  Pfam module annotation: Pfam domain module=Pkinase::Pkinase_Tyr; Domain location=294-537::295-540
MKNHAFGALFLSTLVLLVSTAKGKCPPSFVCGNLGTMHFPYTDTKHPHCGLLVIYGCDDRDNDTIKTIKNNGAWFYITRDQNNGTILFRDDKLRTLLLTRRCGVFSNNYTSLDTTSPFLSLHFMNLNLFICNSTLNVTPPSSVFSKSTICKDEDIFYRPTNMDDYYDYHYPYFEACSRVILPIRDSEIVPDNGNLFDYLSADIPVHAEVFHDCSSCYYLRGGRCQLDTQGKFFCAEATSVAGGLGILMVLACILRRYYFHKKNPTYLMIENFLKQHGHLSAKRYSYLEVKKMTNSFKNKLGQGGYGSVYKGRLQNGSLVAVKILSKLKGDGDEFINEVASISMTSHVNIVSLLGFCLEGSKRVLIYEYMPNGSLEKFIYEEKDPLKHKLTLNCRTMYNIVIGVARGLEYLHKGCNTKILHFDIKPHNILLDELFCPKISDFGLAKICPREKSIVSMMVARGTVGYIAPELFCRNFGGVSHKSDVYSYGMMVLEMLAILSSIQEMGLAKYEVEKFTGQNDFGLWRLKMRALLVQQGLVEALDGEAHSAIILSLGDNVLRQVSKETTAAGVWSKLEDLENIDVTIDDEDQALLLMCSLPKSYSHFKEILLFGRDSVSLDEVQAALNSKELNERKEKMSFRSGEGLTEGHTRKVCPERQKNGGSNNRKKDSGNAAIVQDDGYESVEALMVSEKNPETKWIMDSGCSWQPKEFYQKLSYGT

SEQ ID NO: 154759 - protein, 105 aa, Glycine max
  Coding DNA Sequence Number=SeqID_37981
  Homolog annotation: Hit_ID=Q6Q2Z9; Match level="QueryCoverage=74%, HitCoverage=7%, E-value=1e-26, Identity=77%"; Hit description =Phosphoenolpyruvate carboxylase
  Subcellular localization annotation: CTP_CleavageSite=32; ConfidenceScore=5.59e-01
MDGGGFLSSTTSKIANPNIQLPGTSSANSSASSSALGQKKLYAESQTGKSTFQKLLEPMLPQLPGIAPYRIVLGNVKDKVLLLIYRIVLGNVKDKYFLECWLVHG

SEQ ID NO: 154760 - protein, 42 aa, Glycine max
  Coding DNA Sequence Number=SeqID_37982
MEYYVLLEQGCEYKESSRILFFGGVLEANGPKNPRNLFQEYE

SEQ ID NO: 154761 - protein, 165 aa, Glycine max
  Coding DNA Sequence Number=SeqID_37983
  Gene Ontology: Mol. function=DNA binding; Biological process=RNA -dependent DNA replication
MEDLCLVPDVVIPPKFKVPDFNKYKGTTCPKNHLKVYYRKMGAYVKDEKLLMHFFQESLTGAAITWYTNLEPSRVHSWKDLMITFIRKYQYNFDMAPDWMQLQNMCKIVHESFKGFAQRWRDMASQVAPLMTEKEMISYANLLPYLLDNSMVAITPTKVPQPPFF

SEQ ID NO: 154762 - protein, 382 aa, Glycine max
  Coding DNA Sequence Number=SeqID_37984
  Gene Ontology: Mol. function=1-phosphatidylinositol-4-phosphate 5 -kinase activity; Cellular component=proteinaceous extracellular matrix; Biological process=phosphatidylinositol metabolic process
  Homolog annotation: Hit_ID=Q56YP2; Match level="QueryCoverage=91%, HitCoverage=49%, E-value=1e-153, Identity=68%"; Hit description =Phosphatidylinositol-4-phosphate 5-kinase 1 (EC 2.7.1.68) (AtPIP5K1) ...
  Homolog annotation: Hit description=(1-phosphatidylinositol-4 -phosphate kinase 1) (PtdIns(4)P-5-kinase 1)
  Pfam annotation: Domain name=MORN; Domain location=101-123; Score =34.3; E_value=4.3e-07; Accession=PF02493.10; Description=MORN repeat
  Pfam annotation: Domain name=MORN; Domain location=124-146; Score =28.7; E_value=2.1e-05; Accession=PF02493.10; Description=MORN repeat
  Pfam annotation: Domain name=MORN; Domain location=147-169; Score =26.1; E_value=0.00013; Accession=PF02493.10; Description=MORN repeat
  Pfam annotation: Domain name=MORN; Domain location=170-192; Score =36.7; E_value=8.2e-08; Accession=PF02493.10; Description=MORN repeat
  Pfam annotation: Domain name=MORN; Domain location=193-213; Score =12.7; E_value=0.13; Accession=PF02493.10; Description=MORN repeat
  Pfam annotation: Domain name=MORN; Domain location=55-77; Score=30.3; E_value=6.8e-06; Accession=PF02493.10; Description=MORN repeat
  Pfam annotation: Domain name=MORN; Domain location=78-100; Score =38.3; E_value=2.6e-08; Accession=PF02493.10; Description=MORN repeat
  Pfam module annotation: Pfam domain module=MORN::MORN::MORN::MORN::MOR N::MORN::MORN; Domain location=101-123::124-146::147-169::170 -192::193-213::55-77::78-100
  Subcellular localization annotation: CTP_CleavageSite=35; ConfidenceScore=5.60e-01
MREGDVAPALASPSPPVVVAGRSRSQGFTTRRVTPATAVDGSSAVERVLPNGDFYAGRFSGNVPHGSGKYLWTDGCMYEGEWKRGKASGKGKFSWPSGATYEGEFKSGRMEGFGTFVGSDGDTYRGSWSSDRKHGFGQKRYANGDLYEGWWKRNVQDGHGRYVWKNGNEYVGEWKNGVINGKGALLWANGNRYEGLWENGVPKGHGVMKIHHRLLWGENFNVKRFSVDGRGSVNNDKSFPRICIWESEGEAGDITCDIIDNVEASMFYRDGTTSDCEEKETRRNPCFSSEVKRPGETVSKGHKNYELMLNLQLGIRYTVGKEASTLRELKQSDFDPKEKFWTRFPAEGSKLTPPHQSAEFRWKDYCPVVFRHLRKLFQGGSC

SEQ ID NO: 154763 - protein, 696 aa, Glycine max
  Coding DNA Sequence Number=SeqID_37985
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=74%, HitCoverage=75%, E-value=1e-179, Identity=64%"; Hit description =Putative amino acid acetyltransferase
  Pfam annotation: Domain name=AA_kinase; Domain location=177-451; Score=-46.9; E_value=0.02; Accession=PF00696.18; Description=Amino acid kinase family
  Subcellular localization annotation: CTP_CleavageSite=48; ConfidenceScore=5.59e-01
MAVICPPSQGQTWLPHGPNSNYHFFSRGGVGRRSRSYCTFSSPKTKTNAFTVRGCGQDSVEDHHFVKALRESQPYISVHRGRLFVLLISAQLVAGPYFNPILKFVSDLCHQARTVSVLDLQLEWHVRPVTAAHLGNRKKLNALSEDGESSYHGSMEDKQFVRSFREAWPYLWAYRGSTFVVIISGEIVSGPFLDDIAFLNHLGIRFVLVPGTHVQIDKLLNERGCQPMYVGRYRITDDESLEAAMEAAGGIRLMIEAKLSPGPSICNIRRHGDNSRWHEVGVSVASGNFLAAKRRGVVNGIDFGSTGEVKKVDVTRMRERLDGGCVVVLTNLGYSSSGEVLNCKGKYRELNGTDFSAEYVNQNTTSVTNGTYEVATACALAIGADKLICIIDGPILDESGHLIRFLPLQEADMLIRKRAKQSDAAANYVKAVDEEGFNSLECNNFNGTVKSPPIGCFTEWHNATFHNGVGFENGNGLGSGEQGFAIGGQERLSRMNGYLSELAAAAFVCRVSPCFTFIFHDKEGKNLRASPGAAVKLCLGDLLVMGSNPETVSLHMQGVHLLDGTISGVLLLELFKRDGMGTMVASDLYEGTRTAEVKDISGIKQLIHPLEASGILVKRTDEELLKTLDSFVVVEREGHIIACAAIFPHFEEKCGEVACIAVSPDCRGQGQGDKLLVFDVYADSFDVKTTVNLMSW

SEQ ID NO: 154764 - protein, 73 aa, Glycine max
  Coding DNA Sequence Number=SeqID_37986
MAQALRADEYLHRVIDSNDCYECSPTCPPMPAPDRHFANSNDVPRKRGSSKTVFLEEEDHRHEERIESSRTKF

SEQ ID NO: 154765 - protein, 205 aa, Glycine max
  Coding DNA Sequence Number=SeqID_37987
  Gene Ontology: Mol. function=DNA binding; Cellular component =nucleosome; Biological process=chromosome organization and biogenesis (sensu Eukaryota)
  Homolog annotation: Hit_ID=Q0PJG6; Match level="QueryCoverage=58%, HitCoverage=39%, E-value=1e-56, Identity=95%"; Hit description=MYB transcription factor MYB130
  Pfam annotation: Domain name=Linker_histone; Domain location=35-97; Score=28.0; E_value=1.6e-05; Accession=PF00538.9; Description=linker histone H1 and H5 family
MTLHQTWQRYTENMIHYSVTYVDIPIAVTNNWLDNLILESIIKLKEPRGSDKAAIAAYIEDQYCSTPTLRKLLSTKLKHMVACGKLMKVKHKYRIATNLTISEKRRCSSLVLLEGRPKDSPKAEKTGVHILSKSEIDAELSKMKGVTPQEAAAAAAKAVAEAEAAIAEAEAAAREADAAEAEAEAARVFAKAAMKALKCKTLRVW

SEQ ID NO: 154766 - protein, 222 aa, Glycine max
  Coding DNA Sequence Number=SeqID_37988
  Gene Ontology: Mol. function=catalytic activity; Cellular component =nucleus; Biological process=cell redox homeostasis
  Homolog annotation: Hit_ID=Q69MT1; Match level="QueryCoverage=69%, HitCoverage=33%, E-value=2e-51, Identity=60%"; Hit description=Acyl -CoA thioester hydrolase-like
  Pfam annotation: Domain name=4HBT; Domain location=137-222; Score =16.5; E_value=0.0074; Accession=PF03061.12; Description=Thioesterase superfamily
  Subcellular localization annotation: CTP_CleavageSite=63; ConfidenceScore=5.55e-01
MHPFRNPKPCLSLFHHLFRFRITPTTNSPYPTIPSNHFSTDSSTAYPTTTTTTTTTKTTTSVSIDAGSSNRKPISLWPGMFHSPAIYALWEARSSVFENPVLSNGPSVPKTPSRSRTCIFYNFSEDHMIREQYRNPWNHIRMGKLVEDFDALAGTVAFKHCSNEDGTARPLLLVTASVDKMVLKKAIHIDADLTIVGAVTWVGRSSMEIQLELTQSEQGAAG

SEQ ID NO: 154767 - protein, 880 aa, Glycine max
  Coding DNA Sequence Number=SeqID_37989
  Gene Ontology: Mol. function=actin binding; Cellular component =phragmoplast; Biological process=actin cytoskeleton organization and biogenesis
  Homolog annotation: Hit_ID=Q9SE97; Match level="QueryCoverage=54%, HitCoverage=43%, E-value=1e-166, Identity=64%"; Hit description =Formin-like protein AHF1
  Pfam annotation: Domain name=Extensin_2; Domain location=4-402; Score= -138.3; E_value=0.067; Accession=PF04554.4; Description=Extensin-like region
  Pfam annotation: Domain name=FH2; Domain location=416-833; Score =541.0; E_value=1.3e-159; Accession=PF02181.13; Description=Formin Homology 2 Domain
  Pfam module annotation: Pfam domain module=Extensin_2::FH2; Domain location=4-402::416-833
  Subcellular localization annotation: CTP_CleavageSite=41; ConfidenceScore=5.01e-01
MCATFNILVLLLSLLLTSSSSFLQPRRVLHQPLFPTISVPPAEAPSYLPPEPQPKQQHQPKIPFSSISSSSPPPPQKPFFPSYHSPPLPPSPAVVATFPANISSLLLPHPVSRHHRSAAALAVSLSLCSLALLAAVVAFLLHHHRRTHSSSDDNDDDKASRSDSLRLFPPNTDASDGADRKPHDKASPTSELLYLGTVANSVITTTTTTTTTTIDSSSSHHEIFRPAYQKFGDSPELNPLPPLPRHKFKPWTTEEQNNDKDVTEKEKEEEEEEEFFSPTGSSGGNINKQQQSPPSPSALASASSSRVFHVDKFGSRSFTSRTPSHPRSNSLSFSRSPSLNFSPASVKSLPPNTNLASPSFSSSSSSPREEWNVPSHGKNSPATTTLPTPPPPPPPPPPPPQFWETPVDKSVTFRNESEETPKPKLKALHWDKVKASSDRVMVWDRLRPSSFQLNEDMIETLFMVNNHNNFKEGFGVAIRDNNNPRRQMVHSASPMPLENRVLDPKKSQNIAILLRALNVTIDEVCDALREGNCDTLGTELLESLLKMAPTKDEESKLKEFQDESSFKLGPAEKFLKAVLDIPFAFKRVDAMLYIANFDSELEYLKKSFETLEVACEELRSSRMFLKILEAVLRTGNRMNVGTNRGDAHAFKLDTLLKLVDIKGTDGKTTLLHFVVQEIVRTEGSHISGSNHPHASDNGHQYTLQDEVDFKKLGLQVVSGLSGELTNVKKAAAMDSDVLSSDVAKLSRGIEKVVQVVKLNEELPLKETNKKFSDAMKGFLERGEQELSTIQAQEKNALSSVKEITQYFHGNSAKEEAHPFRIFMVVRDFLSILDGVCKEVGKVNERTLVGSRQSVMPANSIMQTFFPEIIGKQPSDSSESD

SEQ ID NO: 154768 - protein, 67 aa, Glycine max
  Coding DNA Sequence Number=SeqID_37990
MTNDGARAAPDNFDRAAAHLAVAQLCDAARFHGATALALNAFADVVVHYLLDLGRTAEFHANRVDRT

SEQ ID NO: 154769 - protein, 126 aa, Glycine max
  Coding DNA Sequence Number=SeqID_37991
MIVAATTMITVAAITISITATTTRQCRRECSHFRYHYDDDHHHQSPPLQSPSSSTVTTSVTTVVVVVATATNGVTTTNTTTSVVAVTTVVVAKDNYDGDCSSVHDSCDKNDHDGGDGHGDDRCEIF

SEQ ID NO: 154770 - protein, 387 aa, Glycine max
  Coding DNA Sequence Number=SeqID_37992
  Gene Ontology: Mol. function=phosphatidylcholine-sterol O -acyltransferase activity; Cellular component=integral to membrane; Biological process=lipid metabolic process
  Homolog annotation: Hit_ID=Q10PI5; Match level="QueryCoverage=95%, HitCoverage=94%, E-value=1e-150, Identity=64%"; Hit description =Haemolysin-III related family protein, expressed
  Pfam annotation: Domain name=HlyIII; Domain location=60-372; Score =185.6; E_value=1.2e-52; Accession=PF03006.10; Description=Haemolysin- III related
MGGEELCLMENSGKGKRLWKKVKYQLVEYHSLPGYLRDNEYILGHYRSEWPIRQVLLSAFTIHNETLNVWTKLMHMALTILSLVRRKAVSAIRTHDQRHLIGFFIFLALTIYTAMNLNSLQQFPDMLKKADLHKLQSEILTCLPSMPDLHILREGISSWHIKEYLYNCLPHSVKDDLANIIAPLMIRPITRWPFFAFLGGAMFCLLASSICHLLSCHSARMAYIMLRLDYAGIAALISTSFYPPVYYSFMCYPFFCNLYLGFITVLGISTILFSLLPVFQNPEFRTIRASLFFGMGLSGAAPILHKLYLFWGQPEVFHTTGYEILMGVLYGIGALVYATRIPERWMPGKFDIAGHSHQLFHILVVAGAYAHYRAGLVYLRWRDLQGC

SEQ ID NO: 154771 - protein, 181 aa, Glycine max
  Coding DNA Sequence Number=SeqID_37993
MAMAGTHARQSAWILRLLCLWASAVLVFADEHSLCLTQNATLQLSRGLPVGNSPGSKPGATVIVERVHIHGLSRFRNLGKFAHSIKVKVLPLPTNSNVRLPNIENLKNDHCNWFNTFLYALFRNVSLVAGMCRHGQWEKVTKGSWARSMSLFDHKILDVRTAGSTLENFEVSVEEGNIFVP

SEQ ID NO: 154772 - protein, 78 aa, Glycine max
  Coding DNA Sequence Number=SeqID_37994
MESEEFIYNPSSFSISSFPIRFWNMKKIMQRKKWVQWSKIQGSGPTCVNDEGISTYAFSSIRRQMIHIIMPMFPTEDP

SEQ ID NO: 154773 - protein, 157 aa, Glycine max
  Coding DNA Sequence Number=SeqID_37995
  Gene Ontology: Mol. function=ribonuclease H activity; Cellular component=nucleus; Biological process=RNA-dependent DNA replication
  Homolog annotation: Hit_ID=Q1RYI2; Match level="QueryCoverage=74%, HitCoverage=18%, E-value=1e-16, Identity=35%"; Hit description =Ribonuclease H
  Pfam annotation: Domain name=RnaseH; Domain location=25-152; Score =8.4; E_value=9.5e-06; Accession=PF00075.14; Description=RNase H
MEKTIEGYKRNFQVKGITRNIQLNSKKVCPIVDGAHNHLTGRAAYGVVVRNDSDAMIFAFSSNIGNCNFLRAELWGILKGLTIARDRGFNYIVVESDSKIAIKLITYGCPTIHSNYNLVQQIKEIVDSRLEVTFSHIFREANQTTDALAKAWDAKCF

SEQ ID NO: 154774 - protein, 68 aa, Glycine max
  Coding DNA Sequence Number=SeqID_37996
  Gene Ontology: Cellular component=integral to membrane
  Homolog annotation: Hit_ID=Q1S566; Match level="QueryCoverage=65%, HitCoverage=14%, E-value=1e-13, Identity=71%"; Hit description =GNS1/SUR4 membrane protein
MQMQKGAERKRAYDVVGRRAQFSTCEGNARGRKHRTRRKHDHRDTSQGGNIAATGAGSCSAARATASL

SEQ ID NO: 154775 - protein, 449 aa, Glycine max
  Coding DNA Sequence Number=SeqID_37997
  Gene Ontology: Mol. function=ubiquitin-protein ligase activity; Cellular component=ubiquitin ligase complex; Biological process =protein ubiquitination
  Homolog annotation: Hit_ID=Q84QD5; Match level="QueryCoverage=83%, HitCoverage=90%, E-value=8e-42, Identity=30%"; Hit description =Avr9/Cf-9 rapidly elicited protein 74
  Pfam annotation: Domain name=Arm; Domain location=305-345; Score =17.6; E_value=0.046; Accession=PF00514.13; Description=Armadillobeta- catenin-like repeat
  Pfam annotation: Domain name=Arm; Domain location=346-387; Score=3.1; E_value=5; Accession=PF00514.13; Description=Armadillobeta-catenin -like repeat
  Pfam annotation: Domain name=U-box; Domain location=64-138; Score =45.7; E_value=1.6e-10; Accession=PF04564.6; Description=U-box domain
  Pfam module annotation: Pfam domain module=Arm::Arm::U-box; Domain location=305-345::346-387::64-138
MPMFQPCRKDLVAGYEGGGDGQILDLDTAVKDGVLGGVEGGVLGGGVGEKVDLGKMIEELELCEVPSVFICPISLEPMQDPVTLCTGQTYERSNILKWFNLGHFTCPTTMQELWDDSVTPNTTLYRLIHMWFSQKYLLMKKRSEDVQGRASELLETLKKVKSQARVQALKELHQLVASHATARKTVIDEGGVSVVSSLLGPFTSHAVGSEVIGILVTLTLDSESRKNLLQPAKVSLMVDILNEGSIETKINCTRLIESLIEEKDFRSEVILSHSLLVGLMRLVKDKRHNNGVCPGLSLLRTICLHKEVRNLLVSIGAVSQLVELLSGMEPDCLELALCVLDALASVPEGRVALKDCSNTIPIMVKLLMRISENCTQYALSILWSVCKLSPEECSSIAVDAGLAAKLLLVIQSGCNPILKQQSAELLKLCSLNYSDTIFLSKCKLTRTIQ

SEQ ID NO: 154776 - protein, 144 aa, Glycine max
  Coding DNA Sequence Number=SeqID_37998
MIRAIHQGFDLKNITHKYYPDPGPKKKENLNKELKKSSTINIHKQKEIKRERELGKSEKSNIRSDVSSVGACRPRIFFINRFLCFLEDEWQWNGERKRERRCHFKEKMSLEEAHHHRRPWIRAWRKKEMNEGRGREEHEILCSK

SEQ ID NO: 154777 - protein, 112 aa, Glycine max
  Coding DNA Sequence Number=SeqID_37999
  Pfam annotation: Domain name=DUF296; Domain location=8-98; Score= -9.5; E_value=0.0032; Accession=PF03479.5; Description=Domain of unknown function (DUF296)
MKVCKKPGEEGARDIYTGEDVLSLFELCYQYGFWVGWFKMLSLSRSFTVADNSGMKSRTGGLSVSLAGPDGWVIGGGVVGLLTVVGWPHPSSIFNPYENYILSKNPKIKENF

SEQ ID NO: 154778 - protein, 105 aa, Glycine max
  Coding DNA Sequence Number=SeqID_38000
MTLSHHSKLIDQDACQGNWGGVIHYSSRESRNGVDTREYGAMRGSGDVQFWMSKNCRYSGKFKLGWAVMVSGIAACKGTVWDHYGEVIRSYSFKLGRCSIIPSVL

SEQ ID NO: 154779 - protein, 72 aa, Glycine max
  Coding DNA Sequence Number=SeqID_38001
MGMHLSNWGGEGAEFKGFNIFCTKFSLEISEEKKKEGENPSRGAVVMLPRRFCDRFFAVLRSFFVVLRSSTG

SEQ ID NO: 154780 - protein, 35 aa, Glycine max
  Coding DNA Sequence Number=SeqID_38002
MGVKRLKVTNQGALFTEVHGQVAIVAMVGLTLTME

SEQ ID NO: 154781 - protein, 121 aa, Glycine max
  Coding DNA Sequence Number=SeqID_38003
  Gene Ontology: Mol. function=nucleic acid binding; Biological process= DNA integration
  Pfam annotation: Domain name=zf-CCHC; Domain location=96-113; Score =10.7; E_value=0.017; Accession=PF00098.13; Description=Zinc knuckle
MKYKGKGNIREYAMEMSNLASKFKSLKLELDEDMLAHLVLISLHAQFGQFKEERLQRDRIETAHLTPTYKNKNRKKTKDVVEESSQQRKQRKVHELTCCFCKKSTHMKKECLKYATWHVKK

SEQ ID NO: 154782 - protein, 78 aa, Glycine max
  Coding DNA Sequence Number=SeqID_38004
MGAKHLTRTKEWSHVIEQRSPDEIRPHELIVVHASSTNESGATRSDCLVQFSILHFYSEPHELTVIHASSTNESGATR

SEQ ID NO: 154783 - protein, 82 aa, Glycine max
  Coding DNA Sequence Number=SeqID_38005
MACSVFASCPYFRDLHGRELKGLLVIIPKVVICLLMVSRGIIPFEEHIAAGDAGLTGASSKGGKCAESPPTFIRGKRRKNRK

SEQ ID NO: 154784 - protein, 153 aa, Glycine max
  Coding DNA Sequence Number=SeqID_38006
MANNVFEVNEEGPVKGTGTDGAGKGAAIEEDGTIVEGAVERGISEDGGVEVDGVVEFFFIYAKLMAGLRLSKDLESDVTPLALHKVVIKVGNPSLEESCWAMIETWWEMRDQVGVRKNTPSLSMCGHVLPEDLQRLTISIKLKSPPWDAELSS

SEQ ID NO: 154785 - protein, 360 aa, Glycine max
  Coding DNA Sequence Number=SeqID_38007
  Gene Ontology: Mol. function=binding; Cellular component=ubiquitin ligase complex; Biological process=protein ubiquitination
  Homolog annotation: Hit_ID=Q1SXA3; Match level="QueryCoverage=91%, HitCoverage=72%, E-value=1e-29, Identity=32%"; Hit description=IMP dehydrogenase/GMP reductase
MLLQKCVKKLHFGSWEEKEVAAKVIEEGLAKQDVKVREMASELGVVRVLVSMAVSEVASRRRVGLRALIHLSNGGNHRNKVLILEAGISSKLPKKIDLEDESISEFAHLLSSLSSLGNIQFRHSSLHFLQFLIDILKSCSSFDTKQSCLVALCNISSLLENAGPLVSNGVVPILLEMSLMKGRTSEKALTILGNLGVTLIGKKAIENSSMVPKCLIEILTWEDKPKCQEFSSYILVILAHKSSTQREKMLQSGIVPVLLEVALVGSSLAQKSALKLLQCFKDERKIKMGPHSGPQTSRTAKESIVKQRDTKEGKRMMKKIVVESLHKNMEIITKRAHGAEDDSNKLKSLVINTSSKSLPY

SEQ ID NO: 154786 - protein, 93 aa, Glycine max
  Coding DNA Sequence Number=SeqID_38008
DIVAPNSIVIVEDEEAPNDVVAAPKIEELVAPDAGAGEEEKAKENFLHPSFVFLYKLQILLEYLLVPVSIYTTVHGLPLFMLCANGRRLRECA

SEQ ID NO: 154787 - protein, 165 aa, Glycine max
  Coding DNA Sequence Number=SeqID_38009
  Homolog annotation: Hit_ID=Q10L49; Match level="QueryCoverage=81%, HitCoverage=22%, E-value=3e-35, Identity=61%"; Hit description =Expressed protein
MLGCFAGKCSGSIRSIVRHPERPVIASYGRSITLISTCGKRNSPLQVEHTKGRIWRQIIYFPIVQLKDTRGYTLKWSHYLPSPFPEDTSLPCVIYCHGNKCRADANEAAVILLPSNITVFTLDFSGSGLFDGDYVSLGWHEKDDLKMEVSYLRSNKQISRIGLWG

SEQ ID NO: 154788 - protein, 384 aa, Glycine max
  Coding DNA Sequence Number=SeqID_38010
  Gene Ontology: Mol. function=nucleic acid binding; Cellular component= ribonucleoprotein complex
  Homolog annotation: Hit_ID=Q9LKA4; Match level="QueryCoverage=54%, HitCoverage=53%, E-value=1e-76, Identity=56%"; Hit description =Similarity to RNA-binding protein
  Pfam annotation: Domain name=RRM_1; Domain location=177-247; Score =46.6; E_value=8.5e-11; Accession=PF00076.12; Description=RNA recognition motif. (a.k.a. RRM, R
  Pfam annotation: Domain name=RRM_1; Domain location=89-159; Score =62.0; E_value=1.9e-15; Accession=PF00076.12; Description=RNA recognition motif. (a.k.a. RRM, R
  Pfam module annotation: Pfam domain module=RRM_1::RRM_1; Domain location=177-247::89-159
MEFPKKRKTQENGDTTTDSPPPQSTEEAPLAAATPAPASPLASEDIRKILQPFSQEQLLDLLQSASLRHPDVLDAVRAVADCDSTLRKLFVRGLAGETTTETLRSVFSGFGELDEAIVIMDKATGRSKGYGFVVFRHVDGAILALKDPSKKIDGRMTVTQLAAAGGPGGGDVSLRKVFVGNVPFEISSERLLDEFLKFGEVEEGPLGFDKSSGKSRGFAFFVYKTEEGARASLVEPLKTIEGHQVICKLAVDNKKTKPFGTDQHQHQQQHPQQQMQQQVSMMVPQYGGYGGNGYGMQQQQHQVPPYNNQVPVAGGGGYGHRYGNSQMAGPVSGDYGARVPPNSGGGYPDGSQYGFPPSSGHPPQPRVPMARPPGGMYQGAPPYY

SEQ ID NO: 154789 - protein, 121 aa, Glycine max
  Coding DNA Sequence Number=SeqID_38011
  Gene Ontology: Mol. function=transcription regulator activity; Cellular component=nucleus; Biological process=regulation of transcription
  Homolog annotation: Hit_ID=Q1SVR0; Match level="QueryCoverage=76%, HitCoverage=35%, E-value=1e-16, Identity=45%"; Hit description=Helix- loop-helix DNA-binding
MDKATLLAEVISQVKELKKNAAEVSKGFLIPKDADEVKVEPYNDHEGGEGSMSYSATICCDFRPEILSDLRQTLDSLPLHLVKAEISTLAGTMFCDGKGFCLTGFLTKNITCKQEEKTMLY

SEQ ID NO: 154790 - protein, 75 aa, Glycine max
  Coding DNA Sequence Number=SeqID_38012
MFLVFNTALKGLDDTPQPKSNAGARWIVVKYNRQKGSTVCGYYIMHWISTIILRTYRNNWETVKFWVFSKNEESI

SEQ ID NO: 154791 - protein, 107 aa, Glycine max
  Coding DNA Sequence Number=SeqID_38013
  Gene Ontology: Mol. function=cysteine-type endopeptidase activity; Cellular component=vacuole; Biological process=proteolysis
  Homolog annotation: Hit_ID=Q9STL4; Match level="QueryCoverage=81%, HitCoverage=23%, E-value=5e-23, Identity=57%"; Hit description =Cysteine endopeptidase-like protein
  Pfam annotation: Domain name=Peptidase_C1; Domain location=1-100; Score=-84.1; E_value=1.2e-05; Accession=PF00112.13; Description =Papain family cysteine protease
MSQQLLKEVARPPVIVGIDANGQAFRFYSGGVFTGENCGTNLNHAVTAIGYNEDANGKYWLIRNSWGQHWGEGGYMKIKRDTGDPAVRQCSIYETMILAQFIYVSHI

SEQ ID NO: 154792 - protein, 502 aa, Glycine max
  Coding DNA Sequence Number=SeqID_38014
  Gene Ontology: Mol. function=RNA binding; Cellular component =ribonucleoprotein complex; Biological process=gynoecium development
  Homolog annotation: Hit_ID=Q58T16; Match level="QueryCoverage=85%, HitCoverage=72%, E-value=1e-114, Identity=53%"; Hit description=FLK
  Pfam annotation: Domain name=KH_1; Domain location=138-200; Score =56.9; E_value=6.6e-14; Accession=PF00013.19; Description=KH domain
  Pfam annotation: Domain name=KH_1; Domain location=229-296; Score =64.2; E_value=4.3e-16; Accession=PF00013.19; Description=KH domain
  Pfam annotation: Domain name=KH_1; Domain location=417-479; Score =63.4; E_value=7.4e-16; Accession=PF00013.19; Description=KH domain
  Pfam module annotation: Pfam domain module=KH_1::KH_1::KH_1; Domain location=138-200::229-296::417-479
MSGEVFDGQDAGYVPENPEFPQNHSDEHDGGNVIDDSGFPQLQPDEHDAGGFPQLQLQPDEHEGGNLAEDANHPEHNFDGNDVEGLPGPDFPPQEHAEEQHVGGDVTENFASEEKQEPEEDLKGGEVKKWPGWPGENVFRMLVPVQKVGSIIGRKGEFIRKITEETKARIKILDGPPGTAERAVMVSAKEEPDCSIPPAVDGLLRVHKQVVNVDPHPADSASGAGRPVVTRLLVADTQAGSLIGKQGSTIKSFQDATGCNIRILGSEHLPVFALRDDSVVEIQGESSGVHKAVELVAIHLRKFLVDRSIVVVFETQMQRPDVRVNQNVPPGPPHQPWGPPQGFQAPGPGSGGGPAFPPNPQYMPPSHNYDNYYPPADLPPMDKHLHQGPAPAYVRDASMGIHSSSAQPQQSVVTKVTQHMQIPLSYADAVIGASGANISYIRRASGASITIQETRGVPGEMTVEISGTASQIQAAQQLVQVFHFKGLLHSSNLHVSYLIVIV

SEQ ID NO: 154793 - protein, 148 aa, Glycine max
  Coding DNA Sequence Number=SeqID_38015
  Subcellular localization annotation: CTP_CleavageSite=33; ConfidenceScore=5.13e-01
MLDAPSNSPTTSMLTLSLGPRWWWHQKVPPPLKEALVVASFLAFFGSSGFLLPLLRQGHCEPSAKLLLLLCEQGFEDSNLRVEDAGKNGERGLTAAASRRSVRGSSGSLPEHLFRKVSGISSSSGRIPEEGFFWMTFEISGRTFRKKC

SEQ ID NO: 154794 - protein, 289 aa, Glycine max
  Coding DNA Sequence Number=SeqID_38016
  Gene Ontology: Mol. function=nucleic acid binding
  Homolog annotation: Hit_ID=Q4PT05; Match level="QueryCoverage=73%, HitCoverage=83%, E-value=6e-28, Identity=38%"; Hit description =Putative RNA-binding protein
  Pfam annotation: Domain name=RRM_2; Domain location=122-235; Score =72.8; E_value=1.1e-18; Accession=PF04059.3; Description=RNA recognition motif 2
MSTACSPLQVILLQTCIMLSQYPYDYLLNPNAQLYNSTPSNQVFYDPRFISQYYVPPSFGFYPNFPFHAPITYDQNVKTDKAWASVRGRKLPAESNARALRNRAQAVPFPNTIQEAETYSITTVMIRNIPNQFKFEDLLLILDEHCFQQNKSAEDTKAWSKFDFVYLPMDYRKHAIEKRMSNLGYAFVNFTTPTAAFKFYSEFQGFEWDVTKNKKICEINVAQHQGKANLKRIFQAKVFKCESRDFLPVLYSRGRDGLNRRIKRNYVGKHVWGLPRRTLGTSSFNPNDV

SEQ ID NO: 154795 - protein, 92 aa, Glycine max
  Coding DNA Sequence Number=SeqID_38017
MKQNNSGTEQSKEANMSRLARNGDRFTRKCPRRSHELSKTMESQGCKVGGHQLSQLARKCWEMLEMLHGRMGVCRKGEQLALLHNRLTEAHK

SEQ ID NO: 154796 - protein, 477 aa, Glycine max
  Coding DNA Sequence Number=SeqID_38018
  Homolog annotation: Hit_ID=P08283; Match level="QueryCoverage=15%, HitCoverage=28%, E-value=9e-18, Identity=64%"; Hit description =Histone H1
  Pfam annotation: Domain name=Linker_histone; Domain location=54-123; Score=120.7; E_value=4.1e-33; Accession=PF00538.9; Description =linker histone H1 and H5 family
MASEEPTVAVEPAPEPATAEPPPEEKEEPKPEAKAKKTKEPKPKKVSRPRNPPTHPSYEEMIKDAITSLKEKTGSSQHAIAKFIEEKHKQLPPNFRKLLLYHLKKLVAAGKLVKVKGSFKLPPTRPSASSSSSPAKKKKPAPAKPQPKPKPKPKPKPAAKAKDTKATKSKAPAKPKAAAKPKAKVPAKPKPAPKPKAAAAAASKPKPAAAKPKGTKPAAKPKPKPAAKTKAAAAKPAAKPKAKPAKASRTSTRTSPGKKAAPAAKPAAKKVAPAKKAPVKSVKPKSVKSPAKKATAKRGAYYDNNGGGPPCDMSGGSVYHLVDVHVCGGACNHDISENGVPFAVATRLSPRGTFLAVQCYTWFVGPDAGVMFDPFDQQLHRSQLCGRGLVTLVGWTVHSPSSAKLRGSSDNAGFEASTSRNKGGEEQRKAERRGTLLFSFMPDLLSGTIPNQAIYDIGGAAYAEHEIPELPSSIVSK

SEQ ID NO: 154797 - protein, 93 aa, Glycine max
  Coding DNA Sequence Number=SeqID_38019
MQIWWLQNRGEWERMSRPKTKLGKNTTTDANLVAPKQRRMRERQDSKHSWENTITDLVVRHKLCPRNVNSNDFMSWLAILITMQSTEDLTVNL

SEQ ID NO: 154798 - protein, 111 aa, Glycine max
  Coding DNA Sequence Number=SeqID_38020
MESGFQLLMQSGWRSRWTLPLCGCVWGETKVSMTERERVLFPVFVNPEATTQDLVRKEKMRMFHKMGYGATVVDECTCMAKIKDMDLCLEFIDTYVYTTTMTLSVKNFNRY

SEQ ID NO: 154799 - protein, 459 aa, Glycine max
  Coding DNA Sequence Number=SeqID_38021
  Gene Ontology: Mol. function=transferase activity; Biological process= metabolic process
  Homolog annotation: Hit_ID=Q9FHP1; Match level="QueryCoverage=98%, HitCoverage=98%, E-value=1e-117, Identity=49%"; Hit description =Uridylyl transferases-like
  Pfam annotation: Domain name=ACT; Domain location=135-207; Score =27.3; E_value=5.4e-05; Accession=PF01842.15; Description=ACT domain
  Pfam annotation: Domain name=ACT; Domain location=266-338; Score =15.7; E_value=0.037; Accession=PF01842.15; Description=ACT domain
  Pfam annotation: Domain name=ACT; Domain location=345-411; Score =33.7; E_value=6.4e-07; Accession=PF01842.15; Description=ACT domain
  Pfam annotation: Domain name=ACT; Domain location=36-99; Score=14.9; E_value=0.047; Accession=PF01842.15; Description=ACT domain
  Pfam module annotation: Pfam domain module=ACT::ACT::ACT::ACT; Domain location=135-207::266-338::345-411::36-99
MEICYHAHIDREIESLLERIHPPRVCIDNDSCRDCTVVKVDSANRKGILLEMVQVLTDLDLIISKSYISSDGGWCMDVFHVTDEAGKKLTDETLMLHIQQELCATRSKGEISRDTELASQKGAQAQQQNVAMENTALEMSVTDRAGLLSELSAVLVELGYSVTSATAWTHNDRVACIIFLEDASSPGPISDPKRLGLVEEQLENVVAAHGETGQKNSVRVTTLGTGRTHTERRLHQLMYADRDYESCRACDRTHVSVGRCEDKGYLVVNVRSRDRPKLLFDTVCVLTDMQYVVFHAAISSKRSMADQEYFIRHCKGSLALPSESETEELTLCLIAAIERRVSRGLMVDIRTENRMGLLSNVTRVFRENGLSISRFEIGTEGEKAVGSFFVTDSSGEQVNPNIVELVRQASGGSVVTDHKSPHRVRQSQSDIEAKPKFSLGSLLWSRLERLSGGFGPIRS

SEQ ID NO: 154800 - protein, 108 aa, Glycine max
  Coding DNA Sequence Number=SeqID_38022
  Gene Ontology: Mol. function=protein binding; Cellular component=Cul3- RING ubiquitin ligase complex
  Homolog annotation: Hit_ID=Q1SJY8; Match level="QueryCoverage=77%, HitCoverage=25%, E-value=1e-31, Identity=72%"; Hit description =BTB/POZ; TRAF-like
MSDSKVETIARLAQWKIDNFGPCSYKKSDPFKLGIWNWFMSIERNRYLYIHIFPEPSRLTKEQPPVARFILRVSNNSGPTRKFYISPVDPCVFVSEKMEFGVVDCKEI

SEQ ID NO: 154801 - protein, 150 aa, Glycine max
  Coding DNA Sequence Number=SeqID_38023
MGRGGDGYAIPHPCFLKPIPISDGNDFFFPYPFLLGIGERYEYRAGRFVCHLYLRQLSYFSGDRSLPSPAPPHFTYTLFFVALHTPSFLCALTFKTSSFHLFWVLARGWVLVGKVFSSRTNILEQVVRNRCPRIVVLLVLFRNTRVEDIR

SEQ ID NO: 154802 - protein, 119 aa, Glycine max
  Coding DNA Sequence Number=SeqID_38024
MQHKGGLGTWLGLERSFGDIFHKGAKMHGSTLNLPGLDIASGLIRASHFYASYFQTVVLTQAPHGHLVLSDMVYFDVIVGNKQAILNALISVLTANIVKSRNFIKPMLRWRDKKHLLFE

SEQ ID NO: 154803 - protein, 202 aa, Glycine max
  Coding DNA Sequence Number=SeqID_38025
  Gene Ontology: Mol. function=UTP:glucose-1-phosphate uridylyltransfera se activity; Cellular component=cytosol; Biological process=metabolic process
  Homolog annotation: Hit_ID=Q9LKG7; Match level="QueryCoverage=91%, HitCoverage=39%, E-value=9e-83, Identity=82%"; Hit description=UTP- -glucose-1-phosphate uridylyltransferase
  Pfam annotation: Domain name=UDPGP; Domain location=25-202; Score= -24.6; E_value=5.2e-17; Accession=PF01704.8; Description=UTP--glucose- 1-phosphate uridylyltransferase
MTTATEKLSALKSAVAGLNEISESEKNGFISLVSRYLSGEAQHVEWSKIQTPTDEVVVPYDTLAPTPDGSSDVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVAEDFLPLPSKGHTDKDGWYDFIFVFLYSTILLF

SEQ ID NO: 154804 - protein, 170 aa, Glycine max
  Coding DNA Sequence Number=SeqID_38026
  Gene Ontology: Mol. function=protein dimerization activity; Cellular component=nucleus; Biological process=regulation of transcription, DNA-dependent
  Homolog annotation: Hit_ID=O81002; Match level="QueryCoverage=76%, HitCoverage=66%, E-value=1e-20, Identity=39%"; Hit description =Putative embryo-abundant protein
  Pfam annotation: Domain name=bZIP_1; Domain location=68-131; Score =33.8; E_value=5.8e-07; Accession=PF00170.11; Description=bZIP transcription factor
  Pfam annotation: Domain name=bZIP_2; Domain location=67-121; Score =24.2; E_value=0.00045; Accession=PF07716.5; Description=Basic region leucine zipper
  Pfam module annotation: Pfam domain module=bZIP_1::bZIP_2; Domain location=68-131::67-121
  Subcellular localization annotation: CTP_CleavageSite=66; ConfidenceScore=5.19e-01
MLSALPFQGNPFPALDYAFMPWDGLDSLGFKPTSPNPVTSSSGSGYPNRTHAEEKPASDKSNHVTSVMEERKRRRMISNRESARRSRIRKQRHLENLRNQMNLFRVENRKLNNGLQFLLHHCNRLRTENEWLLSERPMLRQKLANINQILLFRHLQPFSSAWPCNIVLAE

SEQ ID NO: 154805 - protein, 313 aa, Glycine max
  Coding DNA Sequence Number=SeqID_38027
  Gene Ontology: Mol. function=nucleic acid binding; Cellular component= intracellular; Biological process=DNA integration
  Homolog annotation: Hit_ID=Q1S1X7; Match level="QueryCoverage=92%, HitCoverage=22%, E-value=1e-102, Identity=60%"; Hit description =Integrase, catalytic region; Zinc finger, CCHC-type; Peptidase aspartic, catalytic
  Pfam annotation: Domain name=RnaseH; Domain location=159-300; Score= -33.9; E_value=0.082; Accession=PF00075.14; Description=RNase H
  Pfam module annotation: Pfam domain module=RVT_2::RnaseH; Domain location=1-72::159-300
ANMEAIKELKNLLQSEFEMKDLGVARRILGMDIIRKRNEGLLYLSQSSYVQKLLRRFNMLDSKPVSTPIAGHFKLSITHSPQTEDEIKDMSRIPYSNATGSLMYAMVCTRPDLAYSASIVSRFMENPGKQHWSAIKWILRYLKGSKSVGLVYGRNSERINGLSGYVDADYAGDIDKRRSLTGYLFTLYGSVISWKANLQSVVALSTTEAEYIALTEARKEAIWLKGLVHELEGKTGPIEVWCDSQSAIDLSKNQVFHERTKHIDIRMHYIRDIIAQGEVEVRKVAGANNPADMLTKEGELAGPNIEDPRWRLL

SEQ ID NO: 154806 - protein, 663 aa, Glycine max
  Coding DNA Sequence Number=SeqID_38028
  Homolog annotation: Hit_ID=Q1T1B3; Match level="QueryCoverage=43%, HitCoverage=86%, E-value=1e-123, Identity=74%"; Hit description=Haem peroxidase, plant/fungal/bacterial
  Pfam annotation: Domain name=Ribosomal_L12; Domain location=392-459; Score=68.0; E_value=3.1e-17; Accession=PF00542.9; Description =Ribosomal protein L7L12 C-terminal domain
  Pfam annotation: Domain name=Ribosomal_L12; Domain location=529-593; Score=61.3; E_value=3.2e-15; Accession=PF00542.9; Description =Ribosomal protein L7L12 C-terminal domain
  Pfam annotation: Domain name=peroxidase; Domain location=46-294; Score=453.7; E_value=2.3e-133; Accession=PF00141.13; Description =Peroxidase
  Pfam module annotation: Pfam domain module=Ribosomal_L12::Ribosomal _L12::peroxidase; Domain location=392-459::529-593::46-294
MANSMSFFLLLSLLAFAPLCLCHYNQEGYLYPQFYDYSCPQVQHIVKSVLAKYVAEQPRLAASILRLHFHDCFVKGCDASLLLDSSVNIISEKGSNPNRNSARGFEVVDAIKAELERKCPSTVSCADILTLAARDSVVLTGGPSWEVPLGRRDSLGASISGSNNNIPAPNNTFQTILTKFNLQGLDLVDLVALSGGHTIGNARCTTFKQRLYNQSGNGEPDSTLDQYYAATLRNRCPSSGGDQNLFFLDYATPYKFDNSYFTNLLAYKGLLSSDQVLFTMNQESAELGVGVDGGGVGDVSPSGGNNNVNIDNGVKNDDGSDCNVDDSDNSGGGDDIDDGNFNGGGNDRDSVNYNDGADAAESDGHGGGDAREGGGGGTVGVAEVKAAEKTAFDVKLEGFDVAAKIKVIKEVRMFTSLGLKEAKDLVEKVPAVLKKGVTKEEVESIIAKMKEVGAKGSEKVAAIVDELMGLTLLEVMDLVEVMREKRGVNELPIAMLMVPGMGVPRGVPNGGGGGAAGVAEVKAVEKTVFDVKLEGFDAATKIKVIKEVRTFTSLGLKEAKDLVEKVPAMLKKGVTKEEAESIIAKMKEVLNIGRCLVADSSQLLILWSNAAAQIMVSDLFKTSNGLELLSATAVLDVLSSHIIMEATFSYNCVILVMAARTGC

SEQ ID NO: 154807 - protein, 177 aa, Glycine max
  Coding DNA Sequence Number=SeqID_38029
MDEDSLHVSDGKDLDFNHGLRSCTTDGDILYLVKDALENENEINVYFHHEVDPIPEEVPLMLDLKCHPIPEASNEDDLDDVPVVDHEEVTIDANVGGGEKGINVDVGGGEEKDVLAPIVDVPPIARYKLNMRRPKQKNIPDTLIVDVPVVDDPPSTSLLFMPTPRFTRRKAADKDPV

SEQ ID NO: 154808 - protein, 252 aa, Glycine max
  Coding DNA Sequence Number=SeqID_38030
  Gene Ontology: Mol. function=ribonuclease H activity; Cellular component=nucleus; Biological process=RNA-dependent DNA replication
  Homolog annotation: Hit_ID=Q1RYI2; Match level="QueryCoverage=56%, HitCoverage=22%, E-value=6e-18, Identity=34%"; Hit description =Ribonuclease H
  Pfam annotation: Domain name=RnaseH; Domain location=95-222; Score= -1.1; E_value=7.4e-05; Accession=PF00075.14; Description=RNase H
  Pfam annotation: Domain name=zf-CCCH; Domain location=45-70; Score =16.3; E_value=0.0092; Accession=PF00642.15; Description=Zinc finger C-x8-C-x5-C-x3-H type (and similar)
  Pfam module annotation: Pfam domain module=RnaseH::zf-CCCH; Domain location=95-222::45-70
MTMMDLNIAQQIGGSSWRFLGIETPLPCCLHEYDTSVVAVKASKKSSRICKYWIDGNCAYGDQCWNRHSFVNVIKKDSPRPKRLVWWTAPPIMFVKINCDGAFTRCGNKAAAGGIVRDWKANFVYAFSSRLGKCCTALEAELWAIKIGVETAVSRVYGNLIVESDSYASIQLINMGVPQGHIFYDLVSSILEIGNKANHIVWNHVFRETNSTADGLAKHGLSLSSGVELFEFPPPFIWAPLCADEMGVIYSR

SEQ ID NO: 154809 - protein, 174 aa, Glycine max
  Coding DNA Sequence Number=SeqID_38031
  Gene Ontology: Mol. function=transporter activity; Cellular component= mitochondrial inner membrane; Biological process=transport
  Homolog annotation: Hit_ID=Q8LFJ3; Match level="QueryCoverage=90%, HitCoverage=50%, E-value=4e-61, Identity=74%"; Hit description =Contains similarity to peroxisomal membrane carrier protein
  Pfam annotation: Domain name=Mito_carr; Domain location=5-62; Score =10.5; E_value=0.00038; Accession=PF00153.17; Description =Mitochondrial carrier protein
  Pfam annotation: Domain name=Mito_carr; Domain location=78-171; Score= 95.0; E_value=2.3e-25; Accession=PF00153.17; Description =Mitochondrial carrier protein
  Pfam module annotation: Pfam domain module=Mito_carr::Mito_carr; Domain location=5-62::78-171
MREEGFSALYKGIVPDAFRTIMREEGFSALYRGIVPGLFLVSHGAIQFTAYEELRKVIVDFKSKGSTVHNQNPDKLLNSVDYAVLGATSKLAAVLLTYPFQVIRARLQQRPSGDGVPRYMDTLHVVKETARFEGIRGFYKGITANLLKNAPASSITFIVYENVLKLLKPARRND

SEQ ID NO: 154810 - protein, 199 aa, Glycine max
  Coding DNA Sequence Number=SeqID_38032
MKTNVTLTGDASHVVRVNFPRQGPIWGRVRWYFELVAHVDSVVVFGERQWLKSIEVPMRSSSPPSCRSVDDNADDEILRTSPSSDFIFTQKLLAFNITLTKTPLQRALLFFFLHPNRMAEGARTAHAPAPHPIQPKPDDKTPNPVKETPPPPEKPEPGDCCGSGCVRDVYYDELEDTISYTNKTIPAPKLLHSLHHRMG

SEQ ID NO: 154811 - protein, 593 aa, Glycine max
  Coding DNA Sequence Number=SeqID_38033
  Gene Ontology: Mol. function=transcription factor activity; Cellular component=nucleus; Biological process=regulation of transcription, DNA-dependent
  Homolog annotation: Hit_ID=Q6SA75; Match level="QueryCoverage=98%, HitCoverage=96%, E-value=1e-77, Identity=36%"; Hit description=ANT -like protein
  Pfam annotation: Domain name=AP2; Domain location=350-423; Score =108.7; E_value=1.7e-29; Accession=PF00847.10; Description=AP2 domain
MKPIENGNTVNINYQNSWLGFSLSPQMINIGVPSHLHQTQPSPAAVETVPPSFYHHTPLHSYGSYYGLEGEHVGLSSSLPIMPLKSNVSLSGIEALSRSQAQATITTSAMHPRLNNMLYNQLLCHGLNNPNNLNHIQENISQQQFSYYSTLRNHDMILEGSKHQLPCIAEDENPGLKSWFSRDFPARHGEESRMIVPLEDNNGGESGSIGSITYGDLHSLNLSVSPTSGSSCVTSSPAITNTVATDTKKRGLQMVDQNQKQIGHRKSIDTFGQRTSQYRGVTRNVCSSGIGGLVDTKLIYGTTAARKRAKEGKEGKLENYQNELEEMKNMTRQEYVAHLRRKSSGFSRGASMYRGVTRSHRLAFTQHHQHGRWQARIGRVAGNKDLYLGTFSTQEEAAEAYDIAAIKFRGVNAVTNFDITRYDVERIMESNNLLSSEQAKRKREMDDGTRSEATVNQKPCTTQETVLMQKRCRSQSEWKMVQYPSSQQLDQNPQRIECSRTESLSTALDNMFHHQVEESSNMGTHLSNPSSLVTSLSSSREESPDKTSLPMLFGMPSTVSKLLADVDSLDLSSNLRPSLSIPQMPIFAAWTDA

SEQ ID NO: 154812 - protein, 312 aa, Glycine max
  Coding DNA Sequence Number=SeqID_38034
  Gene Ontology: Mol. function=oxidoreductase activity, acting on NADH or NADPH; Cellular component=membrane; Biological process=electron transport
  Homolog annotation: Hit_ID=Q8ZPM2; Match level="QueryCoverage=74%, HitCoverage=31%, E-value=7e-89, Identity=69%"; Hit description =Electron transport complex protein rnfC
  Pfam annotation: Domain name=Fer4; Domain location=137-160; Score =21.0; E_value=0.00018; Accession=PF00037.17; Description=4Fe-4S binding domain
  Pfam annotation: Domain name=Fer4; Domain location=98-121; Score =11.8; E_value=0.0051; Accession=PF00037.17; Description=4Fe-4S binding domain
  Pfam module annotation: Pfam domain module=Fer4::Fer4; Domain location=137-160::98-121
MQNFGTAWAVKRAIVDGEPISERVVTLTGEAISRPRNVWGRLGTPVSHLLQQVGFTPGARQMVIMGGPLMGFTLPSLNVPVVKITNCILAPSASEMGQPQEEQSCIRCSACADACPAKLLPQQLYWYSQGGDHDKARAHHIDDCIECGACAYVCPSNIPLVQYYRQEKAELRAIDLEAKRTAEAKARFEARQARLEREKLAREARHEQAKQRVARSDKAELEAATGRVKARQAKTPEQEAAEREARHAQALAQQAEKQAETEPLSRQAIDPRKAAVEAAIARAKAKKVAAPARPAADTTTAESDPRKAAVEA

SEQ ID NO: 154813 - protein, 164 aa, Glycine max
  Coding DNA Sequence Number=SeqID_38035
MTTLTQMWMTLLLSNVLPSDHNSDLPLPKCQLVYVILTRMSVHVAQLIVDAIYLFSGMPPTRHPLDQDKSNRAMGFPALITGLCQTFGVPVTPREAQGDAPQAADTPPEPHQADPAGSFDMERVEFAWPGDWPEAQAGEVPVEALDDAEEARMDEEMTDLLGFL

SEQ ID NO: 154814 - protein, 245 aa, Glycine max
  Coding DNA Sequence Number=SeqID_38036
  Homolog annotation: Hit_ID=Q6YUU0; Match level="QueryCoverage=13%, HitCoverage=8%, E-value=2e-07, Identity=85%"; Hit description =Putative Cgi67 serine protease
QEEKKRKTEEEEEEEEEEEEEEEEEEEEEVRSERKGNEMGMRKEEMEKTGQDTWRMRKVGRSENGDGLEFIYCSSVGVYLKSDLHLMKSGDIDWVSGGAILNGPRTVFIEAKTKGERMETKAGMKDNLKGDWEDLRVLEKEMQENIRKRKSYQSREGRRGSTSLAQHSGTDYNKYVRFTWYMTLSPDSIGLWRTTSLRRGKREARSKDPAAVVVDHSGYAVSATEGDHTLIASDDFIKSDVIFAK

SEQ ID NO: 154815 - protein, 35 aa, Glycine max
  Coding DNA Sequence Number=SeqID_38037
MGAKEMSFIHKDSKNPVTGLAVGPDPWPHHLSNAA

SEQ ID NO: 154816 - protein, 71 aa, Glycine max
  Coding DNA Sequence Number=SeqID_38038
MKSKSNMFKDKWTQSWPMSSKIYPKVHENPRAFFSSSSPILLESLAHGSGDWSLPREDCIIPSPFKEDLIL

SEQ ID NO: 154817 - protein, 159 aa, Glycine max
  Coding DNA Sequence Number=SeqID_38039
  Gene Ontology: Cellular component=vacuole; Biological process =response to biotic stimulus
  Homolog annotation: Hit_ID=Q8H940; Match level="QueryCoverage=80%, HitCoverage=73%, E-value=1e-18, Identity=37%"; Hit description =Lachrymatory factor synthase
MEHDMHQRWEGKVSAKLRNTTKEQAWPLVKDFFNLHKRFPSLATCYGVHGSNGEPGCIRFCAGSSIPSSNGSGSVSWSKERLVAVHDVDLSLKYEMVDNNIGFRSYESTMRVLSDDDSNGCLLEWSFAVDPVKGLVLEDLVRKYHVGLQLMALKMEDEI

SEQ ID NO: 154818 - protein, 201 aa, Glycine max
  Coding DNA Sequence Number=SeqID_38040
MKKDIYKVEKIPLFFKGFWTGSMVFKPLLVKGFMLWSYKWTCDLMRWIQELSRVVIIKKGEIVEASFMMMNQVDSSSFDDNKDDDKKPKRMISRTRFKNQEKFDFKIQEKMNSRFKKRNQEGFTREGTSFVVQVEGTSTWVVVTENKRGYISCGSVQVEGTSTWLFKENKGGYIPCGSLLVKVFTRLKRNLKDRRSLGDWM

SEQ ID NO: 154819 - protein, 137 aa, Glycine max
  Coding DNA Sequence Number=SeqID_38041
  Homolog annotation: Hit_ID=O04238; Match level="QueryCoverage=35%, HitCoverage=6%, E-value=3e-07, Identity=56%"; Hit description =Transcription factor
MLLYADLSLLDLLITEPALNLVKCCNELNIGYARGVGVCVVTFTVNALFNGRYVVLVAYMSVTSLLENPVLQDYLQPVVTSVDSEAKLHGESKVIQSVSMITKDDDKGDDKKLKDQSRTIQEFKIRIKKNSRLKKKV

SEQ ID NO: 154820 - protein, 246 aa, Glycine max
  Coding DNA Sequence Number=SeqID_38042
  Gene Ontology: Mol. function=UTP:glucose-1-phosphate uridylyltransfera se activity; Cellular component=cytoplasm; Biological process =metabolic process
  Homolog annotation: Hit_ID=Q9LKG7; Match level="QueryCoverage=87%, HitCoverage=46%, E-value=1e-106, Identity=90%"; Hit description=UTP-- glucose-1-phosphate uridylyltransferase
  Pfam annotation: Domain name=UDPGP; Domain location=1-191; Score =89.3; E_value=1.2e-23; Accession=PF01704.8; Description=UTP--glucose- 1-phosphate uridylyltransferase
MEVTPKTLADVKGGTLISYEGRLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKISIVANPGVKLEVPDGAVISDKHEVVIPISKPRGLIVIRRKLMAQRTSCEEAR

SEQ ID NO: 154821 - protein, 161 aa, Glycine max
  Coding DNA Sequence Number=SeqID_38043
  Gene Ontology: Mol. function=protein kinase activity; Biological process=protein amino acid phosphorylation
  Homolog annotation: Hit_ID=Q1T001; Match level="QueryCoverage=72%, HitCoverage=22%, E-value=7e-40, Identity=68%"; Hit description =Protein kinase-like
  Subcellular localization annotation: CTP_CleavageSite=63; ConfidenceScore=5.40e-01
MTPKPFNFPAKRTTALFLLTATAVSAAQTSSSAVPSPLPALSPEKIGGEIHGLIRTARAVSTVASTVVDYEFSLRGLPKDSDQYRQTISQVHLRSAKRFLKLCEANKGFYVKAGQFVSAQKVLPKEYSSTLSSLQDQVAPLPFKVIGEVLKDNLGPDFSEM

SEQ ID NO: 154822 - protein, 84 aa, Glycine max
  Coding DNA Sequence Number=SeqID_38044
  Gene Ontology: Mol. function=protein kinase activity; Biological process=protein amino acid phosphorylation
  Homolog annotation: Hit_ID=Q1T001; Match level="QueryCoverage=84%, HitCoverage=13%, E-value=5e-29, Identity=81%"; Hit description =Protein kinase-like
MSGMMVDGHYLYPQYRLEWLPLAFAKSMSSELDFVQEARNSEIAAKTFRNSKMVRIPHVFWDLTTRQILTMQFYTGHKIKDSIV

SEQ ID NO: 154823 - protein, 124 aa, Glycine max
  Coding DNA Sequence Number=SeqID_38045
  Homolog annotation: Hit_ID=Q8LT16; Match level="QueryCoverage=27%, HitCoverage=9%, E-value=7e-09, Identity=88%"; Hit description =Mitogen-activated protein kinase
  Subcellular localization annotation: CTP_CleavageSite=57; ConfidenceScore=5.08e-01
MVVVTEALRVFAIDQVPFFKLLFPHSVYISVSMCGSMIGLQVRQLPQYPRQQFARFPSMSPSAVDLLEKMLVLDPNRRIIEEKKEEEITTTRGEKGGGYSTFNIGAYVTNDVKTHFLHRSRIQH

SEQ ID NO: 154824 - protein, 256 aa, Glycine max
  Coding DNA Sequence Number=SeqID_38046
  Gene Ontology: Mol. function=protein kinase activity; Cellular component=outer membrane-bounded periplasmic space; Biological process=protein amino acid phosphorylation
  Homolog annotation: Hit_ID=Q1T001; Match level="QueryCoverage=99%, HitCoverage=45%, E-value=2e-87, Identity=67%"; Hit description =Protein kinase-like
MVAKSLTELFAEMIFVHGYIHGDPHPGNILVSPEGCNGFSLVLLDHAVYTVLDEEFRKDFCQLWEALILKDSMKIMRLGERFCAGKYSRYLPIIFTGTTIESKNAVGISIEEKETLKHELKSLLFEDLSSFMESLPQDFIAIMRIDALLRYIIRKMDVSRVTRLLTYTKYAVYGRLCPKLDGEDFAVKASFFSFMSTLKYLRILLTVLTGATDVIPRRQKLKSVQNYLHSKINCDTLGLLVHSVFLLLCVCPNALF

SEQ ID NO: 154825 - protein, 45 aa, Glycine max
  Coding DNA Sequence Number=SeqID_38047
MATPMSTACYLDKDESGQSIDIKKYRDAKLIERALVEHVILLVLL

SEQ ID NO: 154826 - protein, 101 aa, Glycine max
  Coding DNA Sequence Number=SeqID_38048
VRVLPLNISLRVLEFEDEAYNLKVISLISSCAVSEIVAVPPRRSQPHNLKGGSCVAHTPACPAPPVKLEIGIISPVRIGRNASNQQNSQVVEVVNKFQWGI

SEQ ID NO: 154827 - protein, 95 aa, Glycine max
  Coding DNA Sequence Number=SeqID_38049
MRLNHPLLGAQQPNTFEYLMTIEVGDFLTMAAKYTSSFEGCYVKRRIGVEIIYDEHGVEAYMQFKRGMCQHARLSHYNTSCGGTSLNILAGQNPP

SEQ ID NO: 154828 - protein, 190 aa, Glycine max
  Coding DNA Sequence Number=SeqID_38050
MECGSGTLSSEGRVLNRRKILLKNLMKSWDHSPYIILRMHGFGFVAPMESTRPILLIGKYMKPGNAKLHFLQHWGIHKSIKGGQVWMAIWSLVVWNMIIVMHTDTVGGYVASCRACRPWNFFINGVSCFLKINDNGMEKEEREREKGERNFEREKRENEEAWKRIKELEYCAQHDNLAQCVRIAQPKKLA

SEQ ID NO: 154829 - protein, 82 aa, Glycine max
  Coding DNA Sequence Number=SeqID_38051
MGEKWSLWGHFPAPGPIRKLRGEVTSPLGSKLHEMNQAILMMPKAKVSDSRLIQDFKIKHQESNPRFKIKRRNQEATSQNFL

SEQ ID NO: 154830 - protein, 111 aa, Glycine max
  Coding DNA Sequence Number=SeqID_38052
IPTVTMQTYVLETSSKSFASIQRLTNWNEENVTGLGEIDGDPVLRGTRIRATWEYVSSVKVGNWGCGTWRYVTGVRRPWGRQASSWQSTDKRTKTTKQEGLCGGWPAVNLE

SEQ ID NO: 154831 - protein, 88 aa, Glycine max
  Coding DNA Sequence Number=SeqID_38053
MTFFLSYTKAKAEGVTVCTKPDNSCLTQFLFVEASFMLMNQVILMMPKAQVIDPRLIQDFKIRHQESNPRFKIQEKKSRSNKSRLHIG

SEQ ID NO: 154832 - protein, 448 aa, Glycine max
  Coding DNA Sequence Number=SeqID_38054
  Homolog annotation: Hit_ID=Q3KAR7; Match level="QueryCoverage=28%, HitCoverage=100%, E-value=3e-32, Identity=51%"; Hit description=4 -oxalocrotonate tautomerase
LFARDHGQAGRCLQHAQAQRRPGAGGGRQFTAAGVDHAHGIQRGRRWRIGGKGGHGVQQGHAQRRQCRPAQARGVGVGFHLFTACKAAPQWQGSSGNSENAHAAVPGHAWRLGKINPKARAQGSGGHQGRRPTRSQCAADALRQRLHRTAQRAAYRRHRRQQQHCRHQQGDQPRGDQAVVAVHAHLMLSVWIGRRLLFGLAVRHPVMLVVPFHRVLRMLCVHRMIHGSHRCGGRNMAMYQPAAHQRGEQHQQHGKPCQGLEPAVEDRTTHAAILRGDGQPWTAFRVCPLRHGDAGSSEGSQWMLFAPRPSTHVLGHTITKRPVFLLHFHQVDKYILAADAHRRVQAIGDAGVQRLRLLQRAPFVPGDLDADEIVGAVHTQIAGVVDQRAGRVLLEDLEAVVFRHAHRAHGLVDGFADSLQVVGGFTFAKIDAGERHGGTPAWMGTATG

SEQ ID NO: 154833 - protein, 174 aa, Glycine max
  Coding DNA Sequence Number=SeqID_38055
  Gene Ontology: Mol. function=siderophore-iron transporter activity; Cellular component=outer membrane; Biological process=siderophore transport
  Homolog annotation: Hit_ID=Q4UZN4; Match level="QueryCoverage=100%, HitCoverage=24%, E-value=3e-73, Identity=76%"; Hit description=TonB -dependent receptor
MVDGEFGAPVRTQQPLRAGVVRGGVVRLVEHVEQPRGQPRARCRLPGQRQVGGAVAGKFQRVGIVGVALADIANTRRCAPVRQELPAQPCVGQALGHVRRHVAIARHQHRRRTGGFQEVLELGLQHRRVDIERPVRREGPIQGRFNTARGLRAHLHPAIRHQRVAAEQPGLADA

SEQ ID NO: 154834 - protein, 206 aa, Glycine max
  Coding DNA Sequence Number=SeqID_38056
  Homolog annotation: Hit_ID=Q7VUZ4; Match level="QueryCoverage=96%, HitCoverage=41%, E-value=1e-34, Identity=42%"; Hit description =Putative exported protein
MTLRSTARRWTYLVHRWLGIGGCLLMLLWFVSGMVMLFIGYPKLTPGERLAALPVLGDARGWQGLSALPAAVQAEPEAVALTTLRGEPAYVVRSGGNVGAWSARTGQVLLPVSAQRAEASAAQFAGGQAFVGAMRVDEDRWTHSRALDAHRPLYRVEVGGAQPGDLYVSSHTGEVVLDAPHVQQRWNYVGAWLHWLYFLRMQSVDP

SEQ ID NO: 154835 - protein, 66 aa, Glycine max
  Coding DNA Sequence Number=SeqID_38057
MWDQHELKGAFKLGVFTPKTYTLKSLLGPLPPDSGNLHFPFNTAHQHFSQDKHWSGYCIIHSSQYK

SEQ ID NO: 154836 - protein, 539 aa, Glycine max
  Coding DNA Sequence Number=SeqID_38058
  Homolog annotation: Hit_ID=Q75GU4; Match level="QueryCoverage=54%, HitCoverage=70%, E-value=2e-46, Identity=34%"; Hit description =Expressed protein
TRNNATFTVGPAHDVKDGEAVAGEEEGAGAKVGGHIGKPGGKEAKGGGSFMVVCASCTISRFMSRMPTWEANSCCYHDDDGMLYRGHCKGEAFGPTYTSEDVVGAEIKNGQGSLRRCGLVNNDLFHFNLGVASAAGSIQLHLIILELLYMNEFVVAVDRASTALDLLLVALELLFEECVRWCMDFLKPVSWTDEEEKQMVRLISFCSKKDSKELMSRVWPSGEDSCEVMLQGLISSTMNSYDNTAFEKAFVGKILRDLLSRETMKRVLEKVFRMSLKMVNESLEDYSSPVFRGDQNEMEAIQRLNLHKASTNGKHLLWLLERMIELRVVDVTVREWSEQAGFTTDLQRAFRDDAWRNIVSGLPTVILRCTFRLTNAVSIGAILASRQVRKKLVEDWLSRIISILPMLDAQELVKKIMCSRELVKVGDDLSEIQMDGHNEHGLDSLPQEEFLSLLGGARTSPPAHQFLVNTLREVGVKLISNVLSGAGKELERIVLDHLQPVVEVIGFRIGELRGLSRWCARYQDIGLDESLINNATEKA

SEQ ID NO: 154837 - protein, 141 aa, Glycine max
  Coding DNA Sequence Number=SeqID_38059
  Gene Ontology: Mol. function=nucleic acid binding
  Homolog annotation: Hit_ID=UPI0000D9BA39; Match level="QueryCoverage =72%, HitCoverage=96%, E-value=2e-10, Identity=42%"; Hit description =PREDICTED: similar to Snf2-related CBP activator protein
MSNGSIIVPPNCQVIESNRTYTLRESPKRVIKNRMRGLKVLAFRGLKFLVFRGLKVLAFRGLKVLAFRGLKVLAFRGLKVLAFRGLKVLAFRGLKVLAYKGLKVLAFKGLKILAFRGLKVLAFKRLKVLTFRGLKVLAGIL

SEQ ID NO: 154838 - protein, 105 aa, Glycine max
  Coding DNA Sequence Number=SeqID_38060
MGVIVLLPSFLIVVSFTKALDGPGNQIIEWFLEPWTQSLCDCLRIVEEVPHSTEEKGLIEFETNFLKLLDVKEVFKVYRGLIVSMDGSHLYDWNNLYGWNNLNNR

SEQ ID NO: 154839 - protein, 115 aa, Glycine max
  Coding DNA Sequence Number=SeqID_38061
MENLPFYFPHTIYINILRNLKGLGGMDDIYYAAIINKVFWDQGVYRIFDKMDDDSKYTIIAKGDEDMFKSKGKDPLEGLGGPMTRARARKAKEALQQVLSILFEYKPKFQGEKSK

SEQ ID NO: 154840 - protein, 214 aa, Glycine max
  Coding DNA Sequence Number=SeqID_38062
  Gene Ontology: Mol. function=glutathione transferase activity; Biological process=auxin mediated signaling pathway
  Homolog annotation: Hit_ID=Q9FQD6; Match level="QueryCoverage=70%, HitCoverage=71%, E-value=5e-61, Identity=70%"; Hit description =Glutathione S-transferase GST 22
  Pfam annotation: Domain name=GST_C; Domain location=110-201; Score =65.7; E_value=1.5e-16; Accession=PF00043.15; Description=Glutathione S-transferase, C-terminal domain
MSVVQDGDYTCEDISLISVCNLSNYLGTVFCFVLEVSFSLIVCFLECYINIEHWSISLWASRSKSRAVLRYYCEKYKKQGTDLLGKTLEAGDLVEKWLEVEAHNYYPPIYNLVMHILVHPLKGEPFDPKVIQESEKKLGKVLDIYEERLSKAKYLAGDFFSLADLSHLPFTHYWINQVKKEYMLRERKHVSAWWDDISNRPSWKKVLLLYKYPI

SEQ ID NO: 154841 - protein, 87 aa, Glycine max
  Coding DNA Sequence Number=SeqID_38063
MRIGKEGTYKYAKASDICKGSGQCNTYKGEFAKMTDQPSSMTPPVAKTVTLRPQPLVGKCPRRACGGQGRVKGENEMYGGHGKVKGE

SEQ ID NO: 154842 - protein, 125 aa, Glycine max
  Coding DNA Sequence Number=SeqID_38064
  Gene Ontology: Mol. function=nucleic acid binding; Biological process= DNA integration
  Homolog annotation: Hit_ID=Q1RSG2; Match level="QueryCoverage=72%, HitCoverage=9%, E-value=1e-08, Identity=29%"; Hit description =Integrase, catalytic region; Zinc finger, CCHC-type
MISASGNLPASLPILNGKNYDRCVDAYILEKILGVNTTKEALDILAKSYEGAEKLKKNYGDKIEDAMIMDKILRTLTPRFNHIVVTIEQGTNLEGMKVEELQGILEAQEMRLNEINSLKSSNKAL

SEQ ID NO: 154843 - protein, 133 aa, Glycine max
  Coding DNA Sequence Number=SeqID_38065
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=96%, HitCoverage=62%, E-value=3e-51, Identity=75%"; Hit description =Inorganic pyrophosphatase
  Pfam annotation: Domain name=Pyrophosphatase; Domain location=51-133; Score=36.9; E_value=1.4e-11; Accession=PF00719.9; Description =Inorganic pyrophosphatase
MSDNGEEARENRPVPHLNERILSSLSKRSVATHPWHDLEIGVFLLVQWLQVVEITKGSKVKYELHKKTRLIKVDRVLYSSVVYPHNYGFIPRTLCEDNDPIDVLVLMQEPILPGCFLRSWAIGLMPMIDGVLN

SEQ ID NO: 154844 - protein, 163 aa, Glycine max
  Coding DNA Sequence Number=SeqID_38066
MDNPDAGNLSATRMCKSIEGKGKYVFMLSQKEKGDMIDKDKSVIILCLGNKSLTKVAREKTTTEIWDAILYGKDQTISLDDVHKSVQIKELQKLQDLKIEDNGEGLNEDCHEKKAKESRNLVDSLDVVVALDGCESVRDYFETLELKEGGMVLLGNNKSCAEQ

SEQ ID NO: 154845 - protein, 100 aa, Glycine max
  Coding DNA Sequence Number=SeqID_38067
  Homolog annotation: Hit_ID=Q1S9T9; Match level="QueryCoverage=78%, HitCoverage=6%, E-value=4e-22, Identity=64%"; Hit description =Peptidase S8 and S53, subtilisin, kexin, sedolisin; Integrase, catalytic region; Zinc finger, CCHC-type
MGTWRKLSICNNQKGLQRTSPRMHQSKLDSTPLGHHTKLSITQAPSTDEERSKIGSIPYASGVRRIMYGMVCSKLDLALVVSIISHFMENSGQAHSEALK

SEQ ID NO: 154846 - protein, 187 aa, Glycine max
  Coding DNA Sequence Number=SeqID_38068
  Gene Ontology: Mol. function=nucleic acid binding; Biological process= DNA integration
MTHRHIQSCAYFKFVIILVRRAHLTKVQVIGIRMHMSRRVKDLLAQQGLSKALCNLKLEKMEVLDWEGLQERVVTTIHLCWVDEVLYHVMELTSLGEIINDLARLDVKIEDEDKACILLCSLHSSYKHLVTTLTYKKNSMSLESIQDALMSHSQRRQNAVRSSQDDGLYVKGKQECGRIQGKGFGGR

SEQ ID NO: 154847 - protein, 97 aa, Glycine max
  Coding DNA Sequence Number=SeqID_38069
  Gene Ontology: Mol. function=glutathione transferase activity; Cellular component=cytoplasm; Biological process=auxin mediated signaling pathway
  Homolog annotation: Hit_ID=Q9FQD6; Match level="QueryCoverage=93%, HitCoverage=43%, E-value=5e-44, Identity=94%"; Hit description =Glutathione S-transferase GST 22
  Pfam annotation: Domain name=GST_N; Domain location=1-75; Score=66.0; E_value=1.2e-16; Accession=PF02798.10; Description=Glutathione S -transferase, N-terminal domain
MVVKVYGPTYASPKRVLVCLIEKEIEFETVHVDLFKGEAKEPEFLKLQPFGLLPVIQDGDYTLYESRAIIRYYAEKYKDQGTDLLGKTIEERGLVEQ

SEQ ID NO: 154848 - protein, 117 aa, Glycine max
  Coding DNA Sequence Number=SeqID_38070
MVFYNTENPKFSTSLSLSSYLHRCGDPHKAGEDIEAQVFVAHEIELDSSPSEAILFLVRTWHLHPPYQNNRVLQLITVDLCLVKFGLLFFNNTLSCYSIQIPLSALCFDVDRPRSNS

SEQ ID NO: 154849 - protein, 210 aa, Glycine max
  Coding DNA Sequence Number=SeqID_38071
MHVDDATDEVHEQPQEVADDDVVLDVEGFPSGPHDTSVLIDYVHHVAVAGWNGEECPELKLSSHGRNVEKFGRPAPKIKGLVVATGLSPLIACSLDIGDQGLISAFAERQHKETSSFHHLPITGVFHSFKALHMDKVVLLLVELLEVSGVEARAKIVQCHGSGSYTWGVVALVHMYDNLNDAFKSSARQLAGYITLFKTSSRVANTYNAI

SEQ ID NO: 154850 - protein, 302 aa, Glycine max
  Coding DNA Sequence Number=SeqID_38072
  Gene Ontology: Mol. function=DNA binding; Cellular component=nucleus; Biological process=DNA integration
  Homolog annotation: Hit_ID=Q8RUQ2; Match level="QueryCoverage=99%, HitCoverage=26%, E-value=3e-55, Identity=41%"; Hit description =Putative retroelement
MVEEIESLQKNQTWELVQLPAGKRAIGCKWVYKRKPLVSENEGEKFKACLVEKRHISIMAVLALVANCDMHLEQMDVKTTFLHDDLEEQIYMELPEGSLYGLKQSPRQWYKRFDSYMLRIDYRRCEYDYCVYVRILDDVFFIFLLLYVDDMLIVGNHLHDVNELKSLLNKDFDMKDFCPAKKMLGMEIKMLVAFTIGLFLEDHCLKTDVGVEYMSKVPYVSAVGCSMKATLGSNEVDLEVPKGYNRSWYYVWHSTGDPSAVGYVDLDDRKSTTGYVFTFGGGKEAMWLAGLVKELGIEQCGV

SEQ ID NO: 154851 - protein, 244 aa, Glycine max
  Coding DNA Sequence Number=SeqID_38073
MVGCGGFIRDLRGSRSCGFAKRIGYANSFLAKLWGFDVDSEVVVKCIIGGREGCATDALANIACHLKDSYVMYEQPPPIIRSLLLVDVNGGFNFPSHSDNHQELAQLNHPTIPQRKLSHTHVLESRKPQDHKVMIIGLNFLLTLDNSEKMLGPIKMFKFNFPKISQTLKARQKRLLLAEPVPVYSPLTQILSSSSTQFGCDECVEHKGREVTNRSKKRMGNGNKCCKRKLKSMFKRLPCKVIEW

SEQ ID NO: 154852 - protein, 531 aa, Glycine max
  Coding DNA Sequence Number=SeqID_38074
  Gene Ontology: Mol. function=ATP binding; Cellular component=outer membrane-bounded periplasmic space; Biological process=apoptosis
  Homolog annotation: Hit_ID=Q8LJ95; Match level="QueryCoverage=84%, HitCoverage=74%, E-value=3e-63, Identity=35%"; Hit description=NBS -LRR resistance protein RGH1-like
  Pfam annotation: Domain name=LRR_1; Domain location=119-141; Score =5.3; E_value=30; Accession=PF00560.23; Description=Leucine Rich Repeat
  Pfam annotation: Domain name=LRR_1; Domain location=314-336; Score =4.7; E_value=37; Accession=PF00560.23; Description=Leucine Rich Repeat
  Pfam annotation: Domain name=LRR_1; Domain location=338-360; Score =13.6; E_value=0.73; Accession=PF00560.23; Description=Leucine Rich Repeat
  Pfam annotation: Domain name=LRR_1; Domain location=362-384; Score =14.3; E_value=0.43; Accession=PF00560.23; Description=Leucine Rich Repeat
  Pfam module annotation: Pfam domain module=LRR_1::LRR_1::LRR_1::LRR _1; Domain location=119-141::314-336::338-360::362-384
MSIRTNPMKAVPTLLKRLVTVEKQLKQVNLNDLKSELIRIKDLFSLVKKNEEELLDTLTVLDGYLRNKNINKLTEEEGHIRKRIRESTQKLLPAGEIQSTNIEDSQSSRKLPSSLQREELEMIEVNCNKLDHVGKRCLLSLLHFPENAVMKKSNIILWWVGVGLTANENGEDVFDKLMDYKIIVPHRSDKYPIENKFRINPCVHHIHKSGKLLLENDEKQPLQIITPSHHSDSGTYLALDKQKVKLSDQFGFKSNNCRSVFNVGASYLNFGPQWMAKMKHLEVLQLGRWLQGSPKHHIEVESEEFLKELRDQKELKYLSLRGISRISELPLSIFQLESLETLDLKACHNLETLPNDIASLRNLRHLDLSQCYLLDRMPKGIEKLAKLEVLKGFVIGSSIKTPCNVSDLAHLSKLKQLSIHIGSGAVIQDKEFESLEKLSELEKLKISWGVFDTRYSAIQVTLPSNLKKLHLEGFPGQNIPEWLKPDKISTSLCELSITGGRLKSMDLQQYAHVSCSLQIIRLKYLKHLKLD

SEQ ID NO: 154853 - protein, 95 aa, Glycine max
  Coding DNA Sequence Number=SeqID_38075
  Gene Ontology: Mol. function=nucleotide binding; Cellular component =endoplasmic reticulum
  Homolog annotation: Hit_ID=Q42434; Match level="QueryCoverage=70%, HitCoverage=12%, E-value=1e-10, Identity=49%"; Hit description =Luminal-binding protein precursor
MNCEAKVFNPKETSVVVLTKINVQLISTILRGRQSRMLAGVIVGLNVARIIKEPTAAAIACGLDKKGGEKHKNRNVKYKDIDEIDLVGGSIRIGK

SEQ ID NO: 154854 - protein, 179 aa, Glycine max
  Coding DNA Sequence Number=SeqID_38076
  Gene Ontology: Mol. function=actin binding; Cellular component =nucleus; Biological process=cytoskeleton organization and biogenesis
MDHSWMKASRIIDEYENGVEQLLSAVLALVNLKARFGRSDKSFTKLLVLLKKMLPKENTLPKNHYKVKKILCPVGKEYKKIHACPNDCILYRNRFVEMCKCPTCGVSLYKVKDDEFSDDASKNNSRLAKLYIKRKYIIICMMIAGLRQPRNDIDVYLTQLIEDLRKLWEDEVDVWDGNL

SEQ ID NO: 154855 - protein, 110 aa, Glycine max
  Coding DNA Sequence Number=SeqID_38077
  Gene Ontology: Mol. function=ATP binding; Biological process=apoptosis
  Homolog annotation: Hit_ID=Q9FHI4; Match level="QueryCoverage=70%, HitCoverage=6%, E-value=1e-13, Identity=56%"; Hit description =Arabidopsis thaliana genomic DNA, chromosome 5, P1 clone:MFC19
MKHLEVLQLGRWLQDSQKHHIEVEIEEFLKELRGQKNLRHLSLRGISRVFEQPPFICQLENLQILVLKACHNLETLPSSSSKTPCRISDLAKLEYLEQLCRSKLHDDESS

SEQ ID NO: 154856 - protein, 92 aa, Glycine max
  Coding DNA Sequence Number=SeqID_38078
MSVVSEFKDKAFDVTRHGNGARTYPILMGKTRVDWGRGRDFISMSGVGRSRENLIPSGAGMEVYKHMYCMGSTASNLHDDLTLSLVDNMNGY

SEQ ID NO: 154857 - protein, 95 aa, Glycine max
  Coding DNA Sequence Number=SeqID_38079
MLTVVDGYIRNKNISKLMEEEEHICKKIRYSTPKFMLGDAIQSGDIEAVGSSGETFEDVKVKLREEVNRPFPWSPQLEELEMIKVGLARVSYGIQ

SEQ ID NO: 154858 - protein, 130 aa, Glycine max
  Coding DNA Sequence Number=SeqID_38080
  Gene Ontology: Mol. function=transition metal ion binding; Cellular component=proteasome core complex (sensu Eukaryota); Biological process=lipid metabolic process
MTYFGVIEEIWELDYSEFRVPVFKCNWLNGNIGVNVDEMGFTLVDLQKVGYKDKQFIMVEQASQVFYAQDLHDSRWLVVLQGRTNSFSLQNHDSTLDICEAPSFSRQMPSIIKEQVVDDVLVDCTDHDEE

SEQ ID NO: 154859 - protein, 303 aa, Glycine max
  Coding DNA Sequence Number=SeqID_38081
  Gene Ontology: Mol. function=nucleic acid binding; Cellular component= intracellular; Biological process=regulation of transcription
  Homolog annotation: Hit_ID=Q1SVP5; Match level="QueryCoverage=99%, HitCoverage=91%, E-value=3e-51, Identity=45%"; Hit description=Zinc finger, C2H2-type
  Pfam annotation: Domain name=zf-C2H2; Domain location=56-78; Score =21.2; E_value=0.0037; Accession=PF00096.16; Description=Zinc finger, C2H2 type
MEEGHCWIKTKRKYSINSSIDSPTNYPSSYDDYSWEEQAFAKDAAWSGCIWPPRSYSCRFCRKEFRSAQALGGHMNVHRRDRARLKQPYSPDQNEILSDGLEKTTQQQSSVQISFTSLGYLYPSSLDGLAPNTSPNSDPYSHAPASPSKFLASSINKRGREKPQIPLYKGCLESSPDLPSKSMSNLTEDFRFCSRRLDPEAGVEKMLKGLDSGCRSTERDDAKTDVAVILNLFMNQPHPPVKFETKEKYTSFKKGKADASSIPFFPKSCSADRHHMQSQMYEFSPSSIEELDLELRLGYRSKV

SEQ ID NO: 154860 - protein, 101 aa, Glycine max
  Coding DNA Sequence Number=SeqID_38082
MKTMIYKSVFELQKHYFNNIALVNTIVTKLCTLATLRLEQESIDPFITQFASSLNFPFLSHRHSFVIFYQLTPTYGGHRDSGHPFCGGAPLASHDSGKQEK

SEQ ID NO: 154861 - protein, 94 aa, Glycine max
  Coding DNA Sequence Number=SeqID_38083
MPKKSWPFNKRMHSYEKLMQEAKNMQMEELAKYRNQVRVEATSTKKEVNKPNFNKTKEEERRDQPPREPYYTYYTSPQVQADLISYIKPWLLKS

SEQ ID NO: 154862 - protein, 59 aa, Glycine max
  Coding DNA Sequence Number=SeqID_38084
MASIRLSKESKRSPTKSHPSEEEEEEKESDHLLPMAERPSSPKNHPSLCGIQRRKPHQH

SEQ ID NO: 154863 - protein, 207 aa, Glycine max
  Coding DNA Sequence Number=SeqID_38085
  Gene Ontology: Mol. function=RNA-directed DNA polymerase activity; Cellular component=nucleus; Biological process=RNA-dependent DNA replication
MDSTNEDKTSYIIESENYCYKVMLFGLKIVKAIYQRLMDKVFNAQLGKNLEVYVDDIVAKSDDLSTHIKNLEKVFENLWKHNMRLNPNKYVFGVEGGKFLGFMLTQRGIQENLDKCQTILEMRSPGNIKEAQRLADRIASLSRFNHELFNPTTSYGECEAKPEKTPEQESLVPTGKAHSGSQQAKTTERTDLGTRWQDNSKNMDHDG

SEQ ID NO: 154864 - protein, 102 aa, Glycine max
  Coding DNA Sequence Number=SeqID_38086
  Gene Ontology: Mol. function=DNA binding; Biological process=DNA integration
  Homolog annotation: Hit_ID=Q1SRN1; Match level="QueryCoverage=86%, HitCoverage=5%, E-value=5e-24, Identity=59%"; Hit description =Integrase, catalytic region
MAIRCNPKDSYRLLSLRSEVPSVFIQFKTMVELQLNTKIKALQTDGAKEYLALTKYLADRGIQHCISCPHTHEQNGAPERKHRHLTETGLTLLAASSLPSKF

SEQ ID NO: 154865 - protein, 315 aa, Glycine max
  Coding DNA Sequence Number=SeqID_38087
MASSRAIKWLQICDHGTNFKNNQFLNIFLRVFVQHLLCQEKFIGQKLVLFYFLPLLHSYKKLFKRPTLGCKSFKRQSTWLNHWTQRSNVLWGSLQEVEFASSYNHWTQRSNVLWGSLQEVGLPLGVITEHKGGRSFGVHCKRWDCLLEVTPAIGVDAPVTSAGSVVVSSSTVTTCLLSVGVATASTPVMLPPSSSAPPVPPSTMLVGEVGKELEDELIMNKKKVIEQHEKGFNRVVRQAGFFAKDLDLGLSYLFKDMKDDVFLDEENITTDEEVLVEPHRGLPRTDLGFYELVKLTKADLGFGELLENQPKMRAS

SEQ ID NO: 154866 - protein, 155 aa, Glycine max
  Coding DNA Sequence Number=SeqID_38088
  Gene Ontology: Mol. function=DNA binding; Cellular component =mitochondrion; Biological process=DNA integration
  Homolog annotation: Hit_ID=Q1T4S3; Match level="QueryCoverage=94%, HitCoverage=9%, E-value=7e-33, Identity=52%"; Hit description=Zinc finger, CCHC-type
MRSTSGFYVYLGNNLVSWLAKKQQSVSRSSTEAEFRSLAALVAEIKWLKSLLTELHIIQMKPHLLWCDNQGVVMITANPVLHSKSKHFELDLWFVCENLAANREIVVKHIPSQFQVVDLLTKAPSSSTFLSLRPKLNVHQLPTISLWGDVKDKAK

SEQ ID NO: 154867 - protein, 188 aa, Glycine max
  Coding DNA Sequence Number=SeqID_38089
MHQLTLVLFFMQVLALAWLKWLHANNQLSTREDFLHNCFISGLHTVIRAKLVIFQPNSLAQAVGLALLVEEKFKDSRSSFSCDSRTSYSPIVHSKPSILGPPPSSMFTTSTLPIKRVNSTDVQKHGSKGLCYNCEDKWSLGHRCQRPISDTTSINSPSNGEQFHLSFAAFSGPPPPRTPRGRLRLKSP

SEQ ID NO: 154868 - protein, 124 aa, Glycine max
  Coding DNA Sequence Number=SeqID_38090
MRSNCPGNDKFLDCVPLLSKPFQLGQEPPSQHPFSVGTKNLVQLEDHERSIISSLPVKMSDAKDDVEWLQYSSKDENQFKWHIQIKQRKLNITSVPPAIANQTRSGAYTNLKAVLFFQTLTRSE

SEQ ID NO: 154869 - protein, 79 aa, Glycine max
  Coding DNA Sequence Number=SeqID_38091
MWASNNAYLEMVVLMNLVFRMSVYPKENVGSCLVPFMLHVSAEAMNDAAEGMQHTIRKLSHHLQIPSANEGVSKYLDFK

SEQ ID NO: 154870 - protein, 49 aa, Glycine max
  Coding DNA Sequence Number=SeqID_38092
MAKWDSSACRNPGHEGREGVNSGGGGIGIGEGWLRQSRSNSTLVARSEC

SEQ ID NO: 154871 - protein, 121 aa, Glycine max
  Coding DNA Sequence Number=SeqID_38093
MDAVKAAVNRSEQQDDGLLPEFKLREHMSRQSWIFSVDPFAYVLWQRESNGYGQDNSNARAEDIGREGTSGQVDPVNNNLRTGMSEVGIPLRATRGENATATSGIVSGLAACAGDIAMHGM

SEQ ID NO: 154872 - protein, 44 aa, Glycine max
  Coding DNA Sequence Number=SeqID_38094
MGNGRVERLLGWLKGEVIYSGLLDRDCNGPVWTVMRSSTGEPKW

SEQ ID NO: 154873 - protein, 392 aa, Glycine max
  Coding DNA Sequence Number=SeqID_38095
  Gene Ontology: Mol. function=RNA-directed DNA polymerase activity; Cellular component=chromatin; Biological process=chromatin assembly or disassembly
MVDNGSILECQQRCADIPLILQGHSFTVTLHLLPISDTDIVLGIDWLQQLGPVVTNYTMLSMKFHHFGSLVELRVDVQNGPLQSFAKQFKRMIQTGSTSSLFHLALQPVTTHHPELDTPHPIPEIKFLLTKYTPIFLIPSPFPPPRLIAHRISLHPSTSPRDGCWRICMDYCALNAVTVRDHFSMSTIDELLDDLRKASWFTKLNLCQGSMPPLLFHSRRYSVGTNFTDASGTTMGVVLMQHGRLVTFFNKQFTPKLQHASKYVRELHAMTTAIRKWRQYLLGHKFTILMDHRSLKELMTQIIQTPEQQYYLAKLLGYNYTIQFKSGHSNVIADSLSRIEVPFEPTFLVLSVPQIEFMDQLRATLQASPIFQQNLSSISSNPKAFPVFQMHS

SEQ ID NO: 154874 - protein, 147 aa, Glycine max
  Coding DNA Sequence Number=SeqID_38096
MKGCRLLEGDGEGGGGFWEKGLGRVGCVDLKGRRQSWILSTYNLASVVAWGNDMGCMANTSRRMSGERPEMKQLRRNGGGISNDEDMFKSKGKDPLEGLGGPMTRARARKAKEALQQVLSILFEYKPKFQGEKSKVVSCIMAQMEED

SEQ ID NO: 154875 - protein, 52 aa, Glycine max
  Coding DNA Sequence Number=SeqID_38097
MVNNHHNHRITVGVGQIGLAILNEFLDIPPGMVPGEISLKVVDSFGNSKVSA

SEQ ID NO: 154876 - protein, 158 aa, Glycine max
  Coding DNA Sequence Number=SeqID_38098
MKGCRLLERDGEGGGGFWEKGLGRVGCVDLKGRRQSWILSTCNLASVVAWGNDMGCMANTSRRMSGERPEIKQLRRNGGANLLDRRNRSGQSGILVPAEIPAMRGREGVNSGGGGVGIGEGWLRWSRSNSTLVTRLATFNKVSNTCTKTLLTDYVLHY

SEQ ID NO: 154877 - protein, 299 aa, Glycine max
  Coding DNA Sequence Number=SeqID_38099
  Gene Ontology: Mol. function=RNA-directed DNA polymerase activity; Cellular component=chromatin; Biological process=chromatin assembly or disassembly
MICLSHITFSSPVLLVKKKDGCWRMCMDYRALNAFTVRDHFSMPTIDELLDDLSQGSWFTKLNLRQVFFDDILVYNESLPEHIKHLDLVLSALLQGKFYLKCSKCFFAQQQLEYLSHIISGKGIEPEDKLHRPSETQQAFDLLKHTMTQALILIPLDVSHPFIVETDASGTTMSAVLMQQGKPVAFFNKQFTPKLQRASKYVQELHAMTTAIRKWRQYLLGHKFTILTDYRNLKELMTQIILTLEQQYYLAKLLGYNYTIQFKSGHSNVIADSLSHIEVPFEPTFLVLLVPQFEFMDQL

SEQ ID NO: 154878 - protein, 247 aa, Glycine max
  Coding DNA Sequence Number=SeqID_38100
  Homolog annotation: Hit_ID=Q39008; Match level="QueryCoverage=20%, HitCoverage=8%, E-value=9e-13, Identity=72%"; Hit description =Mitogen-activated protein kinase kinase kinase 1
MGYKLCYFKRASPGAVVKLCLGDLLVMGSNPETASLHMQGDIRCANILVDANGSVKFADFGLAKEPKFNDVKSWKGTAFFWMAPEVCLQSPPLKKAKEESTQKNFDEGETAQLGLSKVVVTKGATPNQHEMAPNLGNVRAEPVWHGEIGHVRMRERGSLKVAGGWRQLLKNELEKLKMLLEIKQLVEGSTGMWKAKERSLPEKGGSYRGEVWKESRPLGILIAFLFWLRLQAESFFSMEHLLCEGRL

SEQ ID NO: 154879 - protein, 55 aa, Glycine max
  Coding DNA Sequence Number=SeqID_38101
MNGIVAPDLRSNLEALHMIVTKKEKIMKLNLVTMMGRNQKQGDIMGDNNEATEDD

SEQ ID NO: 154880 - protein, 179 aa, Glycine max
  Coding DNA Sequence Number=SeqID_38102
  Gene Ontology: Mol. function=oxidoreductase activity, acting on single donors with incorporation of molecular oxygen, incorporation of two atoms of oxygen; Cellular component=membrane; Biological process=aromatic amino ...
  Gene Ontology: Biological process=acid family metabolic process
  Homolog annotation: Hit_ID=O23920; Match level="QueryCoverage=77%, HitCoverage=32%, E-value=4e-49, Identity=69%"; Hit description=4 -hydroxyphenylpyruvate dioxygenase
MRYLKGFSGFHKFTEDVGMSETELNYSMVLANNSETVLLPLNESVYGTKRKSQIETYLEHNKGAGVQHLALVTHDIFTTLREMRKRSFVGRFEFMPSPPPTYYANLHNHATNVLTVDQIKHCEELGILVDRDDTRTCFAVNIVIVVLGFNQKICRGFRRSDSQVQKCDIALKLYHMIYA

SEQ ID NO: 154881 - protein, 131 aa, Glycine max
  Coding DNA Sequence Number=SeqID_38103
  Gene Ontology: Mol. function=protein serine/threonine kinase activity; Cellular component=cytoplasm; Biological process=protein amino acid phosphorylation
  Homolog annotation: Hit_ID=Q7XTK4; Match level="QueryCoverage=74%, HitCoverage=16%, E-value=6e-45, Identity=89%"; Hit description =Putative mitogen-activated protein kinase 1
  Pfam annotation: Domain name=Pkinase; Domain location=1-128; Score= -55.5; E_value=2.9e-05; Accession=PF00069.15; Description=Protein kinase domain
  Pfam annotation: Domain name=Pkinase_Tyr; Domain location=1-128; Score=-123.3; E_value=6.6e-05; Accession=PF07714.7; Description =Protein tyrosine kinase
  Pfam module annotation: Pfam domain module=Pkinase::Pkinase_Tyr; Domain location=1-128::1-128
MKIILNFFFWVSEDASNLYIFIELVTKGSLRNLYQRYNLRDSQVSAYTRQILHGLKYLHDRNIVHRDIKCANILVDANGSVKLADFGLAKATKFNDVKSCKGTAFWMAPEVCLQSPPLKKVIEKWANICIN

SEQ ID NO: 154882 - protein, 54 aa, Glycine max
  Coding DNA Sequence Number=SeqID_38104
MSLQLRLWAGRPWWACTNKRGERGVRIKEGRSQDGKCRKQMSIFKQHPDQRLAN

SEQ ID NO: 154883 - protein, 101 aa, Glycine max
  Coding DNA Sequence Number=SeqID_38105
MAQGFNITSNHDRGREYFAPNCMIELFSWSFGFDIRTFEFIAFGTGRAITNVSPYQVKSHLNLVDHDPLYKSSCFEGYLNAPKTSKSIIIHSLLFLKLKGG

SEQ ID NO: 154884 - protein, 115 aa, Glycine max
  Coding DNA Sequence Number=SeqID_38106
MLMMLKMHGDDVMLCMYIGATMILLDIPSGGNKVFLMRRNTCSWGHVTRFGTPLRLRLITVGEGVACVRQGDLDTYCLVFLSESVVWTRLGYLLGDGTTLHLRVEVRCMHHTEHD

SEQ ID NO: 154885 - protein, 229 aa, Glycine max
  Coding DNA Sequence Number=SeqID_38107
  Homolog annotation: Hit_ID=Q1SKD7; Match level="QueryCoverage=64%, HitCoverage=38%, E-value=6e-07, Identity=26%"; Hit description =Ankyrin
MAQISRQHSPSDHPSREERGARPCHLTRLPKKRIDVALVRKFYANAYDPEDSSLKYCRVWGKVIRFDVETLNDFLETLVIITEGEEYPIYFQYLYTYPDHEAIMAKLCTSGDQFILNTGGAPWKQLRKDLTTLAQTWSVLSYFNLVPTSHTFYLNMDLARLIYGLVSQMDMDLGNMILGQIRQIAQSSTFQLGFATLITTLCDVQGFTSNTLTFESLSPMINLTYISVQ

SEQ ID NO: 154886 - protein, 94 aa, Glycine max
  Coding DNA Sequence Number=SeqID_38108
MASRRGMLILTFLKFPIVSLSSTTLFRGVTLDGKGKGALCRACRPWIFFINGVLCFLKINRGRMKKEKGEMRCHFKEKMSQEQTHHHRKPWIRA

SEQ ID NO: 154887 - protein, 162 aa, Glycine max
  Coding DNA Sequence Number=SeqID_38109
  Gene Ontology: Mol. function=RNA-directed DNA polymerase activity; Cellular component=intracellular; Biological process=RNA-dependent DNA replication
MPQKCKDPSTFVIPCTIGKCTFADAMLDLGVSINIMPTLIYRPLQLGDLRPTKVVIQLANWSIAQPLGVLEDQSSLELKPFPTHLKYAYLEANDQLHVIISNSLQAGQEEKLLKVLRDHKRAIGWTLVDLPKINLAICMHRILLEDEFKPMRQPQRRLNPII

SEQ ID NO: 154888 - protein, 629 aa, Glycine max
  Coding DNA Sequence Number=SeqID_38110
  Subcellular localization annotation: CTP_CleavageSite=70; ConfidenceScore=5.22e-01
MERSEPALVPEWLRSAGSVAGAGSSAQQFASSSAHTDSLSVRNKSSKNGSDFDSARSVFLERTSSSNSRRSSMNGSAKHAYSSFNRNHRDKDRDREKDRSSFGDHWDCDGSDPLANIFPGRMERDTLRRSHSMVSRKQNEVIPRRVVVDTKSGGSHQNNSNGILSGSNVSNSIQKAVFDKDFPSLSTEEKQGIADVVRVSSPALGAAASQSLPVGSSALIGGEGWTSALAEVPAIIGSSSTGSLSVQQTVNTTSGSVASSTTAGLNMAEALAQTPSRARSAPQVLVKTQRLEELAIKQSRQLIPVTPSMPKASRILKIDCVDCQVHNSEKSKPKTAIRNADMNVVTKSVPQQPPALHIANQSVRSVNSKVDAPKTSGKFTDLKSVVWENGTSPTSKDVSNPTNYSNSKPGNQHAVALGAASAPLRNPNNLKSPTERKPTSMDLKLGSNLEKKHSISQVQSRNDFFNLIKKKTLMNSSAVLPDSGPMVSSPAMEKSGEVNRGVIVSPSASPQSHGNGTELTSNGTHAHEEVHRLSDNEEKESNPSVTIYPDEEEAAFLRSLGWEENSDEDEGLTEEEINAFYQECKKLDPTTFKLCQGKQPKLSKLFESYASNLCESSAELSSSDPRSEA

SEQ ID NO: 154889 - protein, 144 aa, Glycine max
  Coding DNA Sequence Number=SeqID_38111
MAELCLVPDVVIPLKFKEPDFNKYKGTTCPKIHLKMYCRKMGAYARDKNVCWRKDRSRKFDYVTTMSSSNRRLGMSEGNKKEGETHVVTVVPTWPNFPLAPLNPMYQCPPQQYQYSANISPSHYSPPYQPRTPNHPQRPPLNRP

SEQ ID NO: 154890 - protein, 366 aa, Glycine max
  Coding DNA Sequence Number=SeqID_38112
  Gene Ontology: Mol. function=DNA binding; Cellular component=beta -galactosidase complex; Biological process=DNA integration
  Homolog annotation: Hit_ID=Q1SDN3; Match level="QueryCoverage=99%, HitCoverage=32%, E-value=3e-95, Identity=46%"; Hit description =Polynucleotidyl transferase, Ribonuclease H fold
MEGLDFLDTFSPVAKLTLSAVYMKLPPGLIVDNPNLVCRLQRSLYGLKQASRQWFTRLSSFLLSQGFRQSSADHSLFLYSNNDNDITAILVYVDDIILTGNNLKTITHITKLLDQTFSIKDLGILKFFLGLEVARSSHGIQGSCSCQRKYVLDILSDSGMLGSRPTSTPMDYSTYIAHAVQQLSQYMANPTSTHSQAAFRVLRYLKGSPGSGLFFAAQGTLTLKAFSDSDWAGCRDTRRSITGFSVYLGESLISWRSKKQSTVSHSSSEAEYKALASTTCELHGSPTSFTIFGSPSFNLQLSIVTNQSAIQIASNPVFHKCTKHIEIDCHIVRDKVNKGLLKLLPVSSSMQLVDIFTKPLSPALFQ

SEQ ID NO: 154891 - protein, 205 aa, Glycine max
  Coding DNA Sequence Number=SeqID_38113
  Gene Ontology: Mol. function=nucleic acid binding; Biological process= lipid transport
MSTRKQIVQAIIHHNGKMGDSANEVEFNSRKTCNITCELDVTFKNISGDTYSISMRDKNTKRTHTCVLTMSQDHVKLRYDVIGTSIIAMAIEQAYGNWKQSYEDLPKLLLAFQTSVPRTIVEKELKLTYNEHRELLPGCATYHHIFWTFKVLVDGFAYYKPIVEVDDTFHYGTYKGTLLVVVAQDETNHILPIAFALVEGKTTEA

SEQ ID NO: 154892 - protein, 254 aa, Glycine max
  Coding DNA Sequence Number=SeqID_38114
  Subcellular localization annotation: CTP_CleavageSite=71; ConfidenceScore=5.70e-01
MTGFKTEPPSYSFFYNTNPSFAPHLNFSLLPRISTIFLFSSPSPSFPLPPLVTPLILPPSPPQASFLLRLCSAAPFPFLSFPFKRTFLHVGLGQQVAIACRIRGRLDLEEIMNQPEDAGEKGVINDDVDVGRNKDELGKTIGREQEEPPKSQIGRESGSKFSNWLNGERSEMEWFWRKPRADLENVRFSTLNSKYTDEGSSNGYSTEALYSETWCECHVRCLKVVMRSNVGLEGGKKHKWWNCKVYVPFFVFYE

SEQ ID NO: 154893 - protein, 50 aa, Glycine max
  Coding DNA Sequence Number=SeqID_38115
MEKKKTKMNDEKEEVVVLIHKERIEAFRRLCRHNLSRITHYTTLRFRQQN

SEQ ID NO: 154894 - protein, 58 aa, Glycine max
  Coding DNA Sequence Number=SeqID_38116
MELLIERAGHPKIDDGITVLLVASFNQFIISYMFMIYEVEEYLVGSANSLCSWAYSSL

SEQ ID NO: 154895 - protein, 138 aa, Glycine max
  Coding DNA Sequence Number=SeqID_38117
MSKKSLDTSRWNVQIRRKVKIRTNSFKTKEKKGLMSTWDDLDDTSSNEDAEEANICMMANTSSEGFESDQDNEVNCNDPKSLGKAYYELLSNSSILSKAYQNLRKDFKNISKDPLKLEKTLQDQVDGSLDEFAQACKA

SEQ ID NO: 154896 - protein, 94 aa, Glycine max
  Coding DNA Sequence Number=SeqID_38118
MEVPVGTGANGGEKDEAKGDGVQLEKGLARVEEEGVAESGPLALDLRVPGKVIDGSSRAEGLKGQRIGYDSSGYAQSCDQYRKVKSRGVGLGHL

SEQ ID NO: 154897 - protein, 159 aa, Glycine max
  Coding DNA Sequence Number=SeqID_38119
  Homolog annotation: Hit_ID=Q336M6; Match level="QueryCoverage=25%, HitCoverage=34%, E-value=2e-11, Identity=75%"; Hit description =NADH:ubiquinone oxidoreductase 17.2 kD subunit family protein, expressed
  Pfam annotation: Domain name=NDUFA12; Domain location=41-112; Score =55.7; E_value=1.6e-13; Accession=PF05071.7; Description=NADH ubiquinone oxidoreductase subunit NDUFA
MTSWGYMGIKEVIEDEQAPTVYDYFGYGQPSGKPSEQNTCSNIEATYKHRWVEYAEKTRYNASQVPAEWHGWLHFIIDLTGGELLLLKPKRYGAEHKENWSGEVKQDPQVEGEIGLIFTKTMIFCSNGYIILLDNDKNYCKMEIELKAQMIVRIEIMEM

SEQ ID NO: 154898 - protein, 78 aa, Glycine max
  Coding DNA Sequence Number=SeqID_38120
MAPPVRARPNVKKEYPGLAEMSPMQLQARDPRPSSSSQTSKTGVVTGEVEALAEAPGLRKPHLPPKEKDELLARPPEL

SEQ ID NO: 154899 - protein, 44 aa, Glycine max
  Coding DNA Sequence Number=SeqID_38121
MTKEYLKAVGSVSLQPCMAIYRKTAKECKKFSQASCSSHRRIMA

SEQ ID NO: 154900 - protein, 127 aa, Glycine max
  Coding DNA Sequence Number=SeqID_38122
  Subcellular localization annotation: CTP_CleavageSite=12; ConfidenceScore=5.11e-01
MNTNGDKKKKCRRKRKTNKKHRRKWMMNRHRKRKMKGRMNRKRKKKDRRNRKRKKKGHRNRKRKKDARNSRRKRKKKERATAIGRERRRSAGRQYGRNCSFVYIIKVKDIFIISPFVLGVLAMLGAP

SEQ ID NO: 154901 - protein, 307 aa, Glycine max
  Coding DNA Sequence Number=SeqID_38123
  Subcellular localization annotation: CTP_CleavageSite=13; ConfidenceScore=5.46e-01
MAASSKKRKGSSSSTTIAGQHCHDASGDSPTPPNPSLSSPCSLTLFSFDDQRQRYYSSFSNRVILDPKFLDFDFFEGETFDCYQSLFYSLTKLSSQGVPFEGTLVDDWKSIYSSHDARKMVCVENADMTGRLLVGSFTFECHIMHYILCRVLLPRSTNLAQASEEDLILLWALQTDRQIDWAHLVRYRMHKALRANAPLLYLHLVTLILQHFNIPLVNKPFVKVKRSFAIGVAVVASFGYRKDLDGQWVRKQDLSPNAPHEHTRSPPPRDPSSSLLNDVLASFRMFVHLSETGLILWIHVLRDLRMI

SEQ ID NO: 154902 - protein, 499 aa, Glycine max
  Coding DNA Sequence Number=SeqID_38124
  Gene Ontology: Mol. function=transferase activity, transferring glycosyl groups; Cellular component=membrane
  Homolog annotation: Hit_ID=O80941; Match level="QueryCoverage=84%, HitCoverage=79%, E-value=1e-167, Identity=64%"; Hit description =Putative zinc finger protein
  Pfam annotation: Domain name=DUF604; Domain location=215-470; Score =499.0; E_value=5.5e-147; Accession=PF04646.3; Description=Protein of unknown function, DUF604
  Pfam annotation: Domain name=Fringe; Domain location=99-334; Score= -101.2; E_value=0.1; Accession=PF02434.7; Description=Fringe-like
  Pfam module annotation: Pfam domain module=DUF604::Fringe; Domain location=215-470::99-334
MSSGVDSVRDPLDNAWKTLRFPIIKPRELLLLFLKAGIAVSMLLIITLFITLYNQPFYPNNNHTTMKYMLQQKTPEEKASTNISHLLFGIGGSSATWQTRRQYSELWWRPGATRGFVWLESHPPDNTTWPETSPPYRVSGDTSVFKYTCSYGSRSAIRIARIVKESFELGLENVRWFVMGDDDTVFFTDNLVTVLSKYDHNEMYYVGGNSESVEQDVIHFYTMAFGGGGFAISYPLAKELVRILDGCIDRYAEFYGSDQKIQSCISEIGVQVTKEPGFHQVDIHGNPYGLLAAHPVAPLVSLHHLDYVDPIFPNTTRVNAVKKLITAYKMDPGRTLQKSFCYDLRRNWSVSVSWGYSVELYPSLRTSKELETAFETFRTWRTWHDGPFTFNTRPVSVDTCERPHVYVLDGVRNVDGDMTRSWYRKTVDASGKECAREEYARALEVQYVDVYASRFVPDKWKKAPRRQCCEIMDGADGVNSSVVRVKIRGCRRFESVTPS

SEQ ID NO: 154903 - protein, 417 aa, Glycine max
  Coding DNA Sequence Number=SeqID_38125
  Homolog annotation: Hit_ID=Q9FQZ2; Match level="QueryCoverage=75%, HitCoverage=92%, E-value=1e-31, Identity=31%"; Hit description =Avr9/Cf-9 rapidly elicited protein 137
  Pfam annotation: Domain name=DUF668; Domain location=269-365; Score =54.6; E_value=3.2e-13; Accession=PF05003.3; Description=Protein of unknown function (DUF668)
MARCPGAAANLCCLFFHQHHEPSPPPDTLGILAFDAAKTMCRLVSLYNSHDHQEILHLRRHVIRSKSVSKLNSRDECFLLTLACAKRLEDLNLSAATVSRLATRCSDRNLARCFESVDARKLEFGTKDVESKIENMEKLVSLWNQTFDKVVGLMARIVCIVYNRICSVFGTFVTGDVKRRNLNNNNNNGVVKRHIVENSCCRIEHRELYRMNLCMFDQTEEALKKRAWGCCNARKRAPTGVFRFHHAPPREGGEVSGNNHVMRLAPENTVGGAGLSLRYANVILLAEQCMHAADAVIGNDARVALYDMLPGRLKVKLRGKLKSEWLEWEKLEGGEEEHSAAATRRHAAAAEVMEILLPVAHDMVRWQAERNLEKQKFETKPTVLLLQTLHYSDLEKVEEVIVEVLVGLSYMYWNRNL

SEQ ID NO: 154904 - protein, 674 aa, Glycine max
  Coding DNA Sequence Number=SeqID_38126
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=96%, HitCoverage=97%, E-value=0.0, Identity=74%"; Hit description=Lectin -like receptor kinase 7;3
  Pfam annotation: Domain name=Lectin_legB; Domain location=21-252; Score=375.4; E_value=9e-110; Accession=PF00139.10; Description =Legume lectin domain
  Pfam annotation: Domain name=Pkinase; Domain location=334-604; Score =163.3; E_value=6.4e-46; Accession=PF00069.15; Description=Protein kinase domain
  Pfam annotation: Domain name=Pkinase_Tyr; Domain location=334-604; Score=97.1; E_value=5.4e-26; Accession=PF07714.7; Description =Protein tyrosine kinase
  Pfam module annotation: Pfam domain module=Lectin_legB::Pkinase::Pkina se_Tyr; Domain location=21-252::334-604::334-604
MATLLKILSLTVLLLIPVSCQVDQLLYAGFKDVGASNLTMNGVAKIEHNGILKLTNDSSRLMGHAFYPSPFQLKNSTSGKVLSFSSSFALAIVPEYPKLGGHGLAFTIATSKDLKALPSQYLGLLNSSDNGNISNHIFAVEFDTVQDFEFGDINDNHVGIDINSMQSNASANVSLVGLTLKSGKPILAWVDYDSQLNLISVALSPNSSKPKTPLLTFNVDLSPVFHDIMYVGFSASTGLLASSHYILGWSFKINGPAPPLDLSSLPQLPQPKKKQTSLIIGVSVSVFVIVLLAISIGIYFYRKIKNADVIEAWELEIGPHRYSYQELKKATRGFKDKELLGQGGFGRVYKGTLPNSKIQVAVKRVSHESKQGLREFVSEIASIGRLRHRNLVQLLGWCRRRGDLLLVYDFMANGSLDKYLFDEPKIILNWEHRFKIIKGVASALLYLHEGYEQVVIHRDVKASNVLLDFELNGRLGDFGLARLYEHGANPSTTRVVGTLGYLAPELPRTGKATTSSDVFAFGALLLEVACGRRPIEPKALPEELVLVDWVWEKYKQGRILDLVDPKLNVYFDEKEVIVVLKLGLMCSNDVPVTRPSMRQVVRYLDGEVEVPEDLKKPGDISHHEGFDEFLHSLASSSFDKMSSGSNFGNRDMESSFLSFANSPHSLLHGRGETR

SEQ ID NO: 154905 - protein, 142 aa, Glycine max
  Coding DNA Sequence Number=SeqID_38127
MKLRRHCSIWCHHKGVTHGQWMISCLYVEKLTILSEEQERITEPVAHGPASERSFPPQQFHMLPSSVETRGFDRRREIVQAEDFSQQMEQRGHGMYYSPPTFSQYPSQMYQYPFEGHDTDMSASEHSFGGVAEHILIFHGRP

SEQ ID NO: 154906 - protein, 145 aa, Glycine max
  Coding DNA Sequence Number=SeqID_38128
  Gene Ontology: Mol. function=oxidoreductase activity
  Homolog annotation: Hit_ID=Q1T6K5; Match level="QueryCoverage=97%, HitCoverage=43%, E-value=2e-57, Identity=79%"; Hit description=2OG -Fe(II) oxygenase
  Subcellular localization annotation: CTP_CleavageSite=50; ConfidenceScore=5.43e-01
MDTKCFLPEFSTQIYRRVTSDPSRSDLVFPRFRSARMFLSSTWVVKIEPRLFTRSVKPAETMVINHGVALEAAKEMAEVAHGFFKLPVEEKLKLYSEDPSKTMRLSTSFNVKKETVHNWRDYLRLHCYPLDKYAPEWPSNPPSFK

SEQ ID NO: 154907 - protein, 80 aa, Glycine max
  Coding DNA Sequence Number=SeqID_38129
MHACSTQTASGTGGFTVGEGLTTVNGDIHMQAEEIASASGDIRANGNRQSNWRVPGGRLPFSEDRPKGKLQLSLASCNCH

SEQ ID NO: 154908 - protein, 262 aa, Glycine max
  Coding DNA Sequence Number=SeqID_38130
MERCTTLAPKRTPPVIENKSLGHRWLRRRNQHISNDDLIIFRRKLSIMKRHEFLWEPYTATVMSSLPPICLVGSVAWCAVNIHGLTLKSKQDENWFQLLAPMISQWNNRTEFSVDVYPRQEGLLSFNSDYMAEVAETLQYMVSPQGRNTWTVDDLVPYVEKITILLEEQERITEPMYQYPFKGHHTDMSASEHSFGAPHWNVPGAIPDMGDLLGVDLSQEFFAEAEEVQAGRHRGRRNPDRQARRWDRPCGTSSRHHGHDNE

SEQ ID NO: 154909 - protein, 109 aa, Glycine max
  Coding DNA Sequence Number=SeqID_38131
  Gene Ontology: Mol. function=transferase activity, transferring glycosyl groups; Cellular component=cytoplasm; Biological process =metabolic process
  Homolog annotation: Hit_ID=Q2V6K1; Match level="QueryCoverage=90%, HitCoverage=20%, E-value=1e-09, Identity=40%"; Hit description=UDP -glucose glucosyltransferase
  Subcellular localization annotation: CTP_CleavageSite=50; ConfidenceScore=5.18e-01
MASKTLILVLLVSFPAQGLVNPLLRLDKHLAAKGCFVTFSTTKPTGEHMRFATNNNATIDETSSTPMGDGFFAFNFFDDSLGDGDHPERHNLSDTKAHLERIESKSVPR

SEQ ID NO: 154910 - protein, 167 aa, Glycine max
  Coding DNA Sequence Number=SeqID_38132
  Homolog annotation: Hit_ID=Q1SYN6; Match level="QueryCoverage=55%, HitCoverage=15%, E-value=3e-08, Identity=28%"; Hit description=Zinc finger, BED-type predicted
MASPSIPATVNEVNTVNAHVENNIQHGEKDKGQVNENVIKRKRQKTPTVWNDFEEIELLGGLKKVVCKYCKEKLGIGDEDFFMREMAALMKTKFDEYWGECNLLMAIASVLDPRVAKENIKKARESLEKLYDEYVTLSLEESSSMEVDNGGNNPVNDEGYEEITLKI

SEQ ID NO: 154911 - protein, 162 aa, Glycine max
  Coding DNA Sequence Number=SeqID_38133
MVLQGQPIIRNAKYSQEYMVWYQSNTIIFLNMQPPSGLSMNFETGQSSRATNIAQPECNLAYTPIPPIIDYVAPTYTPIPPTPMADYVFPSASNMDYTSPIVQPDDFLSNNKVEPSFNLMFSQDVEENNPSLYDIPDERPRRIQDIIGDAFHVEPDPIMGIK

SEQ ID NO: 154912 - protein, 91 aa, Glycine max
  Coding DNA Sequence Number=SeqID_38134
  Gene Ontology: Mol. function=oxidoreductase activity
  Homolog annotation: Hit_ID=Q1T6K5; Match level="QueryCoverage=77%, HitCoverage=21%, E-value=1e-28, Identity=81%"; Hit description=2OG -Fe(II) oxygenase
MTKGSAGSNSRQCSLHIYMCALSNGLYKSVWHRAVVNVEKPRLSVASFLCPNDEALISPAKPLTEGGSEAIYRGFTYAEYYKKFWSRNLDQ

SEQ ID NO: 154913 - protein, 188 aa, Glycine max
  Coding DNA Sequence Number=SeqID_38135
  Gene Ontology: Mol. function=caffeate O-methyltransferase activity; Biological process=lignin biosynthetic process
  Homolog annotation: Hit_ID=P28002; Match level="QueryCoverage=100%, HitCoverage=58%, E-value=4e-78, Identity=71%"; Hit description =Caffeic acid 3-O-methyltransferase
  Pfam annotation: Domain name=Dimerisation; Domain location=1-35; Score=31.9; E_value=2.2e-06; Accession=PF08100.2; Description =Dimerisation domain
  Pfam annotation: Domain name=Methyltransf_2; Domain location=51-188; Score=87.4; E_value=4.3e-23; Accession=PF00891.8; Description=O -methyltransferase
  Pfam module annotation: Pfam domain module=Dimerisation::Methyltransf_ 2; Domain location=1-35::51-188
AGPGVHLSPSDIASRLPTHNPDAPVLLDRILRLLACYNILSFSLRTLPHGKVERERLYGLAPVAKYLVRNEDAVSIAALNLMNQDKVLMESWYYLKDAVLDGGIPFNKAYGMTAFEYQGTESKSLKSLVDVGGGTGAVINMIVSKYPTIKGINFDLSHVIEDAPSYPVEHVGGDMFVSVPKADAIFMK

SEQ ID NO: 154914 - protein, 590 aa, Glycine max
  Coding DNA Sequence Number=SeqID_38136
  Subcellular localization annotation: CTP_CleavageSite=43; ConfidenceScore=5.18e-01
MKKSGENSNGYQTHTKIVNQERSSAGSPRKFSVTKFAPEYFKSGSAVNDGPFQSKPSCGFGLHYLDITKMKENTVPPAKPTDCASGSSQMGLQHVDLKEFIIFQKQQALVCTGDVDSGCNVNNCSEYSSSCSAEHVPPSPSSVVDTTTTPENSARKVSTEKLNVQMLLDTLQNLSELLLYHCLNDACELKERDCNILKNVISNLNTCALKNAEQIAPAQECFFNQPETSKSAGESREFHQNASFKRPQLTKTEMTKACNMTKDLKRILSENFHDDDEGAEPQTVLYKNLWLEAEAALCSVYYKARYNQIKIEMDKHSYQEKEMEKQSKSEVVPSLSQSQSFATKVHHPNPDSSAALKFRVLDATNLEELSCLNISTDMNKPNAMTPEGKGGQNLDSFINNYFVPCSDDEAERNDESSVMARYQVLKARVDQSSIDNLEEPLDIADKSSPRGRDNQNQVNLSQDSPIPEKNCTDYETSVLARFHILKSRIEGSSSTSEGKQLDGDGSAGKEMDDTTNSTYVSEGKSLDVHVNPAVVHLNSYTAVDKSIPKEFHLDSEDNQETQPSGTCEFQPPTYYSDGFASDWEHVEKSL

SEQ ID NO: 154915 - protein, 218 aa, Glycine max
  Coding DNA Sequence Number=SeqID_38137
  Gene Ontology: Mol. function=protein binding; Cellular component =nascent polypeptide-associated complex; Biological process=protein transport
  Homolog annotation: Hit_ID=Q1T6J8; Match level="QueryCoverage=99%, HitCoverage=100%, E-value=1e-63, Identity=62%"; Hit description =Nascent polypeptide-associated complex NAC; UBA-like
  Pfam annotation: Domain name=NAC; Domain location=73-132; Score=81.9; E_value=1.9e-21; Accession=PF01849.8; Description=NAC domain
  Pfam annotation: Domain name=UBA; Domain location=179-216; Score =21.9; E_value=0.0024; Accession=PF00627.21; Description=UBATS-N domain
  Pfam module annotation: Pfam domain module=NAC::UBA; Domain location =73-132::179-216
MSPGPVLDAGADQQIPFVDDASLKKKPHPLEDDAPIVEDVKDDDKDETEDEDEDDDDKEDDAQGAAEGGKQSRSEKKSRKAMLKLGLKPVTGVSRVTIKRTKNILFFISKPDVFKSPNSETYVIFGEAKIEDLSSQLQTQAAQQFRMPDVESVLAKQDQDAAAAAAQPEEEEEVDETGVEPHDIDLVMTQAGVSRSKAVKALKTHNGDIVGAIMELTT

SEQ ID NO: 154916 - protein, 174 aa, Glycine max
  Coding DNA Sequence Number=SeqID_38138
  Homolog annotation: Hit_ID=Q337M3; Match level="QueryCoverage=77%, HitCoverage=26%, E-value=2e-22, Identity=39%"; Hit description =Expressed protein
MFSVGALKSEFLGRQPDRERKERSKKMEEEKGKSSDLVILSTKEETSVPALVCLRKEDIKRFEETEECFVLDFDPFHSLDFSKLSLDHQDVSILAEKGEVACRDYPHPRHLCVKFPFTATPHGSYCEMCYCYVCDSAAPCKYWNPSTLSHCDADSDDDWKEERNRKKFQSILAS

SEQ ID NO: 154917 - protein, 142 aa, Glycine max
  Coding DNA Sequence Number=SeqID_38139
  Homolog annotation: Hit_ID=Q1S700; Match level="QueryCoverage=46%, HitCoverage=20%, E-value=1e-07, Identity=46%"; Hit description =Ribonuclease H
MKTQRFYTGSSQLLGYIQFSFKPGRVSTNQIFDYNQDRVTIPLLLNYEPSAKALVFSGLDSNVTWMQPDSTPLSWRSNGNLPRWVGLNVILMAQIEANPVRQVVVASLGIIMALQKDTLVFWASQQRWKQNYWVPLQLWKRP

SEQ ID NO: 154918 - protein, 316 aa, Glycine max
  Coding DNA Sequence Number=SeqID_38140
  Gene Ontology: Mol. function=peroxidase activity; Cellular component =membrane; Biological process=response to oxidative stress
  Homolog annotation: Hit_ID=Q1T6J6; Match level="QueryCoverage=99%, HitCoverage=100%, E-value=1e-147, Identity=80%"; Hit description =Haem peroxidase, plant/fungal/bacterial
  Pfam annotation: Domain name=peroxidase; Domain location=42-279; Score=409.1; E_value=6.3e-120; Accession=PF00141.13; Description =Peroxidase
MKPNKLKCITTFFILYLFNQNAHSELQVGYYSYSCSMAEFIVKDEVRKGVTNNPGIAAGLGCDASVLLDSTPLNTAEKDSPANKPSLRGYEVIDNAKAKLEAVCPGIVSCADIVAFAARDSVEFARGLGYDVPAGRRDGRISLASDTRTELPPPTFNVNQLTQLFARKGLTQDEMVTLSGAHTIGRSHCSAFSSRLYNFSTTSSQDPSLDPSYAALLKRQCPQGSTNQNLVVPMDPSSPGIADVGYYVDILANRGLFTSDQTLLTNAETASQVKQNARDPYLWASQFADAMVKMGQIIVLKGNAGEIRTNCRVVNS

SEQ ID NO: 154919 - protein, 166 aa, Glycine max
  Coding DNA Sequence Number=SeqID_38141
  Homolog annotation: Hit_ID=Q337M3; Match level="QueryCoverage=58%, HitCoverage=19%, E-value=7e-22, Identity=46%"; Hit description =Expressed protein
MCCEREEEIKMKTPTTKVAKTLSKRTRPQYDIDIDSPIRAIACLKKIDDMRRFEETEDCFILGFDPSSAAVPLLVDSSADDVSVIAEKGQVACRDYPHSRHLCLKFPFTTTPHESYCEMCYCYVCDTAAPCKDWKGWHCNAESGIYWKNKRSLKKIQPVRLYNSQP

SEQ ID NO: 154920 - protein, 366 aa, Glycine max
  Coding DNA Sequence Number=SeqID_38142
  Gene Ontology: Mol. function=DNA binding; Cellular component=nucleus; Biological process=regulation of transcription, DNA-dependent
  Homolog annotation: Hit_ID=Q1S6Y4; Match level="QueryCoverage=98%, HitCoverage=64%, E-value=9e-49, Identity=34%"; Hit description =Transcriptional factor B3; Auxin response factor
  Pfam annotation: Domain name=Auxin_resp; Domain location=67-145; Score=95.1; E_value=2.1e-25; Accession=PF06507.4; Description=Auxin response factor
  Subcellular localization annotation: CTP_CleavageSite=29; ConfidenceScore=5.00e-01
KFVNHKKLVAGDTVVFVKDSDGRVSVGIRRAARFAAAIETPQPPPAEREGFSRSATGRVTAEAVAAAAESAARNAPFEVVYYPRTGFADFVVSAEVVEESMKCAWVGGMRVKIAMETEDSSRMTWFQGTVSSACASENGPWRMLQVNWDEPEVLQNAKRVSPWQVELVSLPFALHTVYSPNKRLRSDQGSGLLSNREGDPFFPMTGFPNSTMEHMTGFPNSTVGHMDKSLLSYDTFPAGMQGARHDLFSPSSFSNFLNDKSYLYMGSGSFGNNPVQSLGTVTTELNMSSSQSDDLSPHSQSSFHSFAREFAGTRNCDTKVASGSILLFGKIIQPAESDLHDGDCMERDGSRGSNKLKTVEACYFSK

SEQ ID NO: 154921 - protein, 122 aa, Glycine max
  Coding DNA Sequence Number=SeqID_38143
MEKPTTKSKDVDVMQSHSIEEPITNIDVSNKNVEKPTTSLISLTPPIHNQDGFKKALLQLALFAPKMDLNKFDVLNDVKDGELVRKSQMESSKEPFDSEMTSKVGDAKATLNSILTSNPPTT

SEQ ID NO: 154922 - protein, 104 aa, Glycine max
  Coding DNA Sequence Number=SeqID_38144
MADSAWVIGFVASTRGMEVQLAWKVEAAVVTTRRKKIAELSCKKLGHGDLEAVHTSGRKFDVRHSRQALAQQLSCALMTSLVMGSNSETTFMHMQGSKDESLKL

SEQ ID NO: 154923 - protein, 285 aa, Glycine max
  Coding DNA Sequence Number=SeqID_38145
  Gene Ontology: Mol. function=ribonuclease H activity; Biological process=DNA integration
MCLLNYFEEYELKHIFRENNDRENVLSKLASSKKSRQHKTFIQETLVTPSIENFDIFARQIGCDFWMNLIWNYLVNDQLPIDEIELYMPRMKFTEECAAWNWEEGTWQLDFSELVIISQQCILLCIISKRCKECEEFNKLHHAPSEKLHSIRSPWPFVLWGMDILGPFPIVKGQVKFLLVTIDYFAKWIEVEPLAKIIAQKHSMDIPLHFIIHTKGISFQIDYGTNAMIPIEVNEPLTRRAQFEEAFNDENLALELNMVTREFWVGDLVWRMKGEARTILKENLL

SEQ ID NO: 154924 - protein, 186 aa, Glycine max
  Coding DNA Sequence Number=SeqID_38146
  Subcellular localization annotation: CTP_CleavageSite=61; ConfidenceScore=5.73e-01
MQPSPASLPAPLPMPIAPSCPTLVQPFPAPLPAPLPMRAASFPDLRHTRATVSCNKLFSTVAQYGRATAPNDKALEGRNMTLFEMETEYYGPTMVACKCQLTVFALWTAADPEEPRWNRPWDPGGPGRTRNTLRTRFCLMGSRMIQLILGGLQEARATRPTRKSVPPTLCAKWLGGAKRANKIVGC

SEQ ID NO: 154925 - protein, 114 aa, Glycine max
  Coding DNA Sequence Number=SeqID_38147
MAKNHHKFKAQTKHTTAEVARRCKVDVLLEMVSLSMSIWEYTVLLLLRPLLAVTFVLFLISLGWFVAWKLVLVHVPLVQEVFGLKKKAVRVKPPTGRFSKIYGTLHAKNSPSTS

SEQ ID NO: 154926 - protein, 80 aa, Glycine max
  Coding DNA Sequence Number=SeqID_38148
RTSTWVMILRTREGTSLVDEDKARNKGKEPLEGLGRPMARARTKKAKEALQQVLTMLFEFRPKLQVENLQIVNCTMFQEE

SEQ ID NO: 154927 - protein, 186 aa, Glycine max
  Coding DNA Sequence Number=SeqID_38149
  Subcellular localization annotation: CTP_CleavageSite=42; ConfidenceScore=5.20e-01
MKGVGGYHDWPYYSSPASNLSAFAAPFSVNPYTSSEASSQFMDSAESAETVPPIHFQPYGYDFFSSPVRQLDSSAQFPHLGLPSYPARSSLVEAQPYYASSAIHDHSSNSAAPYHWSSEAPSSGWPSLRVANKSPELGFSGQGGVSWDQFPEFNSRSKEKLIEVGRSLSSKETNVAGSVGEQKRNQ

SEQ ID NO: 154928 - protein, 90 aa, Glycine max
  Coding DNA Sequence Number=SeqID_38150
MQRRSKREDGFACEHLVVWHGGDNIHDDRAQVQVAMLETTGGSNTKKIKMKIWKTTTFVAVTFAAKVYFCDYEGRQSARIEGSGRKLGMC

SEQ ID NO: 154929 - protein, 39 aa, Glycine max
  Coding DNA Sequence Number=SeqID_38151
  Subcellular localization annotation: CTP_CleavageSite=27; ConfidenceScore=5.04e-01
MAEPSKKRKGVSTSSIVTKTQSHGSSKAQTVTTRLVATK

SEQ ID NO: 154930 - protein, 103 aa, Glycine max
  Coding DNA Sequence Number=SeqID_38152
MQRCEHILYDTFLFSTNTSDSARFTSVVANCEQEPTTKAWLLTMAMVDIGRDMSTMWGGQREGGALGFESGVRCLGAGRKIRYRKQWPNHRRQNNNETNAQSS

SEQ ID NO: 154931 - protein, 386 aa, Glycine max
  Coding DNA Sequence Number=SeqID_38153
  Gene Ontology: Mol. function=protein serine/threonine kinase activity; Cellular component=cell surface; Biological process =protein amino acid phosphorylation
  Homolog annotation: Hit_ID=Q6UY59; Match level="QueryCoverage=100%, HitCoverage=57%, E-value=1e-136, Identity=64%"; Hit description =Lectin-like receptor kinase 7;2
  Pfam annotation: Domain name=Lectin_legB; Domain location=20-256; Score=407.1; E_value=2.5e-119; Accession=PF00139.10; Description =Legume lectin domain
MSLKVVTVVFLLATIVVASDDTSFTYNGFQSSYLYLDGSAEFTTNGMLKLTNHTKQQKGHAFFPSPIVFKNTTSGSVFSFSTTFVFAIRSEFPNLSGHGIVFVVSPTKGVPHSLPSQYLGLFDDTNNGNNSNHIFGVELDTILNTEFGDINDNHVGVDVNELKSVKSAAAGYYSDEGFKNLSLISGYPMQVWVEYDGLKKQIDVTLAPINVGKPEGPLLSLSKDLSPILNSSMYVGFSSSTGSILSSHYVLGWSFKVNGKAQQLAISELPMLPRLGGKEESKVLIVGLPLILLSLILMVALAVVHVIKRKKFTELLEDWEQDYGPHRFKYKDLSLATKGFREKELLGSGGFGRVYKGVMPISKIEVAVKKVSRESRQGMREFVAEI

SEQ ID NO: 154932 - protein, 289 aa, Glycine max
  Coding DNA Sequence Number=SeqID_38154
  Gene Ontology: Mol. function=protein serine/threonine kinase activity; Cellular component=cell surface; Biological process =protein amino acid phosphorylation
  Homolog annotation: Hit_ID=Q6UY59; Match level="QueryCoverage=99%, HitCoverage=43%, E-value=1e-132, Identity=79%"; Hit description =Lectin-like receptor kinase 7;2
  Pfam annotation: Domain name=Pkinase; Domain location=2-232; Score =67.7; E_value=3.8e-17; Accession=PF00069.15; Description=Protein kinase domain
  Pfam annotation: Domain name=Pkinase_Tyr; Domain location=1-232; Score=15.3; E_value=2.1e-13; Accession=PF07714.7; Description =Protein tyrosine kinase
  Pfam module annotation: Pfam domain module=Pkinase::Pkinase_Tyr; Domain location=2-232::1-232
MREFVAEIVSIGCLRHRKVVPLLGYCRRKGELLLVYDYMPNGSLDKYLYNKPRVTLNWSQRFKITKGVASGLFYLHEEWEQVVVHRDIKASNVLLDAELNGRLGDFGLSRLYEHGTDPHTTHVVGTLGYLAPEHTRTGKATTSSDVFAFGAFMLEVVCGRRPIEKGGESGSEILVDWVYNCWKKGEILESMDPNLGANYRPDEVELVLKLALLCSHSEPLARPSMRQVVQYLEKDVPLPDLCMLSLSSNGLTFGLHEDFQDCPMSYPSSMNRPISHTSSIVESLLSGGR

SEQ ID NO: 154933 - protein, 112 aa, Glycine max
  Coding DNA Sequence Number=SeqID_38155
MILEEGYKRGLDGCKNNLHGRLFLSKGDNPPKIHDLRTQLTKQWQPPWSMADDTFWKKFGVVASNSREGKEQKKHSLPKEGKKTSVKYVPKDKGVVDGKAYAKARGSPKPFR

SEQ ID NO: 154934 - protein, 120 aa, Glycine max
  Coding DNA Sequence Number=SeqID_38156
  Gene Ontology: Mol. function=DNA binding; Cellular component=nucleus; Biological process=DNA integration
MAQVAPLDMELEQLDVKISFLQGWLEEDILMQQPKGFKVKENENFVCRLKRSLYELKQSPSKVEDGSNIYLLLYVDGMLITFQNLLAIQKLKSLLSSEFEIQDMRAVEKILGMEIKRDRV

SEQ ID NO: 154935 - protein, 262 aa, Glycine max
  Coding DNA Sequence Number=SeqID_38157
  Gene Ontology: Mol. function=nucleic acid binding; Cellular component= nucleus; Biological process=DNA integration
  Pfam annotation: Domain name=zf-CCHC; Domain location=43-54; Score =6.9; E_value=0.072; Accession=PF00098.13; Description=Zinc knuckle
MELRDSGVKMEDEDLVSGNGDKAYAFGLSVTDSAKGTYAITAKKPGHWERDCPKKVKNYYIAALVQNDSLSKRDLVMEKFGGNVLMGNNTPRKYVGIGSVQINMHDGVVKTLTKVCRVPKLKKNLVSVGAIDLIGFFCWVKGGVIHIRGKWKYVVMQGTKQINFYMLQGSTTAGSVSTISQSGSHASNNSLWHLRLGHMCEKGLDILSKQGLLANHKVKPFQFCEHRIYGKKHQTKFPKDEHAINDMLDYDHFDYWGPSRVP

SEQ ID NO: 154936 - protein, 44 aa, Glycine max
  Coding DNA Sequence Number=SeqID_38158
MSMLHHDGGTRCLMTGWFSKTPTTVDESRRPGRELSDGGGGGNV

SEQ ID NO: 154937 - protein, 133 aa, Glycine max
  Coding DNA Sequence Number=SeqID_38159
MDIGTSFRVDFAQDGLIPQHGDKDQAMVTKDITFTLIDFMPRCIFFPVKKLNLQWSCSTIYASPTLTLHIDLWDHLKILFDVILDPWLLMGDFNKIIHSSEIQRAWLGHPDYGDIVNKALQVTKEMYLLNFKR

SEQ ID NO: 154938 - protein, 241 aa, Glycine max
  Coding DNA Sequence Number=SeqID_38160
  Gene Ontology: Mol. function=nucleic acid binding
  Homolog annotation: Hit_ID=Q1SU57; Match level="QueryCoverage=47%, HitCoverage=71%, E-value=1e-20, Identity=39%"; Hit description=Zinc finger, CCHC-type
MSQPTTSIFAFSAGPTNGLDFDEDPPDGRGTTSQPLSFKICVSRSMPRSLAMIEYEDENPLKPKVHISKSVSKAYAHLGMRHWWSSFDILDIGNEYFMVSFDMDVDRMKVIEDGTPIKVDINTKYVKRGRFTRVCIEVDLTKPVMGRVWMKVYWYQVQYVGLHQICGICSCYGYLTIETKIVETPPAHANLSNDQTPPTITVEANTMEKEVSQYEEGHNNGSNNIPINVEETNMGNNISFD

SEQ ID NO: 154939 - protein, 258 aa, Glycine max
  Coding DNA Sequence Number=SeqID_38161
  Homolog annotation: Hit_ID=Q9FS21; Match level="QueryCoverage=32%, HitCoverage=16%, E-value=1e-30, Identity=63%"; Hit description =AtABA1 protein
MDEWSSTLGHGSVYGFLEPHSIHNSKDRHVECQHYIETLVKESQQEDVVIWLCSLHKKPDIHLKVAVNNNTMKTLKSSLDGHIDKVATQWIEIKASHIMNVYFQLLMFGHCVAEDVDSVDHSPIDINKYKVSQLHSSYLNFPTGRYKVFLGHKQYFVSLNVGVGKMQWYGFHQEPAGGADILNEKEAILRQDIYDRTPTFTWGKGHVTLLGDFIDAMQQNMGQGGCMAIEKTKDGFHWGVGNKRLLQKIILMGLMKTK

SEQ ID NO: 154940 - protein, 256 aa, Glycine max
  Coding DNA Sequence Number=SeqID_38162
  Gene Ontology: Mol. function=RNA-directed DNA polymerase activity; Cellular component=extracellular region; Biological process=RNA -dependent DNA replication
MVNRLQPHLDTIIVPLQNFEKAYDRVNWDFLKLTLIKFGFLKKITELIMNCVSATSLSLEWNNENLPSFTPRRGLKQGDLLSPYLFMLFIEKLAILINELVHENKWQSLSIKNNGPRVSHFFFVDDCLLFSKACASQVELVKEVLERFCVASGLKVSVDKSRFYASKNVSNTKRCHFSNIINFQYTSNPGKYLGFPIFTSCVTKREFNFILDHIQGKLRGWKSKLLNRAGRMTLSQSVLASIPSYVMNNYLLPRYL

SEQ ID NO: 154941 - protein, 186 aa, Glycine max
  Coding DNA Sequence Number=SeqID_38163
MKKKPREHDFCSNSTPKSLKLHNSISPSILNQITSHKAQNSSFLILFHLHRLKLPKTPPNGIIIEEAKGGCDFICSYRNSKPRNTQSTDISNSSLHIISYIVFLGRTTYPFISMKLPFYPELVKAFYSNLEIQEDSLISEVYGIKMVIDQSLFFELTQLSSDGVPFEGTLDDEWKFDFSVADARQM

SEQ ID NO: 154942 - protein, 389 aa, Glycine max
  Coding DNA Sequence Number=SeqID_38164
  Gene Ontology: Mol. function=protein transporter activity; Cellular component=membrane; Biological process=protein secretion
  Homolog annotation: Hit_ID=Q8D3Z7; Match level="QueryCoverage=93%, HitCoverage=96%, E-value=1e-102, Identity=53%"; Hit description =Multidrug resistance efflux pump
  Pfam annotation: Domain name=Biotin_lipoyl; Domain location=45-103; Score=-17.6; E_value=0.068; Accession=PF00364.12; Description=Biotin- requiring enzyme
  Pfam annotation: Domain name=HlyD; Domain location=71-358; Score =67.0; E_value=5.9e-17; Accession=PF00529.10; Description=HlyD family secretion protein
  Pfam module annotation: Pfam domain module=Biotin_lipoyl::HlyD; Domain location=45-103::71-358
RGWGMQQLKTDQHDLHQRLDAMQAELNLFRIPLNKWTVPTAVLGGVILIGMLILGMNYNFPYSEVGKQVYRTVPIVSQTRGRVTSVPVKPNQMLHEGDILFTIDPTPFQAKVDDLTAQVKAASQEALSLDAGLTSAQADLSKAVAERDRAQREYARFQAGHDKGAFSDQMVDTRRQNWKATQAAVDAARAKVAQARNDLNSVVHGENTKVASLLAQLREAQFKLDNTVVRAPSDGYVSTVGLRPGTMSTALGLKPVMTFVPTDNANSREYVAAFRQNALQRLQKGEQAELLFPSIPGTVFKAQVAEVLPAIGESQFQGQGTLLTATDLAARGRALVVLKVTDDRLANYQLPQGADVEAAVYSEHFEHLSLIRKILIRMKSWESYLYLDH

SEQ ID NO: 154943 - protein, 342 aa, Glycine max
  Coding DNA Sequence Number=SeqID_38165
  Homolog annotation: Hit_ID=Q84VI1; Match level="QueryCoverage=81%, HitCoverage=52%, E-value=2e-93, Identity=82%"; Hit description =Envelope-like protein
MAQKKSTPITSTTSRRSKVAIPSKKRKEISSSDSDDDVELDVSTSKKAKKSGKKVPGNVPDAPLDNISFHSIGNVEKWKYVYQRRLAVERELGRDALDCKETMDLIKAAGLLKTVTKLGDCYEGLVREFIVNIPSDITNRKSDDYQKVFVRGKCVRFSPVVINKYLDRPTDGVMDIAVSEHQIAKEITAKRVQHWPKKGKLSAGKLSVKYAILHRIGAANWRESPLSLHYKLFEGTHVPDIVSTSGKAAASGAVSKDALIAELKDTCKVLEATIKATTEKKMELERLIKRLSESGVDDGEAAEEEEAAEQEEEEAEQEEEEADEEDAAEDTESNDDDSEATP

SEQ ID NO: 154944 - protein, 129 aa, Glycine max
  Coding DNA Sequence Number=SeqID_38166
  Gene Ontology: Mol. function=RNA-directed DNA polymerase activity; Cellular component=chromatin; Biological process=RNA-dependent DNA replication
MAPEDMKKMTFVTLWGTFCYKVMSFGLKNAGVTYQRAMVALFHDMMHKEIEVYMDDMITKSKTEEEHLVNLWRLFERLRKYRLRLNPAKCTFGVKLGKLLGFIVSQKGVEVDPDKVKAILEMPELRTEK

SEQ ID NO: 154945 - protein, 53 aa, Glycine max
  Coding DNA Sequence Number=SeqID_38167
  Homolog annotation: Hit_ID=Q1SYR3; Match level="QueryCoverage=70%, HitCoverage=1%, E-value=2e-08, Identity=65%"; Hit description=RNase H, putative
MNPPVPVPPVLGRPLILYMIVLDESMGCMLGQHDKSEKRKRAVYYLSKKQPTV

SEQ ID NO: 154946 - protein, 175 aa, Glycine max
  Coding DNA Sequence Number=SeqID_38168
MGETYEIPHHNLADFEPRLGYATLGQAVGGVPLPNTLEDPQFCLQPQPFHFAVGRVPPAMVEKGKFDHIEERLRAIEGGGDYAFVDMAELCLVPNIVIPLKFKVSDFNKYKGTTCPKNHLKMYYQKMRAYAKDEKLLMHFFQESLIGAVITWYTNLEPSRVHSWKDLMVVFVRQY

SEQ ID NO: 154947 - protein, 100 aa, Glycine max
  Coding DNA Sequence Number=SeqID_38169
  Gene Ontology: Mol. function=DNA binding; Biological process=DNA recombination
  Homolog annotation: Hit_ID=Q6D8B5; Match level="QueryCoverage=79%, HitCoverage=19%, E-value=3e-14, Identity=48%"; Hit description =Putative integrase
MDTGERCCLITDKVSKVPLYYPCLYISTELRKKNESISTIELHSASIALFYRFLNLKNIDIEARIRTAEFLHLQEIDGLKEFITKRMKKEKVANLDSGCR

SEQ ID NO: 154948 - protein, 62 aa, Glycine max
  Coding DNA Sequence Number=SeqID_38170
MPFKGLKDKEMNCVFYVFSGKRNELAKSACDELAKCAYRTKLVHLVRMNTHPPIEILMAKRG

SEQ ID NO: 154949 - protein, 153 aa, Glycine max
  Coding DNA Sequence Number=SeqID_38171
AQEKSPIKEHESREKDEEQAQQQWEKYSIVENQQENILQINNLPHQLIFKKGRQGEHEETLSAILSLITNTFLEMIWNVLPDYMKFMDFLAKSFFAKRRPRAKRIFVHALSRESQALSAQPLHLRLIWSTKLDKAELSQHQFDLNSAKLQPDR

SEQ ID NO: 154950 - protein, 93 aa, Glycine max
  Coding DNA Sequence Number=SeqID_38172
  Subcellular localization annotation: CTP_CleavageSite=63; ConfidenceScore=5.55e-01
MARKPRQDFSVSKPKFQTALFSLSLTLPFFPPSFSIEAPNKAPTFGHHFCSKSRKEGIFGVVKCVSTSGTSKFQGFYDDACDVHVLKLLMENC

SEQ ID NO: 154951 - protein, 69 aa, Glycine max
  Coding DNA Sequence Number=SeqID_38173
MTGTLFLLKQQNSLEIMSVIILGTPHGGHERANDHINGSHDEYKKDDGGQCSYSCCHKYHHRSGPDSPT

SEQ ID NO: 154952 - protein, 177 aa, Glycine max
  Coding DNA Sequence Number=SeqID_38174
MDLGRFQISILGDGCPSKTFLEEMHQQFIIFRVCPHFPAVHLQQEELFPPQNARVVVVGDTEGPPKCLAWVRRKMSAPQRHIRGEAQSWLDCGLGVLHVCPPGVERYVHDHIGVVGSQWVWARSCQHSHREFVQHWVASHMVGRNACSKLAQNGGRPHFPTLCFLDLPYLRLDVLLD

SEQ ID NO: 154953 - protein, 47 aa, Glycine max
  Coding DNA Sequence Number=SeqID_38175
MAAHPGDSTKGLNLMRKQEIDSLRRPLILNAKDRILDLGIRHMQPLS

SEQ ID NO: 154954 - protein, 163 aa, Glycine max
  Coding DNA Sequence Number=SeqID_38176
  Subcellular localization annotation: CTP_CleavageSite=30; ConfidenceScore=5.39e-01
MSFFLIFLNPNSHRLASGSRGPPNNFIVKKLAHFGELITSGLSFSSPGRVATTPKFQGSEVERNKRREKEEEERRGNDVEALSNHDCDQSLHRSLFGVLCATVAEWRRKRERRLHFKEKMSLEEAHHHRRPWIIAWRKKEMNEGRGREEHEILCSKRALKSEV

SEQ ID NO: 154955 - protein, 92 aa, Glycine max
  Coding DNA Sequence Number=SeqID_38177
  Homolog annotation: Hit_ID=Q1S909; Match level="QueryCoverage=38%, HitCoverage=3%, E-value=1e-10, Identity=94%"; Hit description=MATH domain, putative
MPPSSSDFRFSAKGCKSNKIEVSYQEVVALKRQEELIREEEAAWLAECEQKAKRGNEREKKSKKKQTRKLEVLIKNGSRYFSLFWKLELRIG

SEQ ID NO: 154956 - protein, 328 aa, Glycine max
  Coding DNA Sequence Number=SeqID_38178
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=2e-46, Identity=32%"; Hit description= UPI00006A17C9 related cluster
MSSPSEDYMPSPSKDYTGLHALTFRGLHVLTFRGLHALAFRTLHFLAFRGLHALTFRGQHVLPFRGLHVLTFTGLHVLNFRGLHFLAFRGLHVVAFRGLHVLILEGLHVHALEDYTFSPSKGGLPGHTFRGLHALPFRCLHALAFVGLHALTFRGLHVLAFRGLHVLLFRGLDALIVRGLHVLAFKGLHALAFRGLHVRPLSGLHPFAFRGLHVLIFKGLHVHALEDYMSSLSKGGLHVLTIRGLHVVALRGLRVLPFRGLHALALRGQHVLAFKGLQVLTFRRLHVLTLRGLHALAIRGLHVLGFRVLHALTFRGLHVIPFRGLHVL

SEQ ID NO: 154957 - protein, 54 aa, Glycine max
  Coding DNA Sequence Number=SeqID_38179
MTVRLSHEVLKVSVELSSSVRLSAHPPLSAALARQKNLTEHQYQGRALSVRSVR

SEQ ID NO: 154958 - protein, 154 aa, Glycine max
  Coding DNA Sequence Number=SeqID_38180
MKAQVEKDEGPEAETLSRLLIVAEGPSNPCGVYPDLSSFTGSGVYPDLSSFIGSGVYPDLSSFTGSGVYPNLSSFTRSGVIQTFVACIKRSAPTQVHITNVRLSPVIYRAARNKKQNIRENSNGSKMFLGCRIKSHNMSRRSKLKADDSSKFKR

SEQ ID NO: 154959 - protein, 91 aa, Glycine max
  Coding DNA Sequence Number=SeqID_38181
MSKCSKRTKVSAFGNYSSSSNPETRVEVEEYDMSLPMSCPIGQKAAKRKSKGKESPNTLNLSGIENVMKDKNMNISKLIQLKEAQERHLQE

SEQ ID NO: 154960 - protein, 130 aa, Glycine max
  Coding DNA Sequence Number=SeqID_38182
MASKKRKAPATPSQVKVRGHLVKFDQDTLNTFLKTPMIIGEGETLSAYSRFTLLRPDPRELAAKLCIPGRGFELNADGLTLKILRKNLTTIAQTWSMLSFSNLVPTSHTSDITLDRAKLIYGIIQRMDMN

SEQ ID NO: 154961 - protein, 406 aa, Glycine max
  Coding DNA Sequence Number=SeqID_38183
  Gene Ontology: Mol. function=RNA-directed DNA polymerase activity; Biological process=RNA-dependent DNA replication
  Homolog annotation: Hit_ID=Q8H6Q8; Match level="QueryCoverage=93%, HitCoverage=52%, E-value=1e-49, Identity=35%"; Hit description=CTV.20
  Pfam annotation: Domain name=DUF755; Domain location=74-172; Score= -36.5; E_value=0.028; Accession=PF05501.2; Description=Domain of unknown function (DUF755)
  Pfam annotation: Domain name=zf-CCHC; Domain location=182-199; Score =30.3; E_value=6.8e-06; Accession=PF00098.13; Description=Zinc knuckle
  Pfam module annotation: Pfam domain module=DUF755::zf-CCHC; Domain location=74-172::182-199
QHFIGDPSLWKDRSVELLSNLKCRTLADFRWYRDTFLTRVYTREDSQQPFWKEKFLAGLPRSLGDKVRDKIRSQYNGDIPYESLSYGQLISYVQKVALKICQDEKIQRQLAKEKAQTKRDLGSFCEQLGLPACPKQKKKTSRKETHENKVVTKKRFPRRRYSHKPSTSKEIENPKQKLKSKVTCYNCGKQGHISKYCRLKRKLRNLNLEPAVEEHINNFLMECSEEEETETSFSSDENLNLIRQDDPLSSTEDERQINTLTREQDLLFEAINSIPDPQEKKNFLEKLKKTLEVKLRQKDIIINNKFDVCNILRRLENTSAKPTTIQDLQTEINNLKKEVKELRQQQEIHQNILSQLEEESDSESIANSDTNHIENPEDNMFMGLINKIKIQKFYINIKIIINDFML

SEQ ID NO: 154962 - protein, 86 aa, Glycine max
  Coding DNA Sequence Number=SeqID_38184
  Subcellular localization annotation: CTP_CleavageSite=52; ConfidenceScore=5.03e-01
MGDNWKSPKVKHLNGRSPRNCPLLRYNIRAAWRPTYAFKKATRTLHRFDKVRGSRRNPCLMQMRKAQHGDAHSTTISTNNYKQRRT

SEQ ID NO: 154963 - protein, 169 aa, Glycine max
  Coding DNA Sequence Number=SeqID_38185
METDPNMNNPPIPIIKKETPIKVIINQPRIEEPTTSNQEIHPLGLVFAISMALHQSTTPPTVDNEIPSTDIDPKKSMSFVRKWNYSPMSSTMLLRATNFDQHATNITKIESSTEHDGTKLIQAQEGFPKAKENIMSIQGPMEKIEKSEEDLVKQKEELLAKLRPIQDEL

SEQ ID NO: 154964 - protein, 326 aa, Glycine max
  Coding DNA Sequence Number=SeqID_38186
  Gene Ontology: Mol. function=protein serine/threonine kinase activity; Cellular component=membrane; Biological process=protein amino acid phosphorylation
  Homolog annotation: Hit_ID=Q1SF45; Match level="QueryCoverage=99%, HitCoverage=96%, E-value=1e-129, Identity=69%"; Hit description =Protein kinase
  Pfam annotation: Domain name=Kdo; Domain location=9-196; Score=-86.4; E_value=0.078; Accession=PF06293.4; Description=Lipopolysaccharide kinase (Kdo)
  Pfam annotation: Domain name=Pkinase; Domain location=29-280; Score =139.4; E_value=9.9e-39; Accession=PF00069.15; Description=Protein kinase domain
  Pfam annotation: Domain name=Pkinase_Tyr; Domain location=29-280; Score=139.9; E_value=6.7e-39; Accession=PF07714.7; Description =Protein tyrosine kinase
  Pfam module annotation: Pfam domain module=Kdo::Pkinase::Pkinase_Tyr; Domain location=9-196::29-280::29-280
MITGDQKQIKLEELPLFEFEKLSTATNNFHLANMLGKGGFGPVYKGQLDNGQEIAVKRLSKASGQGLEEFMNEVVVISKLQHRNLVRLLGCCIERDEQMLVYEFMPNKSLDSFLFDPLQRKILDWKKRFNIIEGIARGILYLHRDSRLRIIHRDLKASNILLDDEMHPKISDFGLARIVRSGDDDEANTKRVVGTYGYMPPEYAMEGIFSEKSDVYSFGVLLLEIAWKLWNEGNIKSIIDLEIQDPMFEKSILRCIHIGLLCVQELTKERPTISTVVLMLISEITHLPPPRQVAFVQKQNCQSSESSQKSQFNSNNNVTISEIQGR

SEQ ID NO: 154965 - protein, 500 aa, Glycine max
  Coding DNA Sequence Number=SeqID_38187
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=71%, HitCoverage=48%, E-value=1e-129, Identity=56%"; Hit description =Protein kinase; EGF-like, subtype 2; S-locus glycoprotein; Curculin- like ...
  Homolog annotation: Hit description=(Mannose-binding) lectin; Apple -like
  Pfam annotation: Domain name=PAN_2; Domain location=274-342; Score =64.3; E_value=3.8e-16; Accession=PF08276.2; Description=PAN-like domain
  Pfam annotation: Domain name=S_locus_glycop; Domain location=132-257; Score=116.4; E_value=8e-32; Accession=PF00954.11; Description=S-locus glycoprotein family
  Pfam module annotation: Pfam domain module=PAN_2::S_locus_glycop; Domain location=274-342::132-257
MGVISVNDTITSTRFIRDPETIISSNGDFKLGFFSPEKSTHRYVAIWYLAETYIIWIANRDQPLSDLSGPGVFKIHKDGNLCFTHPADAAVPSMKIAANRLTGKKIEYVSWKSSSDPSSGYFTGSLERLDAPEVYFWYNKTKPYWRTGPWNGRVFLGSPRMSTEYLYGWRFEPNDSGTAYLTYNFENPSMFGVLTISPHGTLKLVEFLNKKIFLELEVDQNKCDLYGTCGPFGSCDNSTLPICSCFEGFEPRNPEEWNRENWTSGCVRNVQLNCGKLNNTSDVQQDRFRVYQNMKVPDFAKRLLGSDQDRCGTSCLGNCSCLAYAYDPYIGCMYWNSDLIDLQKFPNGGVDLFIRVPANLLVAAAGGKKRRENMGLLIGITGAIGALIIAVGAYLLWRKFTPKHTVKVATHARVLTRGTSSTCEGFWASRGRATRWGFKESLRWRREGLDGNTAKHTKSEKVANYDHKIAQVVLGFAHEAESVDRVIDAREIVGREWKRE

SEQ ID NO: 154966 - protein, 123 aa, Glycine max
  Coding DNA Sequence Number=SeqID_38188
  Homolog annotation: Hit_ID=Q1SY67; Match level="QueryCoverage=91%, HitCoverage=12%, E-value=9e-14, Identity=35%"; Hit description =Peptidase aspartic, active site
MLGHGYEPRMGLGRNGNGIASLVEFMENYGRSNNESYESSDTEDPNVDIEKLINQAENREDEDWGLPPELKRMVEQEEREVKPHQEETKVVNLGVGEERKEVKVGIGMSANIRDEVVALLRDY

SEQ ID NO: 154967 - protein, 236 aa, Glycine max
  Coding DNA Sequence Number=SeqID_38189
  Homolog annotation: Hit_ID=Q1SKD7; Match level="QueryCoverage=96%, HitCoverage=58%, E-value=3e-19, Identity=27%"; Hit description =Ankyrin
MPPRKLSAKRSRRDAAAEGTSAAPEFDSHRFRSTEHQQRFEAIKGWSFHRERRIQLRDDEYTDFQEEIARRCWTSLVTPMAKFDPDIVLEFYTNAWPTEEGVWDMRSWVRGQWIPFDADALSQFLGDPLVLEEGQECEFSQRRNRADGFDEEAITQLLFIPGQDFARTVAVRRVRIMLTSMTTLTQMWMTLLLSNVLPSDHNSDLPLLKCQLVYAILTRMSVHVAQLIADAIYLFA

SEQ ID NO: 154968 - protein, 173 aa, Glycine max
  Coding DNA Sequence Number=SeqID_38190
  Gene Ontology: Mol. function=oxidoreductase activity; Cellular component=vacuole; Biological process=hydrogen peroxide catabolic process
  Homolog annotation: Hit_ID=P22195; Match level="QueryCoverage=95%, HitCoverage=59%, E-value=4e-58, Identity=65%"; Hit description =Cationic peroxidase 1 precursor
  Pfam annotation: Domain name=peroxidase; Domain location=43-173; Score=103.8; E_value=5.1e-28; Accession=PF00141.13; Description =Peroxidase
  Subcellular localization annotation: CTP_CleavageSite=27; ConfidenceScore=5.36e-01
MASSCFSMTTPIFKIRFFLFLCFIGISSSQLSSDFYSTTCPNALSTIKSAVDSAGCDASVLLNDTSSFTGEQTAAGNVNSIRGFGVIDNIKSQVESLCPGVVSCADILTVAARDSVVALGGPSWTVQLGRRDSTTASLSSANSDLPRFDLSLQQLSDNFQNKGLTTAEMVALS

SEQ ID NO: 154969 - protein, 55 aa, Glycine max
  Coding DNA Sequence Number=SeqID_38191
LFFQYAVRDKIIHPVKAEIFDPSLNGFIFYDVGYNDGRPPSLYPAFHRLRIAFLQ

SEQ ID NO: 154970 - protein, 259 aa, Glycine max
  Coding DNA Sequence Number=SeqID_38192
  Gene Ontology: Mol. function=oxidoreductase activity; Cellular component=anchored to membrane; Biological process=lignin catabolic process
  Homolog annotation: Hit_ID=Q9SU40; Match level="QueryCoverage=52%, HitCoverage=27%, E-value=3e-24, Identity=46%"; Hit description =Putative monocopper oxidase precursor
  Pfam annotation: Domain name=Cu-oxidase; Domain location=82-213; Score=79.8; E_value=8.3e-21; Accession=PF00394.12; Description =Multicopper oxidase
MVIDQSLFYDLTQLSSEGVPFEGTLIDDWKYEFSVHDARRLVCTNQADMTGRLLASSLAFEMRGSRFRHKVRKKFVVSEAADLSFLCLVSHSSNPTQTTYSPYLSDVPSPDWMLINGKGPYMNNLCQSYETFNVTQGKTYLLRISNVGTAWSFNFRIQNHQLVLVETEGQSYLVLVTTNQNAADYYIVASPKLSNATNNNTLVGVVVLHYDNSTTPANGSLPSGPDPFDLQFSINQAKSIRSLIAMIITAICLFYIDLH

SEQ ID NO: 154971 - protein, 186 aa, Glycine max
  Coding DNA Sequence Number=SeqID_38193
MWVFLTSRQIDWAHLVRYRMHKALRSNAPLPYPHLITLFLQHFKVPLDSEPFVKVKRSFSIGANVVSSFGYRKERDGSWVKKDAPRDDSSSLMHNILDRLDGLHTFVGERFDSLDSRIDAMDVRFAGMDTHCHHQKGGDCGSNVFQDYFDDAKESRVKQVSRIIKIKIQDSSKESRLKNQEKIQSR

SEQ ID NO: 154972 - protein, 103 aa, Glycine max
  Coding DNA Sequence Number=SeqID_38194
  Homolog annotation: Hit_ID=P55737; Match level="QueryCoverage=36%, HitCoverage=5%, E-value=3e-07, Identity=68%"; Hit description=Heat shock protein 81-2
MSTSLCWGHHKFVCRILGSSIFVRAGNNYFLVYCAMHNVNNFNIKEMKRLTGISVPHLRSASQANALPVIGVNLVESIILLLCDLLRLCHPNGLMLVHQRAFM

SEQ ID NO: 154973 - protein, 36 aa, Glycine max
  Coding DNA Sequence Number=SeqID_38195
GYKVNGVGSYFGGESDLYGKWRALLEITDGFRNIKK

SEQ ID NO: 154974 - protein, 110 aa, Glycine max
  Coding DNA Sequence Number=SeqID_38196
MVKEERKEVSVSSKMLAKKESHFAIKTNIKETSPLRQPPHLLLCKKKLVSTARPLGFDIIPQVKELLDEGLVHKSLNPCALLVPKKGIIIMKIKKKVLRKESRSFKNLYI

SEQ ID NO: 154975 - protein, 154 aa, Glycine max
  Coding DNA Sequence Number=SeqID_38197
  Subcellular localization annotation: CTP_CleavageSite=57; ConfidenceScore=5.44e-01
MPNILQHLTTRRALPMTSSKVIQSYGVTWRMNIRSTSQSTPSRVVLYIQMIAARMIRYMSVTDSWSYLTCRSDGNRCSRFRIRIHTVRSDWSNRDLVANCPSLAGSSSVNCMIDPIVELVRLDHRVSVGLVRIAEPNWISQLCLQRLKNEKDED

SEQ ID NO: 154976 - protein, 193 aa, Glycine max
  Coding DNA Sequence Number=SeqID_38198
MTPDGRSLWRGRQQRGQRRHTRGNQRGWRWSYQRWGRGRGGGRRRSDSFCSWIFARPAAWSTVIGWWTWTVRQIFNVKLEMKQGNRKGADKPIILLVKSSNSFRNRGGVARDWCGVGRGGGRHKSKVVEKLVHVEGHRVHGIVKTNKGLVEVAGGHEDKREHQLLRTKHKCRKLRVGFEAPEPPEEEEEQRWE

SEQ ID NO: 154977 - protein, 298 aa, Glycine max
  Coding DNA Sequence Number=SeqID_38199
MGGGGPIYLVRVRSGANWPAPLPMRAGLTRGGVARLPTPTAYPLGPNIEQPNPKLATPVSEGPDPKPTPDSDPNPTPDPELAQISSNSLSGDLAPRILHLVGLLSDNRVVLLVDGGSNHNFLQPQLAISLGLPCRTAPTPLRVMFFHHGRFVEFLGENATTPGLLPQHQFCHLCRHNEGVSHFHIARFPEAPPDSLPIDTPSAVRQNKPWDPGIVFGCHSLKNQHHEDMFLMGQGVIRKRDNIADKGMYSKEIDANQDIATIGVSTAKKGVNQAEKEVQAAVNTKRKISKPAYLKDYV

SEQ ID NO: 154978 - protein, 90 aa, Glycine max
  Coding DNA Sequence Number=SeqID_38200
  Homolog annotation: Hit_ID=Q9MAZ9; Match level="QueryCoverage=46%, HitCoverage=23%, E-value=2e-14, Identity=88%"; Hit description =Nonclathrin coat protein zeta1-COP
MVFNLLIQTKWKRVAVKYYSDDWPTNNAKLAFEKFVFTKTVKTNARRRDKEAPKLTESGFQFLCSSSSNLMQDRGVDAADLSHSCWNQFS

SEQ ID NO: 154979 - protein, 437 aa, Glycine max
  Coding DNA Sequence Number=SeqID_38201
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=99%, HitCoverage=53%, E-value=0.0, Identity=81%"; Hit description=Class III HD-Zip protein 4
  Pfam annotation: Domain name=Homeobox; Domain location=16-76; Score =68.0; E_value=3e-17; Accession=PF00046.19; Description=Homeobox domain
  Pfam annotation: Domain name=START; Domain location=149-359; Score =233.6; E_value=4.4e-67; Accession=PF01852.10; Description=START domain
  Pfam annotation: Domain name=bZIP_1; Domain location=57-117; Score =2.9; E_value=0.078; Accession=PF00170.11; Description=bZIP transcription factor
  Pfam module annotation: Pfam domain module=Homeobox::START::bZIP_1; Domain location=16-76::149-359::57-117
MALSMHKDSANNQMDSSKYVRYTPEQVEALERVYAECPKPSSLRRQQLIRECPILSNIEPKQIKVWFQNRRCREKQRKEASRLQTVNRKLTAMNKLLMEENDRLQKQASAGTTTDNSCESVVMSGQNQQQNPTPQHPNRDANNPAGLLAIAEETLAEFLSKATGTAVDWVQMIGMKPGPDSIGIVAVSRNCSGVAARACGLVSLEPTKVAEILKDRQSWYRDCRCVDVLSIVPTGNGGTIELMYMQTYAPTTLAAARDFWTLRYTTSLEDGSLVICERSLTSSTGGPAGPPSTTFVRAEMLPSGFLIRPCEGGGSIIHIVDHIDLDVWSVPEVLRPLYESSKILAQKLTIAALQHIRQIALESSGEIQYGGGRQPAVLRTFSQRLCRGFNDAVNGFVDDGWSLMGTDGVEDVTIAINSSPNKFLGSNYNASMFPAFG

SEQ ID NO: 154980 - protein, 259 aa, Glycine max
  Coding DNA Sequence Number=SeqID_38202
  Homolog annotation: Hit_ID=Q7XDI4; Match level="QueryCoverage=52%, HitCoverage=13%, E-value=2e-17, Identity=43%"; Hit description =Expressed protein
MGLHARRRDSSPGTVPPLSPTISIPPPQLLHHHHVPSSNNIFKSHHDRSHNRRESLPGPSFLPLSPPPATIHSRRDSYPGPFPSPTFAESDSGLLPSTSSHYYHPELYHHTSKRRLCLYDKDSDLAWPFRDLEGLDHDDIRETAYEIFFTACRSSPGFGGRSPITFYSKHDGSGEGRSTPVSQTSRVKQALGLRMLRSSLSQRIMVSAPASPVTERSPRSRAVPRRTVTMAEVMRLQMGVSEQSDSRLRKTLVRTLVGQ

SEQ ID NO: 154981 - protein, 512 aa, Glycine max
  Coding DNA Sequence Number=SeqID_38203
  Homolog annotation: Hit_ID=Q8H612; Match level="QueryCoverage=97%, HitCoverage=88%, E-value=1e-137, Identity=48%"; Hit description =Pentatricopeptide (PPR) repeat-containing protein-like
  Pfam annotation: Domain name=DUF247; Domain location=43-511; Score =214.1; E_value=3.3e-61; Accession=PF03140.6; Description=Plant protein of unknown function
MSSLRPTMSNAHSKLTFDELQWVINIRKTLEEELEEDGDQFAVSIFSVPKLLMASDPDSYVPQQVALGPYHYWRPELYEMQRYKIAAAKRFQKHHQSCKLENLVDQLTKLEQRVRACYHKFLDFNGETLVWMMTVDASFLLEFLQVFSMQEGAKVQRVSSSMSHLVDYAGKKSAHNAILRDIVMLENQIPLFVLRKMLDLKFSSLEAADDMLSLMFIGLFKEISPFKMMEEYPNIQVSENVHLLDFLYNVIVPKLEQQSDTIEVEFQQEQKEGNDEEATSDSSHVKQFFSEVWKLLSKLNKGPMKMVKKVIVSKPLKVFVQLPWKIVSNLPGLKVMKQPLEHFLFSQEKGDENKGESASSRSNSLMNKPPSVEEITIPSVTELLNCGIRFVPTKGSISSISFDVKTCTFYLPTIGLDVNTEVFLRNLVAYEASVALGPLVITRYTELMNGIIDSEEDAKVLREKGIILNHLKSDKEVANLWNGMSKSLRLSRVSLLDKVIEDVNKYYNGRMK

SEQ ID NO: 154982 - protein, 850 aa, Glycine max
  Coding DNA Sequence Number=SeqID_38204
  Homolog annotation: Hit_ID=Q7XDI4; Match level="QueryCoverage=97%, HitCoverage=83%, E-value=0.0, Identity=44%"; Hit description =Expressed protein
  Pfam annotation: Domain name=DUF810; Domain location=2-850; Score =1136.1; E_value=0; Accession=PF05664.2; Description=Protein of unknown function (DUF810)
MPGVMTNTWGETAMESLFSLGRQAETIILPLELLRHLKPSEFNDSHEYHLWQKRQLKFLEVGLLFHPSIPIEKTNTFAMNLKEIIRSAEFKPLDTGKNSDTMRSFSNSVISLSMRSPDDTPTNVCHWANGYPVNIHLYISLLQSIFDLRDETSVLDEVDEQLDLIKKTWSTLGINRPIHNVCFTWVMFQQYVETGQIEPDLLCASYTILNEVANDAKKERDSLYVEILKSVLGSLQEWADKRFLNYHVYFQGGDIGQIENLLPVVLLASRILGDVTNSEEGQEKGDKTRVSSSEGRVDYYICSSVKNAFEKMMEAANAKSAESETEKKIGEVILQLAQETEYLALKERQNYSPILKKWNTIAAAVAALTLNNCYGHVLKQYLSEMTTSITVEVVLVLQRAKILEDVLVQMVVEDSADCEDGGKTVVREMVPFEVESTIMIRIRKWIDESLHKGKECLERAKESEAWNPKSKSEPYAKSVVELMNLAKKIVQEFFQIPISITEVLVQELADGLQKIFREYTMFIAACGLKENYIPSLPPLTRCNRNSKFHKLWKIASPCSVSCEDPHIYGIFEANHPHSCTSRGTQRLYIRLNTLSYLLSHIPSLDKSLALTPGVVPSNRHSFTNSHKTQSNRTSYFETTNTSILAACQHVSEVASYRLTFFDTNPFFYDSLYVGDVANARISNLLTILKHNVKLMTAILTERAQALAVKEVMKASFDAFLTVLLAGGTTRVFNESDHQSIQEDFDSLKQLFCSFEELIAENVVEKEAEVVEGVIALMGMSTEQLMENLSTLSNETSGIGVIGNGQKLPMPPTTGKWNRSDPNTILRVLCYRNDRTASNFLKRTFQIAKRR

SEQ ID NO: 154983 - protein, 143 aa, Glycine max
  Coding DNA Sequence Number=SeqID_38205
  Homolog annotation: Hit_ID=Q9LIQ2; Match level="QueryCoverage=93%, HitCoverage=92%, E-value=2e-38, Identity=54%"; Hit description =Arabidopsis thaliana genomic DNA, chromosome 3, BAC clone:F14O13
  Pfam annotation: Domain name=Self-incomp_S1; Domain location=36-142; Score=87.9; E_value=3.2e-23; Accession=PF05938.2; Description=Plant self-incompatibility protein S1
MKFVASVYLTLCLASSFIMMMATVQRARLLFATNEYYVRVINGFSDNSSVPLVIWCASEEMDLGGRALQEHDDFSWVMRPNFWSSNRMKCTMKWDNTRKSFEAFKASRDTDRCGIHRMCSWMVTQDGFYFSNDEVNWRKDFLW

SEQ ID NO: 154984 - protein, 269 aa, Glycine max
  Coding DNA Sequence Number=SeqID_38206
  Gene Ontology: Mol. function=oxidoreductase activity; Cellular component=membrane; Biological process=electron transport
  Homolog annotation: Hit_ID=O49859; Match level="QueryCoverage=99%, HitCoverage=51%, E-value=5e-97, Identity=63%"; Hit description =Cytochrome P450 82A4
  Pfam annotation: Domain name=p450; Domain location=1-252; Score= -57.3; E_value=2.3e-08; Accession=PF00067.12; Description=Cytochrome P450
MKENFKELDVVVTEWLEEHKRKKDLNGGNSGDLIDVMLSMIGGTTIHGFDADTVIKATAMAMILGGTDTSSATNIWTLCLLLNNPHTLEKVKEEIDTHIGKERIVTEEDISKLVYLQAVLKESLRLYPATPLSGPREFREDCKVGEYHVKKGTRLITNLWKIQTDPSIWPEPLEFKPERFLTTHKDIDVKGRHFELIPFGSGRRICPGISFGLRTSLLTLANFLHCFEVSKTSSEPIDMTAAVEITNVKVTPLEVLIKPRLSPSLYESM

SEQ ID NO: 154985 - protein, 418 aa, Glycine max
  Coding DNA Sequence Number=SeqID_38207
  Gene Ontology: Mol. function=inositol or phosphatidylinositol phosphatase activity; Biological process=abscisic acid mediated signaling
  Homolog annotation: Hit_ID=Q84MA2; Match level="QueryCoverage=94%, HitCoverage=60%, E-value=5e-59, Identity=36%"; Hit description=Type I inositol-1,4,5-trisphosphate 5-phosphatase 1
MKHHHRSPHHQQLFWARVVMRKWLNMGSYESDYSADPVDDDDDSESGSDNEEWGRRSRFANEDEASSESTEFLPKLRRQKSSTYRSQYINKKELRVCVGTWNVGGKLPPDDLDIDDWLGVNEPADIYVLGLQEIVPLNPGNIFGAEDTRPVPKWENIIRETLNRVRPEMPKIKSFSDPPSPSKFKPSDDIPDIEEEILLESDSDIGEEVHPLDEENNICDGTFMGETVNTNLLASDAADIANSGLPVKTDLQRQFSFPKMFDKQHSFSENMVTPFAHQATKLTRMLSGSERMGLSWPEPPLHLLSQRVLDRPTSFKSLKSFKSSKSFKTFNSFKSIMDEMPGIVGLPEIDLEALIKRKRRSPYVRIVSKQMVGIFITVWVRRSLRKQIQNLKVSTVGVGVMGYIGNKSDHLTDIALDY

SEQ ID NO: 154986 - protein, 99 aa, Glycine max
  Coding DNA Sequence Number=SeqID_38208
MMTANIAHHHITVIAPTIHSYVGDDHTKVIHRFKCTSKTAAKILEETCFAWKQTQNSLKKDNTCFFLQHGDISFQQKKLKLSCIHCSESNRLPVCPRMF

SEQ ID NO: 154987 - protein, 59 aa, Glycine max
  Coding DNA Sequence Number=SeqID_38209
  Homolog annotation: Hit_ID=Q6L5I9; Match level="QueryCoverage=78%, HitCoverage=8%, E-value=2e-12, Identity=70%"; Hit description ='putative inositol-1,4,5-trisphosphate phosphatase'
MRLLSYKRAELKLSDHRPVTATYMVEVEIFSPRKLQRALTFTDAEIENEQGYIMSCKGD

SEQ ID NO: 154988 - protein, 105 aa, Glycine max
  Coding DNA Sequence Number=SeqID_38210
MVQLLIKKKDINLEYEKEEKQPMQAVSTLQLGVLVTKSQQDNDLGKALEVSANGRIEPTKGEELGIEDKDSKIIEAKGVEEIMVEEAKNLQQKMQEQKAMEIGII

SEQ ID NO: 154989 - protein, 579 aa, Glycine max
  Coding DNA Sequence Number=SeqID_38211
  Gene Ontology: Mol. function=binding; Cellular component=nucleus; Biological process=metabolic process
  Homolog annotation: Hit_ID=Q9LTV8; Match level="QueryCoverage=86%, HitCoverage=76%, E-value=2e-90, Identity=30%"; Hit description =Selenium-binding protein-like
  Pfam annotation: Domain name=PPR; Domain location=155-189; Score =47.0; E_value=6.2e-11; Accession=PF01535.11; Description=PPR repeat
  Pfam annotation: Domain name=PPR; Domain location=190-224; Score =48.3; E_value=2.6e-11; Accession=PF01535.11; Description=PPR repeat
  Pfam annotation: Domain name=PPR; Domain location=225-259; Score =40.3; E_value=6.8e-09; Accession=PF01535.11; Description=PPR repeat
  Pfam annotation: Domain name=PPR; Domain location=260-294; Score=3.0; E_value=3.3; Accession=PF01535.11; Description=PPR repeat
  Pfam annotation: Domain name=PPR; Domain location=326-360; Score =54.9; E_value=2.6e-13; Accession=PF01535.11; Description=PPR repeat
  Pfam annotation: Domain name=PPR; Domain location=361-395; Score =15.1; E_value=0.12; Accession=PF01535.11; Description=PPR repeat
  Pfam annotation: Domain name=PPR; Domain location=397-431; Score=2.2; E_value=4.1; Accession=PF01535.11; Description=PPR repeat
  Pfam annotation: Domain name=PPR; Domain location=463-497; Score=6.3; E_value=1.3; Accession=PF01535.11; Description=PPR repeat
  Pfam annotation: Domain name=PPR; Domain location=54-88; Score=9.8; E_ value=0.52; Accession=PF01535.11; Description=PPR repeat
  Pfam annotation: Domain name=PPR; Domain location=89-123; Score=3.1; E_value=3.2; Accession=PF01535.11; Description=PPR repeat
  Pfam module annotation: Pfam domain module=PPR::PPR::PPR::PPR::PPR::PP R::PPR::PPR::PPR::PPR; Domain location=155-189::190-224::225-259::260- 294::326-360::361-395::397-431::463-497::54-88::89-123
ALRPGMQVHATLLISGTNMNILSLHSKLVGMYASCADLKSAKLLFKKIEHPNVFAFNWMVLGLAYNGHFDDALLYFRWMREVGHTGNNFTFSIVLKACVGLMDVNMGRQVHAMVCEMGFQNDVSVANALIDMYGKCGSISYARRLFDGMRERDVASWTSMICGFCNVGEIEQALMLFERMRLEGLEPNDFTWNAIIAAYARSSDSRKAFGFFERMKREGVVPDVVAWNALISGFVQNHQVREAFKMFWEMILSRIQPNQVTVVALLPACGSAGFVKWGREIHGFICRKGFDGNVFIASALIDMYSKCGSVKDARNVFDKIPCKNVASWNAMIDCYGKCGMVDSALALFNKMQEEGLRPNEVTFTCVLSACSHSGSVHRGLEIFSSMKQCYGIEASMQHYACVVDILCRSGRTEEAYEFFKGLPIQVTESMAGAFLHGCKVHGRRDLAKMMADEIMRMKLKGPGSFVTLSNIYAADGDWEEVGNVRNVMKERNVHKQSGFSWIEKPGGILEGEKEKEGNNMASELDIVSVIVGTGEGHSRLSTAQTIAINIAACNTAAAGTKSLPSPPPPEVDLWDSDAT

SEQ ID NO: 154990 - protein, 375 aa, Glycine max
  Coding DNA Sequence Number=SeqID_38212
  Gene Ontology: Mol. function=ATP-dependent helicase activity; Cellular component=nucleus; Biological process=rRNA processing
  Homolog annotation: Hit_ID=Q5VRY0; Match level="QueryCoverage=80%, HitCoverage=48%, E-value=1e-108, Identity=66%"; Hit description =Putative VASA
  Pfam annotation: Domain name=DEAD; Domain location=133-316; Score =197.0; E_value=4.5e-56; Accession=PF00270.19; Description=DEADDEAH box helicase
  Subcellular localization annotation: CTP_CleavageSite=49; ConfidenceScore=5.66e-01
MAGATGRTLFTLSLSSSSSLTRLSLIPKRVPLPKPLPLFRRFRPLCSVSAAAPEAADAKHSILLERLRSRHLRDAAKAAPEPRKKEKVAAAAAAAAAAAEAKEKKKAVASFEELGLSEEVMGAVREMGIEVPTEIQSIGIPAVLEEKSVVLGSHTGSGKTLAYLLPLAQLLRRDEQLNGILLKPRRPRAVVLCPTRELSEQVFRVAKSISHHARFRCTMVSGGGRLRPQEDSLNNPIDVVVGTPGRVLQHIEEGNMVYGDIKYLVLDEADTMFDRGFGPDIRKFIGPLKNRASKPDGLGFQTILVTATMTKAVQNLIDEEFLGIVHLRTSTLHKKISSARHDFIKLAGSENKLEALLQVVLRCVDLVALSLFGIV

SEQ ID NO: 154991 - protein, 358 aa, Glycine max
  Coding DNA Sequence Number=SeqID_38213
MDDFEWHPLVKQVGLVDTDVFPSSVNFNEPFRGGGGIFDAVDATPCVPPSMTGKRKRSDEVGGTEIHKKKRAPFSLQALKTPNPRSPTSIHSAAQIATPMTSVYDPLAPPPSSALVVFISPSSALATFTSGHAAFAPISSIALHLLSARLTMAGVVTSMPPPPSVVPPLTPTIPNSRMSASSSRPSVWSLPILEESGSKHGEAINKIDSLEEVAKWKATAKTVWQVDCPMVANAIISFVEAMKLNHQLLSKVDNVFAKLMSTRLDDDEIFGFYKYVLKEKDDLASKNIREGRRVLGVKRLTKDRPWILPAFGDLIRADLGFDDPLEIQPGARVDLGFGETHQGQTLAQSFEYKFPPCL

SEQ ID NO: 154992 - protein, 172 aa, Glycine max
  Coding DNA Sequence Number=SeqID_38214
  Gene Ontology: Mol. function=structural constituent of ribosome; Cellular component=ribonucleoprotein complex; Biological process =translation
  Homolog annotation: Hit_ID=Q8LPW2; Match level="QueryCoverage=81%, HitCoverage=100%, E-value=2e-54, Identity=85%"; Hit description =Small ribosomal subunit protein S13, mitochondrial precursor
  Pfam annotation: Domain name=Ribosomal_S13; Domain location=25-97; Score=-12.8; E_value=0.00024; Accession=PF00416.12; Description =Ribosomal protein S13S18
MFGSARILSDVTLRLRQNLSVHGVRVQNINIGGGVGGEIPDNKRLVYALQNLHGIGRSKAQHIVAELGVENKFVKDLSKRELYSIRELLSKKSVLREMWEGWWAFSATEGLDMLIACHAADRGLIQMHAPGGAGKLSPDPDRWCDYNCGPNASHGHPENLNVRAAIAVAHCL

SEQ ID NO: 154993 - protein, 439 aa, Glycine max
  Coding DNA Sequence Number=SeqID_38215
  Homolog annotation: Hit_ID=Q1ZY19; Match level="QueryCoverage=91%, HitCoverage=81%, E-value=3e-44, Identity=30%"; Hit description =Fgenesh protein 60
  Pfam annotation: Domain name=DUF247; Domain location=31-428; Score =358.0; E_value=1.5e-104; Accession=PF03140.6; Description=Plant protein of unknown function
MEGQQICSQSQAQYLETELTKMLPNVVLQMSEVNEQCIYKVPQKFREGNPKAYTPQVVSIGPFHKPRDSNGENNTLVRMEELKLEYLRRFLNRSKQLSMKHLFQRLIEKEKRIRSCYGEPINCNSNDFLTMILVDACFIIEHFLRFYTGLASIDIDPLSKSWLVNDVFHDLTLLENQLPFSVLEDIFNSAKPDFIGPIRDVESLSFLSITFHYFRKYNYIGIRENTIDSPKHFTDLLRTFMQPSKIHHESLKVGYMVNHLPSASQLSEVGMVFKASSCKCLFELKYHHRKGVMEMPCLTIEDRTETLFRNILALEQCHYILSPNVTQFLFLLNFLINTEKDVNILVDKKIIVNWMGDANAVVKMFNSLCSNVIVSYMSEEYCTLYHDLIKFHENPRNKYKAIFYHEYFNTPWKKASTTAAVLLLLFTLIQAICSVISLF

SEQ ID NO: 154994 - protein, 364 aa, Glycine max
  Coding DNA Sequence Number=SeqID_38216
MAAEWRRKKERRCHFKEKMSLEKAHHHRRSWIRAWNKKEMNEGKGREEHEILCSKRALKSKDHFFKAKATNISSDGLSLMYEENGVDKAILEQLLALLDALAILSLPSASNPLLILDGSSTEARVDLPHASDTIETDVEATPDMHPPPAMKRKHSEKAGGIGQHKKSRASFSLRALKQAMGLASGSSRPSSLLPRTTNPQGHSGCCRYNQHFLYPTPPSPSTQAIFEPSSSTSATSIPTSAALDLVSSIAPPLLSEGVKTASVLTNMPSPSSALPPSAPTVLTLIMPSSFSCPSVSLDQNLTNTFKVFLQNSVAILEENGNRRKEAMNKIAFLGRSLPSGGPLPGKYGEWSVLRWQMLFLHLLK

SEQ ID NO: 154995 - protein, 323 aa, Glycine max
  Coding DNA Sequence Number=SeqID_38217
  Homolog annotation: Hit_ID=Q9LTF9; Match level="QueryCoverage=40%, HitCoverage=30%, E-value=3e-29, Identity=58%"; Hit description =Arabidopsis thaliana genomic DNA, chromosome 5, BAC clone:F6N7
RRQGGGEGLKGEGEEKKVQEFRKGNPFISAVYFGCFNHPTVHIPKSEFRSRVEDKRVTNKQHKRHFSAKSPMLESELHDLSDDADYAASQQQGSASVMLRSDSAKQSSPREGAEIVFLKDNVAIHPTQFASERISGRLKLIKQSSSLSMTWIPYKVHSSEARLSDKDRNLYIIRAVPFTDIRSIRRHNPAFGWQYVIVVLSSDPGVQRRGVAASLWFCAASCKPKWQVHGDQRVADQVRWRAAATSSSVKNEDEEKGSLAAAARFLGIVPIAKHSVSNALKAQSGFVKPAGSPGSLKTGQVILGHMHERSNSKIGLVRSPDCC

SEQ ID NO: 154996 - protein, 173 aa, Glycine max
  Coding DNA Sequence Number=SeqID_38218
  Gene Ontology: Mol. function=Rab GTPase activator activity; Cellular component=intracellular; Biological process=regulation of Rab GTPase activity
  Homolog annotation: Hit_ID=Q9LTF9; Match level="QueryCoverage=81%, HitCoverage=42%, E-value=1e-28, Identity=50%"; Hit description =Arabidopsis thaliana genomic DNA, chromosome 5, BAC clone:F6N7
MYYVQDLTILSFEQVIRSEEDANVFLVNDFQNTLQRTLSSLEMPRAVPLTCGPSNTSVDESILIENQERADNGANDGRFSVNQFHGKPRHKVDPARDLSIQVLEKFSLVTRFARETTSQLFGENQSNGFSPIDRRTHIQTNLDHPKKSSNVEENTSDESPVALDSQEAQNYFD

SEQ ID NO: 154997 - protein, 60 aa, Glycine max
  Coding DNA Sequence Number=SeqID_38219
MMVELEEEGSDIREKEKDRRYEVRIEVMEKQRMYILVGFASGWEGEEGEWNDVKGEQHLL

SEQ ID NO: 154998 - protein, 70 aa, Glycine max
  Coding DNA Sequence Number=SeqID_38220
MLRRILPSLARTGSVGEENDVREGEDTVKVRLRDQQVYATFLHYHARPFSLLSSSNSKPFYGSILEFVAG

SEQ ID NO: 154999 - protein, 135 aa, Glycine max
  Coding DNA Sequence Number=SeqID_38221
PLIELVRNHVPSWEDAQEMGVEGRSPEYEEPRDLRSNPFQGGGNDVILSRKGIETTFTSMSSTTDDTPCNLASCNVSSSRLFLVGVATYPSAGGRRETRGMRVPRKEYARSRHQRLFEENVGKTGKDVIYELFSE

SEQ ID NO: 155000 - protein, 84 aa, Glycine max
  Coding DNA Sequence Number=SeqID_38222
MIYICRNLPFDGRATRDSRVHLSRKENARSRHQRLFEENVGKTEKRRGLQTLSVKGSRVVFTHGEGCFPCSYVFPNCDKKIKPT

SEQ ID NO: 155001 - protein, 83 aa, Glycine max
  Coding DNA Sequence Number=SeqID_38223
QRYVHDAIDKWVQVNDIIVDIKEPRSGVDWGFLLITVEGELSIIFLVSRFGMGGCFKGWRVLWGWWRWMMDGKPCSEVHILLL

SEQ ID NO: 155002 - protein, 398 aa, Glycine max
  Coding DNA Sequence Number=SeqID_38224
  Gene Ontology: Mol. function=RNA-directed DNA polymerase activity; Cellular component=chromatin; Biological process=chromatin assembly or disassembly
  Pfam annotation: Domain name=rve; Domain location=205-346; Score =49.6; E_value=1e-11; Accession=PF00665.16; Description=Integrase core domain
  Pfam annotation: Domain name=zf-H2C2; Domain location=146-187; Score =13.5; E_value=0.0057; Accession=PF09337.1; Description=His(2)-Cys(2) zinc finger
  Pfam module annotation: Pfam domain module=rve::zf-H2C2; Domain location=205-346::146-187
MADTLFHQGLTRLPRLVGILPEAAFDKLKEAICHAPVLGLSDFSLPFVVETDASGLAAITSTVKMWSQYLLGHQFTILTDHRSLKELMSQVVQTPEQQLYLARLLGYDYRIQYRSGKANTAADALSRRIWLPKHFCFIKILLEEFHSTPAGGHMGITKTLARMSDNFTCSGIKNDVCNFVLACVDCQQTKYNHRKSSGLLCPLPVPAWTWKDLSLDFIGGLPAFRGHTMVLVVVDRFSKGIHLGSLPPHYTAINVVHIFMEIVGKFHGMPHNLVFDCDPLFVSHFWQELFKLSGTKIRMSLAYHPQFDGQTEVLNKIVEQYLMWAEWSYNTLVHSGTQMTLYEIMFGKIPPIIPQYIVGTSSVNVVDDFLINREELFASLRKKLLKAQQTMKHFADNK

SEQ ID NO: 155003 - protein, 243 aa, Glycine max
  Coding DNA Sequence Number=SeqID_38225
  Homolog annotation: Hit_ID=Q9FHQ1; Match level="QueryCoverage=47%, HitCoverage=37%, E-value=8e-27, Identity=59%"; Hit description=GDSL -motif lipase/hydrolase-like protein
  Subcellular localization annotation: CTP_CleavageSite=57; ConfidenceScore=5.43e-01
MSAVIAASNCMTLPSVKQQQHKNAITSYASEIVVPTTNKYRFVLNSPNSLQSSPTQVAEQVKELSAPNLTIPAIGLTTVVAKPLEDSPMEGLLVISYLQNLESHHHQLICECLRMLIPYSKIQRLSFDDHINNFKKTKEVISANIGEAAANKHFNEATYFIGIVLRIKGRASSNHKLNIMGNKFGCYLLSMVCKMESDCIEDMDIEVLSSMWSEDVGTDVGKQFNIEKLGIDQYILEEVNIIE

SEQ ID NO: 155004 - protein, 78 aa, Glycine max
  Coding DNA Sequence Number=SeqID_38226
MQLSFDDSGMMKKGEEERLDALKSTKDKYELSSLVKSIKMKSKQVQLPSDDKTMKDGKSHIKETQQGKKDLSRIMKEV

SEQ ID NO: 155005 - protein, 100 aa, Glycine max
  Coding DNA Sequence Number=SeqID_38227
  Gene Ontology: Mol. function=pepsin A activity; Cellular component =anchored to membrane; Biological process=proteolysis
  Homolog annotation: Hit_ID=UPI000034F181; Match level="QueryCoverage =85%, HitCoverage=15%, E-value=3e-12, Identity=46%"; Hit description =aspartic-type endopeptidase/ pepsin A
MYNSKVKAKRHSSQSPDSNIPFDYCYDISISQTIEVPFLNLTMKGGDDYYVMDPIIQVSSEEEGDLLCLGIQKSDSVNIIGRRPSSGELEQHVQGHKFKP

SEQ ID NO: 155006 - protein, 66 aa, Glycine max
  Coding DNA Sequence Number=SeqID_38228
MAISGKRTTTNVKVGLIMNDRLGGLIDGFDLATGFTAIAGETAGECDGVLIGDVFESTSSEPDRTI

SEQ ID NO: 155007 - protein, 328 aa, Glycine max
  Coding DNA Sequence Number=SeqID_38229
  Homolog annotation: Hit_ID=Q37875; Match level="QueryCoverage=24%, HitCoverage=41%, E-value=4e-08, Identity=43%"; Hit description =Lysozyme
MTPDDIRLVVNEILPQYQASQWQIYLIALCIGGLIASIGIYWGANLKKRGEINASEALFDKISEQLRQNTKDVETIKTALSGQHWVSQQTWVNKEKYYTGLITYLHDFIHAIDGQLDCVRSSISVHDEAISDPEFYEEMQDLGTKASEGLNDLRGPSLVFLSEKTNLALDQMLAELWNLREHSTGPRSEFLKGEVEYDNAGESNLRGLPLFGVPGAGRQGIAIGIATFAANIYFQNRQTRAIERASRAGATIINPGLIIGLALSQANDFTSANGNALRFSKAAMEVMGNAEGCHREPYLCPAKIITQGIGHTGKGVAAVSQASDQQIA

SEQ ID NO: 155008 - protein, 607 aa, Glycine max
  Coding DNA Sequence Number=SeqID_38230
  Gene Ontology: Mol. function=RNA binding; Cellular component=nucleus; Biological process=ribosome biogenesis and assembly
  Homolog annotation: Hit_ID=Q6CBN0; Match level="QueryCoverage=69%, HitCoverage=65%, E-value=1e-44, Identity=28%"; Hit description =Similar to tr|Q06344 Saccharomyces cerevisiae YDR365c
  Pfam annotation: Domain name=NUC153; Domain location=586-607; Score =7.9; E_value=0.092; Accession=PF08159.2; Description=NUC153 domain
IMGSKNANGKNHKDKRKKFKDNLNSNHSSTGDAKVIIISDPRYSKAHTDPRFREAPKRETKVAIDSRFNRMFTHKSFLPSSALIDKRGKPKNNPTSQLGSLRHYYKVDEKEVEQSSDEEEDNEEELVKANRMKPESDKGTELEETSESESEETSESESDVDTDTDEGADEEVYEEEASDVHEDIATIDKETHRVAVVNMDWRYVKAVDLYVLLSSFVPPNGLIKSVTVYPSEFGLQRMKEEEVHGPIGLFDDEDEKNDEDSSNDDIDNEKLRAYEKSRMRYYFAVVECDSSATANYIYKECDGLELKQSSNALDLRFIPDNMEFKHPPRDVATEVPANYECKDFYSRALQHSEVNLTWDDDEPLRAKTLKQKFTDDQLAQMEVKEFLTSDESESDDSKDNNETDDQPDKRAKKRAKYRALLQAGDDSDGGNEHDNVQNMEVTFNTGLEDLSKHIMEKKDKKSETVWDAHLRKKCEKKKTRKNKRKYSSDDDDSDDTDQEATEEADDFFIEEPAVKKRKKLENKDEEPKEMNGLDEASKEELELLLADDKGTDTGLKGYNLKFKKGKGKRTENSIDEEKIPSNAYDDPRFSALFSPDYAIDPTNPQFK

SEQ ID NO: 155009 - protein, 93 aa, Glycine max
  Coding DNA Sequence Number=SeqID_38231
  Homolog annotation: Hit_ID=Q1LJU0; Match level="QueryCoverage=89%, HitCoverage=31%, E-value=3e-15, Identity=44%"; Hit description =Hypothetical protein precursor
MNQPANEKGGQTEVLLVNSALVDCVGVAPMKCMQVRRSAQQPWELFYTGIEGFTFEPGYQYRLKVRVTPVENVPADASSLRYTLIEQLEKNKA

SEQ ID NO: 155010 - protein, 194 aa, Glycine max
  Coding DNA Sequence Number=SeqID_38232
MNEFVYNTSNLKWLNLSESIKLNRERKLKSEEGWGPEAEWHVMVVTEEQALDYLSELGLIRISGTQKRGHSAPNCRIELEGNVDNEIAEDRLPQMEFLLRYKQGHAIPSLFAGIDMCRHSHQRLPFCLRGVEDANTNGKLLMEPVKRKALGLQCCRVQQVRVAAMQGQQVRGEGRVIGYCEFHKGGAIPSSNLL

SEQ ID NO: 155011 - protein, 71 aa, Glycine max
  Coding DNA Sequence Number=SeqID_38233
MWLREKHKKALLEALEKVKAELMVLGFLSLLLTFRQSYIVRIRIPVGVADKFFPILGIYYACKSFKIPAYT

SEQ ID NO: 155012 - protein, 106 aa, Glycine max
  Coding DNA Sequence Number=SeqID_38234
MNVDDKSSRTTLYQRVYIDSNAVEDFLGYIGVEVQITTSHQYFLGHLWKIIIGKQRFKLDREVKSAKRATFWFLKHSDDGKAWLINIIYRNPTVKEISVAHMASFD

SEQ ID NO: 155013 - protein, 174 aa, Glycine max
  Coding DNA Sequence Number=SeqID_38235
  Homolog annotation: Hit_ID=Q56X76; Match level="QueryCoverage=43%, HitCoverage=12%, E-value=3e-08, Identity=40%"; Hit description=DEAD -box ATP-dependent RNA helicase 39
  Pfam annotation: Domain name=PABP; Domain location=102-170; Score =25.7; E_value=5.3e-06; Accession=PF00658.8; Description=Poly -adenylate binding protein, unique domain
MRTVRLLRRDGGLLGSNSKYPQAIVLCATEEKSEQCFNAAKYIIHNAELKSAKDSASPDNGQSKASIGLMIGTPSEILEYIEEGSVVPAEIRYLRLLGYQFLGAPSIDLTSLSHVSCVLGEQSSVVKHLECDHAGNISAMSLEMEQTEVFHFTESLDALRKKVAEAMDSLLKQQ

SEQ ID NO: 155014 - protein, 111 aa, Glycine max
  Coding DNA Sequence Number=SeqID_38236
MVLNEMEAVNQDDDQGYWLPFQLLITFSSKHSHSHRDEMSIISKIVWGKNEKGCETSRNLENWVTMKEEEGRLWKKMPLSSSNSPWAMCKLMQQKCTQECVFVPYFLSDNP

SEQ ID NO: 155015 - protein, 194 aa, Glycine max
  Coding DNA Sequence Number=SeqID_38237
  Gene Ontology: Mol. function=carbon-sulfur lyase activity; Cellular component=vacuole
  Homolog annotation: Hit_ID=Q9FE98; Match level="QueryCoverage=95%, HitCoverage=39%, E-value=3e-44, Identity=46%"; Hit description =Alliinase, putative; 28821-30567
  Pfam annotation: Domain name=Alliinase_C; Domain location=92-194; Score=-158.0; E_value=1.1e-05; Accession=PF04864.4; Description =Allinase, C-terminal domain
  Pfam annotation: Domain name=EGF_alliinase; Domain location=32-90; Score=99.7; E_value=8.6e-27; Accession=PF04863.4; Description =Alliinase EGF-like domain
  Pfam module annotation: Pfam domain module=Alliinase_C::EGF _alliinase; Domain location=92-194::32-90
MAKRTSAMNLAFILILLCAPISMFICMGEWEPTWSTRAAEEAEAVAAIPCSGHGRAYLDGLILKGHEHVHVCECNSCNGGSDCFKFLSDCIANASSGDPYFLEPFWMRHAASSAILVSGWHRMSYSYSDGSYISEVLVKYIQKVHSIVGNAITKGRYFIFGSGSTQLFNAAVYALSLNSSVSPAKVVATTPYYP

SEQ ID NO: 155016 - protein, 397 aa, Glycine max
  Coding DNA Sequence Number=SeqID_38238
  Gene Ontology: Mol. function=carbon-sulfur lyase activity; Cellular component=vacuole
  Homolog annotation: Hit_ID=Q9FE98; Match level="QueryCoverage=52%, HitCoverage=46%, E-value=4e-68, Identity=56%"; Hit description =Alliinase, putative; 28821-30567
  Pfam annotation: Domain name=Alliinase_C; Domain location=1-220; Score=226.9; E_value=4.3e-65; Accession=PF04864.4; Description =Allinase, C-terminal domain
  Pfam annotation: Domain name=zf-MIZ; Domain location=234-276; Score =1.5; E_value=0.00076; Accession=PF02891.10; Description=MIZ zinc finger
  Pfam module annotation: Pfam domain module=Alliinase_C::zf-MIZ; Domain location=1-220::234-276
DTSLWKNNTDSNSRFIEFVTSPNNPDGKLTKRVLEGPNVKTIYDRAYYWPHFTAIPSPADEDLMLFTISKLTGHAGSRFGWAIIKDEAVYQKMLIYLQLNTIGVSRDVQLRALKLLDVIVEGDGKEIFQFAYSTMRDRWIRLKQVISESKRFSLQKLSPQYCTFFKRVRDPSPAYAWLKCERQEESNCYEILEAAGIIGREGNSFSTQQRLPSHPMSTLFIALQCCQCSTMQALSLSLSLSLIFCVHSNPIDCNYVQVKQKKKSSNKWNCAVCNQKQSVCRVFAQGFMAKELRKFVQDFNMSRKSFDDGEYPLAGTLNPPLPATEHGDAELNLKKKRNDWSAYLHQEQQPDHDADDDFEPLVVTELQKGMFKKRRVVEDSTAGSDRLFKKSLFHNSQ

SEQ ID NO: 155017 - protein, 105 aa, Glycine max
  Coding DNA Sequence Number=SeqID_38239
MSFMWIHIDAEELRIDQPRVTSLTESNPKRNNYVTPTNQRTQKCKPTSSRAASKWNNYLTEDNENLELGWKKSFNFEDHSGPRNNTVLETMTSEIVEDDIHPDFM

SEQ ID NO: 155018 - protein, 78 aa, Glycine max
  Coding DNA Sequence Number=SeqID_38240
MCLKISVIHDHNHFLARSRIIVQILFPSSIQRRVSIGLIHIEFVYVESQRGGRLWMLLLITERILVLELFGYLDLHHH

SEQ ID NO: 155019 - protein, 98 aa, Glycine max
  Coding DNA Sequence Number=SeqID_38241
MDRCSSIPSPLVLWVMRELPPKEAASISEESSTIAFVVDSSIAIHHPQRWTTATSIQIPTATSVRKVRPKVTIAKFQFNPKTCHMGLLIWTKTCHIDI

SEQ ID NO: 155020 - protein, 125 aa, Glycine max
  Coding DNA Sequence Number=SeqID_38242
MGLDNSGLMGQTGYWKNFPWKPAESSQSPCDPGVVKINVDAAIFSDANTLEADMVLRDHNGMFLQAKTVRGRSLSFVVGQTLEYSAVEEDCKAFDGLQTNIIGVSEFYNLLATCQSLLSYYPNSN

SEQ ID NO: 155021 - protein, 102 aa, Glycine max
  Coding DNA Sequence Number=SeqID_38243
MAKFEKYMEMLQGRKMNHLLKNSHRTYYINTMESGKRDNKEEEQQVRIILGRSFMRIAHVTINVRKGTYTLREGKKQMFYYIQRIEDFPNESAHQQHHHTIP

SEQ ID NO: 155022 - protein, 152 aa, Glycine max
  Coding DNA Sequence Number=SeqID_38244
  Gene Ontology: Mol. function=nucleic acid binding; Cellular component= nucleus; Biological process=RNA catabolic process
  Homolog annotation: Hit_ID=O64380; Match level="QueryCoverage=85%, HitCoverage=19%, E-value=7e-23, Identity=50%"; Hit description =Polyadenylate-binding protein 3 (Poly(A)-binding protein 3)
  Pfam annotation: Domain name=PABP; Domain location=58-131; Score =96.9; E_value=5.9e-26; Accession=PF00658.8; Description=Poly -adenylate binding protein, unique domain
MLHLNSSQGFGYMGNGQNGMDPSVVPHGIVAPMMPLPFDGSGISAAPTYNQHPGGSLSNTFASALASATPENQHLMLAEHLYPLVDEITKNHHQTEKVTGMLLEMDQSEVIHLTESPEDLKIKVFEAMQALGEAAPDSEEVGDQLGSVSLKE

SEQ ID NO: 155023 - protein, 312 aa, Glycine max
  Coding DNA Sequence Number=SeqID_38245
  Gene Ontology: Mol. function=nucleic acid binding; Cellular component= nucleus; Biological process=synaptic transmission
  Homolog annotation: Hit_ID=Q1STD4; Match level="QueryCoverage=100%, HitCoverage=56%, E-value=1e-112, Identity=48%"; Hit description=RNA -binding region RNP-1
  Pfam annotation: Domain name=RRM_1; Domain location=124-195; Score =94.2; E_value=3.9e-25; Accession=PF00076.12; Description=RNA recognition motif. (a.k.a. RRM, R
  Pfam annotation: Domain name=RRM_1; Domain location=228-298; Score =99.4; E_value=1.1e-26; Accession=PF00076.12; Description=RNA recognition motif. (a.k.a. RRM, R
  Pfam annotation: Domain name=RRM_1; Domain location=33-103; Score =87.2; E_value=5e-23; Accession=PF00076.12; Description=RNA recognition motif. (a.k.a. RRM, R
  Pfam annotation: Domain name=RRM_2; Domain location=122-209; Score =1.4; E_value=0.091; Accession=PF04059.3; Description=RNA recognition motif 2
  Pfam module annotation: Pfam domain module=RRM_1::RRM_1::RRM_1::RRM _2; Domain location=124-195::228-298::33-103::122-209
MEHLNFTPLNGKSIRVMFSNRDPSIRKSGYANVFIKNLDISIDNKTLHDTFAAFGFVLSSKVAVDSIGQSKGYGFVQFDNEESAQNAIKELNGMLINDKKVYVGLFVNRQERAQVDGSPKFTNVYVKNFSETYTDEDLEQLFSTYGTITSAVVMKDTDGKSRCFGFVNFESPDSAVAAVERLNGTTVNDDKVLYVGRAQRKAEREAELKARFELERIRKYEKYHGTNLYVKNLDYNINDDKLKELFSEFGTITSCKVMLEPNGRSKGYGFVAFSAPRNANRALHEMNGKMIGRRPLYVAVGQRKEERKALLE

SEQ ID NO: 155024 - protein, 540 aa, Glycine max
  Coding DNA Sequence Number=SeqID_38246
  Gene Ontology: Mol. function=isomerase activity; Cellular component =cytoplasm; Biological process=negative regulation of transcription
  Homolog annotation: Hit_ID=Q10PT6; Match level="QueryCoverage=97%, HitCoverage=93%, E-value=0.0, Identity=42%"; Hit description=MA3 domain-containing protein, putative, expressed
  Pfam annotation: Domain name=MA3; Domain location=111-222; Score =158.4; E_value=1.9e-44; Accession=PF02847.7; Description=MA3 domain
  Pfam annotation: Domain name=MA3; Domain location=246-357; Score =120.9; E_value=3.7e-33; Accession=PF02847.7; Description=MA3 domain
  Pfam annotation: Domain name=MA3; Domain location=414-523; Score =145.9; E_value=1.1e-40; Accession=PF02847.7; Description=MA3 domain
  Pfam module annotation: Pfam domain module=MA3::MA3::MA3; Domain location=111-222::246-357::414-523
MAAILLSALYADVLDPSQVYKGFSKLVDSADDLIVDIPDTVEVLALFIARAVVDDILPPAFLKKHMAYLPKDSKGVEVLKKTEKSYLAAPLHAEIIERCWGGSKNTTVDDVKAKINNFLKEYVGSGDKKEAFRCIKDLKVPFFHHEIVKRALIMAMERRQAESPLLDLLRAAAEEGFINSSQMSKGFGRLIDTVDDLSLDIPDARGILQKLMSKAASEGWLCVSSLKSLSVEPEKNTIEDSAAKSFKVKTQSIIQEYFLSGDILEVNSCLEQENSKNCAALNAIFVKKLITLAMDRKNREKEMASVLLSSLCFPADDVVSGFVMLIESADDTALDNPVVVEDLAMFLARAVVDEVLAPQHLEEIGAQSLGPGSIGSKVLQMTKSLLKARLAGERILRCWGGGGSSRPGWAFEDVKDMIGKLLEEYESGGEIREACRCMKELGMPFFHHEVVKKALVTTIEKKNERLWGLLKECFESGLITMNQMVKGFGRVAESLDDLALDVPDAKNQFACYFERAKANGWLDNSFCFSKQEHATENGTH

SEQ ID NO: 155025 - protein, 262 aa, Glycine max
  Coding DNA Sequence Number=SeqID_38247
GAIGEDEGECGDDIGGENEGFMRTTIMVASATTMKGILYLVHQAPIMFSSTQFGLYPSSFNSLPLSCKQIDSLPFVLHCSAVISVFVKNQLHEVNLRLETLVEEREYEVAVLHREVSDPATGLENKASALAEEQRSSQESLTVIVIETLIKEAIEVVSSEKSEIQSRNRALEKKIGSLETELNNIGGVIKNCVWPEPESQGSRFTGENWRRKNTHSGMDTPDWLKKLNFSGVNFPPWILACVVIVFTRTRKRTRDFLKKRGW

SEQ ID NO: 155026 - protein, 102 aa, Glycine max
  Coding DNA Sequence Number=SeqID_38248
MKELLYFMGLLNLRLQIHFFLSLGNKRQQGRKGETTPEQRESLKHQPTKDVATGKDNSEKSTTGRMKKLHFPLTNEHNIDCHVSEHAQRRGSKGVEGTFESS

SEQ ID NO: 155027 - protein, 316 aa, Glycine max
  Coding DNA Sequence Number=SeqID_38249
  Gene Ontology: Mol. function=RNA-directed DNA polymerase activity; Cellular component=chromatin; Biological process=chromatin assembly or disassembly
  Pfam annotation: Domain name=zf-CCHC; Domain location=248-265; Score =6.6; E_value=0.08; Accession=PF00098.13; Description=Zinc knuckle
MDKSLKVGEDEWRERERKSMKFYASNEFPKLFLALCAKRQRGKAHSFPTSSSAMPHLASPHPPNPHCMKLEVPHFNGFDPSGWILKITQFFEYHSTPDHECLTIASFYMEGPALAWFQWITHNGQLASLLGFLQPLEARFSLSQYNDPTGALFKLTQCGSVTNYLSEFETLANCIIGSRFSQTLGGEVQRLSLFSSWQTHLSLHLGPALFSHLDSKYFFTYVTIPSQTTAIPFKRLSPEELVTRREKDLCFNCNEKFHKGHKCVSKVFLLIAEEDDDSQEAHGLMDPLLDSQEALASSQAQISLHTLSGHLAPKTL

SEQ ID NO: 155028 - protein, 228 aa, Glycine max
  Coding DNA Sequence Number=SeqID_38250
MDFANPNVTKGKQQMDMEGQTLNICVNRDGDSSSKHLVRLSDPQYHSCDRAGGFETCPDNQASLSCHTSIAYMELITKTPSFEGGDYQGVNSFSLEDEEDMTWYQTNYSLLSLLQDEEQSLESPIDMKEIHDASFSMEPWKAPGPNGYLARAPFFAPQRGPRCLGPYESWENWPFSVHLMFVDDLLLFGQAYESTTKAIKKAMDLFYGISRQLISNDKTNIFSKNVNP

SEQ ID NO: 155029 - protein, 151 aa, Glycine max
  Coding DNA Sequence Number=SeqID_38251
  Gene Ontology: Mol. function=DNA topoisomerase activity; Cellular component=chromosome; Biological process=DNA unwinding during replication
  Homolog annotation: Hit_ID=Q2HTL3; Match level="QueryCoverage=75%, HitCoverage=28%, E-value=1e-52, Identity=86%"; Hit description=WD40 -like
  Pfam annotation: Domain name=DNA_gyraseA_C; Domain location=30-79; Score=42.5; E_value=1.5e-09; Accession=PF03989.3; Description=DNA gyrase C-terminal domain, beta-propeller
  Pfam annotation: Domain name=DNA_gyraseA_C; Domain location=80-128; Score=31.4; E_value=3.1e-06; Accession=PF03989.3; Description=DNA gyrase C-terminal domain, beta-propeller
  Pfam module annotation: Pfam domain module=DNA_gyraseA_C::DNA_gyraseA_ C; Domain location=30-79::80-128
MKNKFSNPRPSMLEDTDDGQLEDIDVIPNEEMILALSEKGYVKRMKPNTFNLQNRGTIGKSVGKLKVNDSMSDFLVFRAHDHVLYFSDKGTVYSARAYKIPECSRTAAGTPLVQVHGDELKWVRLCSNDDFVAMASHNGMVMLSQCSKASC

SEQ ID NO: 155030 - protein, 219 aa, Glycine max
  Coding DNA Sequence Number=SeqID_38252
  Gene Ontology: Mol. function=RNA-directed DNA polymerase activity; Biological process=RNA-dependent DNA replication
MDDGTRGNNESLWWQDLKVVFHQSQQGNVFQNGIAWRVGCRDKIKLWEDSWTIDDVPLITKYPRLYHISCQQKQFIQQMGSHTDAGWEWNFIWRRSLIDNEIDMADSFLGDIVGSLIQPHKRDNWVWKAYPNGQYSAQNQLPTKLNLRRRHIEINDLLCPFCRNKEEDVAHLFFNCSKILPIWWESLSSVNISGAFPQNPRQHFLHHANGLDAGIRANR

SEQ ID NO: 155031 - protein, 43 aa, Glycine max
  Coding DNA Sequence Number=SeqID_38253
MEQLLDPQEMKTITLKIYCRKCLWSPLYVHSSDLESNAKAIRQ

SEQ ID NO: 155032 - protein, 51 aa, Glycine max
  Coding DNA Sequence Number=SeqID_38254
MSKAKQRKGKNAQRFLYCYHDVITNKIIVRFHYEVLILKNLIDEHYEEPSE

SEQ ID NO: 155033 - protein, 116 aa, Glycine max
  Coding DNA Sequence Number=SeqID_38255
MDQTWMNASCMSPVYEEGIGEFLQFSSKRSRPDEDGKYFCPCINYLNGRRQVLDDIQEHLIDSKKPLYRGCKKSLTLLSVMLSLINVKAIYWWSDKNFTSLLQVVQDMLPDENTLP

SEQ ID NO: 155034 - protein, 173 aa, Glycine max
  Coding DNA Sequence Number=SeqID_38256
MRANWRQHKDVTSFYFTRFPEDAIVEDLWYHFKQSGEMREVFIPWKRNRHGRRYGFVRFKGVRDMHQETRNECGSPARAYAEVVTQTIPRTEQRRASAKDDYTRYNSTSAVNLDIPLTGQHWLKEAWVDRLKNLALFDSIEDDMRWDSGQNISPKYLGDDMVLLLGLTEEKAA

SEQ ID NO: 155035 - protein, 100 aa, Glycine max
  Coding DNA Sequence Number=SeqID_38257
  Homolog annotation: Hit_ID=Q9FKX3; Match level="QueryCoverage=89%, HitCoverage=42%, E-value=1e-26, Identity=64%"; Hit description =Arabidopsis thaliana genomic DNA, chromosome 5, TAC clone:K2A18
MGFMCFAYFTVIDAQQKESLPEHETQLSSIRWHLSEGGLKDYNLLERLGDGNKPTAIIGDVADDLNLDLVVISMEAIHTKHIDANLLAEFIPCPVMLLPL

SEQ ID NO: 155036 - protein, 91 aa, Glycine max
  Coding DNA Sequence Number=SeqID_38258
MPLQNIMEVEVFDCWDYVSKWVEVVATPRNDAKIVRKAKEKRRGEAPSTREYAKEEGASPPRIALDKKLEEDALMEEKKERRGEHEIEGIK

SEQ ID NO: 155037 - protein, 144 aa, Glycine max
  Coding DNA Sequence Number=SeqID_38259
MGIIDMDRGFPLFAILRLRMYSLESSKSLYLDVLHVVFQNSKINAPTNQQPKPSSIIGNHDDIIEGDKANHELVGEKMKVNHADYLDRNNRRESQNLLITCAIDTTFPWCTFGDFNDLLSNEENIGLVDHPTQLLNGFREGFID

SEQ ID NO: 155038 - protein, 114 aa, Glycine max
  Coding DNA Sequence Number=SeqID_38260
MDLCLVVCFKVYLQTYVIFKKVLILNVWCSHKKWKVTIRCFDDNNDDDKGDDKKLKDQSKNNSSESRIIQEFKIRIKKNSRTQEESLETRIKIQGSRSQESRSRFKNKEKTQSR

SEQ ID NO: 155039 - protein, 210 aa, Glycine max
  Coding DNA Sequence Number=SeqID_38261
  Gene Ontology: Mol. function=actin binding; Cellular component =intracellular; Biological process=cell division
  Homolog annotation: Hit_ID=Q8SAG3; Match level="QueryCoverage=64%, HitCoverage=95%, E-value=3e-60, Identity=81%"; Hit description=Actin- depolymerizing factor
  Pfam annotation: Domain name=Cofilin_ADF; Domain location=83-210; Score=192.8; E_value=8.4e-55; Accession=PF00241.10; Description =Cofilintropomyosin-type actin-binding pr
  Subcellular localization annotation: CTP_CleavageSite=77; ConfidenceScore=5.79e-01
MGGGKSLSFSAVFMVPNSTQHFASNIALFTSKFNSFSVVALSSTSSLIPHVFQRPQPVLDEKASDPDAFELQPNATSGMGVADHSKNTFMELKQKKVHRYVIFKVDEKKREVVVEKTGGPAESYDDFAASLPENDCRYAVFDYDFVTSENCQKSKIFFIAWSPSTSRIRAKMLYATTKDRFRRELDGVHYEIQATDPTEMDLEVLRDRAH

SEQ ID NO: 155040 - protein, 155 aa, Glycine max
  Coding DNA Sequence Number=SeqID_38262
  Homolog annotation: Hit_ID=Q1SUM5; Match level="QueryCoverage=55%, HitCoverage=80%, E-value=3e-08, Identity=34%"; Hit description =Polynucleotidyl transferase, Ribonuclease H fold
MTNRRHKMHMEIRDKGKRSSRKESRSHMHQAPPNRSNSTWTPSTDLCMKCNVDATVFKDTINFSVLACMKDSGGRFIAARPQVYQGDPTPQEAKVVASLTALKWISNSQLANVIVELACKANMEAINIKNFANNKARDRLRQCLDNKNSLINYQT

SEQ ID NO: 155041 - protein, 113 aa, Glycine max
  Coding DNA Sequence Number=SeqID_38263
MRLLVKIKVLRDNEVITSELAYISSSNISSDNDSGYGTNPVDDELMMCRRLLGIQWVVALMRPTQANQEKSFVLMPKEELFIKDGQGYLEKRFVFHPGGWIDIKELNLRSNSL

SEQ ID NO: 155042 - protein, 40 aa, Glycine max
  Coding DNA Sequence Number=SeqID_38264
MLRLRGRDRYVWRGPRNGVKAVGKRILSCSQRLQPSPAPF

SEQ ID NO: 155043 - protein, 57 aa, Glycine max
  Coding DNA Sequence Number=SeqID_38265
MEKMNVHETTRGAPKVVAHPGELKLSAEAMGLPKRVGAHSGVQHHNSTIKAQKIKER

SEQ ID NO: 155044 - protein, 905 aa, Glycine max
  Coding DNA Sequence Number=SeqID_38266
  Gene Ontology: Mol. function=protein transporter activity; Cellular component=nucleus; Biological process=intracellular protein transport
  Homolog annotation: Hit_ID=Q9FLH0; Match level="QueryCoverage=84%, HitCoverage=81%, E-value=1e-155, Identity=38%"; Hit description =Putative nuclear matrix constituent protein 1-like protein
MATPITPDSATLASRDPWKRLKQPAFDDNSIQRKDKAALYRSVPVISVLLVDYYRFNGWSSCLETSSKWISRKLLAFKYEQVKASIDSSEFMHKHDSAMNLSALIEARKREESLKMAIGINEACIASLEKALHEMRTECAETKVSAESKVSEAHQLIDEAQKKSTEAEAKLRAAESFQAEACGYYSVADRKLRDVEAREDELRRQIKSFKSEYVFKYFFGEYRALLYTRNAKDEELDSLQKELEDTKTNTNKEHGALCDEKTNLKLMEATLTIREEALSKRESELNKKEQELLDLQVKLASRESDETQKVKAVQEAELGARKTNFEAELQIQLKLVENEIEMKRWAWELKEVDLTQREEKLQEREHELEILSRTLGEKEKDLVDMSSALKEKDQSLRASEKELELNKVLLQKDKEEINKTKLDVQMSLVSLENNLRQFDNAKERHEALKSETNDLSVLEVKLKEEIDVVRSQKLEIVAEADKLEAEKAKFEAQWELLDEKKEELRKEAEYIAEEKKAVSAFIKKERDKLRQEKENMRDQYKRDLESLTCEREEFMNKMAHEHDDWFGKMQQERANFLRDVEMQNRNMNILIDKRREEIESYLKEREKSFEEEKNNQLEYINALKEKVAKEYKQCIEELKVQRDKLQNQRELLHADRIEIHAQTEELKKVKDLKIVSDDIALTELLNSDMESNQQKISMKKKLNQRTLKHDDHLNSPQKIDANKISNGFDSSFVQNSSVVLPSSPVRFSWIKRCTKLVFRRSPEKSLVHDDDKEPKVILEVPSPAEDINRLSDFESENKKDVNRPVPLVSNGSLGNTEGTGVVMVDKVMHVSEVTSERTDAISLPNLESADHLCDPTIVVDKGDLHGNKIDQSNSQIIEIDIPCGSDVFAKSEEIWEENSGQVPDR

SEQ ID NO: 155045 - protein, 208 aa, Glycine max
  Coding DNA Sequence Number=SeqID_38267
  Gene Ontology: Mol. function=chaperone activator activity; Cellular component=cytosol; Biological process=regulation of progression through mitotic cell cycle
  Homolog annotation: Hit_ID=Q9FR34; Match level="QueryCoverage=65%, HitCoverage=75%, E-value=3e-43, Identity=64%"; Hit description =Ripening regulated protein DDTFR8
  Pfam annotation: Domain name=CS; Domain location=22-98; Score=66.8; E_ value=7e-17; Accession=PF04969.6; Description=CS domain
MVMDASDGNLLLSTTYLEYRHPSVKWAQTSDVLYLTVELPDAQDVKLKLEPEGKFYFSATAGAEKIPYEVDIDLFDKIDVNNSKASVGSRHICYLVKKAENKWWDRLLKQGGKSPVFLKVDWDKWVDEDEEQDNKPAASDMDFGDIDFSKMSMGGGEGLDFDAAGNDDDDESDTEEEFAAEASASKEQDSKDAVSSYPIPKDAPDTKA

SEQ ID NO: 155046 - protein, 131 aa, Glycine max
  Coding DNA Sequence Number=SeqID_38268
MEDASMSPCVALPPKGSVDEKKGGVIVSDRKCKIFRDKICDNDDGLRVVLSGVCMRVMENLFFISLREGFRISLTWFCSKWKLLGSRDQGLNGFMMEMLHSMNKMRGKEDFFVVKVDLAKSYDHMSWKFVN

SEQ ID NO: 155047 - protein, 607 aa, Glycine max
  Coding DNA Sequence Number=SeqID_38269
  Gene Ontology: Mol. function=nucleoside-triphosphatase activity; Cellular component=membrane; Biological process=defense response
  Homolog annotation: Hit_ID=Q1RTS6; Match level="QueryCoverage=58%, HitCoverage=23%, E-value=4e-82, Identity=46%"; Hit description=TIR; Disease resistance protein; AAA ATPase
  Pfam annotation: Domain name=LRR_1; Domain location=158-183; Score =9.6; E_value=4.6; Accession=PF00560.23; Description=Leucine Rich Repeat
  Pfam annotation: Domain name=LRR_1; Domain location=223-244; Score =8.6; E_value=7.1; Accession=PF00560.23; Description=Leucine Rich Repeat
  Pfam annotation: Domain name=LRR_1; Domain location=246-268; Score =2.9; E_value=80; Accession=PF00560.23; Description=Leucine Rich Repeat
  Pfam annotation: Domain name=LRR_1; Domain location=270-291; Score =1.8; E_value=1.3e+02; Accession=PF00560.23; Description=Leucine Rich Repeat
  Pfam annotation: Domain name=LRR_1; Domain location=293-315; Score =12.7; E_value=1.2; Accession=PF00560.23; Description=Leucine Rich Repeat
  Pfam annotation: Domain name=LRR_1; Domain location=317-338; Score =8.0; E_value=8.9; Accession=PF00560.23; Description=Leucine Rich Repeat
  Pfam annotation: Domain name=LRR_1; Domain location=340-362; Score =3.1; E_value=74; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=158-183::223-244::246 -268::270-291::293-315::317-338::340-362
MGYECNSALDKYERIPHEKIHEILKVSYDGLEENEKQIFLDIACFFNTCGVGYVTSVLRAHGFHVKDGLRVLVDRSLLKIDASGCVRMHDLIRDTGREIVRQESTVEPGRRSRLWFEEDIVHVLEENTGTDKIEFIKLEGYNNIQVQWNGKALKEMKNLRILIIENTTFSTGPEHLPNSLRVLDWSCYPSPSLPADFNPKRVELLLMPESCLQIFQPYNMFESLSVLSIEDCQFLTDLPSLREVPLLAYLCIDNCTNLVKIDGSIGFLDKLQLLSAKRCSKLKILAPCVMLPSLEILDLRGCTCLDSFPEVLGKMENIKEIYLDETAIETLPCSIGNFVGLQLLSLRKCGRLHQLPGSICILPKVKVIFGFGHVVYRFWEENQYEQELSLEVSPRSMVVVDGDLDFTYIDMYYPHISPNNVIQVCSPNLLLHHDFILLFKKLASKDGSRCRKSSMHFSFRNKFPKIAVCCSVLPSLKITMILILKLGVLINGTKIFSSSCNYLFTQTWNPKLWCDLESKAEGMFSEQEWNEAEILFELGYPTPCAGLTMSLHNFAEGRLNWTLFGVYEEGNNKEDIKFKDPMSTFSFCNMLMEPPSSLPSCLYYVVK

SEQ ID NO: 155048 - protein, 102 aa, Glycine max
  Coding DNA Sequence Number=SeqID_38270
MTLSKKYFQKMNGTAIESVKALISCWTWHFLEWLKYFENSGLWMVICKFQVLRGLSLNMIRICKISEVQIFTPHNNDIATLMLLNQRNGEEVAQQGTKSLES

SEQ ID NO: 155049 - protein, 107 aa, Glycine max
  Coding DNA Sequence Number=SeqID_38271
  Gene Ontology: Mol. function=protein serine/threonine kinase activity; Cellular component=nucleus; Biological process=response to high light intensity
  Homolog annotation: Hit_ID=Q9XET1; Match level="QueryCoverage=82%, HitCoverage=58%, E-value=3e-45, Identity=100%"; Hit description=Seed maturation protein PM31
  Pfam annotation: Domain name=HSP20; Domain location=1-107; Score =115.2; E_value=1.9e-31; Accession=PF00011.11; Description=Hsp20alpha crystallin family
MKEKEKEIAVIACVIGVWVKKEDLKVQVEENKILQISGERVKEKEDQNDKWHRVERQCGSFLRRFRLPEDANPNQISCTLENGVLNVTVPKVEKKPENKNVRQIDVV

SEQ ID NO: 155050 - protein, 248 aa, Glycine max
  Coding DNA Sequence Number=SeqID_38272
  Gene Ontology: Mol. function=pyridoxal phosphate binding; Biological process=carboxylic acid metabolic process
  Homolog annotation: Hit_ID=Q1SBV6; Match level="QueryCoverage=100%, HitCoverage=50%, E-value=7e-84, Identity=65%"; Hit description =Probable histidine decarboxylase [imported]-Arabidopsis thaliana
MENSAGKNMAMDFIIPRTHATELLSSKVVSNANFSRKEENLPIDIKENLAITKCSGETQANLASVITHYVETLNQYSLRNLGYPTNQNFNYDTLASLLHFHLNNAGDPFLGSSFSLNSTRFEVCVLDWFANLWEIEKNKYWGYVTTGGTEGNLHGILVGREQLPDGILYTSQDSHYSIFKIARMYRMQCMKVSTLVSGEINCVDLKALLLAHKDKPAIINLNIDTWRNINMVLVSGTTMKGGVDDLDL

SEQ ID NO: 155051 - protein, 360 aa, Glycine max
  Coding DNA Sequence Number=SeqID_38273
  Gene Ontology: Mol. function=protein serine/threonine kinase activity; Cellular component=cellular_component; Biological process =protein amino acid phosphorylation
  Homolog annotation: Hit_ID=Q2QXA8; Match level="QueryCoverage=97%, HitCoverage=92%, E-value=2e-69, Identity=54%"; Hit description =Protein kinase family protein, putative, expressed
  Pfam annotation: Domain name=Pkinase; Domain location=186-353; Score=- 87.0; E_value=0.0022; Accession=PF00069.15; Description=Protein kinase domain
  Pfam annotation: Domain name=Pkinase_Tyr; Domain location=186-353; Score=-30.9; E_value=1.4e-10; Accession=PF07714.7; Description =Protein tyrosine kinase
  Pfam module annotation: Pfam domain module=Pkinase::Pkinase_Tyr; Domain location=186-353::186-353
MDLVEGVGESSSPPRAFSGYSNYDVRNDVYNRLLQTGHDQAVSNPDFREHLEAHFNRLPPSYGLDVNIDRAEDVLLHQSLLALAKDPHKRPVYHIRFLELSALLSDIGLNIREAHVFSTTDGYSLDVFVVDGWPVEETDDLYDAMEKAVSRSEGSWSRSLKSHSAVEKALATEGKSGDWEIDRKLLKLGEKIASGSSGDLYRGVYLGEDVAVKVLRSEQLNDALEDEFAQEVAILRFYFKYLTVNGFFHKVINHQPYDQKADVFSFSIVLWELVTAKVPYDTMTPLQAALGVRQFITRIDHFVSDSAVMLYILQGLRPELPKNGHPKLLELMQRCWEAIPSHRPSFNEITAELEIFCKKW

SEQ ID NO: 155052 - protein, 55 aa, Glycine max
  Coding DNA Sequence Number=SeqID_38274
MALATPALVKENLAPYSNTNILLSSPRQQDMNKIPINIKYSGELVLLGWAVALKA

SEQ ID NO: 155053 - protein, 375 aa, Glycine max
  Coding DNA Sequence Number=SeqID_38275
  Gene Ontology: Mol. function=oxidoreductase activity; Cellular component=intracellular; Biological process=lignin catabolic process
  Homolog annotation: Hit_ID=Q84J37; Match level="QueryCoverage=74%, HitCoverage=71%, E-value=9e-51, Identity=47%"; Hit description =Putative laccase (Diphenol oxidase) family protein
  Pfam annotation: Domain name=Cu-oxidase; Domain location=27-171; Score=120.3; E_value=5.4e-33; Accession=PF00394.12; Description =Multicopper oxidase
  Pfam annotation: Domain name=Cu-oxidase_2; Domain location=168-288; Score=52.0; E_value=2e-12; Accession=PF07731.4; Description =Multicopper oxidase
  Pfam module annotation: Pfam domain module=Cu-oxidase::Cu-oxidase_2; Domain location=27-171::168-288
EGTIRWHAHSDWARATVHGPIYIYPRKGEWWKNDARDVYEEFLRTGGAPNDSDAITINGQPGDLYACKIRNIELNAHQGKTYLLRMVNAAMNLNLFFSVSKHHLTVVGVDSGYSKPLTRDYICIAPGQTADVLLHANQEPNDYYMAARAFKIHYDENHAPNKSLSLPYLPYYNDKEAAFDYYVSIKGLTETYPYQIPKEETKVALTKYGSTVELVFQWKNLVAGIDHPMHLHGTSFFAVGYGFGNFDIHKDHKTYNLIDPPIMNTILVPKKGWASIKYRAANPDGEEEEEEDDDDDEEDEEEEENRGSEREARWCGGALWWKCILVRRKRRRCGSGVARKKRLGMCLEAMVARGTDPKVVPWCQGQYLVNCKPIK

SEQ ID NO: 155054 - protein, 87 aa, Glycine max
  Coding DNA Sequence Number=SeqID_38276
  Homolog annotation: Hit_ID=Q1S735; Match level="QueryCoverage=93%, HitCoverage=13%, E-value=8e-10, Identity=42%"; Hit description =Probable transposase [imported]-Arabidopsis thaliana-related
MDENKTKKIKTQEADDENDVAFDEDSLRVSDDPPLRATPLTSQRGNNSNRIGDYFVPITTAGAQPTLKSVLQSKKVVEKCDIAFEDG

SEQ ID NO: 155055 - protein, 141 aa, Glycine max
  Coding DNA Sequence Number=SeqID_38277
  Gene Ontology: Mol. function=protein serine/threonine kinase activity; Cellular component=integral to membrane; Biological process=protein amino acid phosphorylation
  Homolog annotation: Hit_ID=Q8GRK2; Match level="QueryCoverage=82%, HitCoverage=18%, E-value=2e-60, Identity=94%"; Hit description =Somatic embryogenesis receptor kinase 1
  Pfam annotation: Domain name=LRRNT_2; Domain location=25-61; Score =36.4; E_value=9.8e-08; Accession=PF08263.3; Description=Leucine rich repeat N-terminal domain
  Pfam annotation: Domain name=LRR_1; Domain location=113-135; Score =15.3; E_value=0.23; Accession=PF00560.23; Description=Leucine Rich Repeat
  Pfam annotation: Domain name=LRR_1; Domain location=65-87; Score=1.4; E_value=1.6e+02; Accession=PF00560.23; Description=Leucine Rich Repeat
  Pfam annotation: Domain name=LRR_1; Domain location=89-111; Score =20.3; E_value=0.0072; Accession=PF00560.23; Description=Leucine Rich Repeat
  Pfam module annotation: Pfam domain module=LRRNT_2::LRR_1::LRR_1::LRR_ 1; Domain location=25-61::113-135::65-87::89-111
MGYALMARVIIFTAPDLLSLYYETGDALHSLRTNLQDPNNVLQSWDPTLVNPCTWFHVTCNNDNSVIRVDLGNAVLSGQLVPQLGQLKNLQYLELYSNNISGPIPNDLGNLTNLVSLDLYLNRFSGPIPESLGKLSKLRFL

SEQ ID NO: 155056 - protein, 537 aa, Glycine max
  Coding DNA Sequence Number=SeqID_38278
  Homolog annotation: Hit_ID=Q3LHL2; Match level="QueryCoverage=98%, HitCoverage=99%, E-value=1e-117, Identity=47%"; Hit description =Hypothetical protein PPS5
  Pfam annotation: Domain name=DUF292; Domain location=23-144; Score =243.4; E_value=4.8e-70; Accession=PF03398.5; Description=Eukaryotic protein of unknown function, DUF292
MAMFDSIFNKGFKAAKCKTLLKLTIPRIKLLRNRREIQLKNMRREIAKLLETGQEATARIRVEHIIREENMMAAQEIIELFCELIAVRLPIIESQRECPLDLKEAISSVCFAAPRCADLPELLQVQMLFAAKYGKEFLSATTELRPDCGVNRQLIELLSIRAPSPEKKLNLLKEIAVEHDLDWDPEASETEFFKKHEDLLNGPTQFVSGSKLPLPDEKHNEEMHSTHDAPNKEQPDSDSGSDTLEFPEVPKVSVQPNANVATAPEMVTPLTMEPLEVDLDSPRHSGDFADAKQEQVEDRSSVHKDEPHTSICKTENKQFLPFISPPSVSSGSFSARHSDSPPSFSSTKSEGNVDLQDVLAAAHAAAETAERAAAAARSAASLAQLRINELTKKKSSEHVPDSSSSENPFYAGGSNESPTIIEKHFTEQNTAGNSDVHNGNDVEHHQDHYASPDSHSSSFPSFETLKEDFASSLPNDHRVLDDKSSSHQPKRLPSMDDDSYFSYPNLFTSQNSNVGSQAHSDNSRSPHSDNSRSPHDL

SEQ ID NO: 155057 - protein, 218 aa, Glycine max
  Coding DNA Sequence Number=SeqID_38279
  Homolog annotation: Hit_ID=Q9FNL3; Match level="QueryCoverage=71%, HitCoverage=75%, E-value=3e-21, Identity=33%"; Hit description =Arabidopsis thaliana genomic DNA, chromosome 5, P1 clone:MCL19
  Pfam annotation: Domain name=DUF679; Domain location=47-205; Score =146.1; E_value=9.4e-41; Accession=PF05078.3; Description=Protein of unknown function (DUF679)
MSNSNSTQELILHCDDQQQQQNEDDYYDLDDYDIDESYYFYVINAILSGTARLNVLLPTVTILAFSIFAPLLTDDGECNTLNRWLMGNFLALLAVSCVFFTLTDSFRSATGRLYYGVATFRGIWTFNGGKKPRVPSDYRLRWSDLFYASLSLVSFLAFAGLHQDVVKCYYPALPRKVTNTLPLVIGFFVSVLFVVFPSKRRGIGYPFLLQRDPFYSRT

SEQ ID NO: 155058 - protein, 208 aa, Glycine max
  Coding DNA Sequence Number=SeqID_38280
  Gene Ontology: Mol. function=oxidoreductase activity; Cellular component=nucleus; Biological process=electron transport
  Homolog annotation: Hit_ID=Q1T227; Match level="QueryCoverage=83%, HitCoverage=52%, E-value=2e-88, Identity=85%"; Hit description=AAA ATPase
  Pfam annotation: Domain name=AAA; Domain location=41-204; Score= -31.9; E_value=0.054; Accession=PF00004.19; Description=ATPase family associated with various cellular activities (AAA)
  Pfam annotation: Domain name=ATP_bind_1; Domain location=44-198; Score=-70.7; E_value=0.069; Accession=PF03029.7; Description =Conserved hypothetical ATP binding prot
  Pfam module annotation: Pfam domain module=AAA::ATP_bind_1; Domain location=41-204::44-198
MLCVKFEPSESYGGLDVCSLTLASGEVAVMVQENGKRKKPNILVTGTPGTGKTTMCTALAEATQLRHINVGELVKEKNLHDGWDDELDCHVLNEDLVCDELEDVMEEGGNIVDYHGCDFFPERWFDCVVVLQTDNTVLYDRLSRRGYKDSKLSNNIECEIFQVLLEEAKESYSEEKLIAMKSDNIEDISRNVATLTDWVRNWSLPSQS

SEQ ID NO: 155059 - protein, 331 aa, Glycine max
  Coding DNA Sequence Number=SeqID_38281
  Gene Ontology: Mol. function=protein dimerization activity; Cellular component=nucleus; Biological process=regulation of transcription, DNA-dependent
  Homolog annotation: Hit_ID=Q0GPF5; Match level="QueryCoverage=49%, HitCoverage=47%, E-value=5e-26, Identity=41%"; Hit description=BZIP transcription factor bZIP131
  Pfam annotation: Domain name=bZIP_2; Domain location=141-195; Score =17.0; E_value=0.014; Accession=PF07716.5; Description=Basic region leucine zipper
MDPGFAGAPPGTAVFDQILAEEPDSSLLHRNTFSGDSFSIPDTFEDVLNFDLEQFDFDILNSPPPSPTLPPTVTVDSASSVELKAQASEVGPVGPTAGLDLGGERKGKRRLRNSYTVGAYGPLVSRGKRTMNSEELAELARVDPKRVKRILCNRKSAAKSKERRVIYEKDLREKVPQLAIQSANLDAKLRFLAEDTTNRDVRLKQLRLTIDAMRQEAQIKDALSASVKEELRSLRRNKHGHVGVMSSCGSVDELTSQFSSQLALQKFHNHPSSSQKHLDLPQQTQLSMPNPLPYSTTQSFSGQYGPNNYFSNFNQQNYVFVGTYVLLFQAR

SEQ ID NO: 155060 - protein, 370 aa, Glycine max
  Coding DNA Sequence Number=SeqID_38282
  Gene Ontology: Mol. function=pyridoxal phosphate binding; Biological process=carboxylic acid metabolic process
  Homolog annotation: Hit_ID=Q1SBV6; Match level="QueryCoverage=92%, HitCoverage=88%, E-value=1e-143, Identity=62%"; Hit description =Probable histidine decarboxylase [imported]-Arabidopsis thaliana
  Pfam annotation: Domain name=Pyridoxal_deC; Domain location=2-296; Score=-27.2; E_value=1.7e-12; Accession=PF00282.9; Description =Pyridoxal-dependent decarboxylase con
MEKNMAIAFMGAKLTTRSEKYENDNSHTNLAITQCSGETQANLASLGSSFSLNSTTFEVCVLNWFTNLWEIKKNEYWGYVTTGGTEGNLHGILVGREQLPDGILYTSQDSHYSIFKIARMYRMKCMKVSTLTSGEIDCVNLKDLVLTHKDKPAIINLNIGTTMKGAIDDLDLVIQTLEECGFTRDRFYIHCDGALFGMMLPFVKQAPRITFKKPIGSVTVSGHKFLGCPIPCGIAITRLEYINALSKNVEIIASRDATITVQKCIMKARYLQNRLRDAQISTMLNKFSDIVIFERPLDDDFIRRWNLACNGNIAHVVVMQHITIEMLDSFGGEFRKKRSFWFEDGQLQPLCIANDIGSRNCVCSMHRSLS

SEQ ID NO: 155061 - protein, 122 aa, Glycine max
  Coding DNA Sequence Number=SeqID_38283
  Gene Ontology: Mol. function=protein serine/threonine kinase activity; Biological process=protein amino acid phosphorylation
  Homolog annotation: Hit_ID=Q851M7; Match level="QueryCoverage=99%, HitCoverage=19%, E-value=1e-15, Identity=32%"; Hit description =Putative receptor-like protein kinase
  Pfam annotation: Domain name=PAN_2; Domain location=60-109; Score= -17.5; E_value=0.087; Accession=PF08276.2; Description=PAN-like domain
MQKNDVLRVLKLDGDANLRIYSSSYKGSGTSIIRWAAVKDHNTRTQNFEKIDPNNSRKGCRMKINPEVLYTPMSACREICLSAGSCFASTSLSDGSRFCYVKTKDIFGGYQSPALTSTTYVK

SEQ ID NO: 155062 - protein, 836 aa, Glycine max
  Coding DNA Sequence Number=SeqID_38284
  Gene Ontology: Mol. function=protein serine/threonine kinase activity; Cellular component=cell surface; Biological process =protein amino acid phosphorylation
  Homolog annotation: Hit_ID=Q851M7; Match level="QueryCoverage=89%, HitCoverage=87%, E-value=0.0, Identity=61%"; Hit description =Putative receptor-like protein kinase
  Pfam annotation: Domain name=B_lectin; Domain location=70-167; Score =56.6; E_value=8e-14; Accession=PF01453.15; Description=D-mannose binding lectin
  Pfam annotation: Domain name=PAN_2; Domain location=319-386; Score= -7.4; E_value=0.0078; Accession=PF08276.2; Description=PAN-like domain
  Pfam annotation: Domain name=Pkinase; Domain location=488-760; Score =181.1; E_value=2.7e-51; Accession=PF00069.15; Description=Protein kinase domain
  Pfam annotation: Domain name=Pkinase_Tyr; Domain location=488-760; Score=119.8; E_value=8e-33; Accession=PF07714.7; Description=Protein tyrosine kinase
  Pfam annotation: Domain name=S_locus_glycop; Domain location=171-300; Score=-9.8; E_value=0.00019; Accession=PF00954.11; Description=S -locus glycoprotein family
  Pfam module annotation: Pfam domain module=B_lectin::PAN _2::Pkinase::Pkinase_Tyr::S_locus_glycop; Domain location=70-167::319- 386::488-760::488-760::171-300
  Subcellular localization annotation: CTP_CleavageSite=74; ConfidenceScore=5.63e-01
MFLKTQFLFLTLALATTTVTTAIDPGSTLAASSSNQTWSSPSGTFSLRFISVQPPTTPPSFIAAIVFSGGAPVVWSAGNGAAVDSAGSLQFLRSGHLRLFNGSGATVWDTGTAGASSATLEDSGNLVISNSTGSLWSSFDHPTDTLVPSQNFTVGKVLNSESYSFGLSSIGNLTLKWNNSIVYWTQGLNSSVNVSLDSPSLGLLSIGLLQLSDANLSPSIDVAYSSDYAEGNSDVMRVLKLDSDGNLRIYSTAKGSGVATARWAAVLDQCEVYAYCGNYGVCSYNDSTPVCGCPSENFEMVDPNDSRKGCRRKASLNSCQGSATMLTLDHAVILSYPPEAASQSFFSGISACRGNCLSGSRACFASTSLSDGTGQCVMRSEDFVSAYHNPSLPSTSYVKVCPPLEPNPPPSMGGVREKRSRVPAWVVVVVVLGTLLGLIALEGGLWMWCCRNSTRFGGLSAHYALLEYASGAPVQFSHKELQQATKGFKEKLGAGGFGTVYRGTLVNKTVIAVKQLEGIEQGEKQFRMEVATISSTHHLNLVRLIGFCSEGRHRLLVYEFMKNGSLDNFLFLTELHSGNFLNWEYRYNIALGTARGITYLHEECRDCIVHCDIKPENILLDENYVAKVSDFGLAKLINPKDHRHRTLTSVRGTRGYLAPEWLANLPITSKSDVYSYGMVLLEIVSGRRNFDVSEDTNRKKFSIWAYEEFEKGNISGILDKRLAEQEVEMEQVRRAIQASFWCIQEQPSQRPTMSRVLQMLEGVTELERPPAPKSVMEGAVSGTSTYFSSNASAFSTVGVSPAGPSSSSSFQTSVVSTFTLGRNPEKATSSLLQSDT

SEQ ID NO: 155063 - protein, 223 aa, Glycine max
  Coding DNA Sequence Number=SeqID_38285
  Gene Ontology: Mol. function=protein serine/threonine kinase activity; Biological process=protein amino acid phosphorylation
  Homolog annotation: Hit_ID=Q851M7; Match level="QueryCoverage=37%, HitCoverage=9%, E-value=2e-24, Identity=60%"; Hit description =Putative receptor-like protein kinase
  Pfam annotation: Domain name=Pkinase_Tyr; Domain location=42-172; Score=-171.9; E_value=0.064; Accession=PF07714.7; Description =Protein tyrosine kinase
MVVDLWCCRNIPRFGGLYGQYDLVEYASGAPIQFSYKELKGLTNGFNEKLGAGSFGSIYRGMLGNGTIVVIKQIQGIELEEKQFKLEIATKFYLGTIFIRCGTSTCPITTLQGGINYHDFEAKLSYFNLVKLITPKDDRYQTVLNMRGTKGFWCIQEQPSQRTAISKVLHMLEGVTKIKKPPAPKSMNGGSFSGNEEWLRKNVSALSTVSTPTPTCSSSSFHY

SEQ ID NO: 155064 - protein, 208 aa, Glycine max
  Coding DNA Sequence Number=SeqID_38286
  Gene Ontology: Mol. function=drug transporter activity; Cellular component=membrane; Biological process=multidrug transport
  Homolog annotation: Hit_ID=Q851N6; Match level="QueryCoverage=75%, HitCoverage=30%, E-value=4e-42, Identity=54%"; Hit description =Putative MATE efflux membrane protein
  Pfam annotation: Domain name=MatE; Domain location=33-194; Score =106.0; E_value=1.1e-28; Accession=PF01554.9; Description=MatE
MGDNKDRDFFSHKFPTTSQVMEEMKELWGMALPITAMNMLVFVRAVVSVLFLGRLGSLELAGGALSIGFTNITGYSVLVGLAAGLEPVCSQAYGSKNWDLLSLSLQRMVLILLMAIVPISLLWLNLERIMLFMGQDSAITGMASLYCFYSLPDLLTNTLLQPLRVFLRSQKVTKPMMKREVVVKWGCWGVGGGVVCSALGQLMRFCCA

SEQ ID NO: 155065 - protein, 101 aa, Glycine max
  Coding DNA Sequence Number=SeqID_38287
  Gene Ontology: Mol. function=nucleic acid binding
MKEPGTITTEDDGKKGNEGGFGSNPKTSRSDKQIPTPYALTLNDNLGNIITQVQLKGENYDEWARAMCTALRAKKKYGFVDGSIKQPGDDSPELEDWWTVN

SEQ ID NO: 155066 - protein, 870 aa, Glycine max
  Coding DNA Sequence Number=SeqID_38288
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=81%, E-value=0.0, Identity=49%"; Hit description=Zinc finger, CCHC-type; Peptidase aspartic, catalytic; Polynucleotidyl transferase, Ribonuclease H fold
  Pfam annotation: Domain name=rve; Domain location=233-394; Score =146.0; E_value=9.9e-41; Accession=PF00665.16; Description=Integrase core domain
  Pfam module annotation: Pfam domain module=RVT_2::rve; Domain location=601-832::233-394
MENVKDLWEDIKQRFSIGNGPRVQQLRSNLANCKQEGTSEKYDEDGYGTIRSNILSTKPLPNLNRVYAMVVQQERVRTMTQTKEERGNPMSFAVQNGGATGHAQSQVDAVVDVDMGSSRELVKDKGAKGLLVPMQFKRQELVDHTSRMMIGAGEQLGGLYFLIEVAPARVYKTTRIASSELWHKRMGHPSSRIVDLISEIGNVGRSDSVKNKFCDICFRAKQTKEEFISSNNKVAECFSLIHCDLWGAYRVPASCGAVYFLTIVDDYSRELWIYLLNRKDEVACALKNFIVMVKRKFEKDMKVVRSDNGTEFMCLKDYFAEQGILHQTSCVGTPQQNRHVERKHRHILNVTRALRFQAHLPIEFWGEYVLIAGYLINKTPSVILDGRTPYEMLYEQAPTYKHIQTFGCLCYAHAQNRDKDKFASQSRKCIFIGYPFGKKGWRLYDFENGEYFVSRDVVFIETKFPYSTNIASSFVTKNGVTNYFADNEDSYVQNEMEEQQAPTSGVEHEVNVEIGNDVEVPSNVNTGVVERRGTNIEGPMVLEELLGRGKRVKQPSVRLKDFVTHTIRIIPSAGSSFQSKSSGYEPNTYVEAVKDECWREAMRKEVQALQDNGTWTIEDLPLGKKAIGSKWVYKIKYNSDGSIERCKARLVILGNKQVEGIDYNETFSPTTKMVTVQTFLAFVAARRWELHQMDVHNAFLHDELDEEVYMKFPPGFSSPTPAALNRYGFQQSYSDYSLFTYKDQHVQLHVFVYVDDLIISGNNGVAVQRFKDYLSQCFHMKDLGKLKYFLGIEVARNLEGIFLCQRKYALDIISETRLLGAKPFMQQPKEEHWEAALRVVRYLKGNLGQGILLRADCDLKLYAYCDFDWA

SEQ ID NO: 155067 - protein, 119 aa, Glycine max
  Coding DNA Sequence Number=SeqID_38289
MSGDKPRKALKFNTQGYVRVEVALEVGGTTLQREASFLGTCFDDGQGGFSSMALEAAAYCLKCIACRGDGELAVEIGGDGATHSLMRLLPHSDGRMQKDSCCHQWWGGNHRWFVEFLHR

SEQ ID NO: 155068 - protein, 37 aa, Glycine max
  Coding DNA Sequence Number=SeqID_38290
MTSIAYYKLKMHEGFQYYITDGIYSDWTTFVKIILMP

SEQ ID NO: 155069 - protein, 71 aa, Glycine max
  Coding DNA Sequence Number=SeqID_38291
  Gene Ontology: Mol. function=RNA-directed DNA polymerase activity; Cellular component=mitochondrion; Biological process=DNA integration
  Homolog annotation: Hit_ID=Q1T6H9; Match level="QueryCoverage=97%, HitCoverage=15%, E-value=1e-25, Identity=76%"; Hit description =Stomatin
SSPISWKTKKQQTVSRSSAEAEYRSMATTTCELKWLKGLLSTLGVMHSGPALLHCDSQAALHIAANPVFHE

SEQ ID NO: 155070 - protein, 110 aa, Glycine max
  Coding DNA Sequence Number=SeqID_38292
  Subcellular localization annotation: CTP_CleavageSite=53; ConfidenceScore=5.31e-01
MREKNRTSCCLLSLAFSSSKCSTQTTDSRFLMSLAFLMSPDGRILIFPKGLPKGSTFESFLWWGCPNCKSLCVAESKWNSERVLKVRAVTGGEGSEAMVLKLVKGLDRKS

SEQ ID NO: 155071 - protein, 294 aa, Glycine max
  Coding DNA Sequence Number=SeqID_38293
  Gene Ontology: Mol. function=DNA binding; Cellular component=nucleus; Biological process=regulation of transcription, DNA-dependent
  Homolog annotation: Hit_ID=Q9SLT2; Match level="QueryCoverage=99%, HitCoverage=99%, E-value=2e-67, Identity=49%"; Hit description=Myb -related transcription factor LBM1
  Pfam annotation: Domain name=Myb_DNA-binding; Domain location=14-61; Score=49.5; E_value=1.1e-11; Accession=PF00249.21; Description=Myb -like DNA-binding domain
  Pfam annotation: Domain name=Myb_DNA-binding; Domain location=67-112; Score=39.7; E_value=1e-08; Accession=PF00249.21; Description=Myb-like DNA-binding domain
  Pfam module annotation: Pfam domain module=Myb_DNA-binding::Myb_DNA -binding; Domain location=14-61::67-112
MGRAPCCEKMGLKRGPWTPEEDQILINYINTYDHANWRALPKLAGLLRCGKSCRLRWINYLRPDIKRGNFTREEEDTIISLHEMLGNRWSAIAARLPGRTDNEIKNVWHTHLKKRLPQNYKQSHDQKKRSKKQPKLDVDASKSNQDAKLEQQQEPVNNNFPFHASNSEDMMPLSPPQCSSHMSSSSLTTSDNNGSINNNHDMSLNVNDDIDTPENNLALDEDFWSEVLSSDNSGETTSGFPTIDYDHQFLPMSPLMTEEGVLIDASSSSVCDDGMDFWCNVYARAEEFTQLLEL

SEQ ID NO: 155072 - protein, 70 aa, Glycine max
  Coding DNA Sequence Number=SeqID_38294
MASTASPLLWKQHLHRCGEVTNDVIQSYAQAMPSPNPKIETLLVQAGFSNVAKLRQVKIDDTLVIILVER

SEQ ID NO: 155073 - protein, 75 aa, Glycine max
  Coding DNA Sequence Number=SeqID_38295
MQCEVKIVWGKSNVGTHPFSGTKDRIPDRLLNVISAISVTLLAQRTKLYRIPDGSSIVVNAISTTPFSGTEDKIL

SEQ ID NO: 155074 - protein, 109 aa, Glycine max
  Coding DNA Sequence Number=SeqID_38296
  Subcellular localization annotation: CTP_CleavageSite=39; ConfidenceScore=5.27e-01
MENNPWELLNIDNSNLPSFVCPTNHSSSSSTRHIPGPARAVQAATMNQQSRECNERQRRRDERRRHPLGNKPWKKELHHQDEPWIRSLERMLQWRKRKRERKREGGARN

SEQ ID NO: 155075 - protein, 199 aa, Glycine max
  Coding DNA Sequence Number=SeqID_38297
  Gene Ontology: Mol. function=nutrient reservoir activity
  Homolog annotation: Hit_ID=Q3HW60; Match level="QueryCoverage=95%, HitCoverage=46%, E-value=2e-45, Identity=86%"; Hit description =Glycinin subunit G7
MLQSYLPGNPKEEHPGSGGCKQEEGNNRNMFGGFDPRFLAEASNVKKKNPRPEKKEEVVEEKEIRKRKHLKGEHEGCGECEEKTRTHYYLRREWHEHKGQQDGKEESRERYKERGEGSNVLEESLCTLKLHENIADPSHADIFNPRAGRLRAINSLTLPVLKLLRLSAQLVKLYKSDIYVPHWSMNANSVASVTHMTNR

SEQ ID NO: 155076 - protein, 106 aa, Glycine max
  Coding DNA Sequence Number=SeqID_38298
  Gene Ontology: Mol. function=ribonuclease H activity
  Homolog annotation: Hit_ID=Q1S4N4; Match level="QueryCoverage=57%, HitCoverage=17%, E-value=5e-13, Identity=54%"; Hit description =Ribonuclease H
  Subcellular localization annotation: CTP_CleavageSite=47; ConfidenceScore=5.28e-01
MGFANSNSKKNLSSLQTSTCRRRFSKNWKLTITSNGFAVFKEHFKPIALVKWEPPPLNVIKINIDGSSFGNPDSSGFGGLLRDALGNWLLRYLGSCGFSTNTTAEL

SEQ ID NO: 155077 - protein, 42 aa, Glycine max
  Coding DNA Sequence Number=SeqID_38299
  Gene Ontology: Mol. function=transferase activity, transferring hexosyl groups; Biological process=metabolic process
  Homolog annotation: Hit_ID=Q1RXI8; Match level="QueryCoverage=97%, HitCoverage=9%, E-value=1e-12, Identity=81%"; Hit description=UDP -glucuronosyl/UDP-glucosyltransferase
IQAIQGTPCFPSKDWNLKIPSGSMEFDLKMMGEAQWGKEKGT

SEQ ID NO: 155078 - protein, 485 aa, Glycine max
  Coding DNA Sequence Number=SeqID_38300
  Homolog annotation: Hit_ID=Q67YL8; Match level="QueryCoverage=99%, HitCoverage=93%, E-value=3e-09, Identity=21%"; Hit description=MRNA, complete cds, clone: RAFL24-22-E06
  Pfam annotation: Domain name=TolA; Domain location=11-350; Score= -151.5; E_value=0.062; Accession=PF06519.2; Description=TolA protein
MFRSSQQRNSRCKDFKVKHALQICVLLGVCIWMAYLVQHSREKKRSYGEGTNADSEVVKLGRKDPDPNVEQSSSILHARDKEEKDEEENNHEKQKKTDDVNRVENEIQTQKNEQNNNEEKSEQRKDPVDQDTEENEHKANKESDSVIKENEDNKNKVEEDNQSRGISEEKNETKKEETDKEEDEEINQNRTEARERMEEDHKQEDEEESNATDNEREENDHIQEVDSPEDRVRDQNSERNNEEAKEEYYASSEGLNKTKQSDKRENNEFELESQTNGTEVAHVHENERVLNVTQRKATQVTNSVVTNITNQGNGSENQAEKKNDSQKSSIAESDKQEREPNKPSSDDVEALHSQNGTDTTEKQLETPENSKVEDSILHNSTLTMKDLKSDAAVEQVDSILTNSSGAHERNVTNGEYNGKANANGNSHDGSGSASDSSIVEGKDASSRNNGDAGQVENENIDTSKNEDRAQNEPVESSIKKEESAH

SEQ ID NO: 155079 - protein, 504 aa, Glycine max
  Coding DNA Sequence Number=SeqID_38301
  Gene Ontology: Mol. function=cysteine desulfurase activity; Cellular component=mitochondrion; Biological process=metabolic process
  Homolog annotation: Hit_ID=O49543; Match level="QueryCoverage=89%, HitCoverage=98%, E-value=0.0, Identity=76%"; Hit description =Cysteine desulfurase 1, mitochondrial precursor
  Pfam annotation: Domain name=Aminotran_5; Domain location=59-422; Score=422.5; E_value=5.9e-124; Accession=PF00266.9; Description =Aminotransferase class-V
  Pfam annotation: Domain name=Beta_elim_lyase; Domain location=96-347; Score=-90.5; E_value=0.00012; Accession=PF01212.11; Description=Beta -eliminating lyase
  Pfam annotation: Domain name=DegT_DnrJ_EryC1; Domain location=96-428; Score=-210.8; E_value=0.078; Accession=PF01041.8; Description =DegTDnrJEryC1StrS aminotransferase family
  Pfam annotation: Domain name=Pyridoxal_deC; Domain location=58-346; Score=-182.9; E_value=0.025; Accession=PF00282.9; Description =Pyridoxal-dependent decarboxylase con
  Pfam module annotation: Pfam domain module=Aminotran_5::Beta_elim _lyase::DegT_DnrJ_EryC1::Pyridoxal_deC; Domain location=59-422::96 -347::96-428::58-346
  Subcellular localization annotation: CTP_CleavageSite=28; ConfidenceScore=5.17e-01
MTSKLIASNLRHQITKSAQNLRRQLLSTAAAVAVPEHDGNNSNSSGMTMKGVRISGRPLYLDVQATSPVDPRVLDAMLPFYLSRYGNPHSRTHFYGWESDEAVEHARAQVASLIGASPKEIVFTSGATESNNISVKGVMHFYKDKKRHVITTQTEHKCVLDSCRHLQQEGFDVTYLPVESDGLIDLDELRASIRPDTGLVSVMAVNNEIGVVQPMEEIGRICKEFNVPFHTDAAQALGKIPIDVERWNVSLMSLSGHKIYGPKGVGALYMRRRPRIRVEPQMNGGGQERGIRSGTVPTPLVVGMGAACEVAKDEMEYDEKRISALQQRLLNGIREKLDGVVVNGSLERRYVGNLNLSFAYVEGESLLMGLKEVAVSSGSACTSASLEPSYVLRALGVEEDMAHTSIRFGIGRFTTEAEIDRAVELTVQQVEKLREMSPLYEMVKEAMFMKKKDMHWQFGTVWTNKCWNGGFKFCSISVLDQGEGDLAQASFTMSSFALEIATSY

SEQ ID NO: 155080 - protein, 385 aa, Glycine max
  Coding DNA Sequence Number=SeqID_38302
  Gene Ontology: Mol. function=L-lactate dehydrogenase activity; Cellular component=glyoxysome; Biological process=tricarboxylic acid cycle intermediate metabolic process
  Homolog annotation: Hit_ID=P37228; Match level="QueryCoverage=99%, HitCoverage=100%, E-value=0.0, Identity=87%"; Hit description=Malate dehydrogenase, glyoxysomal precursor
  Pfam annotation: Domain name=Ldh_1_C; Domain location=187-351; Score =230.2; E_value=4.5e-66; Accession=PF02866.8; Description =lactatemalate dehydrogenase, alphabe
  Pfam annotation: Domain name=Ldh_1_N; Domain location=42-185; Score =247.8; E_value=2.3e-71; Accession=PF00056.13; Description =lactatemalate dehydrogenase, NAD bind
  Pfam module annotation: Pfam domain module=Ldh_1_C::Ldh_1_N; Domain location=187-351::42-185
MEANSGASDRISRIAGHLRPQREDDVCLKRSDCRAKGGVSGFKVAILGAAGGIGQPLAMLMKMNPLVSLLHLYDVVNTPGVTSDISHMDTGAVVRGFLGQQQLEDALIGMDLVIIPAGVPRKPGMTRDDLFNINAGIVKTLCEAIAKCCPKAIVNVISNPVNSTVPIAAEVFKRAGTYDPKRLLGVTMLDVVRANTFVAEVLGVDPRDVDVPVVGGHAGITILPLLSQIKPPCSFTPKEIEYLTGRIQNGGTEVVEAKAGAGSATLSMAYAAVKFADACLHALRGDAGIIECAYVASQVTELPFFASKVRLGRVGVEEILPLGPLNDYERYAVITCISTSEFPMHIGETETLEFIYCFYFNRESLEKAKKELAASIEKGISFIRK

SEQ ID NO: 155081 - protein, 811 aa, Glycine max
  Coding DNA Sequence Number=SeqID_38303
  Gene Ontology: Mol. function=protein serine/threonine kinase activity; Cellular component=integral to membrane; Biological process=protein amino acid phosphorylation
  Homolog annotation: Hit_ID=O49544; Match level="QueryCoverage=96%, HitCoverage=97%, E-value=1e-177, Identity=41%"; Hit description =Receptor protein kinase - like protein
  Pfam annotation: Domain name=LRRNT_2; Domain location=28-70; Score =39.1; E_value=1.5e-08; Accession=PF08263.3; Description=Leucine rich repeat N-terminal domain
  Pfam annotation: Domain name=LRR_1; Domain location=124-145; Score =10.4; E_value=3.3; Accession=PF00560.23; Description=Leucine Rich Repeat
  Pfam annotation: Domain name=LRR_1; Domain location=148-168; Score =16.7; E_value=0.085; Accession=PF00560.23; Description=Leucine Rich Repeat
  Pfam annotation: Domain name=LRR_1; Domain location=170-193; Score =12.4; E_value=1.3; Accession=PF00560.23; Description=Leucine Rich Repeat
  Pfam annotation: Domain name=LRR_1; Domain location=195-217; Score =11.1; E_value=2.4; Accession=PF00560.23; Description=Leucine Rich Repeat
  Pfam annotation: Domain name=LRR_1; Domain location=219-241; Score =14.4; E_value=0.41; Accession=PF00560.23; Description=Leucine Rich Repeat
  Pfam annotation: Domain name=LRR_1; Domain location=258-281; Score =9.4; E_value=4.9; Accession=PF00560.23; Description=Leucine Rich Repeat
  Pfam annotation: Domain name=LRR_1; Domain location=336-358; Score =11.6; E_value=1.9; Accession=PF00560.23; Description=Leucine Rich Repeat
  Pfam annotation: Domain name=LRR_1; Domain location=360-382; Score =6.8; E_value=15; Accession=PF00560.23; Description=Leucine Rich Repeat
  Pfam annotation: Domain name=LRR_1; Domain location=384-410; Score =13.0; E_value=1; Accession=PF00560.23; Description=Leucine Rich Repeat
  Pfam annotation: Domain name=LRR_1; Domain location=411-433; Score =3.5; E_value=62; Accession=PF00560.23; Description=Leucine Rich Repeat
  Pfam annotation: Domain name=LRR_1; Domain location=75-97; Score=3.9; E_value=54; Accession=PF00560.23; Description=Leucine Rich Repeat
  Pfam annotation: Domain name=LRR_1; Domain location=99-122; Score =3.5; E_value=64; Accession=PF00560.23; Description=Leucine Rich Repeat
  Pfam annotation: Domain name=Pkinase; Domain location=520-805; Score =122.3; E_value=1.4e-33; Accession=PF00069.15; Description=Protein kinase domain
  Pfam annotation: Domain name=Pkinase_Tyr; Domain location=520-805; Score=63.9; E_value=2.2e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR _1::Pkinase::Pkinase_Tyr; Domain location=28-70::124-145::148 -168::170-193::195-217::...
  Pfam module annotation: Domain location=219-241::258-281::336 -358::360-382::384-410::411-433::75-97::99-122::520-805::520-805
MRRQPLFLFLLLSCLLSSSTGLSQVLSLETETQILLRVKNTQLEDKNKSLKNWVPNTDLNPSSWTGITCDSRIHSLVSIDLSETGVYDEFPFGFCRIHTLQSLFVASNFLTNSISLNSLLLCSHLRLLNLSDNYFVGVLPEFPPEFTELRELDLSKNNFTGDIPASNLSELTHLELAYNPFKPGPLPSQLGNLSNLETLFLVDVNLVGEIPHSIGNLTSLKNFYLSQNSLSGNIPNSISDLSQNALTGKLPDTIASLHLSSLNLNDNFLRGEIPETSTNDLVGELPKYLCQGNKLEHLITFVNRFSGTLPQQYGECVSGNVHQQVPRPVSGSISRGLTKLILSGNSFSDNFPIEICELQNLLEIDVSKNRFTGQVPTCVTRLIKLQKLRLQDNMFTGEVPREIPVKLTNLRLNQFNVSGNKLHGVVPLGFNRQVYLSGLMGNPDLCSPVMKTLPSCSKRRPFSLLAIVVLVCCVSLLVGSTLWFLKNKTRGYGCKSKKSSYMSTAFQRVGFNEEDMVPNLTGNNVIGTGSSGRVYRVRLKTGQTVAVKKLFGGAQKPDMEMVFRAEIESLGMIRHANIVKLLFSCSVEEFRILVYEYMENGSLGDVLHVAIAVGAAQGLAYLHHDSVPAIVHRDVKSNNILLDREFVPRVADFGLAKTLQREATQGAMSRVAGSYGYIAPGNVYLIDSISEYAYTVKVTEKSDVYSFGMVLMELITGKRPNDFPFGENKDIVKWITETVLSPSPERGSGNIGIGKDYIMSQIVDPRLNPVTCDYEEIERVLYVALLCTSAFPINRPSMRRVVELLKDHKLS

SEQ ID NO: 155082 - protein, 304 aa, Glycine max
  Coding DNA Sequence Number=SeqID_38304
MATGTVDNKAAKSKPPRPKRICFSFAAYAGDLLNCLKASKVAIDEGLSDAELSNIESKLKFSFPPDLRAILQQGLPVSQGFPNWRSSSTQQLQILLNLPASSILRRVSSTRFWHPSWGPEPSDPTRVIARLLHDAPPLVPIYRHCYIPSSPGAAGNPVFHVDNDGDVRLLSFDVAGFFREFLAPGTEEPVWAATAARRVRFWSEVADAQGGELGGCLERVVWKLREGGWTEEEIREMMTVEEKKKNKLKLKDKEALEWHVRALSLVLLRGGWSREDVVYSLGLVADQGKSWLEFHQDQHNLNIN

SEQ ID NO: 155083 - protein, 366 aa, Glycine max
  Coding DNA Sequence Number=SeqID_38305
MEDKKKDQERGFVCNQESQTNYEPQNNLQNGQPNVSVGPIAKISSPPPSRDNTPYSNQQQQPPIVPWPYTPQNATMHFPTQASPPGALNQWPQFAYSQLFAQSASPFWQPQPPGANAPKFFQPFTDTGFRGGPSSTIQTPLPNMCYNYTFPGFPNSWNPSSYMAQLYQMQHPYVFSFPGAPNFSSATPKVPDCLASGEHSSQKGIMRPPSKLSQKHQQLWEAQSAENVKLWSVINKLQAEVSDHKDRLKKLEEEVSSFKKEAEVLTNKVIGTIPILTEQPTKRGRAKRSLALVDASYESHLPAGGKKPALSNSLYQSKSPFGAVKSSIFEKVILKKVENKEITTRSNTKMVQHESNVKDGELQHPD

SEQ ID NO: 155084 - protein, 222 aa, Glycine max
  Coding DNA Sequence Number=SeqID_38306
  Gene Ontology: Cellular component=endoplasmic reticulum; Biological process=nitrogen fixation
  Homolog annotation: Hit_ID=Q9M2C0; Match level="QueryCoverage=92%, HitCoverage=97%, E-value=4e-61, Identity=60%"; Hit description =Nodulin-like protein
  Pfam annotation: Domain name=DUF125; Domain location=41-216; Score =229.2; E_value=9e-66; Accession=PF01988.9; Description=Integral membrane protein DUF125
MALDHSSVNQPKFVHPNNDLEQQEALEVETKDFDYSKRSQWLRAAVLGANDGLVSTASLMMGVGAVKQDIKVMILTGFAGLVAGACSMAIGEFVSVYSQLDIEVAQMKREKERDSIDQDQEDDDGDEKEKLPNPMHAAAASALAFSVGAMVPLLAASFIRDYKVRLGVVLGAVSLALVVFGWLGAVLGKAPTFRSIVRVLLGGWLAMAITFGLTKLIGSSGL

SEQ ID NO: 155085 - protein, 282 aa, Glycine max
  Coding DNA Sequence Number=SeqID_38307
  Gene Ontology: Mol. function=drug transporter activity; Cellular component=membrane; Biological process=multidrug transport
  Homolog annotation: Hit_ID=Q851N6; Match level="QueryCoverage=86%, HitCoverage=42%, E-value=1e-80, Identity=60%"; Hit description =Putative MATE efflux membrane protein
  Pfam annotation: Domain name=MatE; Domain location=6-197; Score=97.4; E_value=4.3e-26; Accession=PF01554.9; Description=MatE
MGFAVPSCLMICLEWWWYEIVTVLAGYLPRPTLAVAATGILIQTTSMMYTVPMALAGCVSARTILHFVFIDTPPKPRERYLVKFLHAHPNVGNELGAGKPYKAKLAAVVALGCAFVIGFINVTWTVILGQRWAGLFTNDEPVKALVASVMPIMGLCELGNCPQTTGCGILRGMARPGIGAHINLGSFYFVGTPVAVGLAFWFKVGFSGLWFGLLSAQVACAVSILYVVLVRTDWEAEALKAEKLTRIEMGSCNGLRNKENERDEERKGLLVNGNGNNKDDIC

SEQ ID NO: 155086 - protein, 413 aa, Glycine max
  Coding DNA Sequence Number=SeqID_38308
  Gene Ontology: Mol. function=catalytic activity; Biological process =protein amino acid phosphorylation
  Homolog annotation: Hit_ID=Q5Z6N6; Match level="QueryCoverage=95%, HitCoverage=89%, E-value=1e-97, Identity=47%"; Hit description =Tyrosine-specific protein phosphatase-like protein
  Pfam annotation: Domain name=DUF860; Domain location=25-343; Score =431.8; E_value=9e-127; Accession=PF05898.4; Description=Plant specific of unknown function (DUF860)
MGVVEGRGLEMRQWLFLRRFSLWSMKKEPDLESALSRNRRWIVNNQIKNIILRYPNNEIPIHTLQNKFKTLDLQGKALNWLSKYPCCFQIHDNRCRLTKRMMNLVAEEQSLLDSLEPLFARILAKLLMLSLTKRLTVLKINEFKRSFGFPDDYILRIVPKYPNLFRIVNESGRRSSMAVELLHWDPDLAVSTIEASAKKLGTPPRFSCSLPSSWVKSWERFHEFESIPYFSPYSESRGLVEGSKEMEKRNVGLVHELLSLTLWKKFSIVKLGHFRREFVLPDKLNVLLLKHPGIFYVSNKYQIYTVLLREAYVGSQLVDKDPLVIVKDKFGELMQEGLHEYNQRRCQLNVEKRRKKGVPLVSVDDGARGRRRSRQVVDDDDDGGGGGDGKVGRLFDPEERKRFYRVLFDDDAS

SEQ ID NO: 155087 - protein, 138 aa, Glycine max
  Coding DNA Sequence Number=SeqID_38309
SFLCNGLAASNTARGNHRWLVAVEEEIGGVGGLATSNHNSWQSPMVGGGGGGGWGCWVRVNVMFNAEIDGSKNLGELASGDYLAFGALIWHRELSGLTLLLLMGFETILFGVGSLEINIRCTEPLSKEDEDDPSKDPP

SEQ ID NO: 155088 - protein, 285 aa, Glycine max
  Coding DNA Sequence Number=SeqID_38310
  Homolog annotation: Hit_ID=Q1SKD7; Match level="QueryCoverage=61%, HitCoverage=45%, E-value=1e-13, Identity=26%"; Hit description =Ankyrin
MAPKKLPAKRSKKDTTGEGSSTASQADMDFNRHQFWSAKHQQHFETIKGWSFVRERWVQLSNDEFSDFQEEIARRHWAPLVTPMAKFDLEILMEFYANAWPTEEGVEDMRSWVRGQWIPFDANALSLYLGHPLVLAEGQQCEYNQRRRQVSSFDEEAIAQLLCIPGQDFTQTIVGRWVSVHVAQLISDAIYPFAGTAPMRHPMDSEKSNRALGFPALITGLYQFYRVPVAPSKVIWSPITRAFIEKYYTPSRRRARHHSSLETASRRQPMHHHHPRSPPQLTYGG

SEQ ID NO: 155089 - protein, 75 aa, Glycine max
  Coding DNA Sequence Number=SeqID_38311
  Homolog annotation: Hit_ID=Q7EYF8; Match level="QueryCoverage=71%, HitCoverage=5%, E-value=8e-11, Identity=64%"; Hit description =Putative phytosulfokine receptor
MCGTTLIVQDKKLHQHGPLWLKIAIDVARHLSYVHFDHAGPRGNLKPANMLLDTDDLNARVGLLHRFMTQARTIY

SEQ ID NO: 155090 - protein, 349 aa, Glycine max
  Coding DNA Sequence Number=SeqID_38312
  Gene Ontology: Mol. function=transcription regulator activity; Cellular component=nucleus; Biological process=regulation of transcription
  Homolog annotation: Hit_ID=O81348; Match level="QueryCoverage=62%, HitCoverage=65%, E-value=1e-46, Identity=49%"; Hit description =Symbiotic ammonium transporter
  Pfam annotation: Domain name=HLH; Domain location=176-225; Score =47.9; E_value=3.5e-11; Accession=PF00010.16; Description=Helix-loop -helix DNA-binding domain
MMEIANHYYLPELGIEDPTLFDQYPMDSFACPLDDFDFESFSGSPESNSSYQFNSESTPNCFPAESPDQSFVPARPTKRLKTFNTSNTCASDIISHKVSASSSSQVISFDHFNAPSDASSLQFHRNLDFDVKPKIEKASSGNMDFAAFVSHGSYVDKTFLSSDTNQVGITSRNPIQAQEHVIAERKRREKLSQRFIALSAILPGLKKMDKASVLGDAIKYVKQLQERVQTLEEQAAKRTAGSRVLVKRSILFADDENSDSHCEHSLPEIEVRVSGKDVLIRTQCDKHSGHAAMILSELEKLHFIVQSSSFLPFGNNNTDVTIIAQMNKENCMTAKDLLGRLRQALKQFI

SEQ ID NO: 155091 - protein, 174 aa, Glycine max
  Coding DNA Sequence Number=SeqID_38313
  Homolog annotation: Hit_ID=Q38IW9; Match level="QueryCoverage=32%, HitCoverage=11%, E-value=3e-10, Identity=62%"; Hit description =Ornithine aminotransferase
MSCFFEFQENMCEPKEKTYSIVLFMSSRFKPDSKLSFKYLSALFATTKCNTLRLFINVESKLAAYILGKASGGGVIPISAVLADKDVMLCIQPGQHGRFFKTGGPNVSIKMEGSKLRIEQNRGTKTAFKPLFYFGLGMLLLFKLIGSWDKIRLLHLQKLSVNRTIYISKRETID

SEQ ID NO: 155092 - protein, 288 aa, Glycine max
  Coding DNA Sequence Number=SeqID_38314
  Gene Ontology: Mol. function=transcription regulator activity; Cellular component=nucleus; Biological process=regulation of transcription
  Homolog annotation: Hit_ID=O81348; Match level="QueryCoverage=59%, HitCoverage=51%, E-value=2e-29, Identity=44%"; Hit description =Symbiotic ammonium transporter
  Pfam annotation: Domain name=HLH; Domain location=140-189; Score =41.5; E_value=3e-09; Accession=PF00010.16; Description=Helix-loop -helix DNA-binding domain
MDDASEASWLSDLMLKETEDCNLFRHSHLETLLDDDDELLSHEIASAFENLHQPLYSETFERSTKQPKTNASSSPSSPTSKILLSFDNSSDSAALSPNQIKNKGVSVSVSLPQTRKRSSENHNFQTESPKGPRSYKSPSYARDHIIAERKRREKLSQSLIALAALIPGLKKMDRASVLGNAIKYVKELQERLRMLEEENKVMVNKAKLSCEDDIDGSASREDEEGSERLPRVEARVSEKDVLLRIHCQKQKGLLLKILVEIQKFHLFVVSSSVLPFGDSILDITIVAQ

SEQ ID NO: 155093 - protein, 47 aa, Glycine max
  Coding DNA Sequence Number=SeqID_38315
MNAKAHTAHGTRHRDMKEVLDTEFMVVRDLNIYIRDRRESSVQKELG

SEQ ID NO: 155094 - protein, 144 aa, Glycine max
  Coding DNA Sequence Number=SeqID_38316
  Gene Ontology: Mol. function=transferase activity; Cellular component= oxygen evolving complex; Biological process=DNA integration
  Homolog annotation: Hit_ID=Q1T010; Match level="QueryCoverage=91%, HitCoverage=9%, E-value=5e-37, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDSALFKQFVVSLRYLCNNRPSICYAVCLISRFMHEPKQVHMTTAKRVLRYLKGIQNFGVMSPNEAKQEEEELIGHSNFDWCRDKIDTRSITACIFEFSGAPISWCSKKQPVVALSSCEAEYIARAFATCQAETTQTHKEEANI

SEQ ID NO: 155095 - protein, 609 aa, Glycine max
  Coding DNA Sequence Number=SeqID_38317
  Gene Ontology: Mol. function=zinc ion binding
  Homolog annotation: Hit_ID=Q2QSD0; Match level="QueryCoverage=90%, HitCoverage=56%, E-value=8e-27, Identity=34%"; Hit description=PHD -finger family protein, expressed
  Pfam annotation: Domain name=PHD; Domain location=15-70; Score=40.1; E_value=7.8e-09; Accession=PF00628.19; Description=PHD-finger
MEPANIRVDMVKVLRCDTCGASGFDNELVVCHKCNEGAEHTYCMDPDEQSKLEAKPELRKDWTCQECMPREGTNKLVQDEVEVAERKRKGHLFESSTDSESRKGSKLKSRSSCTGKSGENGAELLSRRPLVPVKKFKLKSVNKILYSGPERSSGETSFPGHRILVSNHDTHKDPNSPNAKKKNESQHGEQPTKAGTSMSLSELWTNPDFDGNTYLRNLASNHNTHKDPNFLNGKEKNESQQGEQPTKAGTSMSLSELWTNPDFDGNTYLRNLASNHNTHKDPNFLNGKEKNESQQGEQPTKAATSMTMYELRTDPAFDEKTYLRNLVHVEAAYLSHRVVPKADYKWLGKFQIHNSEGIARTWDGIQAHLSNCASVEVLEVANRLSEIIIILEELPRLRTWPSQFMRSQVTENDIALYFFAHDSDSYIYYEQLVNYMMNNDLALKGNLDGVELLIFPSNILPGYSQCWNGMFFLWGVFRGQKANNSASTPVSNSLKLKDGDAATILPSDLNVYPQDGDAVAIIDEIPESEPSGDTVLLVGENSDGKGGVADAEHDAVIEDINVSLWPESETQENGSVGIEDSLVPLSTPDSDELQAASALLLLAEGFIKF

SEQ ID NO: 155096 - protein, 196 aa, Glycine max
  Coding DNA Sequence Number=SeqID_38318
  Gene Ontology: Mol. function=transferase activity; Biological process= RNA-dependent DNA replication
  Homolog annotation: Hit_ID=Q1RYK2; Match level="QueryCoverage=84%, HitCoverage=72%, E-value=2e-15, Identity=30%"; Hit description =Polynucleotidyl transferase, Ribonuclease H fold
MVVKEGYRWKLVGGANIALWSESWLRNDKLWSNIDVTGFSVIHKADEFYQDWYHAKEVCGSVVRESNDVGVMESLPIGYTKCNVDASFKQHSNLTRAGMCTWDHHGKIIVIRTNFIEPCMSVPEGEARALNASISFTTGRGYQNVIFVINYKTIMDKIKSKAANNSKLGHICIVQHCRSLIHSNHICHWIFQETSQ

SEQ ID NO: 155097 - protein, 162 aa, Glycine max
  Coding DNA Sequence Number=SeqID_38319
MSKKGTIAVHMTIAGGQGAHASGQGTTFGEEGLEKEAHKEKKKDVFLACCQWVQKGEFPYSVNDISIELIPKVDHPRSGWAYSSKKSLRQSNLLSPYLFILFVEGFSTVIKDAKRRTGLHVMIASCNILDFQLLSGSHTTTLHAMTLPQHLCWSKPSVGSPF

SEQ ID NO: 155098 - protein, 33 aa, Glycine max
  Coding DNA Sequence Number=SeqID_38320
YRVSEVEWIQDILPPEGTSERETGKEIPKLAGA

SEQ ID NO: 155099 - protein, 386 aa, Glycine max
  Coding DNA Sequence Number=SeqID_38321
  Gene Ontology: Mol. function=transposase activity; Biological process= transposition, DNA-mediated
  Pfam annotation: Domain name=PLAC8; Domain location=294-363; Score =44.6; E_value=3.4e-10; Accession=PF04749.7; Description=PLAC8 family
MASSWEYFGEIANVAQLTGIDAVRLIGMIVKAANTARMHKKNCRQFAQHLKLIGNLLDQLKISELKKYPETREPLEQLEDALRRSYILVNSCQDRSYLYLLAMGWNIVYQFRKAQSEIDRYLHLVPLISLVDNNRVRERLEVIEKDQCEYTLDDEEQKVQSVILKPEPEKVDAVVLKKTPSCSYPNFSFTEALKKENEKLQVELQHSQANMDLHQYEFIQHLLDVTEVAALYHSEKSHKTVEYSDYSFSDANGDKGHSSNEKIHEKNDTHSTSRSSVSEKDQLSTGGSYHWEDWHTDLLACCSEPCLCIKTCFYPCGTLSKIATVANNRPISIDILCQGGFIDDFLSHLMCCCCALVQERREVEIRGVEGPEKTNTRPPPSQYMES

SEQ ID NO: 155100 - protein, 442 aa, Glycine max
  Coding DNA Sequence Number=SeqID_38322
  Gene Ontology: Mol. function=RNA-directed DNA polymerase activity; Cellular component=chromatin; Biological process=chromatin assembly or disassembly
MCVTGYYQKKPLYVLIDSGSTHNFLDIEVAKRLGCKSNAFDSLSVVVADGTKLNVSAVWLVSLGDIVWNFNKSQMKFYVKGRRHVLRRASTGLKTVKSQQLGKAMSTGVHLSILQVCDGQRGLLNSLTTQAADKEVPPTLAKLLDEFSDLFQEPSGLPPRRLVRDHTGMLNNIKMRLVKVGAGIFVGWDLNKHTVKNKFPIPLVDDLLDELVSSSIFSKIDLRSGYNQVRMDPADVYKTAFKTHAGHFEYLVMPFGLINAPTTFQGLMNSIFKEFLRKFMLVFFEDILVYSCSLEDHLLHLHKVLATMRANSLFAKRSKCYFEVSKVEYLGHFISKEGVSTDPVKVHAAEQWPLPKTLKQLRGFLGLAGYYRRFKKLTETPVLALLDFSKIFVVEVDASGLGIGAVLMQDHHPIAYISRHLNHQQQSYSTYEKELLAMAMAV

SEQ ID NO: 155101 - protein, 154 aa, Glycine max
  Coding DNA Sequence Number=SeqID_38323
MDFLFKPPQKATQPMLLTHIQMSYNSIKSFMLDVFRKNKKISHLELGFPPLKNELCPYYYYVEGPAFVVISTRLTTVLGNREEFVHRSCHLHESFINLGTETILHAIFNFMLKSTISCSICHVWSHLEGYRLIPLVKLFTWWWPNEERVKEKKS

SEQ ID NO: 155102 - protein, 473 aa, Glycine max
  Coding DNA Sequence Number=SeqID_38324
  Gene Ontology: Mol. function=RNA-directed DNA polymerase activity; Cellular component=chromatin; Biological process=chromatin assembly or disassembly
  Pfam annotation: Domain name=Chromo; Domain location=429-471; Score =20.9; E_value=0.0034; Accession=PF00385.14; Description='chromo' (CHRromatin Organisation MOdifier
  Pfam annotation: Domain name=rve; Domain location=161-315; Score =40.2; E_value=7e-09; Accession=PF00665.16; Description=Integrase core domain
  Pfam module annotation: Pfam domain module=Chromo::rve; Domain location=429-471::161-315
MEFDFSIEYKQGHDNVVADALSRVEPVACQALAVHQVVSELVIKIKASWDSDPAVQRLILELQANSGFHKHYSWKDRGLMRKERLVLGRDDALRQDILLHFHASAAAGHSGRNATLERLKSMVYWKGMSKDVRAFVQKYSVCLKCKYETKAFPGLLQPLPISDLIWQHITMDFIEGLPSSFGKQVIFVVVDRLSKAAHFMALSHPYSAADVAQSFLDHVFKLHGFPDSITSDRDSIFLSQFWQDLMAFQGVQVQLSTAYYPQTDDQTEIVNSSIRATPYEVVYGQPPPVNLPYLVGASKIELVDRSLLRREEMLKLIKFHMKRAQNRMKQLADKHRSERQFSVGNMVYVKLHPYRQISVVARSNVKLSPKFYGPFQVLEQIGAVAYKIKLPSSSSMHDVFHVSQLKKYVGEAVTSSSLPSSVEGDPLIKEPEAILDRMTVKRRGRAVTKVLVKWKHSLLEDATWEFFFDVRHK

SEQ ID NO: 155103 - protein, 76 aa, Glycine max
  Coding DNA Sequence Number=SeqID_38325
MKRIMMGLPCSLHAMKMMVPVSSPMRHSLTSCKVNDVVGVEGGEEGGVTWREGRGKGFGFGLRYIKAKGEEWARGE

SEQ ID NO: 155104 - protein, 284 aa, Glycine max
  Coding DNA Sequence Number=SeqID_38326
  Homolog annotation: Hit_ID=Q7XE39; Match level="QueryCoverage=95%, HitCoverage=96%, E-value=5e-55, Identity=45%"; Hit description=F-box domain containing protein, expressed
MGKVSLKEKGWRVKGRRQVRSSGNKYLRPGALAQLRCSKPSGSGGGGKCCCTDLGKKRVAVLHSRKSGGGCGGGGGGSVQQRYVENNIRVFDKSPVMLSPVNLVKHNSGFVGTPKTPRLDDSLSESKLESLPMDLLVKILCHLHHDQLRAVFHVSQKIRKAVIIARQFHFNYTTPDRSRQEMLSTMTPRPTEHWPFLCKGDGKGVRIPSPHTPKAPRHGPRPPSRLKISEMRQVTAVLFPESAFPSHCLVPSVISKPLCKSLASNRVLFYEDELCQAVAQNKLR

SEQ ID NO: 155105 - protein, 54 aa, Glycine max
  Coding DNA Sequence Number=SeqID_38327
MKHGASQAAISRLGVKQHRIKTLYKQQYAATNHFGNNKNIACKITNQGRTKKAE

SEQ ID NO: 155106 - protein, 59 aa, Glycine max
  Coding DNA Sequence Number=SeqID_38328
MTRPTRFSISHLGGELSTSSRNTQDLLSLTIVYRQQGSCILGYFLSKHLNMIGKGEDEF

SEQ ID NO: 155107 - protein, 214 aa, Glycine max
  Coding DNA Sequence Number=SeqID_38329
  Gene Ontology: Mol. function=hydrolase activity, acting on ester bonds; Biological process=lipid metabolic process
  Homolog annotation: Hit_ID=Q1S3U8; Match level="QueryCoverage=65%, HitCoverage=61%, E-value=8e-38, Identity=53%"; Hit description=GDSL -like Lipase/Acylhydrolase
MTAYTTTPDHNIQSTAQGMTQTLRASEHLHCVMNSDGCSPDWWVQLYMPPYAYTRSMLHELRWAGISLEKKPCTGRFSNGRIPLDFLAEILGLKEALPHFLDPNLEIEDLLTESMLSVEDQLNMFNEYIGKLKAVVGEARTTLILAKSLFTISMGSNDIAGTYFMKQYRRDEYNVEEYTTMLVNISSNFLQELYKFGARRIGVLNLSLIGYGPL

SEQ ID NO: 155108 - protein, 64 aa, Glycine max
  Coding DNA Sequence Number=SeqID_38330
MARDALKFLHISPKNSEHMTYGDNNKDACNRLPVTKLLKFKLKSHVPSKYNYVIDYEYPVIDDQ

SEQ ID NO: 155109 - protein, 314 aa, Glycine max
  Coding DNA Sequence Number=SeqID_38331
  Gene Ontology: Mol. function=RNA-directed DNA polymerase activity; Cellular component=chromatin; Biological process=chromatin assembly or disassembly
MEVEKASNSQLDKFMSVATIHQYCDVVMQLRGFRESSYSASEGHWVPRRGGQNKKGGHLILRKTGILDIALRLSCGESLDSGVGGFKESSCSVSEGKEKSILSSAMNKWICGLHRYSTMQEEGSQWAEHSGLKVGKMDGYGWSGDDPGLNLAMKFRNESRDKTIEKKWGCKTYCAVREPFKRSMILRPITWSPKMSRTHYVTSIDTSIELGLPCRRAQPPGTHCRGCIGNYRTRRFLKSIPVDPGHKSAGHLGSYEDDGVVKVEEEVSVGILVKMRIMVLSEICLTLSKAVNNLLEPFCGGLTSVMFQHGGKQG

SEQ ID NO: 155110 - protein, 305 aa, Glycine max
  Coding DNA Sequence Number=SeqID_38332
  Gene Ontology: Mol. function=hydrolase activity, acting on ester bonds; Cellular component=nucleus; Biological process=lipid metabolic process
  Homolog annotation: Hit_ID=Q1S3U7; Match level="QueryCoverage=93%, HitCoverage=80%, E-value=1e-120, Identity=74%"; Hit description =Lipolytic enzyme, G-D-S-L
  Pfam annotation: Domain name=Lipase_GDSL; Domain location=44-302; Score=86.8; E_value=6.5e-23; Accession=PF00657.12; Description=GDSL -like LipaseAcylhydrolase
MNLLYQKKLLSRWLIAILWCSIIAPIFQHVSVMSLPNNETVPAVMVFGDSIVDPGNNNYITTLVKCNFPPYGRDFGEGNQPTGRFSNGLVPSDIIAAKLGVKKLLPAYLDPNLQLQDLLTGVSFASGGAGYDPLTAELVNVMSLSDQLDMFKEYIKKINEAVGRNRTTMIVSKSIYIVCVGSDDIANTYYQSPFRSAEYDIPSYTDFMASEASKFLQELYGLGARRIGVFGLSVIGCVPSQRTLGGGLNRACLDSSNQAAMLFNSKLNSQMVVLGKKFSDSRLVYLDSYNGFLSMLQNPAKFGNH

SEQ ID NO: 155111 - protein, 104 aa, Glycine max
  Coding DNA Sequence Number=SeqID_38333
MRPNIGDGPFIHTMGMVEKEAMGKVGRPTMVVAVIRTSKTSKNPSSILWTRGGYGRIESKDKCLANGVKDNQILYFSFAFGHGCMFMVGLGVLVAKLRNVFDIL

SEQ ID NO: 155112 - protein, 185 aa, Glycine max
  Coding DNA Sequence Number=SeqID_38334
  Homolog annotation: Hit_ID=Q9FY46; Match level="QueryCoverage=37%, HitCoverage=10%, E-value=4e-25, Identity=77%"; Hit description =Sulfate transporter 4.1, chloroplast precursor
  Pfam annotation: Domain name=STAS; Domain location=2-64; Score=-0.5; E_value=0.045; Accession=PF01740.11; Description=STAS domain
MTAAVTYIDSSAVQALKDLYQEYKLRDIQIAISNPSPEVLLTLSRSGLVELIGKEWYFVRVHDVVQVCLQHVQSLKGASNSPQAPFSSVENKPSLFARLSKERLEKLSITDLESGHEASAVKFKLVIEKVSGWPTGDSGFRCLSSANNTITSGQYITGPHTLISPNSVFKLGFFSPQNSSNCYPS

SEQ ID NO: 155113 - protein, 322 aa, Glycine max
  Coding DNA Sequence Number=SeqID_38335
  Homolog annotation: Hit_ID=Q6ZBP8; Match level="QueryCoverage=13%, HitCoverage=7%, E-value=1e-11, Identity=75%"; Hit description =Putative cleavage and polyadenylation specific factor
MVYLCLNYINNNFGGLKVAKDAGFDKVICESDLASTIKFITDGVSDFHSYAPLIKHTLQQDDACVDCLVEFGATSHNGDLMDQFCHNEAMHVVIDEGFLGEEEDNDYEDLYNDVNTKEVFLQSLHKNDSSGFQNSDVEEKKPSSPSLVLDVVGVLISGVGGNGEGAIGGGGREVMESRVSGRVDGFQNQGFIGNEMGAKCGIRVELGNQSRNLSEIKDQGGNDGVVKMVLVVVEEVGNANRVGGNGVRNSVIVVSHVNTGGVGGAISDGVVVVGSGGTILFVGDSHWWTIDAELEIELSKYKPMKEVQFFYEKASGKSKGYH

SEQ ID NO: 155114 - protein, 366 aa, Glycine max
  Coding DNA Sequence Number=SeqID_38336
  Gene Ontology: Mol. function=nucleic acid binding; Cellular component= intracellular; Biological process=DNA integration
  Homolog annotation: Hit_ID=Q1S9T9; Match level="QueryCoverage=99%, HitCoverage=29%, E-value=1e-126, Identity=58%"; Hit description =Peptidase S8 and S53, subtilisin, kexin, sedolisin; Integrase, catalytic region; Zinc finger, CCHC-type
  Pfam annotation: Domain name=rve; Domain location=69-232; Score =186.1; E_value=8.3e-53; Accession=PF00665.16; Description=Integrase core domain
MKVSPGASIIAKGRRSNGLYILEGSTVIGQASVASHTMEDKSKLWHLRLGHISEKGLIELEKQHLLMHTSTRPFEYAHADLWGPSRIQTHGGGSYFLSIIDDYSRKVWVYILRNKAETFQKFKEWHTQIENQQGTKLKVLRTDNGLEFVSDQFNTFCTHHGIKRHKIVAGTPQQNGLAERMNRTILERVRCMLLGAGLPKVLWGEATNTGAYLINKSPSSALEYKTPMEVWSGSPTNYSNLRVFGTLAYAHVKKDKLDARAKKCLFLGYAEGVKGYMLWRLGPNSFKLIINRDVTFDETRMGMYSENSECGKEKTHIEVKPFTDKVQENTPINPITDPDNIADEIGHSISNLRRSDHAINDYQLVR

SEQ ID NO: 155115 - protein, 72 aa, Glycine max
  Coding DNA Sequence Number=SeqID_38337
MLGYVHAPKSPYTFFASSTSSVSTLPDMYMEPVVQLYDSSSPLECSICLEKWLLMLRIKMSWSWTRHKIMPS

SEQ ID NO: 155116 - protein, 78 aa, Glycine max
  Coding DNA Sequence Number=SeqID_38338
MAAATPNEEDIDVHHLRHAVDDFVTIADKLDMLLNMRIFTEGIEAYTVVEECLGIARRYIGQPTAGHRSRRKQRTNDH

SEQ ID NO: 155117 - protein, 121 aa, Glycine max
  Coding DNA Sequence Number=SeqID_38339
  Homolog annotation: Hit_ID=Q943W5; Match level="QueryCoverage=43%, HitCoverage=10%, E-value=5e-18, Identity=79%"; Hit description =Putative tyrosine-tRNA ligase
GGVTDPHGGPADECDSAVAATAEPGEDNEVEEVAEVEGFLGGVEAAINLEGWRCQARAVESFTVVTKAKAKANCPSFETRNLPSLSIQFIREPFITPGTKVYDNSKETTASKLTCMFRDQK

SEQ ID NO: 155118 - protein, 109 aa, Glycine max
  Coding DNA Sequence Number=SeqID_38340
MEWFFRISHPFVTRTEETAEPRHPPPPHDEEFIEPPIPEVSVTSDLPTHSVVDCKGCQGMAEDLGAIAKDLEWVINLRMVTEDNDLYDIMTCCLRRARGDAADGSLRPR

SEQ ID NO: 155119 - protein, 117 aa, Glycine max
  Coding DNA Sequence Number=SeqID_38341
  Subcellular localization annotation: CTP_CleavageSite=39; ConfidenceScore=5.27e-01
MTLAAKCVMVRRDPFGTPLYLGPCRPTLGLPPISKFSVTVTSLGSPSTNLNLNEEPHLVSLAVSITPYDPYLVPPRTLRRRRHLTLSFSWWLRWKKRVARGGGIWVCACVYTTSFLL

SEQ ID NO: 155120 - protein, 111 aa, Glycine max
  Coding DNA Sequence Number=SeqID_38342
MTLTDVDETSGSQRGIGDFIHCGQEHGVVDDLVKDAIHGSVIDGVHKSTTLTILSLQCELCSNSFNCVSEYTRKFGVAWWDLIHSVEGVNGGWISSGMDEWTTLHFRLGFL

SEQ ID NO: 155121 - protein, 96 aa, Glycine max
  Coding DNA Sequence Number=SeqID_38343
  Gene Ontology: Mol. function=protein-tyrosine kinase activity; Cellular component=integral to membrane; Biological process=protein amino acid phosphorylation
  Homolog annotation: Hit_ID=Q49N12; Match level="QueryCoverage=98%, HitCoverage=9%, E-value=2e-29, Identity=74%"; Hit description =Putative receptor-like protein kinase 2
MERTIPFTDKKEESFSILEWANLLKEKGSLMELVDRRLGSDFNKEEVLVMIKVALLCTKVTATQRPTMSSVVSILEGRTIVEEVYSETSEVLDEKR

SEQ ID NO: 155122 - protein, 523 aa, Glycine max
  Coding DNA Sequence Number=SeqID_38344
  Gene Ontology: Mol. function=nucleotide binding; Cellular component =nucleus; Biological process=cell cycle
  Homolog annotation: Hit_ID=Q9MBA3; Match level="QueryCoverage=99%, HitCoverage=86%, E-value=1e-145, Identity=52%"; Hit description=Cell cycle checkpoint protein RAD17
  Pfam annotation: Domain name=AAA; Domain location=56-261; Score= -34.6; E_value=0.087; Accession=PF00004.19; Description=ATPase family associated with various cellular activities (AAA)
  Pfam annotation: Domain name=Rad17; Domain location=7-458; Score =29.9; E_value=5.1e-10; Accession=PF03215.6; Description=Rad17 cell cycle checkpoint protein
  Pfam module annotation: Pfam domain module=AAA::Rad17; Domain location=56-261::7-458
MDASGTHRHYAEDLWIDKYKPCSLEELAVHKKKVEEVKTWFEERLKPSKGAYCNNVLVISGQAGVGKSAAIHVIASHLGAVVCGWNTPTPVIWQEHLYNSGTGTKYTSKLDEFESFVDRVRKYGLLLTSHTGESKPSVILLIDDLPLTNGKSAFRRLKDCLHVLVNSTQIPTAILFTDYGNADSADYNARCLEELKLSLESSGACKVAFNPITLNTMKKILFRICQMEHCDVTAEYVDLIAKTSGGDIRHAITSLQFFCLKPSTCYRGALKEESDKPVRSDDGYSLHFGRDETLSLFHALGKFLHNKRESGVSTEYDQDGFLMQERLSRLPLKMDVPEKILYQAHVQPGPVADFLHENVLDFLNDEAIDDAWTLSSYLGDADILLTKLRGMLSTYNEAESVLRSAAASIAVRGVLFGNSHPLSSRWHAIRRPKLWQVEKASLYKNEVDRLRIPACRRFSSYHMSIMTTEYMPMLKLLGNGAWGGHHEPSPESLLNLEMEDFDFDKMDLDGQSREISDDDIEDW

SEQ ID NO: 155123 - protein, 119 aa, Glycine max
  Coding DNA Sequence Number=SeqID_38345
  Subcellular localization annotation: CTP_CleavageSite=53; ConfidenceScore=5.03e-01
MAKRNCVVILSSEDEEEDGFIVRSLSSSHSYNTKTKSKSKSTSASSRGRKRARASASRSHLSKLHEIDLFGDDFNEVFTGSKVSAEFGLFLFSSTTKIAYFTLACFRQAKSDKITDHDA

SEQ ID NO: 155124 - protein, 512 aa, Glycine max
  Coding DNA Sequence Number=SeqID_38346
  Homolog annotation: Hit_ID=Q56W45; Match level="QueryCoverage=43%, HitCoverage=32%, E-value=7e-31, Identity=34%"; Hit description=BZIP -like protein
  Pfam annotation: Domain name=DUF630; Domain location=60-121; Score =69.8; E_value=8.8e-18; Accession=PF04783.3; Description=Protein of unknown function (DUF630)
  Pfam annotation: Domain name=DUF632; Domain location=148-371; Score= -7.9; E_value=1.2e-09; Accession=PF04782.3; Description=Protein of unknown function (DUF632)
  Pfam module annotation: Pfam domain module=DUF630::DUF632; Domain location=60-121::148-371
FYQPQLATPHRTEPELYVAKEGTVLAEQKETNTSQPDSKQQRFIAIPVFVFFGCCVVVLMGCCWHSRIAREETALSHCKARKRCMKHFVEARHSFSSSHSMYIRSLHTTASALVHFANTEEKEEKETVTLHHHSPTTSLPQPLPTSPVSDNALTVGLQVFSLCGVSWSSGVKEVHGCFLKAADAGTNVSLLLEVPTSAFSNPCKASKVYNYGWILNPLLRSRFSIRKRCKKFFGAIADVNGSHCSTVERLYTLEKKLCQEAKLEDLNNTVPSTNPTSEIHRKSTLQREVGIQQWHQSFGNIFKAHRDYIQSLTAWLRLNLHHFSRNPLNKSADESKIYTLCEQWNLALDHTPDKVASKGIKSLLEDIHAIVVQQTEEHKQKKKLDAALKELQKKVVQLQSIECKHGSRSMSESSDPKDRVTKKRAKVEHLRAKVEKEKTKHENSIGVTHRMTKKNLQMGFPQAFEGIVRFSSVCVEVFESVYNKANIDDVKRILPKENRHVSFIQNRHFLIK

SEQ ID NO: 155125 - protein, 123 aa, Glycine max
  Coding DNA Sequence Number=SeqID_38347
MHLETPLTFLCEGVGGFNMKLRSHSRKGKMMQFSSIPKLNNKIRFHFDGAGLWGLQIWVEGVEGWFAGGFGLAASTRWSWRDDAVVVENQEKKLINNLTEPLRFLTEIGKDDVNETFKIFFKG

SEQ ID NO: 155126 - protein, 279 aa, Glycine max
  Coding DNA Sequence Number=SeqID_38348
  Gene Ontology: Mol. function=protein binding; Cellular component =integral to membrane; Biological process=protein amino acid phosphorylation
  Homolog annotation: Hit_ID=Q1S979; Match level="QueryCoverage=99%, HitCoverage=44%, E-value=1e-76, Identity=55%"; Hit description =Leucine-rich repeat
  Pfam annotation: Domain name=LRR_1; Domain location=107-129; Score =10.1; E_value=3.7; Accession=PF00560.23; Description=Leucine Rich Repeat
  Pfam annotation: Domain name=LRR_1; Domain location=131-153; Score =19.4; E_value=0.013; Accession=PF00560.23; Description=Leucine Rich Repeat
  Pfam annotation: Domain name=LRR_1; Domain location=155-177; Score =9.0; E_value=5.9; Accession=PF00560.23; Description=Leucine Rich Repeat
  Pfam annotation: Domain name=LRR_1; Domain location=179-200; Score =6.9; E_value=15; Accession=PF00560.23; Description=Leucine Rich Repeat
  Pfam annotation: Domain name=LRR_1; Domain location=203-225; Score =9.7; E_value=4.5; Accession=PF00560.23; Description=Leucine Rich Repeat
  Pfam annotation: Domain name=LRR_1; Domain location=251-273; Score =6.8; E_value=15; Accession=PF00560.23; Description=Leucine Rich Repeat
  Pfam annotation: Domain name=LRR_1; Domain location=59-81; Score=9.7; E_value=4.4; Accession=PF00560.23; Description=Leucine Rich Repeat
  Pfam annotation: Domain name=LRR_1; Domain location=83-105; Score =17.1; E_value=0.066; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=107-129::131-153::155- 177::179-200::203-225::251-273::59-81::83-105
KLLQAISDKVENLNWKVTQRSCNVKGDRGFDNRKISRDQAQIIRNVTCDCTSNNFTTCHVTSISLKGLNISGPIPDELGNLNRLEILDLTRNNFNGSIPKSLGRLSSVVTLSLLGNRLTGSIPSEIGDMASLQELNLEDNQLEGPLPPSLGKMSSLLRLLLSTNNFTGTIPETYGNLKNLTMFRIDGSSLSGKIPTFIGNWTKLDRLDLQGTSMEGPIPSVISDLTNLTELRISDLKGPAMTFPNLKNLKLLQRLELRNCLITGPIPRYIGEIESLKTM

SEQ ID NO: 155127 - protein, 501 aa, Glycine max
  Coding DNA Sequence Number=SeqID_38349
  Gene Ontology: Mol. function=binding; Cellular component=membrane; Biological process=photosynthesis
  Homolog annotation: Hit_ID=Q1S3U4; Match level="QueryCoverage=99%, HitCoverage=100%, E-value=0.0, Identity=72%"; Hit description =Tetratricopeptide repeat, putative
  Pfam annotation: Domain name=TPR_1; Domain location=177-210; Score =38.8; E_value=1.8e-08; Accession=PF00515.18; Description =Tetratricopeptide repeat
  Pfam annotation: Domain name=TPR_2; Domain location=177-210; Score =37.3; E_value=5.5e-08; Accession=PF07719.7; Description =Tetratricopeptide repeat
  Pfam annotation: Domain name=TPR_2; Domain location=81-114; Score =4.1; E_value=11; Accession=PF07719.7; Description=Tetratricopeptide repeat
  Pfam module annotation: Pfam domain module=TPR_1::TPR_2::TPR_2; Domain location=177-210::177-210::81-114
  Subcellular localization annotation: CTP_CleavageSite=52; ConfidenceScore=5.38e-01
MLQDMWNAPPGFRPSKSAPSSPAKPLGMVPRTRSETFHVAHKVPIGDTPYVRAKNVQLVNKDPERAIPLFWAAINAGDRVDSALKDMAIVMKQQNRAEEAIEAIKSLRSRCSDQAQESLDNILLDLYKRCGRLDDQIALLKHKLYLIQQGLAFNGKRTKTARSQGKKFQVSVEQEATRLLGNLGWALMQQNNYIEAEEAYRRALLIAPDNNKMCNLGICLMKQGRIGEAKETLYRVKPAVMDGPRGSDSHLKAYERAQQMLKDLESEMMNKGGVDRIEQSRLFEAFLGSSSIWQPQPCKDHHHTTLPAAATTTNSAKIHDEFADENINSNIISTNHTALPPTKGSNNNKQLGAILGNSLNVAAPPFYASSKSSMLREPIENHLSETLKRTRSGNAAGSMRVVSDVRDANNNNNNKKLHVELGVPVPQNKTRRLSSEDAEKNKLTDLDLLPDDDEFEEAILAAILGPPNESDKANYDTSSTTSRMLRLKVFQDITLSLSPRA

SEQ ID NO: 155128 - protein, 64 aa, Glycine max
  Coding DNA Sequence Number=SeqID_38350
MTLVEAGTIPILIDLMNVVDEVEEQRDNVDEALANYVDPLLTYIRASNEHMTRSLRRISVGQLT

SEQ ID NO: 155129 - protein, 270 aa, Glycine max
  Coding DNA Sequence Number=SeqID_38351
  Homolog annotation: Hit_ID=Q9LH72; Match level="QueryCoverage=98%, HitCoverage=51%, E-value=1e-111, Identity=76%"; Hit description =Arabidopsis thaliana genomic DNA, chromosome 3, BAC clone: T21E2
MAVLRLEMKIHLFSWFSLDLFSLSVIQLSSCLFICQSSTCCGMAMIESFPFEAMAKYAEMMLMLNGMHSLCPAVWSKHRRWLLMSMLCLNPVACSFVDLQFPNGQLTYVSGEGLSTSAFLPVCGGLLQAQGQYPGEMRFSFSCKNKWGTRITPMVQWPDKSFSLGLAQALAWKRSGLMVRPSVQFSVCPTVGGSNPGLRAELIHSVKEKLNLICGCAFMTYPSAFASVSIGRSKWNGNVGNSGLVLRVDVPLSTVGRPSFSIQINSGIEF

SEQ ID NO: 155130 - protein, 338 aa, Glycine max
  Coding DNA Sequence Number=SeqID_38352
MDQVQRQAFSKVYGKIWDLAMIELSVEAITSITQYYEQSLRCFTFGDFQLAPTIEEFEGILGCPIGGMKPYLFSGYYPSMEWSSGNTKKVLGGEGGNSGKPRKVVDLAAIDAFLAYHHSKESSVIAVLADAYDMFDLRCEKSSVKIVCCTPTLYNECTLRYPYQTRAKARIMSDVEEVQKQMKASMEAMKNHMTTMMEAMMSMRKMMEVNATVVVATSTATKVDPTHPSGINQVQSKHPFPPYGLPPNYPPPNVAHALDENFDNSAPIPIESQQPQSGHAHVSQPMGETHEVPRDHILADFEPHLGYATEGQAFYGVPLPNTLGGPQYLPQPRPLHFA

SEQ ID NO: 155131 - protein, 280 aa, Glycine max
  Coding DNA Sequence Number=SeqID_38353
  Gene Ontology: Cellular component=chloroplast thylakoid membrane
  Pfam annotation: Domain name=Methyltransf_11; Domain location=114 -210; Score=3.4; E_value=0.025; Accession=PF08241.2; Description =Methyltransferase domain
  Subcellular localization annotation: CTP_CleavageSite=62; ConfidenceScore=5.07e-01
MSRRPANPSRRFGDSGGGLFSSSKSKASPVLSVGLIIVGCLFLIAYVYKGSGGFGSHLESVSRVEGWQYPAMLYGPVIVYLELPNAGDYLCAREVLRAIPVLQKAYGDSLHKVLHVGPDTCYVVSKFLKEEETEAWGIEPYDVEDADGNCKALILKGIVRMADIKFPLPYRPKSFSLVIVSDALDFLSPRYLNKTLPDLARVSADGIVIFTGFPDNQKAKVADVSKMGRAAKMRSSSWWVRFFLSINLEENETASKKFAQASTKSSYISNCQIFHLKSLH

SEQ ID NO: 155132 - protein, 205 aa, Glycine max
  Coding DNA Sequence Number=SeqID_38354
  Gene Ontology: Mol. function=heat shock protein binding; Cellular component=integral to membrane; Biological process=protein folding
  Homolog annotation: Hit_ID=Q6ATJ1; Match level="QueryCoverage=80%, HitCoverage=65%, E-value=2e-25, Identity=38%"; Hit description =Putative DnaJ protein
MKEDAEKDKGKDNNRIWGAILFGLIGATVTTFARLEYYNCFRICRSVSCGGVLNGSILRTQSSWKGERNGSFRSALQEEAWRRHNKRMQEELEEEMERVERIRRMQSVFNRERNKYKRSYESWRGSGPGAYHQHFQREDWYWKADTSFRDKRTNYQETPRESGNYALSHHYSVLGLDRCELDWLLNHDSEITARMMILSVELCDS

SEQ ID NO: 155133 - protein, 58 aa, Glycine max
  Coding DNA Sequence Number=SeqID_38355
MAYYVNNVFLHGELEEDVYEGVDCRENNKSSMEPDIYRSGMDPLFVRTVITFQIIIGL

SEQ ID NO: 155134 - protein, 109 aa, Glycine max
  Coding DNA Sequence Number=SeqID_38356
MSIREQCGTFVFITCTQSSHACLRNVQENFLNPLPPIISTHFVSQYTSCWKFDYADTWHECNDYGKQLLYYTLHFGRRFPEQRHCEVIQETFEHVPTILKALQVQIRQA

SEQ ID NO: 155135 - protein, 50 aa, Glycine max
  Coding DNA Sequence Number=SeqID_38357
MVMRNGVSKIQIHTHHDAIIVSTSLLLMASKFLSVESGLGRLASVQKIGC

SEQ ID NO: 155136 - protein, 83 aa, Glycine max
  Coding DNA Sequence Number=SeqID_38358
  Homolog annotation: Hit_ID=Q1S3T3; Match level="QueryCoverage=77%, HitCoverage=13%, E-value=5e-18, Identity=72%"; Hit description =Senescence-associated
MAAHPLPSLLVSLSRKVCDAVEVAGKSVMSTSNTVTTELVNHRYGEEAAKATSEGLDAAGHAVGTAWAAFKIPQALNPKSVFG

SEQ ID NO: 155137 - protein, 97 aa, Glycine max
  Coding DNA Sequence Number=SeqID_38359
  Homolog annotation: Hit_ID=Q5VQE5; Match level="QueryCoverage=57%, HitCoverage=8%, E-value=1e-07, Identity=48%"; Hit description =Alpha/beta hydrolase-like
MFETIISAKNVESLLQAVGDIPVLVTAGAGDSLVSLESCQAMASKLLNSNVTSNETCNAVHENINIASDHFEANPTDRAAESEVEYRTRCHLAISLN

SEQ ID NO: 155138 - protein, 361 aa, Glycine max
  Coding DNA Sequence Number=SeqID_38360
MADSLPDSSNSLSKLSASVSGCLDIDGIPSPLPWGHQYHPTARAAKWIHFDFKHEFLQMLENNLFSGATHEDLMQQLRKFIKLTDMSLVHIFYGGVVSSHNRTSLDASCGGNIMLKPPTNAIKMIEDMCSNPYNNLRDMRIMKRGMNQVEKDDSQTKLGKQMQALTIKIETLMRAQAQNVHGPRECTVDVELVATIDEITFVGGRNSSYNQYPNNFSQGQGFRQNEGMYRPQPMQNQRPVQEERQPTLQETTLQYMTLNDQRMKLDDKAVMIRSKRVQEDFEEKDDSSKVVDDVFTERHQAPEKVKVPIDRNPMPQNEGYKKNEILTSPQGKQKISQEVSPLKSFVYGKGKNQKNSQTVPS

SEQ ID NO: 155139 - protein, 138 aa, Glycine max
  Coding DNA Sequence Number=SeqID_38361
  Gene Ontology: Mol. function=transition metal ion binding; Cellular component=endoplasmic reticulum; Biological process=electron transport
  Homolog annotation: Hit_ID=P49098; Match level="QueryCoverage=99%, HitCoverage=99%, E-value=1e-47, Identity=67%"; Hit description =Cytochrome b5
  Pfam annotation: Domain name=Cyt-b5; Domain location=7-81; Score =100.9; E_value=3.9e-27; Accession=PF00173.18; Description=Cytochrome b5-like HemeSteroid binding doma
MGGERKVYTLAEVSEHNTSKDCWLIIDGKVYNVTKFLDDHPGGDDVLLSSTGKDATDDFEDVGHSKGARAMLDDLYVGDIDPSTIPTKVQHTPLTQPQNNQDKTSSSSDSMTKMLQFLLPLLILGVAVGIRFYNTKST

SEQ ID NO: 155140 - protein, 264 aa, Glycine max
  Coding DNA Sequence Number=SeqID_38362
  Homolog annotation: Hit_ID=Q1S3T3; Match level="QueryCoverage=76%, HitCoverage=42%, E-value=1e-79, Identity=74%"; Hit description =Senescence-associated
  Pfam annotation: Domain name=Senescence; Domain location=1-263; Score= 192.8; E_value=8.5e-55; Accession=PF06911.3; Description=Senescence -associated protein
EESSDSDSSSSDEEGGKAKRQNKKKKKKDSNSNFGASVLSHGLTIASKGQEDLLKELDKVLQECSAFSVQKVSEKAKKEGDVVDASVALAISPVDLEKEEKKEMMEEKCAAYWTTLAPNMEDYSGTATKLIAASSGQLVKGILWCGDVTVEQLRWGNEVMKRRMTLGSQGEISPKTLKRIKRVKKVTKMTESVANGVLTGVVKVSGFFTSSVANSKAGKKFFSLLPGEVVLASLDGFSTGIAIPPGGINFSVHTWTIPPLELTG

SEQ ID NO: 155141 - protein, 217 aa, Glycine max
  Coding DNA Sequence Number=SeqID_38363
  Pfam annotation: Domain name=Transposase_21; Domain location=124-209; Score=-129.3; E_value=0.0014; Accession=PF02992.5; Description =Transposase family tnp2
MQRGSQTEPVDEEMGDRLKDMSRYLGKESFQQAHVPVYNTLESDSKKPLYLGCKKSLMLLLIVLSLVNVKVRYGYSEKKLYFTASGSAGYASRGKYIAKKLPLGKKDIVFVGFKHLFANEDDAKDLTWHTNGRNYDGMLRHPVDSSQWKKINSLYPEFSKEARQRMVIHQDLAEMGIRDQLQQRSNAKKKYLPSACHTLSRKEKTSFCQCLCCVKVP

SEQ ID NO: 155142 - protein, 351 aa, Glycine max
  Coding DNA Sequence Number=SeqID_38364
  Gene Ontology: Mol. function=transition metal ion binding
MPYFGVIEEIWELNYVKFIVCVFKCKLVDSNIGVQTDNFEFTLVDLKKLAYQNESFVKVDKLNRCFMFKILVMKGGQWFYKEKPLVLILKMMIQPLLLVSLLSPHKCLMSTEKKLTMSMQIVMIMMKHMTTPPSFHPPLELVPSLSPKKTRRATWLKSLATRLVGMKPDGPYRKKLRTCLGVIARDMVDVTFVNRKQVPTTQKYLIWGDIQAKFDILEEDDDDTICKKYNISKEKWQQFCQTRRDPSWEDVLTVAIERSKHSGCVHAARVGGLILPHEPEVGSSAVRVSTKGSYVDPSRQDPDIGELEKFALYIDDDPPCLVALGRVYEGSTTVHNISLGNDQVKVGVEEV

SEQ ID NO: 155143 - protein, 73 aa, Glycine max
  Coding DNA Sequence Number=SeqID_38365
MTLFGCERNRAQGLRGKRFTRERVSAPMTVASTEKGLGTAAKGGQREAKHGKGLQEEEVENGTLKDKLETEGF

SEQ ID NO: 155144 - protein, 294 aa, Glycine max
  Coding DNA Sequence Number=SeqID_38366
  Gene Ontology: Mol. function=catalytic activity; Biological process =metabolic process
  Homolog annotation: Hit_ID=Q2WGL6; Match level="QueryCoverage=28%, HitCoverage=10%, E-value=8e-30, Identity=72%"; Hit description =Cycloartenol synthase
MDCSATASSKGNILQHIYSIFIMFVGLHLTDERDPGEGPIPRLDTYLFVLLCITTLVVANLIGEEEGKLFEEAEHSPANQRMDKQALGVRHGESVISLQLLGDYENLLTHPQSVIWGANQAAAKANLFVLGHSGYLEHKNVLEDCPGDLNKWYCHISKGAWPFSTTNHGWLISDYTSEGLKAVVLLSKIAPETVGEPIDLKRLYDYMNVILSLQGVDFYAINTYAQALLNSIVENPIKIGEVLTRGLDQALYLHSTGGNPLLGEQAIEESRNAIVDALKESDLVFITVGMGGGT

SEQ ID NO: 155145 - protein, 87 aa, Glycine max
  Coding DNA Sequence Number=SeqID_38367
MERENRIAQSHYKMEASILLQHLRTLSKHSKKKIEKSQEFARDAAIAVRIHVSPLRVVSYELCDHTIVRPFKGDEYCDEIYCENPTS

SEQ ID NO: 155146 - protein, 91 aa, Glycine max
  Coding DNA Sequence Number=SeqID_38368
MGRLAGFTKNNTGLSDTEVLLSGNCYGLANQLRLAYCTRWMIVHPLEINSLSAQCALSECSYKHLCSGKNSLSAVRALSEFFRKTLIFNEY

SEQ ID NO: 155147 - protein, 175 aa, Glycine max
  Coding DNA Sequence Number=SeqID_38369
  Gene Ontology: Mol. function=RNA-directed DNA polymerase activity; Cellular component=intracellular; Biological process=RNA-dependent DNA replication
MVMVKKSTRKWRMCVDYINLHKACPKDAYTLPSIDKLVDTTCATYQRLMNKVFKEEIGENIKVYVDDMVVKYLSSDQHARDLAEIFAELRKLNMRLNPKRHFWGWGWEFGNEVVSILPRSPDQKLFEFGLKFELQRPIKTQCMADFMAKLPPKLVEAMPSKIILMMLKNQESRKF

SEQ ID NO: 155148 - protein, 175 aa, Glycine max
  Coding DNA Sequence Number=SeqID_38370
  Homolog annotation: Hit_ID=Q338F7; Match level="QueryCoverage=64%, HitCoverage=54%, E-value=3e-11, Identity=35%"; Hit description =YGL010w, putative, expressed
  Pfam annotation: Domain name=DUF962; Domain location=9-150; Score =58.7; E_value=1.9e-14; Accession=PF06127.2; Description=Protein of unknown function (DUF962)
MALGRRSGLFALEKHFAFYGAYHSNKINIAIHVLFVWPIFFSALLILYFVPLPPLFNLQNLEFSMWENYVILVWNVGFLVALLYSVFYVSLDLKAGSLAALLCALCWIGSSFVASQLGLSLAWKKGMVWERAGREERAKSGVRKIEGESMKRAWRKGWGWRRKRVGERQEKPTSS

SEQ ID NO: 155149 - protein, 121 aa, Glycine max
  Coding DNA Sequence Number=SeqID_38371
MSVKDVTYTPLTKSQARILVEAFNKEILGLVQRGCINDFFGGKNYNRGSYKGDKGGHRGSFRGRYVGGWGNNNQHPIGEDEQENPPCAVRGVINTIVGEGCTSSIWKRHLQALKSVNAIRT

SEQ ID NO: 155150 - protein, 168 aa, Glycine max
  Coding DNA Sequence Number=SeqID_38372
MSYGGVNILHIEYQNIQKVCQTNRYFEEGVDAIMSSLGNMVPSYRSMSRGFIHREGGHQGFCQQKDVDDVTRLLDPEIFDGIVQLCLYDSWCHLTLTLNSRSLPYTLEIEGNFISTSQWTPNVLTRLLVVQPMSSFLPVFPSSFSNGGLEYLKKDSNAKVNVYLGSVQ

SEQ ID NO: 155151 - protein, 80 aa, Glycine max
  Coding DNA Sequence Number=SeqID_38373
MCVQEEGRLVLEIGESAFTVTLDKGKKERKEKNHIPLIAKIKKSLDLRFIFLIPCKASQAKGIQMKVNDSSTLRIGCVHV

SEQ ID NO: 155152 - protein, 122 aa, Glycine max
  Coding DNA Sequence Number=SeqID_38374
  Gene Ontology: Mol. function=nucleic acid binding; Biological process= DNA integration
MAPIVKGDRFNLNQCLRNIPYASVVGSLMYAQVCTRHGIAFVVGMLGRYQSNPGIEHWTIAKEKVVGYSNSNFAGCIDSRWSTSRYIFMMANGAISQRSAKQSLVATSTMEDEFISLFEATS

SEQ ID NO: 155153 - protein, 382 aa, Glycine max
  Coding DNA Sequence Number=SeqID_38375
MASAKAKPRKRLGEFLKEQQEPFILELYLLEKGYSTNIGESGKSKERWSISKKREPLFQFSKVLTTLHKKLVFHNQSCILIRDSDIIDEHVNVNVNVSVPREAESTDQSHQTIEDTDRFSFSTSINSTVYLSCSDIDEDGTSLSPHKDKALFSPNTFQASNIEVLQSQQATNNEEHHQRCLEGSPVPESRNISVAHATLNQDVSGMEERRMSSCCVFVPKKITEDSLLSVALWSSLIQSVKRERCSKELREFLGANPDVCHVLKSRTLLHKAKQLLFYCVREISTPKNLSRKDCRQKQCLKQLTRGPEELGKIIWERTRELGGNETNLITKLLSLEYLNSMDEWSELKPQVRHICVEVAEAVLERLTYEIVEEMIQVLSPTL

SEQ ID NO: 155154 - protein, 378 aa, Glycine max
  Coding DNA Sequence Number=SeqID_38376
  Gene Ontology: Mol. function=nucleic acid binding; Cellular component= ribonucleoprotein complex; Biological process=multicellular organismal development
  Homolog annotation: Hit_ID=Q9FWK8; Match level="QueryCoverage=70%, HitCoverage=63%, E-value=2e-53, Identity=42%"; Hit description =Putative RNA binding protein
  Pfam annotation: Domain name=RRM_1; Domain location=12-81; Score =86.2; E_value=9.8e-23; Accession=PF00076.12; Description=RNA recognition motif. (a.k.a. RRM, R
  Pfam annotation: Domain name=RRM_1; Domain location=130-200; Score =85.2; E_value=2e-22; Accession=PF00076.12; Description=RNA recognition motif. (a.k.a. RRM, R
  Pfam module annotation: Pfam domain module=RRM_1::RRM_1; Domain location=12-81::130-200
MNFKMDSDRAKLFVGGISRDTTEDVLKLHFAKYGVVSDSTISVDRTTRSPRGFGFVTFSDLSAADKALQDTHVILGRTVEVKKAIPRSEQHQHQNQLQSRVGGYYNNNNNNNNNYSNDCSSDYNVRTKKIFVGGLPAGISEEEFKNYFERFGRITDVVVMQDSVTHRPRGFGFITFESEDSVQNVMVKSFHDLNGRQVEVKRAVPKEGNHGYDGFSKFRNKSERGVPKSLPPYSPRNMFPGFSPSPWYSGDGVYAYGSNAYGCWYPVGGYGGNGYAVLCDAPRNFWYGPMMTGPQACQVPYTSAVPDVVYVGGRIGVVGSGAGSWGYSGILGPATNLKFDQAFNANGFVPGNVTSLHGVQQDVIDSSSLKGSNGGISS

SEQ ID NO: 155155 - protein, 132 aa, Glycine max
  Coding DNA Sequence Number=SeqID_38377
MEHTLNNDVYFQEKVSIPFSWEHKPGLSKVTHKKNDSRHSNLVLQPPPPQSSSMNIGRKKQLQVEDTKGPNFILCAVQPSSLRIRSFRLESDQKGDPFVEAYKKCTETPKEYPFMHKGSTNGLAPLTKGSPA

SEQ ID NO: 155156 - protein, 321 aa, Glycine max
  Coding DNA Sequence Number=SeqID_38378
  Gene Ontology: Mol. function=transcription regulator activity; Cellular component=nucleus; Biological process=regulation of transcription
  Homolog annotation: Hit_ID=Q0WL61; Match level="QueryCoverage=79%, HitCoverage=62%, E-value=6e-35, Identity=41%"; Hit description=BHLH transcription factor like protein
  Pfam annotation: Domain name=HLH; Domain location=231-281; Score =34.8; E_value=3e-07; Accession=PF00010.16; Description=Helix-loop -helix DNA-binding domain
  Subcellular localization annotation: CTP_CleavageSite=80; ConfidenceScore=5.29e-01
MGDLENALGLQSVSEMTVSSASMAMPSGAANPFLSSSAWDPLVPLSQTFGGSLVVSHSEFAHSAYPFVMNCDSHFVQYVSDSNFEHMALKVPSIGQTGCYDIDNNIGYLPNHNPSNESGIERNQLNNEKSKHEDSTSEEGAAPGEHKRKRGLYYNVTFSSNKNAEGETLQNSSGKSCDDVKEQCEKKPKFAQNSAANLCGKQLLKHKKDDSESEEAPKENFIHVRTRRGQATNSHNLAERVRREKISERMRLLQELVPGCEKITGKAVMLDEIINYVQLLQQQVESRIGHAPIGGYGASISMPSQSNTIPSNATGCLKTEL

SEQ ID NO: 155157 - protein, 704 aa, Glycine max
  Coding DNA Sequence Number=SeqID_38379
  Gene Ontology: Mol. function=protein-methionine-S-oxide reductase activity; Cellular component=membrane; Biological process=protein metabolic process
  Homolog annotation: Hit_ID=Q9ZQB9; Match level="QueryCoverage=99%, HitCoverage=99%, E-value=0.0, Identity=67%"; Hit description =Putative glucosyltransferase
  Pfam annotation: Domain name=Glycos_transf_2; Domain location=252 -427; Score=35.1; E_value=2.4e-07; Accession=PF00535.16; Description =Glycosyl transferase
MAPPLFNWGVKDTHRGTPVVVKMENPNWSMVELEGPEEEDLMLTNSPSSGVSRDKGRGKNAKQLTWVLLLKAHRAAGCLTSIAPALLGFVAAVKRRVAAGKTDADTDTDGGRENENPAVKTRFYSCIKLFLCLSVFLLVFEIVAYFKGWYFSAARFQLEHFMWTPSFGVKGFFDWLYARWVFVRVEYLAPPLQFLTNACIVLFLIQSMDRLALCLGCFWIRFKKIKPVPKGGGVLDLESGEEKGFSFSPMVLVQIPMCNEKEVYQQSIAAVCNLDWPKGKLLIQVLDDSDDPATQSLIKEEVQKWQQEGANILYRHRVIRDGYKAGNLKSAMNCSYVKDYEFVAIFDADFQPTPDFLKKTVPHFKDNDDLGLVQARWSFVNRDENLLTRLQNINLSFHFEVEQQVNGIFINFFGFNGTAGVWRIKTLEDAGGWLERTTVEDMDIAVRAHLHGWKFIFLNDVECQCELPESYEAYRKQQHRWHSGPMQLFRLCLPDIIRAKISVWKKFNMIFLFFLLRKLILPFYSFTLFCIILPMTMFVPEAELPAWVVCYIPAAMSFLNILPAPKAFPFIVPYLLFENTMSVTKFNAMISGLFQLGSAYEWVVTKKSGRSSEGDLVSLIEKGPKHQRGSSAPDLEELRKQEQQKASKKKKKHNRIYMKELALAFLLLTASARSLLSAQGIHFYFLLFQGISFLLVGLDLIGEQ

SEQ ID NO: 155158 - protein, 220 aa, Glycine max
  Coding DNA Sequence Number=SeqID_38380
  Gene Ontology: Mol. function=RNA-directed DNA polymerase activity; Cellular component=chromatin; Biological process=chromatin assembly or disassembly
VSSELVTLDVDGDLRVATSAMDNAIVTNHDAKEGNRSQRETEELSHAQLHKVVRTTTIHEDRELVSVDSVINTEGFGGAHAGQCIQAQQGRGFLEWGQGKVGIVCCNEKMDTGVAAVPRRPFLVTVIAKPLVAFQGDFLRREAANEEFGCGRNRGWRAIACGKHIGCRAWTSRRNSGDRPEMKQLSNNGGASPTTRLASLSNSERYSLTVPLCWILKSVP

SEQ ID NO: 155159 - protein, 213 aa, Glycine max
  Coding DNA Sequence Number=SeqID_38381
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=71%, HitCoverage=10%, E-value=3e-26, Identity=42%"; Hit description=Chromo
MEAVHKLTQHQATLSHANTDLNQKLDSVLDRLVALTTAPPSPKTPPSPPPFHHLRPHMKLEVLCFNAQDPLGWIFKITQFFDYQGVSDAERLTVASFYMEGLPFAGFNGCRGMALESRFALSYYDDPYGTLFKIQQRGTVNEYLSEFERLANRVVGLAPPLLLSCFISGLSPELRREVQALQPMCLPQAMALAKLQEDKLLDRCRSHRPTSHM

SEQ ID NO: 155160 - protein, 761 aa, Glycine max
  Coding DNA Sequence Number=SeqID_38382
  Gene Ontology: Mol. function=metal ion binding; Biological process =metal ion transport
  Homolog annotation: Hit_ID=Q5JL93; Match level="QueryCoverage=17%, HitCoverage=34%, E-value=8e-08, Identity=34%"; Hit description =Glycine-rich protein-like
MKIMLVTMTMITTTLVVVIVVEITMTTIMVVITVDSGNHDSCSKNDHDNSSGGGHDSDRGFRNMATTTEEGVEYESDPEEATRSLAMRRRREASDDEEGDADADGRDSATADRRITHSDDSDGEGGVADYDDEEELEEEEEEEEEEEEEGEERVGLEHEHEHEGGANGTVVKDSDDADVKAPLEESGNGNEEEKKENEPFAVPTAGAFYMHDDRFRDNAGARHRRMRGGRRLWESKDDRKWGHDKFEEITLQERHYKEGRRPSKGNFRGRGGKTRGVDHSGRYVRGSRKGYDNRGNQTQAPKSVVRGRGPQRYEPTNKNNDSASQVQNKQPGKQPEKASHASLGKTFAPVSNSKSDPVPAKKQVFASNLNYASPPFYPSSSSNKDISVAPKGDVQTGGTGRTVRPGVVDEGFLVQQNNVLLRGKNVVDHVSMEKLYIDGPGTPSVGKAFNNMHIPPPGSSGVNPSQSAHPRGHGRSGAVPVQMNYQPVTSHNQPSKIDPTQLPAIQRTAPGRTSPSLQAPAPQVGNRPGSGSQASSPPKTSSAISSLDSGEIDAASDSDKLKGALVGKGRGAPQGSGRGSFVYGGAMGTAGNISGTHGDHNFPTFLPGQHPGGIGVPAVGMAFPGYVGQPQLGLGNSEMTWLPVLTGAAGALGAAGALGATYCPPYLTVDGAYHARQSGQTSATPISSKENNVNKANNEWKSPQKSEPVNDEFGQRQNKPRRGSGKGYFSLDSRGLLPPGPLSSSFCSGVLGQQYVSRIFR

SEQ ID NO: 155161 - protein, 65 aa, Glycine max
  Coding DNA Sequence Number=SeqID_38383
MESAASTGDVPVVYGANVRGGLPYVISYGEMPAAEWKRVPQGRPVMDERAEVLLESSIKNLGLSV

SEQ ID NO: 155162 - protein, 352 aa, Glycine max
  Coding DNA Sequence Number=SeqID_38384
  Gene Ontology: Mol. function=transferase activity; Biological process= biosynthetic process
  Homolog annotation: Hit_ID=Q9LSB5; Match level="QueryCoverage=88%, HitCoverage=44%, E-value=4e-73, Identity=50%"; Hit description =Glycosyl transferases-like protein
  Subcellular localization annotation: CTP_CleavageSite=49; ConfidenceScore=5.42e-01
MEESINRGEYQPNLAKQSSLRLGGSFKSTLSGRSNPRNSPSFRRLNSVRTPRKEGRISVGGALWFRSNHLLLWLLLITLWAYLGFFVQSRWAHSDKKEEFSGFGTGPRNTNTDAEQIQRRDLLASDKSLSANNETGADIAGISKTISVALAKKDNDVPSHRKTSSKKRSKSRRSSKGKSRGKLKPTTEIKNTDIEEQEPEIPTTNNTYGLLVGPFGPMEDRILEWSPEKRSGTCNRKEDFARLVWSRRFILIFHELSMTGAPLSMMELATELLSCGATVSAVVLSRKGGLMSELARRRIKVLEDKSDLSFKTAMKADLVIAGSAVCASWIALKLISSSQSKGYDHYQLTIAL

SEQ ID NO: 155163 - protein, 50 aa, Glycine max
  Coding DNA Sequence Number=SeqID_38385
MGIAIWLYYDWFGVKGEMYMVGNGADRGRGCDGNICYEVDREAHMGEGPG

SEQ ID NO: 155164 - protein, 672 aa, Glycine max
  Coding DNA Sequence Number=SeqID_38386
  Homolog annotation: Hit_ID=Q66LI1; Match level="QueryCoverage=99%, HitCoverage=83%, E-value=1e-160, Identity=49%"; Hit description=CENP- C
PSVESLLPTLDLDSLKDPAEFFLAHERLENAKREIQKQLGGASFESDQDNVAARPRQRRPGLLGNNQLPIKYKHRYPKETSDDVLSSQETLGSQSLAPVTENTDKGEASMASSEKEVIDSSGTKGIELDELLDGLLHCDSEDLEGDGAITLLQERLQIKPIALEKFSVPDFPDKQMVDLKSLQGNKSKPRKALSDIDNLLKGMSMNMNKKTPLKKAVQCPVQQLASPTPPRSPFASLSLLQKHISQSKQSMDPFSAHEIDHLSSKNYSPTHMEEKSGKSSNKLNAPSIQDIIAVGGTSLAEDTVRNGTSTSRKSMVDNSREPRFDVNILSNEPHGDMDVDVGGSGMGDNKDRSNIEAHTIEGDIAVSNTSTVLDTDINGTHTSEVSKEDNSGKSSNNLNVSLIEDIIAVYGTSLAEDTTRNCTSTFKKSMVDNSREPRFDVTLDSNEPHVNMDVDVGVSAVGDRVMDDTKDRSNIEVNASCQSEDKAENMQTFTASIPTDGMNLNVLNPLADQPNPAGYEANSVDKRARRSDDDPEHCLQEKTDGSMVPVNGQKRVKSLVQKVSKNKKLSNRHSLAAAGTSWTSGLRRSTRIRTRPLEYWKGERLVYGRVHKTSIVKIILDTGLKEFVMCAGLATVIGVKCISPGSDGKPIMKVKSYVSDKHKELFELASLY

SEQ ID NO: 155165 - protein, 115 aa, Glycine max
  Coding DNA Sequence Number=SeqID_38387
MGDSDKCGLKRVYEGSTAVHNIPLLHGQVKVDIEEIKDVDALVPVLTDELCLKQSFQIGRILSAYWQMVIILPKENPVWFCSLHNRPENYLKGIINCALKGLDDTPQPKSKAGAR

SEQ ID NO: 155166 - protein, 88 aa, Glycine max
  Coding DNA Sequence Number=SeqID_38388
MEETNSGLISETTSSLIAKESSSNSDSNPMLSGNIPINRLKDKYKILNMSLLHHEEFWKKLEISPFNLLFERSNLCNVHMLPKKDGIL

SEQ ID NO: 155167 - protein, 408 aa, Glycine max
  Coding DNA Sequence Number=SeqID_38389
  Gene Ontology: Cellular component=intracellular
  Homolog annotation: Hit_ID=Q5VQ75; Match level="QueryCoverage=97%, HitCoverage=96%, E-value=2e-86, Identity=45%"; Hit description=DNA repair protein XRCC1-like
  Pfam annotation: Domain name=BRCT; Domain location=70-145; Score =48.3; E_value=2.7e-11; Accession=PF00533.16; Description=BRCA1 C Terminus (BRCT) domain
MSDTKRSANNSGSKRSLPSWTNSRENESDNSAKKPTLDGQGEKSSDAETPNKSKVQNENGGNASSLESKSFNKLLEGVVFVLSGFVNPERGMLRSRAMEMGAEYKPDWNSDCTLLVCAFPNTPKFRQVEADCGTIVSKDWIIECYTQRKLIEIDSYLLHAGKPWRKGNGSLEVNEDKKPSVPKKLLKHVEREQPSASTASIKSKGKDTDVARKCFEPSEVKKWAIDDLNKTIQWLESQEEKPDPGELTKIAAEGILTCLQDAICSLEEKQCSAFITGMNQIYDFTAGCVCLIIFNQDIRKGTEDWMFLPRVVEELAKFDVVGNKGSLSKEDLRRQALDCKRIYEEELNSLDHERKKNSKVNKEQRSKTGRTNAMSSGAVEYDSDETIEMTEQEIDIAYKALSSNICHL

SEQ ID NO: 155168 - protein, 177 aa, Glycine max
  Coding DNA Sequence Number=SeqID_38390
  Gene Ontology: Mol. function=metal ion binding; Cellular component =integral to membrane; Biological process=ubiquitin cycle
  Homolog annotation: Hit_ID=Q9C965; Match level="QueryCoverage=97%, HitCoverage=43%, E-value=2e-73, Identity=68%"; Hit description =Putative RING zinc finger protein; 53384-54880
  Pfam annotation: Domain name=PHD; Domain location=122-166; Score=0.9; E_value=0.047; Accession=PF00628.19; Description=PHD-finger
  Pfam annotation: Domain name=zf-C3HC4; Domain location=123-163; Score= 46.9; E_value=6.9e-11; Accession=PF00097.15; Description=Zinc finger, C3HC4 type (RING finger)
  Pfam module annotation: Pfam domain module=PHD::zf-C3HC4; Domain location=122-166::123-163
MALDCFFAVWFVVGNVWIFGGHTSPSDAPQLYSCIGYAMPFILCATICCCLPCIISVLGIREDFSQNRGATVESINALPIFKFKLKNNENGDDQDANSAIDEGGILAAGTEKERMISGEDAVCCICLAKYADDDELRELPCSHVFHVECVDKWLKINATCPLCKNEVGTSNGGSPSA

SEQ ID NO: 155169 - protein, 99 aa, Glycine max
  Coding DNA Sequence Number=SeqID_38391
  Homolog annotation: Hit_ID=Q5EMP6; Match level="QueryCoverage=38%, HitCoverage=14%, E-value=5e-13, Identity=94%"; Hit description =Senescence-inducible chloroplast stay-green protein 2
MCGARVLTFDQIEGLKNPDMQCWGTEEGVDENKHLGNLPRTYTLTHTDITAKLTLAISQTINNSQQKFSEEDADVAAKQKKPVYLTFLLCKRTLFGPKR

SEQ ID NO: 155170 - protein, 637 aa, Glycine max
  Coding DNA Sequence Number=SeqID_38392
  Homolog annotation: Hit_ID=O81059; Match level="QueryCoverage=29%, HitCoverage=14%, E-value=2e-65, Identity=61%"; Hit description =Putative calmodulin
MILSSFEHDFVEEENATEPRDSSNKLLVGQLPNSEHGNTVWNAKIILMNGLSRSALEELSSDKIVDDRIPHFCNFLRFGVLKKDHSFMAVGGPWEPVDGGDPSIDNNSLIKTALRYANDVIQLDLQNCQHWNPFLEIHYDRIGKDGFFSHKEITVLYVPDLSDCLPSLDEWREKWLAHKKSVAERERQLSLKKEKSRDNKEESKDKSDKRKDSTPSGKSDVKKKEKDNNTVKEEIEGKTGVNNNNIVKNEGSDIGEEGKSAEKKLAGETATGQTTGGVKSVKKKIIKRVVKQKVATKANAAATKQTDKAGEKDVAEEVTTSNVTDRDGKFSVDPTGVQTPVKNLVAEDMSIGKIDGEEGKDTEINSSEDKPQNKPDPIVNAVASDPAVKTTKKKKIIKRVPKKKVVGEASKSLVSEPKKDVENQGQDGTLSSGKQTADANTVVTEVKKPGKVVPKKKIKTPVSKKQEETADSNKTETPSDKKDEGSVVAVQAQDDTQSTGKQTANADTTVTPEVKKTGKVVPKKQSKTPMPEKRDNADTSKTETKSDKDDKKEERGGTGEKSGAKTDKQKASDVSNVKGKVKEGDKSKDEKVTKERDGKDEGFKSKSSKEVKDKRKSDEPPRHPGFILQTKWTKDSK

SEQ ID NO: 155171 - protein, 51 aa, Glycine max
  Coding DNA Sequence Number=SeqID_38393
MIGNKIRAEREGAVRKPGWVVHLASTLKRSHPAFKCPNSAFDMWREGFEGS

SEQ ID NO: 155172 - protein, 75 aa, Glycine max
  Coding DNA Sequence Number=SeqID_38394
MGRGDTSGVGEVADAGVDTDYIADHTTIPAKARSARLVRVTYVILTNMLVVFKMLEWLTQGWRVLGVPLIFPKMA

SEQ ID NO: 155173 - protein, 175 aa, Glycine max
  Coding DNA Sequence Number=SeqID_38395
  Gene Ontology: Mol. function=RNA-directed DNA polymerase activity; Cellular component=intracellular; Biological process=RNA-dependent DNA replication
MTQECYIASLKIAKEKKVAKPKEQLISCTFLNNNLGKVEVYPGETVQRIKPAKEDSSEKYNTPHGCPMCFLDVYYGYKQISMFKSNGEKTTFMMDTTNYYYSVMEFDLKNVEATYQRLMDKIFVKQLKRNLEVYVDDMVVKSTSTTSHTEDLAEIFAEMRKYNMRLNLEKCIFDV

SEQ ID NO: 155174 - protein, 105 aa, Glycine max
  Coding DNA Sequence Number=SeqID_38396
MPEEHQKLIVDLRMEKEDARNKHSNAVEGKGNSLTRKKCTKNELEKSKSGVPLKYKNKESLITITTEMEEEVDSNEVIPFNVSFSKRLVELQVPKQLRKLSAMEI

SEQ ID NO: 155175 - protein, 171 aa, Glycine max
  Coding DNA Sequence Number=SeqID_38397
  Gene Ontology: Mol. function=two-component response regulator activity; Biological process=two-component signal transduction system (phosphorelay)
  Homolog annotation: Hit_ID=Q56TL2; Match level="QueryCoverage=91%, HitCoverage=29%, E-value=4e-25, Identity=50%"; Hit description =Timing of CAB expression 1 protein
MYFSKSVTGTPRKHPSSSRTIDGHFSSGPKKSELKIGESSDFFTYVKATTEESAHVDNSNNTTITTTTTEVRMEDMNQACTEQGDSGLKTQKMEKCLETIHKMTYRAATVSPILSLLRDLVLLPHRWKFHNKSITRKNIIREWCIQEMEVTVLCLLNMVIHIIFQELLIML

SEQ ID NO: 155176 - protein, 95 aa, Glycine max
  Coding DNA Sequence Number=SeqID_38398
MTKYSHLTPISSITMTKHHYSSLFCQYRLLNSNVTCLAIANDKISVSLLHISLYLVSIHGGSPVNLAEKDSEKCDAELSGKRKPTRQKASLVFYF

SEQ ID NO: 155177 - protein, 84 aa, Glycine max
  Coding DNA Sequence Number=SeqID_38399
  Gene Ontology: Mol. function=methylcrotonoyl-CoA carboxylase activity; Cellular component=mitochondrion; Biological process =metabolic process
  Homolog annotation: Hit_ID=Q42523; Match level="QueryCoverage=81%, HitCoverage=14%, E-value=8e-11, Identity=51%"; Hit description =Methylcrotonoyl-CoA carboxylase subunit alpha, mitochondrial precursor
MFCGQSQPPFTSTPIGTRSTWHPLTRPSESDRHWHGSAIHRGYGYFSIINLFFGMDCGSASKRIMGAVGVPVVLGYHGRIDVVL

SEQ ID NO: 155178 - protein, 63 aa, Glycine max
  Coding DNA Sequence Number=SeqID_38400
MAYIHPENLQQMLCCTATRGFWFFHISAAKGNDVETATYYISATTRNDVEITVYYIGGFTKTM

SEQ ID NO: 155179 - protein, 163 aa, Glycine max
  Coding DNA Sequence Number=SeqID_38401
  Gene Ontology: Mol. function=translation initiation factor activity; Cellular component=cell outer membrane; Biological process =carbohydrate metabolic process
  Homolog annotation: Hit_ID=Q1SR54; Match level="QueryCoverage=99%, HitCoverage=21%, E-value=1e-67, Identity=76%"; Hit description =Initiation factor eIF-4 gamma, middle; Initiation factor eIF-4 gamma, MA3
  Pfam annotation: Domain name=MA3; Domain location=93-162; Score=-2.8; E_value=0.012; Accession=PF02847.7; Description=MA3 domain
MEFMLEIVCDIKNNKRKPNEDSHMTLGLRSGYKRGFKWSKLLDPDKKGQWWLSGDVASSTGNVEEVANRIDKDVHETQRMLQLAAAQKMNTNARREIFCIIMSGEDYLDAFEKLLRLELPGKQDRDIMWVLVECCLQEKVFNKYYTVLASKLCEHDKNHKLTL

SEQ ID NO: 155180 - protein, 82 aa, Glycine max
  Coding DNA Sequence Number=SeqID_38402
  Homolog annotation: Hit_ID=Q3YXP7; Match level="QueryCoverage=55%, HitCoverage=20%, E-value=1e-10, Identity=63%"; Hit description =Hypothetical protein yghT
VDSRGSPSLAVACARKPDHRKAALEKKIAVTPLLTFEGADIVDLDADRPIEEVLSAAEKAIAEFMAAQGYRYSADEVSTAAH

SEQ ID NO: 155181 - protein, 164 aa, Glycine max
  Coding DNA Sequence Number=SeqID_38403
  Gene Ontology: Mol. function=RNA-directed DNA polymerase activity; Biological process=RNA-dependent DNA replication
  Homolog annotation: Hit_ID=Q1RV13; Match level="QueryCoverage=67%, HitCoverage=34%, E-value=4e-12, Identity=29%"; Hit description=IMP dehydrogenase/GMP reductase
MDQTMLDFRYSFGVGKWKSHKGVYAGERVETRLMSLPFVYLGIPMVENLRLEETWSPILRKINRRLAKWKHKVLSLAGRMSGQVVKKIIIKERDFLWGCEEGNKKVSWSERHIIFNDSLLEKSRWEIFHQTDSLWAQVLELKYGGQRGLRDQGGDIENPFGGVT

SEQ ID NO: 155182 - protein, 69 aa, Glycine max
  Coding DNA Sequence Number=SeqID_38404
MTRVRGPKLLMLRQPLRKDDDLLVVTLASFCVRPQVSESRKQRGVANLDRVVCLTLIGFYCFNFVSTPE

SEQ ID NO: 155183 - protein, 330 aa, Glycine max
  Coding DNA Sequence Number=SeqID_38405
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-40, Identity=32%"; Hit description= UPI00006A17C9 related cluster
GLHAIAFRGLQALAFGGLHVLAFRGLHALALGTSTLAFRGLHVLTDYTPRLQTTIRPHLRGLHALSLRGLHALSLRVLHVLGFRGLHVLTFRGLHALAFRGLHALAFRGLHIHAIRGLRSLTFRGLHALSFRGLHALAFRGLHVLTFRGLHRTTRPDLQRTTHLAIRELHVLNFRGLHVLSFRGLHALAFRGLHIITFRGLHVPTFRGLHILNFRGLHMHDFGGLHVLTFRGLHALTFKGLHILTFKGLHVLTFRELHVPTFRGLHVLNFRGFHALSFRGIHALSFRVLHVLTFRGLHTLAFRAQHILAITGSRILTFRGMHALAFRRLH

SEQ ID NO: 155184 - protein, 103 aa, Glycine max
  Coding DNA Sequence Number=SeqID_38406
SKSDGCARQVASYELTTLTCIPGVITYRGAKIQLSALCSEGPVVDWGGGGGQFIGKYMLLLSIRHNCNFSSAPQHLPQFGGQEPCILHIMSLYIFEAKWGPFL

SEQ ID NO: 155185 - protein, 78 aa, Glycine max
  Coding DNA Sequence Number=SeqID_38407
MRTREALAEIDTKQIIQFAASGIVARDNELVEIIIKKGEGYLRRQSEWSKKERGMDCDGGAAEDGGDGEQRTKDARLQ

SEQ ID NO: 155186 - protein, 74 aa, Glycine max
  Coding DNA Sequence Number=SeqID_38408
MDKDEWMYEIMSKQADMDYENEEACGANEPHVDCSDAFNTSQVFECREDVLWWARSVAHENGFVAVILRSDTNT

SEQ ID NO: 155187 - protein, 166 aa, Glycine max
  Coding DNA Sequence Number=SeqID_38409
MGARCCVLPTREGYAAVWIHPDHSCSPVDSWVSYDDIHDRWMHYSNHMVLAGEVCAVPGQTSDPLPNGHALQSRVIPQAPETDIPHVLEPGAPSTSARPAVEEPRHAMEVCYGIVERLEHHLSLGVVTPGLSTHEVIEECLRMVRSVTQDQLVYVRSRRRQHTDQA

SEQ ID NO: 155188 - protein, 113 aa, Glycine max
  Coding DNA Sequence Number=SeqID_38410
MNDLQGTLGYSGQRGSKNLGELASGDYSTFGALIWYEELINLTLLLLTSFETILFGVGSLGIGLCALGHQRCCLPRKAIHHGYRTHPYNQQLSSIDVRGNHDDLMPAEIEEYR

SEQ ID NO: 155189 - protein, 70 aa, Glycine max
  Coding DNA Sequence Number=SeqID_38411
  Subcellular localization annotation: CTP_CleavageSite=43; ConfidenceScore=5.71e-01
ISAPVSSTSAGAIGSSGNMSTSTFGAGSTDSSCTAVTGTRYLYADAVGHRRCGASSESSRSPLPAPLPVT

SEQ ID NO: 155190 - protein, 73 aa, Glycine max
  Coding DNA Sequence Number=SeqID_38412
MPICVRPMKFERMKSVMEFAEIVMIPMMLRSVDVLPHPHRVLPAPNVEVDIFPDDPMAPADVEDTGAEIPADT

SEQ ID NO: 155191 - protein, 96 aa, Glycine max
  Coding DNA Sequence Number=SeqID_38413
MRGYKYTPEASQPASALVLKAGDTQTASGTGKFGVLEGTARTTGDIVSMGTASQTGEFQVAENQAFFRRVPGFFHVLFSGRVAFSEKGKLQLALAS

SEQ ID NO: 155192 - protein, 88 aa, Glycine max
  Coding DNA Sequence Number=SeqID_38414
MAILASLQRSPALLHVALQLAALSCHELASLTGGSPMHGEITNGDDGFFTASELASLTGVVHKCTYWGYNAYNNTCFARLLTLHLTGF

SEQ ID NO: 155193 - protein, 227 aa, Glycine max
  Coding DNA Sequence Number=SeqID_38415
  Gene Ontology: Mol. function=protein binding; Cellular component =integral to membrane; Biological process=defense response to fungus
  Homolog annotation: Hit_ID=Q1T2W5; Match level="QueryCoverage=98%, HitCoverage=76%, E-value=4e-40, Identity=33%"; Hit description =Leucine-rich repeat
  Pfam annotation: Domain name=LRR_1; Domain location=118-146; Score =10.1; E_value=3.7; Accession=PF00560.23; Description=Leucine Rich Repeat
  Pfam annotation: Domain name=LRR_1; Domain location=16-38; Score =20.1; E_value=0.0081; Accession=PF00560.23; Description=Leucine Rich Repeat
  Pfam annotation: Domain name=LRR_1; Domain location=166-189; Score =15.4; E_value=0.2; Accession=PF00560.23; Description=Leucine Rich Repeat
  Pfam annotation: Domain name=LRR_1; Domain location=191-214; Score =6.3; E_value=19; Accession=PF00560.23; Description=Leucine Rich Repeat
  Pfam annotation: Domain name=LRR_1; Domain location=40-62; Score =12.6; E_value=1.2; Accession=PF00560.23; Description=Leucine Rich Repeat
  Pfam annotation: Domain name=LRR_1; Domain location=69-91; Score=7.9; E_value=9.4; Accession=PF00560.23; Description=Leucine Rich Repeat
  Pfam annotation: Domain name=LRR_1; Domain location=93-116; Score =13.4; E_value=0.81; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=118-146::16-38::166-189::191- 214::40-62::69-91::93-116
MLEGPIPDGFGKVMNSLEVLYLSGNKLQGEIPSFFGNMYALQSLDLSKNKLNGEISSLFQNSSWCNRDIFKRLDLSYNRLTGMLPKSIGLLSELEDLNLAGNSLEGDVTESHLSNFSKLQSLYLSENSLSLKLVPSWVPPFQLSSLGLRSCKSGPSFPSWLKTQSSLYELDISDNGINDSVPDWFWNNLQYMRYLNMSFNYLIGAIPDISLKLPMRPSIILNSNQFE

SEQ ID NO: 155194 - protein, 109 aa, Glycine max
  Coding DNA Sequence Number=SeqID_38416
MWVLSMKKSNLILKLLLIPWLFKCVIDHPPSRAYVCMLEAELAKTREFLAQALKDRAHDEKRACKCWKPPRPPTPPSRPIHLLSDFDYSGDEFLRKLDEEVAKQKEEKK

SEQ ID NO: 155195 - protein, 338 aa, Glycine max
  Coding DNA Sequence Number=SeqID_38417
  Gene Ontology: Mol. function=protein binding; Cellular component =integral to membrane; Biological process=xylan catabolic process
  Homolog annotation: Hit_ID=Q1T435; Match level="QueryCoverage=99%, HitCoverage=33%, E-value=4e-62, Identity=43%"; Hit description =Leucine-rich repeat; Leucine-rich repeat, cysteine-containing type
  Pfam annotation: Domain name=LRR_1; Domain location=151-173; Score =13.0; E_value=1; Accession=PF00560.23; Description=Leucine Rich Repeat
  Pfam annotation: Domain name=LRR_1; Domain location=175-197; Score =16.9; E_value=0.071; Accession=PF00560.23; Description=Leucine Rich Repeat
  Pfam annotation: Domain name=LRR_1; Domain location=199-221; Score =18.3; E_value=0.029; Accession=PF00560.23; Description=Leucine Rich Repeat
  Pfam annotation: Domain name=LRR_1; Domain location=223-244; Score =10.2; E_value=3.5; Accession=PF00560.23; Description=Leucine Rich Repeat
  Pfam annotation: Domain name=LRR_1; Domain location=24-46; Score =11.2; E_value=2.3; Accession=PF00560.23; Description=Leucine Rich Repeat
  Pfam annotation: Domain name=LRR_1; Domain location=49-71; Score =13.2; E_value=0.97; Accession=PF00560.23; Description=Leucine Rich Repeat
  Pfam annotation: Domain name=LRR_1; Domain location=73-95; Score =14.1; E_value=0.51; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=151-173::175-197::199 -221::223-244::24-46::49-71::73-95
MKALVLRNNGLMGELPSSLKNCSSLFMLDLSENMLSGPIPSWIGESMHQLIILNMRGNHLSGNLPIHLCYLNRIQLLDLSRNNLSSGIPSCLKNLTAMSEQTINSSDTMSDIYRNGKTYVVFNGYIFGGYTLDITWMWKGVERGFKDPELELKSIDLSCNNLMGEIPKEVGYLLGLVSLNLSRNNLSGEIPSRIGNLGSLESLDLSRNHISGRIPSSLSEIDDLGKLDLSHNSLSGRIPSGRHFETFEASSFEGNIDLCGEQLNKTCPGVGDQTTEEGQEPPVKGDDSVFYEGLYMSLGIGYFTGFWGLLGPLLLWRPWRIAYTRFLNRLTDYVYVCL

SEQ ID NO: 155196 - protein, 109 aa, Glycine max
  Coding DNA Sequence Number=SeqID_38418
MALWKFEWIKDIIHLTHSSVHIINKKGQAWLNPIMYNEVEEMSHVNEVIEVESISGLQDLIGGVEEVDPANLLTNEGESNNLNEESNNFEEENEGELEYDFEVYNSEED

SEQ ID NO: 155197 - protein, 54 aa, Glycine max
  Coding DNA Sequence Number=SeqID_38419
MSGAKVLPQQQWEQNSVHNAKGAAYNKALEDAIAVLIKIAMRIDSWDCNFFLLN

SEQ ID NO: 155198 - protein, 270 aa, Glycine max
  Coding DNA Sequence Number=SeqID_38420
  Gene Ontology: Mol. function=RNA-directed DNA polymerase activity; Cellular component=nucleus; Biological process=RNA-dependent DNA replication
MTKQRRNTIHTLMLDLGTWCCDVVVLKDEAKNVDACHSLTTEVTLEEVRRAIMSIKAYKSLGLDGFQPFFFKMYWEIMKKDFWDLVHDTFKNGFYEDKIVETLIVLVPKIDHPKHFKDFKPISLCNVIYKIITKVIVQRLRPFLDELISPLYGSFIPSHGTIENAIVAQEIIYFMNHSKAKKGNVAFKTDLEKAYHRVSWDYLKKVLHDFGFPQATISLIMWCTRASSLFVLWNGARTNFFKPTKGLRKEDPLSPYLFVIYIEKLSIYIQ

SEQ ID NO: 155199 - protein, 216 aa, Glycine max
  Coding DNA Sequence Number=SeqID_38421
  Gene Ontology: Mol. function=ribonuclease H activity; Biological process=RNA-dependent DNA replication
  Homolog annotation: Hit_ID=Q1S4N4; Match level="QueryCoverage=58%, HitCoverage=35%, E-value=1e-15, Identity=36%"; Hit description =Ribonuclease H
MAYPANNGGSQQAPLIIPKWFLPSENQFKLNEDGSFLSSSKDIGFGGVVRNHDRQWISGFFAYDGKGDCLKVEILAIMHGLTLACEKTLNLLTCETNNKELAYILESWRVLQHHPHAAPIFHILDMLDRCWIMDATHLLANQGVHQLTCWLTDENMTKSKGKDPLEGLGGPMTRARARKAKETLQQVLSILFEYKPKFQGEKSKVVSCIMAQMEED

SEQ ID NO: 155200 - protein, 338 aa, Glycine max
  Coding DNA Sequence Number=SeqID_38422
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=86%, HitCoverage=86%, E-value=5e-27, Identity=34%"; Hit description=CAMP response element binding (CREB) protein
  Pfam annotation: Domain name=bZIP_1; Domain location=267-331; Score =25.0; E_value=0.00026; Accession=PF00170.11; Description=bZIP transcription factor
  Pfam annotation: Domain name=bZIP_2; Domain location=268-323; Score =21.7; E_value=0.0026; Accession=PF07716.5; Description=Basic region leucine zipper
  Pfam module annotation: Pfam domain module=bZIP_1::bZIP_2; Domain location=267-331::268-323
MARRSVGMVSPSRTQGLQYPPMVRQGSYYSLLTLDDEVQSHYQLGNTGKPLHSMNLDELHKNVISADQSGQLLQDPSSDHNNSFILGSNGSLNNDTLSNKTNNDSISESWRKFVLEEQVSRSMDTPLKQQPSLGENLENFLARAGVINVGDHQDHNVNVVIGGDTHHQALMGMDPMVMHSQQEHWLQMQIPAAINIHQHQEQQHHHQQMNFGGCQDFSVPKSLFYENQVMEIGYSENSAGISSMSPAYSDSKSAVFGKNKYSDEVLERTIERRQKRMAKNRESAGRSRAKKQEHINRLEKEKCRLQKMNSQLKKLKMTKLNLSTIRVIASDQGNMRND

SEQ ID NO: 155201 - protein, 839 aa, Glycine max
  Coding DNA Sequence Number=SeqID_38423
  Gene Ontology: Mol. function=RNA-directed DNA polymerase activity; Cellular component=chromatin; Biological process=chromatin assembly or disassembly
  Pfam annotation: Domain name=RVP_2; Domain location=13-130; Score= -64.4; E_value=0.1; Accession=PF08284.2; Description=Retroviral aspartyl protease
  Pfam annotation: Domain name=rve; Domain location=623-779; Score =102.6; E_value=1.1e-27; Accession=PF00665.16; Description=Integrase core domain
  Pfam annotation: Domain name=zf-H2C2; Domain location=567-605; Score =14.7; E_value=0.004; Accession=PF09337.1; Description=His(2)-Cys(2) zinc finger
  Pfam module annotation: Pfam domain module=RVP_2::RVT_1::rve::zf -H2C2; Domain location=13-130::242-405::623-779::567-605
MKLCFHICLVGNIVGNPILVLIDGGSTHNFIQEQLVAQLGLPCHTTTPLWVMVGNGQHLECHTTCEAITIDLQNQSFIVDFYVLPIARANAILGVQWLRSLGPVLTDYTNLRMQFFYDGRLVELQGDPEAHRSMLSSPQLWRLCRHQQNLCFHITVLPKEPEHKFPDNIHPAVHHLLHQFSALFQDPNTLPPARDTDHNIHLLPQATPVNVRPYKYPYYQKREIKTQVEAMLQKGIIQPSTSPFSSPVLLVKKSDGTWRFCVDYRALNALTIKDRFPIPTIDELLDELGGARCFSKLDLLQGYHQIRMQPPNIPKTAFRTHLGHFEFKVMPFGICNAPSSFQETMNSIFRPYLRRFVIVFFDDILIYSVSLSDHLHHLQTTFQATTIEPFQWSLATQAAFDSLKQALTFAPVLALPDFSFPFTVETDASAIGMEAVLSQRGHPIAFFSKAFSPKMLRASTYVRELFAITTAVVQTPEEHTYLARLLGYDYNIQYRSGTHNQAADALSKLLKTDSQACLILFIPCLTFMTELHSQLHSNSTFQQQMKKVQDHPDQFHDFSIANKLLLYKGGHTGIAKTVAHLMHNFYWPDLRDDVSHFVTNCVDCQVTKYETKKSAGLLCPLPVPSRPWEYLSLDFIGGLPPYRGNSVLLVVVDRFSKGIHLGMLPQSHFTLTVAKLFLDMVVKIHDIPRSLVSDRDPLFISHLWQELFRSNGTQLRMSSAYHPQSDGQTEVLNRVIEQYLRAFVHQKPTSWGRLLPWIEWSHNTSWMANTGTSPYEITFGRKPFNIPNYVTGSSKVAAVEDLLSEREATFQIIKKKLVKAQERMKHYADQHRRDIQYAI

SEQ ID NO: 155202 - protein, 58 aa, Glycine max
  Coding DNA Sequence Number=SeqID_38424
MREARRSRAASMRSLPESAMGAGRTMKAPVIGSGIRGPVPPESRISKRKREEERVRWT

SEQ ID NO: 155203 - protein, 284 aa, Glycine max
  Coding DNA Sequence Number=SeqID_38425
MVSYRVSDFETFWAGPCLVRHTRSSDHWKKWRWLAAVMLAGDNGRQHTAGRARSTRFDTNNEYPLFIPRQNYCSTDGENSWSERSSSNFGVASVESERRHRLDSSGSTSFNYSLASSHSVQTHKDLQKGISLLKKSVVCITAYCYNSLCLDVPSEASTFEAFAKLLATLASSKEVRSVFSLKMARSRTCKQVQQLNKSVWNMNSAISSTTLLESAHSVPTTRIENYLPSSTGSFLYAADLSDGKNECLIEGWDIVEHPTFPPPPSQSEDVEHWTRAMFIDAKGK

SEQ ID NO: 155204 - protein, 374 aa, Glycine max
  Coding DNA Sequence Number=SeqID_38426
  Gene Ontology: Mol. function=sequence-specific DNA binding; Cellular component=nucleus; Biological process=regulation of transcription, DNA-dependent
  Homolog annotation: Hit_ID=Q93WT0; Match level="QueryCoverage=82%, HitCoverage=61%, E-value=8e-71, Identity=49%"; Hit description =Probable WRKY transcription factor 31
  Pfam annotation: Domain name=WRKY; Domain location=302-349; Score =70.4; E_value=5.6e-18; Accession=PF03106.6; Description=WRKY DNA -binding domain
  Subcellular localization annotation: CTP_CleavageSite=39; ConfidenceScore=5.25e-01
MDKGWGLTLDTSSSQSLPLFPSNDNKMFPLLGFPVNLSRASKEDDENRKVVGEVDFFSDRNKPTPPPSHDHNVKPNIVKKEIDETPLHINTGLQLLTANTGSDQSTVDDGVSSDAENKRAKTTELAQLQVELQRMNSENKKLKEMLSHVTGNYTALQMHLVTLMQQNQQRTGSTENEVVQGKVEDKNVGVGGGKVPRQFLDIGPSGTAEVDDQVSDSSSDERTRSSTPQNHNIEAGARDGARNNNGKSQLGREESPDSESQGWSPNKLQKMNPSNPMDQSTAEATMRKARVSVRARSEAPMISDGCQWRKYGQKMAKGNPCPRAYYRCTMAVGCPVRKQARITIHCHLLLWPWHQPLQLLLACCFLDQCPVQME

SEQ ID NO: 155205 - protein, 505 aa, Glycine max
  Coding DNA Sequence Number=SeqID_38427
  Gene Ontology: Mol. function=glycerol-3-phosphate O-acyltransferase activity; Cellular component=integral to membrane; Biological process=phospholipid biosynthetic process
  Homolog annotation: Hit_ID=Q9FZ22; Match level="QueryCoverage=94%, HitCoverage=90%, E-value=1e-132, Identity=51%"; Hit description =Probable glycerol-3-phosphate acyltransferase 2
  Pfam annotation: Domain name=Acyltransferase; Domain location=298 -409; Score=28.0; E_value=1.3e-05; Accession=PF01553.11; Description =Acyltransferase
  Subcellular localization annotation: CTP_CleavageSite=12; ConfidenceScore=5.15e-01
MNPNYSKMRTISLVQKKAKPGNNETLVFNFEGTLLRSTSLFPYFMLVAFEAGGVLRSLILFLSYPLVWLVGENQLGLKIMVFLSFFGLRKDTFRTGSAVLAKFFLEDVGLEGFEAVICCERKVASSKLPRVMVENFLKDYLGVDAVIARELKSFSGFFLGVFESKKPIKIPSYKVNGGTKEGNINNNNSIGIIDNHVEYIDQEELFQQFKEFYITDERRNWHVLPRERYPKPLIFHDGRLAFRPTLASSVALFIWLPFGLFLSLFRFTIGIALPLNVSAPILALSGTRTTVSRPQSTLSLVHYEENQKGMLYVCNHRTLLDPLYVAIVLGKPLSAVTYSLSRLSEIVSPIRTIRLTRDREKDREIMDKMLSLGNLVVCPEGTTCREPYLLRFSPLFSELTDNIVPVAVDVKVSMFYGTTASGYKCLDPFFHFLNPNPTYFIKFLGMLPQSQTCQAGGKSKIEVANFVQNEICNALGFACTNLTRKDKYLVLAGNEGVSPSNDCNR

SEQ ID NO: 155206 - protein, 80 aa, Glycine max
  Coding DNA Sequence Number=SeqID_38428
  Subcellular localization annotation: CTP_CleavageSite=14; ConfidenceScore=5.23e-01
MEPIRTVWRTLSVRNTALARKNGPSFVSLAETLLGRMCAKRHRPSRSRTLPPTFCLVGVMIIWKQKLLAEKTKKKLEEAA

SEQ ID NO: 155207 - protein, 81 aa, Glycine max
  Coding DNA Sequence Number=SeqID_38429
MASKVRLLLVQPISQCIWGTKIRCIVHGYHISFDLDNLIFVEPNDDAQSEEDLDDDNGDGDDDESDDIHGDDPIRGLDMLL

SEQ ID NO: 155208 - protein, 507 aa, Glycine max
  Coding DNA Sequence Number=SeqID_38430
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=99%, HitCoverage=100%, E-value=0.0, Identity=74%"; Hit description =Aspartic proteinase 1
  Pfam annotation: Domain name=Asp; Domain location=82-506; Score =534.7; E_value=1e-157; Accession=PF00026.14; Description=Eukaryotic aspartyl protease
  Pfam annotation: Domain name=SapB_1; Domain location=378-416; Score =67.1; E_value=5.6e-17; Accession=PF05184.5; Description=Saposin-like type B, region 1
  Pfam annotation: Domain name=SapB_2; Domain location=315-349; Score =58.5; E_value=2.2e-14; Accession=PF03489.7; Description=Saposin-like type B, region 2
  Pfam module annotation: Pfam domain module=Asp::SapB_1::SapB_2; Domain location=82-506::378-416::315-349
MGNMPNVVVLCFCLWTLLFPLVFCAPNDGLRRIGLKKVKLDTDDVVGFKEFRSSIRKHHLQNILGGAEDTDVVALKNYLDAQYYGEIAIGTPPQKFTVIFDTGSSNLWVPSSKCYFSVACFMHARYRSSQSSTYRENGTSAAIQYGTGAISGFFSNDDVKVGDIVVKDQEFIEATREPGVTFVAAKFDGILGLGFQEISVGYAVPVWYTMVEQGLVKDPVFSFWLNRKPEEENGGELVFGGADPAHYKGKHTYVPVTRKGYWQFDMGDVLISGKPTGYCTNDCSAIADSGTSLLAGPTTVITMINQAIGAAGVVSKECRSVVNQYGQTILELLLAEAKPKKICSQIGLCTFDGTHGVSMGIESVVDKNEKKSSGGIRDAGCSACEMAVIWMQNQLRQNQTEDRIIDYANELCEKLPNPMGPSSVDCGKLSSMPIVSFTIGGKVFDLSPEEYILKVGEGPEAQCISGFTALDVPPPRGPLWILGDVFMGRYHTIFDYGKLRVGFAEAA

SEQ ID NO: 155209 - protein, 435 aa, Glycine max
  Coding DNA Sequence Number=SeqID_38431
  Homolog annotation: Hit_ID=Q6H6J8; Match level="QueryCoverage=79%, HitCoverage=82%, E-value=6e-79, Identity=45%"; Hit description=F-box- like
  Subcellular localization annotation: CTP_CleavageSite=31; ConfidenceScore=5.22e-01
MGTTMVSSKFSSFSYCSSRRIAATINVPKIKVTKISTPRPPNKDLVAELNYLNNYISATSTTHAKENPCYSNISTNSSTAPRTSTPNSIEAVKLHLIMEIVAERMEMHKNIGAQRDNWNCLLTTSVNMITLSAATMVGLAAVGSSGAPIVALKVSSTILYMAATGLLVVMNKIQPSQLVEEQRNAARLFKQLHGELRTRLSVGNPSENYVNEAMEKVLALDRAYPLPLLGSMLEKFPQTVEPAVWWPRQKQRCVRKEEFGGIGNLKGKNGWDASLEDEMKKVVMVLRKKDMEDYLRLAKGVLNFNKVLAVSGPLLTGLAALGSVFLGSVNASWPAMLGVIGGASASVVNTLEHGGQVGMAFEMYRTTTGFFKLMEESIELNINEQDPHKRENGELFEIKVALQLSRSLSELRQFTASISSSYKENDCEEFASKLF

SEQ ID NO: 155210 - protein, 136 aa, Glycine max
  Coding DNA Sequence Number=SeqID_38432
  Gene Ontology: Mol. function=protein serine/threonine kinase activity; Biological process=protein amino acid phosphorylation
  Homolog annotation: Hit_ID=Q9FLQ2; Match level="QueryCoverage=56%, HitCoverage=17%, E-value=3e-15, Identity=47%"; Hit description =Similarity to NPK1-related protein kinase
MITWKPPWHGSVDPAAVVYRIGFFGEEPEIPSYVSEQGRDFLGKCLKRDPSERWSVEELLGHGFWDSLETAPHEARDCPSLRDRIRRLFSNEPVCAWNDDEWVTVRGNEVHDMQLEGEGLSFTKRTPLFVMKRMFW

SEQ ID NO: 155211 - protein, 85 aa, Glycine max
  Coding DNA Sequence Number=SeqID_38433
MTQHKKKQMMIRAVPRERSTTDLIPEGYKVLIANSPIQTNVNSNGSQVQPELSANDMRGGSINSCQTPDIGDKRKSGIEGNELHL

SEQ ID NO: 155212 - protein, 231 aa, Glycine max
  Coding DNA Sequence Number=SeqID_38434
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=95%, HitCoverage=23%, E-value=2e-75, Identity=59%"; Hit description =Glutamate receptor 3.4 precursor
MQRLKTKETPSFNSYALYAYETVWLVARALDAFVKKGSVVSFSFDPKLLETNGSMLHLHSLHVFDDGPLFLETILSTNFSGLTGTTHFDIERNRNHPAYDMLNIGRCGMRKIGYWSNYSGLSVVTPEILYKKPANTSTSSHQLYGVIWPGETATKPRGWVFPNNGKPLRIAVPNRVSYKEFVSKDNNPPGVTGYCIVLEAAIKLVPYPIPREYILFRPGNINPSYDDLASQ

SEQ ID NO: 155213 - protein, 119 aa, Glycine max
  Coding DNA Sequence Number=SeqID_38435
  Homolog annotation: Hit_ID=Q1S2I1; Match level="QueryCoverage=43%, HitCoverage=14%, E-value=3e-18, Identity=85%"; Hit description=C2
MVRQPLFPMEAFFTFTHLLLCGRNPTAGHVQNNQLNPVWNEHFEFIIEDASMQHLNLVKSRTCGLTWLRIWRSIEITNTGVRLLHVNQIITKEVGDGTQVQVVAEACSIRALGKKKMSM

SEQ ID NO: 155214 - protein, 289 aa, Glycine max
  Coding DNA Sequence Number=SeqID_38436
  Gene Ontology: Mol. function=protein serine/threonine kinase activity; Biological process=protein amino acid phosphorylation
MAFMMQDEIGCLCLLSVMSKIIVLLLVKSSFWTDCLLSSRKFDEELDAVMLAAQALVYNLKKLNGLNRYVNQDGVDNLQMASLLALFVSDHFGGTGSSTSISSPTEPVANTIEDITLSKMGYLHFSPHAWNIILIKRGATWVQMLIDACRPLDIREEKDPEYFCRGLLKHRVLRSAIFMEYVEGGSLKNYLEKLSEAGEKHVPVELALLLPKMSHRDDGTPTVKLCHFDSAVPLRSTLHVFCIAHAGTRPPCICVGTPRWMALEIDTDIRLIQYLEKGEDKVSLGHSPR

SEQ ID NO: 155215 - protein, 129 aa, Glycine max
  Coding DNA Sequence Number=SeqID_38437
  Homolog annotation: Hit_ID=Q9SK32; Match level="QueryCoverage=71%, HitCoverage=18%, E-value=5e-10, Identity=39%"; Hit description =Expressed protein
  Pfam annotation: Domain name=DUF1723; Domain location=19-68; Score =25.6; E_value=0.00017; Accession=PF08330.1; Description=Protein of unknown function (DUF1723)
MQEASAHGNKEMHEPNLLRKNRKRQMKLMNADENPKLTFHFPHGETTITLQDVALQLGLKIDKLSVIGAITGDVRVACQTLPSDTPPDKYIKGKMIHLTWLRQNFRQLPIDANDVVIAQHARAHIMMLI

SEQ ID NO: 155216 - protein, 103 aa, Glycine max
  Coding DNA Sequence Number=SeqID_38438
  Gene Ontology: Mol. function=transcription regulator activity; Cellular component=nucleus; Biological process=regulation of transcription
  Homolog annotation: Hit_ID=Q1PF17; Match level="QueryCoverage=88%, HitCoverage=31%, E-value=9e-12, Identity=41%"; Hit description=Basic helix-loop-helix family protein
MKFSFSAEDGTKTFPHVEARVSAKDVLIRVICDKEIDIVTKLLSKLAAHNLSIVCSNVVPFGNSTLKISMIAKVDREFNMAMDDLVKKLNEDLLKCCNLQQEY

SEQ ID NO: 155217 - protein, 237 aa, Glycine max
  Coding DNA Sequence Number=SeqID_38439
  Gene Ontology: Mol. function=RNA-directed DNA polymerase activity; Biological process=RNA-dependent DNA replication
MRRALTHQVAHQLSESGSNRKRLPNSTHDNQHIFSRFRPSSSLRGLRYGWTFIGGVEGRKVIWWSMAHYGGRWKGVWKSCWNWLRSALMAEIRWKVTIKGWPWRHVKRGSRLGEKVEELGDSRLEEVVGAAAINEDSEAFMADNTEEAKGLNDGRPESAWRLICSKGPSHGGGPFHLGFFGRIKAWVLGLGECGGSTVKAGLCRFVMIHILQEKVLRLILSPTLEKVLQCAKVSKVY

SEQ ID NO: 155218 - protein, 157 aa, Glycine max
  Coding DNA Sequence Number=SeqID_38440
  Gene Ontology: Mol. function=RNA-directed DNA polymerase activity; Cellular component=chromatin; Biological process=chromatin assembly or disassembly
MVQWPPPTLAKELRAFLGLTGFNHKIIKNYAAIATPLTSLLCKDAFEWTSTSQTTFDQLKITMTSALVLALPNFAKSFVVEIDAFDTAMGAVLMQHGHPVIFFSKSFGPKLLCASTYVIQMLEQHYYLSKQLGFNYTIQYKSDASNAVADALSRTPP

SEQ ID NO: 155219 - protein, 56 aa, Glycine max
  Coding DNA Sequence Number=SeqID_38441
MARGPSFKGEYDAHKQNTKLLVAIEPMVVKAEEGDNDMKKKEEILSVGYPEKIVAH

SEQ ID NO: 155220 - protein, 444 aa, Glycine max
  Coding DNA Sequence Number=SeqID_38442
  Homolog annotation: Hit_ID=Q6H6J8; Match level="QueryCoverage=81%, HitCoverage=81%, E-value=1e-51, Identity=35%"; Hit description=F-box- like
  Subcellular localization annotation: CTP_CleavageSite=55; ConfidenceScore=5.10e-01
MASIQTSTLLSHTSMSSKKIHAAIHVPKKLSRVDVSAPKLRTIKQAEELKPKDTSLMLEKKSFNSTISHDIGEQQHSTNPNALIQLYAILEAVADRVEMHDNIGEQRDNWNTLLFNSINMITLTATTMAGVAATCGAGAPLLALKLSSALLFSAATGMSLIMNKIQPSQLTEEQRNASRLFRNLQSEIETTLALGNNPTEEDVKGAMEKVLALDKAFPLPLLGAMLEKFPKKFEPAVWWPSKPYEGKGKSESAVHLKEVNTGETYPWTPTQRMGKMNGWSEELEMELREVVEVVKRKDSEDYERLGNMVLKVNKTLAIAGPLLTGIAAAGTAFIGNNGSWGALVPLMAGSLASAVNSFEHGGQVGMVFEMYRASGGFFKMLETSLESTLEEEDLERRENGELFEMKMALKLGRSVSQLRELASKSTSYRMEGVLDIDEFASKLF

SEQ ID NO: 155221 - protein, 108 aa, Glycine max
  Coding DNA Sequence Number=SeqID_38443
MEKLPNNKVFSPPLAWRAHYKAKNKIEMECLGVVFSSHLCCMCPLVSLSLLALKTFEFLRLRMRAQRACLAEQELVTKRLTNVDALSVRSDKGFAERADFLAKQISLA

SEQ ID NO: 155222 - protein, 417 aa, Glycine max
  Coding DNA Sequence Number=SeqID_38444
  Homolog annotation: Hit_ID=Q6H6J8; Match level="QueryCoverage=81%, HitCoverage=80%, E-value=6e-63, Identity=41%"; Hit description=F-box- like
  Subcellular localization annotation: CTP_CleavageSite=35; ConfidenceScore=5.38e-01
MASLQISSLLSNTFCSTSSSRIKSFIHIPKKLPIPFSTAPNPKPSRKLFEELNGFSHTIPILQDNSCNNNTTSNATIKLYAIVEAVADRVEMHHNIGEQRDNWNTLLLNSINMLTLTAAAMAGVAATIATGDAPLLALKLSSTLLFSASTGMLMVMNKIQPSQLAEEQRNATRLFKQLKSHIETILAIGNPTEEDVKDSMEKVLALDKAYPLPLLGAMIEKFPKKFEPAMWWPSKRNNSKYHETNKQHGMNNGWNEGLEIELRDVLKVVKENDMKDYERLGNLVLKINKSLAIAGPLFTGVAAVGSACLSQDSSWGAIVAVLGGALATTVNAFEHGGQVGMVSEMYRNCGGFFQLLENSIQETMEEDEEQRENGELFEMKLALKLGRSLSQLRDLARKSAYSRVEGTTTDEFASKLF

SEQ ID NO: 155223 - protein, 216 aa, Glycine max
  Coding DNA Sequence Number=SeqID_38445
  Homolog annotation: Hit_ID=Q2QZQ0; Match level="QueryCoverage=70%, HitCoverage=17%, E-value=1e-07, Identity=30%"; Hit description =Ribonucleases P/MRP protein subunit POP1 containing protein, expressed
MAYFSSWHYNISENYWQLKKHVPIEEESVSQIRNSSILRNEDYFSSCAMLSLNVKDPRELPWKKTVVPVESISTKTPSDAQEKKYKEVAELGGILEENRDLSSLSRSKLVDSQFDIDGSMTRGLRPPVEDSYLSKEKHHERMVNFCLDDIHSGEVNSTTTVQCSRCCPILLLKNDMKELTIGVQGSGFRVRGFGVRGSGFGVQGSGFRVQGSGFRV

SEQ ID NO: 155224 - protein, 179 aa, Glycine max
  Coding DNA Sequence Number=SeqID_38446
  Homolog annotation: Hit_ID=Q1T493; Match level="QueryCoverage=81%, HitCoverage=29%, E-value=2e-13, Identity=28%"; Hit description =Nucleic acid-binding, OB-fold, subgroup
VVAGQFERGLLVDVIGVVEEVVFRQVSGKGRRVVFKLKDLSQQLLSCTLWDDYCLQFLKFLDDYEGSYPASINNFFKASKLIINQPVMEIQEFNERYFLLAELGIDARLGFKSHGEGSTQLSGSMQLSSKESFFGKAEAKTIADINTISKEIVCVTVGTITRIVLDNHSWCYTACIQCH

SEQ ID NO: 155225 - protein, 257 aa, Glycine max
  Coding DNA Sequence Number=SeqID_38447
  Gene Ontology: Mol. function=ligase activity, forming aminoacyl-tRNA and related compounds; Cellular component=aminoacyl-tRNA synthetase multienzyme complex; Biological process=glutamyl-tRNA aminoacylation
  Homolog annotation: Hit_ID=P27305; Match level="QueryCoverage=96%, HitCoverage=91%, E-value=1e-104, Identity=74%"; Hit description =Glutamyl-Q tRNA(Asp) synthetase
  Pfam annotation: Domain name=tRNA-synt_1c; Domain location=7-257; Score=33.7; E_value=5.3e-16; Accession=PF00749.11; Description=tRNA synthetases class I (E and Q), catalytic domain
MMSATLPCIGRFAPSPSGDLHFGSLIAALGSYLSARAQQGRWLVRIEDIDPPREVAGAATRILRQLTHYGLHWDGDVLWQSQRHEAYRAALSWLREHRQSYFCTCPRSRIQQLGGFYDGHCRDLHLQPEGAALRLRQHAPVYGFDDRLRGHLQAEPRLAQEDFIIHRRDGLFAYNLAVVVDDHFQGVTEIVRGADLIEPTVRQIALYQQFGWPVPAYLHLPLAINPDGAELPRAVGFAGLAGPWAGGAAGPCRYTLG

SEQ ID NO: 155226 - protein, 92 aa, Glycine max
  Coding DNA Sequence Number=SeqID_38448
MDGLVDQVAIDASLAYHHSKESPIVAVLVDAYDTFDQSCKKSSAKIVCCSPTLYVWLVSHIFCHESRPVYPYKVTACALRKGKQIGRSSWLV

SEQ ID NO: 155227 - protein, 158 aa, Glycine max
  Coding DNA Sequence Number=SeqID_38449
  Gene Ontology: Mol. function=RNA-directed DNA polymerase activity; Cellular component=intracellular; Biological process=RNA-dependent DNA replication
MVKKANGKWHMFIDYINFNKACPKDAYPLPNIDRLVDGASSFQLLIFLDAYSRYNQIKMQPSDEEKTTFIIEDANFCYRIMPFGLKNAGATYQRLMDWVFKQCVGQKVEFYIYNMVVKSHSVAQHVANLEEVFREVHKYDYSGKLSHSYGMKLVSKLS

SEQ ID NO: 155228 - protein, 117 aa, Glycine max
  Coding DNA Sequence Number=SeqID_38450
  Subcellular localization annotation: CTP_CleavageSite=36; ConfidenceScore=5.78e-01
MASPPASPPPPPPPSPPPHPPSSDASASPSTVKRTRKASLVNVDPATGKVDGPPRKKLRTYWGIVARDKVDVMQNLKSQRLLKVGRRRSYFRLSTRDGGGSNQTSQGNGPLQPIRTV

SEQ ID NO: 155229 - protein, 1132 aa, Glycine max
  Coding DNA Sequence Number=SeqID_38451
  Subcellular localization annotation: CTP_CleavageSite=47; ConfidenceScore=5.00e-01
VNPVPGNLSKGCMASLITDFNIIKHFVVVTLLSLLRSPKSLRACLLRVGLKETQMGLLEACQAPQLGQAVSWLKLIDCLSALKRKVLSNHVYTSEDGNSLWIMGFRPEQRMATNFVSPFDQNLLRLVGGAKLNRCCEVEHPKVANAIAVLAEAVTSNYQLSSKVDDVFAKLISIRMDCDKVFKRHKDLLKEKNDLASKLRELELTVSSLQTKLKDSKLMATKEKEQAMFFTEGLDLGLFDPFKDVKVGQFLDKEEIIDGAIFPYLTNLYEIKNKMASDHLEFNFNLVEETHQGWNLGLTSLWRFDQGCVRPEFGETHQGQTLGLTSLWRFDQGRVDLEFGKTHQGQTLGLTGMRFTMGALVDHVGEMFFLLGASHMSLQLIMAGLQFSEFLLMATFHLCSVGGFEFSGSGSRRRPEHVLTMSAGRERHMLVARALNCVNDRVEGSMEPALSQLVGERDCPMSKEIVPCRKNLSDVRGSSLENPRVWTSVVWAAFVTLPVMDTCVQCTHNTLVYVSLTNWALTRVVVRAWVGVLPSSTMSSFLSDSAIGMGGASDRKSSSSEKVRASRRTGGELVPVIVILPPSAFGVVRRGSGGDVRESPRVRLSNSVGSPSSIPIIAGYEWVRDNVLKYKSSLTSASSVAALHYQVKLASPEDSCKIMFEVLGLILPLTVFQCALLEHLNVASSQLHLKSWPMLTGEIGWVSLNNVSKKLFKFDSNIFHHFKDYFFNVLATGVVTDDTPLMFNRDGEPYFPFYWQFDPTRFKWYDEDLLNLVEKTDKAILEKLSTSLDAQVILSLPSVSDPLVVVDAIEALVAAPTHSPPLVVVIQKATPVATRVLVLATLDGSYVTSSSTIVSHLLSADVVTTNAPVVLPSSSSALMVPPSTILVTALPSLSSRPRVSLDHVYTSSDVDSLWGATFKPEHKTLIGFVLVFDKNLIRSTGATARTIWRVERSKVANATIAFAEALRSNLQLSSKVGGVLAKLLRTKLDGDDLFKRCKDLQVEKKDLGGKVESITTEKDELVKVVAELEARLKESESRLEEFKLQAAKEGEASKELEEELLIYKKDAMEQHEKGFNKVVKQVGFFAKDLDLGLFDPFKDVKDGVLLDEEDIPAKEAIDEEQSVVEQGGDACV

SEQ ID NO: 155230 - protein, 245 aa, Glycine max
  Coding DNA Sequence Number=SeqID_38452
  Gene Ontology: Mol. function=RNA-directed DNA polymerase activity; Biological process=RNA-dependent DNA replication
MYTKWVMYCPGFTKYKWHPTWHLKTHVNPPCQSTCKVLEPTLAMSILMYLISKFCTQSGLRREIPLEDSHPRFTTMTDTDTRQQLQNYIAEMERHHKEELRKLKADYDQLEARVRRPQGNEHSAYTLSKCTQGESHPRRIINTANDLSLSRMHHVVGRTTHRHHFVDHIIETYIPFGWKPLNLERYDGTIDSDEHLNAFLTQANLYTNNDAIPCHVSPTSLKGVTLTSLSGLPPRSIDIFDTLVE

SEQ ID NO: 155231 - protein, 508 aa, Glycine max
  Coding DNA Sequence Number=SeqID_38453
MRKGIDLENTFLLNFYLAFKDDPGLASSHVGHTVNIKGHHPSYEFRLSQNLLDGVVRHDYHLMTMEVELMASPATKRYRSGGTPGMGQLKTVSVVVVFLKLLDFLDVGWDAHLEYGSALVGVGFNTPMSSHEVEELASTYPGTCPIQISVVDAYSPFAIGFFDHDDVGEPVPTESRALPGFRSKLQLNKLFDRFWASIRGVVSRIYVEFIAQARLVDGQDSDLRPFIHTHDLSAFNRYRLRLGKLLGERIWVGNFIFKWGVETGSKLVKAPRELALIKGGHQVHVAFGFYSLFRKAEEWIDVRMDSVKGDPKSLESLPVQDISGTALINKDPGHHEVCSDDRDNHGVVLVDGVDTLEVHIRKEIIAHAAIVVVFVYLGLSLFFCLLRGSYVATLGVLQVLPNNIMCYDQYRDDSLMGTFKLKASSRIVVRLVIRVGLGVCFSLVMLLSILLDFIPESEHFFHLNVVIGLFAQLVNATVRFFPQTVGELIWADLLSTCHKLAKAVEVMQ

SEQ ID NO: 155232 - protein, 75 aa, Glycine max; identical to SEQ ID NO: 142399
  Coding DNA Sequence Number=SeqID_38454

SEQ ID NO: 155233 - protein, 112 aa, Glycine max
  Coding DNA Sequence Number=SeqID_38455
RKGLGPIEGGEDYAFANLKELFLVPNIITPPKFKVLDFDKYKGTTCPENPLKMYYRKMGAYAKDEELLMHSFQESLTGVAVTWYTNFEPSRVHSWKDIMVAFVRQCQYNGFG

SEQ ID NO: 155234 - protein, 256 aa, Glycine max
  Coding DNA Sequence Number=SeqID_38456
  Homolog annotation: Hit_ID=Q47522; Match level="QueryCoverage=16%, HitCoverage=53%, E-value=7e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLSVRHPEGGMTTMDEVDFADMVEHTPVTSYVVEYREPSPDGVTPGRLVGACLTDRQCESSLSIPSTSRGGPVPAFVPFSEVGKPVVPAALMNRPTRGERRFAYWALAECILAYYVGTDEGVSEVLHVAGEKRLH

SEQ ID NO: 155235 - protein, 132 aa, Glycine max
  Coding DNA Sequence Number=SeqID_38457
MRGAVTLLDIPGAGNAVGVYHSVWNSLETQADHHGGEGGVACARQGGLDTYCLVFLSESVVWTRLGYFLGDGTTLHLRVEVSISSFYNELTLAILYRAVDTCDDREPSSWEQNDSSRVQEVKFCCGAAEPTR

SEQ ID NO: 155236 - protein, 78 aa, Glycine max
  Coding DNA Sequence Number=SeqID_38458
MTSAKCRDKWRILHKPYHLFLPLSSNPASALGQLYQRFKKFAMNSLSEPSTLSEFIYTHCIHAFLVELAGRTCRAKRV

SEQ ID NO: 155237 - protein, 75 aa, Glycine max
  Coding DNA Sequence Number=SeqID_38459
  Gene Ontology: Mol. function=RNA-directed DNA polymerase activity; Biological process=RNA-dependent DNA replication
MEICKTHISFLGTEIANGKIRLQPHISQKILGFPDKMEDIKTLRAFLGLLNYARNFTKDLGKYTTPLYNKTSLTG

SEQ ID NO: 155238 - protein, 204 aa, Glycine max
  Coding DNA Sequence Number=SeqID_38460
  Gene Ontology: Mol. function=helicase activity; Biological process =protein amino acid phosphorylation
  Homolog annotation: Hit_ID=Q1SN45; Match level="QueryCoverage=99%, HitCoverage=12%, E-value=1e-50, Identity=51%"; Hit description=AAA ATPase
MPYPESANPASCLENSLILSELNYNNDEARSEFENHFLSMTDEQKQIYHKIMEVVNNDEGGMFFLYGYGGTGKTYIWRTLASSLRAKNQIVIMVASSGIASLLLPRGRIAHSKFKIPVPIFKDSTCNILQGSQVAELLNQTNLIIWDEAPMAHKFCFEALDQTLRDIIKEKKIPIKFLEAKLLYLVEISDKLCQSFQEEVVQTL

SEQ ID NO: 155239 - protein, 102 aa, Glycine max
  Coding DNA Sequence Number=SeqID_38461
MEFGSRKSTMKDIMTKLEYSTVRMIGLHGPGGVDKSTLIKVIAKKARDKKLCNVVVKVEITPNSNQQRIQEEIDYVLTGESNFQKRIFFKNKLKGKVEISNV

SEQ ID NO: 155240 - protein, 69 aa, Glycine max
  Coding DNA Sequence Number=SeqID_38462
  Subcellular localization annotation: CTP_CleavageSite=39; ConfidenceScore=5.03e-01
MGAKWSIWGHSSALGPTWALSYPNFVRGPLFHGMQPLVDCFEVLGTLSCTIREVPRHARNQKEALLRNP

SEQ ID NO: 155241 - protein, 45 aa, Glycine max
  Coding DNA Sequence Number=SeqID_38463
MHTKRKLQVTFVSVVLLLGLGLGYESWTLLIIGVSPYPTLTPLQH

SEQ ID NO: 155242 - protein, 81 aa, Glycine max
  Coding DNA Sequence Number=SeqID_38464
MYASDKFRGWAKPVRQPQRRLNPVILDVVKKKVTKLLQAGIIYPIFDSQWIKQVNNTRELLTQFGATSPTSGGYQAREEIH

SEQ ID NO: 155243 - protein, 48 aa, Glycine max
  Coding DNA Sequence Number=SeqID_38465
MRKNPEEDELLGSLSAPLQVIKRTASAHLLSEISALSQKSLTCAKRSI

SEQ ID NO: 155244 - protein, 97 aa, Glycine max
  Coding DNA Sequence Number=SeqID_38466
GLWDLTLNVTHLHGLIDFAYQLCKRVKLICDLHSLDVKQPPYWGNPLTHFPLPVRGVLYIYLKDMDRSTAAGEEKQMGNNKLDLKERKNKKSKLDVQ

SEQ ID NO: 155245 - protein, 59 aa, Glycine max
  Coding DNA Sequence Number=SeqID_38467
MTTFKVCNKPFTILREKLPKIITHKWKFGNLLEAPNTLPMKGLLLQYLKAMKELMKHWA

SEQ ID NO: 155246 - protein, 79 aa, Glycine max
  Coding DNA Sequence Number=SeqID_38468
  Subcellular localization annotation: CTP_CleavageSite=41; ConfidenceScore=5.16e-01
MAESSKKRKRSSSTTTAAGHRHHRPSEAPTTPIHPSLSSPRSSTLFSSDDQHLGQGASFEGTIVDDWKFHYSSHDARRM

SEQ ID NO: 155247 - protein, 122 aa, Glycine max
  Coding DNA Sequence Number=SeqID_38469
MVLKGETHVSLIDLVNIEGVATYPSAGGRRGAHRCIFQERKARGVVTNVYLRKTSEKPERCGLRTLIVKGSGVVFTHGEVVDKGVSLAPTYSSIVMRKSNLRSSLRTKRWLSCFDLFPRDRF

SEQ ID NO: 155248 - protein, 157 aa, Glycine max
  Coding DNA Sequence Number=SeqID_38470
  Gene Ontology: Mol. function=aspartic-type endopeptidase activity; Cellular component=intracellular; Biological process=proteolysis
MVEVVKINEILINGGATIDILPIIMLKRFGKTLEDPISNNIVVSDYSGKASRSQGMTTLDLIVGSRRRPTFFIVISSQVSINMLLGREWIHGIGAVPSTIHLKLFIWNEKGGLQVVNSNQKSYDSFYVSIAKKHERTMALTTPFEIEDSYYVNQREA

SEQ ID NO: 155249 - protein, 304 aa, Glycine max
  Coding DNA Sequence Number=SeqID_38471
MTHVELFGKFREYERELTRMAEEEDIDKINRGLALKTSIPSSNESEDDNAEGLDAENLNLLMIRFNKFLKKKKNYGNKTFQPKKNLKKVEPFSSNKHTCFECKKIGYIKVGYPIYQKKQQRDKKNKGSFKKKKKVYVALDDDESTTSSNNSEEDQAKSCLMANNEAESEVTISDSKNGDNYDKLLDAFNEMHQEAQKLAISNYLLKGKLRWHVDKLVEIQKELLEEKAKDGILEKEKNNSSCNCTKTTNVTSPCEGYNVLEVKVEYLLKTLSKLTMGRYNLEALLAQLLDFWQAYPLSSQLIDL

SEQ ID NO: 155250 - protein, 298 aa, Glycine max
  Coding DNA Sequence Number=SeqID_38472
RKEGGGCHPARPSELGCFHQKAPPSFGTLRKAQNVAKLYGLCNDACFMGSEGSKQGSRTDRKYSQIKLGYERRKMKARYYTQIHEPELVRMEAADLNFFIHEKIVNKHLSDMSQLAEKGKLNIAKLKLGPSHTCQMLKPEESQNKFSNAKYSFDVSKESKIFNILLQNKKIVSSKGHKILQVEQRKDTLPEFLIRNENAKGKLLCPRCTVVFGKVATKSLEKFEYVRKSHEDAAHKELDKGKQQISMFVNKIQNPANFYQGKSNFVPQLECLQIDGSTMRQVKEETWVGILEEKVLLV

SEQ ID NO: 155251 - protein, 737 aa, Glycine max
  Coding DNA Sequence Number=SeqID_38473
  Homolog annotation: Hit_ID=P45951; Match level="QueryCoverage=35%, HitCoverage=50%, E-value=3e-49, Identity=42%"; Hit description =Apurinic endonuclease-redox protein (DNA-(apurinic or apyrimidinic site) lyase)
  Pfam annotation: Domain name=SAP; Domain location=62-96; Score=22.8; E_value=0.0013; Accession=PF02037.17; Description=SAP domain
  Pfam annotation: Domain name=zf-CCHC; Domain location=645-662; Score =10.3; E_value=0.019; Accession=PF00098.13; Description=Zinc knuckle
  Pfam module annotation: Pfam domain module=SAP::zf-CCHC; Domain location=62-96::645-662
MGSKRPFSNSSKPSSPFVEDKKNVKLKGLEASLGSKKLVVEENDVNSYSIELERLRNDPTIVDTVTVQELRKTLKRFNVPAKGRKDDILSAWKSFVGSNMCELDSHAQEKKWPWISSENASVEVEAKKVLDEDHIENVNENPEISELNQAKRRLKQSESERKTIKVTTKKKVSLKSDEDSDFKPSRAKRKVSSDVASIVVQSEEISTATIQTEPWTVLAHKKPQKGWIAYNPRTMRPPPLAQDTKFVKLLSWNANGLRALLKLEGFSALQLAQREDFDEKDIEEIKHHLIDGYDNSFWTFSVSKLGYSGTAIISRRVVFTTVCAAVHRRPSSLWPPFRPEIAGFGAPQRAQPNPTSRLTGNLSTRSSRSCQTPARDHHAPPSRGRNHARPVPAGSSDSPESISVIAKMTSYGLVLSFSGTPTITTAKLNWKNYLSWSASVELWFLGQGHHDHLEKGAEAVPNDKRPEWEKLDYQLCAVLWQSVEADVLEILRSFKTCCSFWKKAREIFANDIQSLFDVTMKVTALKQTNHDMIAHIRKARAAVEELKRFLVAESLEEVNRKLDKFCMVLILRSLHSDFDHVRDQVLAGDQVPLMDSLITRLLRVPHALKEENPAELMETSVMVSPRGRGGGRNSRGGRGGRGGRPQCTYCKRMDHTQENCYSLHGFPDKVAQVTQTEKPESKFSDKEYQEYLKLKSEKSSSQASSSSVPCYSTACISQSVDGPSPWILDSGASDHIS

SEQ ID NO: 155252 - protein, 861 aa, Glycine max
  Coding DNA Sequence Number=SeqID_38474
  Gene Ontology: Mol. function=RNA-directed DNA polymerase activity; Cellular component=nucleus; Biological process=RNA-dependent DNA replication
MTTSQRQGDPNSMLEFNDWISALEVEEVPCLGRKFTWIRPNGTAKSKLDRFLVFDDWMSKWPGSTQYILDRNFSDHYPILLRAKIVDWGPKPFRVLDCWLKDKTFQNIVIGSWSSTQLMGWGGYSLKQKLKKLKERMKRWNKEQFGDTAKKVQQLHNELNNLEAASRDRQLTPLELSSRKKIQENLWTATQAHESLLRQKARTKWIKEGYCNSRYFHKLINYNRRQNAVKGVRIDGSWVEEPNSVKEAAHNFSQLRFTEPDYDRPVINGTTFRGLGQQQNQLLVAQFQEEEIKAAVWECGSDKSLGPDGLNFKFIKHFWELLKPDISCFLDEFHVNGCIYKIVAKILANRLKKVLPDIIDERQMAFIKGRHLLHAVLTANEAGFLPKMDTMDFGMSSFSIDVYFEGLSGLMRKAVNKKHFSSFLVGKNKEPVSILQYAEDTIFFGEATIENVKAVKTILRCGAIYKSEQWCKKAADFLNCRMLPMPFTYLGIPIAINPNRREIWDPSKIAWVNWEIVCLPKDKGGLGIKDLRMFNTALLGKWRWEIFQHNVELWTRILLSKYGGWRNLDGHRRSCYHSHWWKDLQLLNQQQQTIALKRQIEWRVGCGDKIKFWEDTWTADDRPLMVKYASLYQISNQQQQTISLMGSHNDEGWEWNFSWRRNLFDNEATMAAEFIQETAVLTVQQQGADSWVWKADPSGNYLTKSAYDILLEAKRGETDDGPFVELWKLRIPPKTATFAWRLIRDSTPFLQLQQNNPLWWESLSWVKTKDTFPQNPKEHFLQHTIGNAGGTKATRWKCWWVALTWTIWHHRNKTVFENQTFITSKVLDDALLLLWSWLRAMEKDFTLHYNQWSSQLRETFG

SEQ ID NO: 155253 - protein, 106 aa, Glycine max
  Coding DNA Sequence Number=SeqID_38475
AGPAGLLDTEQYLRHLVRQQATNHRAHVQTHDGLYQMSLSLQSQGFTSFPCPTPDQFRAEVAWPGDWPEAQVGEAPAGAPAEAPDEAHEAREDEEMTDLLDFLGGS

SEQ ID NO: 155254 - protein, 99 aa, Glycine max
  Coding DNA Sequence Number=SeqID_38476
MIKAFWWGPLENNKRELFHCRDLLLRVTCIGKSISSQICKVYDDDKFNVEVEYLSEELHSGGNMACSKCQKRLITNRNYAPFVLFASREDFNDAIKAYI

SEQ ID NO: 155255 - protein, 721 aa, Glycine max
  Coding DNA Sequence Number=SeqID_38477
  Gene Ontology: Mol. function=protein serine/threonine kinase activity; Cellular component=cell surface; Biological process =protein amino acid phosphorylation
  Homolog annotation: Hit_ID=Q1T003; Match level="QueryCoverage=82%, HitCoverage=88%, E-value=4e-79, Identity=32%"; Hit description =Protein kinase; Concanavalin A-like lectin/glucanase
  Pfam annotation: Domain name=Lectin_legB; Domain location=33-276; Score=234.7; E_value=2e-67; Accession=PF00139.10; Description=Legume lectin domain
  Pfam annotation: Domain name=Pkinase; Domain location=383-634; Score=- 5.0; E_value=2.9e-08; Accession=PF00069.15; Description=Protein kinase domain
  Pfam annotation: Domain name=Pkinase_Tyr; Domain location=383-634; Score=-19.1; E_value=2.7e-11; Accession=PF07714.7; Description =Protein tyrosine kinase
  Pfam module annotation: Pfam domain module=Lectin_legB::Pkinase::Pkina se_Tyr; Domain location=33-276::383-634::383-634
MASLSNILLMFCLFNLLAYPVSVHSAGEVPINVTKHFSFYNFSFSNNPRLVHDVKLLGSAKFSNEKGALQIPNESEDIRHQAGRGIYSFPIRLLDPSTKTPASFQTTFSFQMNNSTASEQAAYGGSGLTFIIVPDEFTVGRSGPWLGMLNDACENDYKAVAVEFDTRKNPEFGDPNDNHVGINLGTIVSTKVINVSDVGLSLKDGSVYRAWITYDGPQRRMDIRLGKANQEDYPSKPMFSESMDLSPYLNEYMFVGFSASTGNHTQIHNLLSWNFTSTSQAFLHLPSSESCQGKILLENSTAATEPTNSQKSSKNEPPRSFLIFVAAVALALALFLGFYFISKHRRNAAKLNTSVETELHMPRPPNKPRRFAFSQLSTATRSFSEIELLGSDNRGEYYRGKLSGGSQVAVKRFSAQFLSTHGSDKKRLLKEIKGISHVRHPNLLPVRGWCQDNHEIMVAYDFVPNGSLDKWLFGAGVLPWTRRFKVIKDVADGLSFLHTKQLAHKNLKCSSVFLDVNFRAVLGDFGFVLMGAESKHFESQVCQGADVFEFGVLVLEVIAGRVRDEKEEGNPEERNLLGYAWNLHQIDEKVKLVDKRMGSLINLEQAIRALEIGLLCTLNENKGRPSMEQVVDFLLNMDKPIPELPRTRPCLAGIKELAYATIDTMWYNIGGKRLDIGYEKDSAAKISFGETENDANTDFDIFYNVNQKAGLGGKEKAKSER

SEQ ID NO: 155256 - protein, 105 aa, Glycine max
  Coding DNA Sequence Number=SeqID_38478
MDLSPEKVIIFLFKLFRHSFSTTIHMLIADQIIGIHNKFQKLEEVCPAMEKQITKWTKVLLSSERLLGFSCSAFRTSMFNPGTNSKSGRWYPVGLAQMEQWIALL

SEQ ID NO: 155257 - protein, 109 aa, Glycine max
  Coding DNA Sequence Number=SeqID_38479
MKVAPKGANNHQVIQQLMLMAHEGRVAGCSLAEEGCYRRKPTKVEEKVVARALEDIWQGWISSRDQSIIAYNSMRPLELKCERMKIIFPKFSLCNLSKGNFRIWLKCTY

SEQ ID NO: 155258 - protein, 59 aa, Glycine max
  Coding DNA Sequence Number=SeqID_38480
  Subcellular localization annotation: CTP_CleavageSite=41; ConfidenceScore=5.09e-01
MASMFAVLRRPRVRRCHSTPPFAVQGRVRRLCGVVLLPFVAAATLANFLKTYQEKLLYM

SEQ ID NO: 155259 - protein, 1286 aa, Glycine max
  Coding DNA Sequence Number=SeqID_38481
  Gene Ontology: Mol. function=RNA-directed DNA polymerase activity; Cellular component=chromatin; Biological process=chromatin assembly or disassembly
  Pfam annotation: Domain name=Chromo; Domain location=1203-1251; Score= 33.1; E_value=9.7e-07; Accession=PF00385.14; Description='chromo' (CHRromatin Organisation MOdifier
  Pfam annotation: Domain name=rve; Domain location=1006-1161; Score =34.3; E_value=4.2e-07; Accession=PF00665.16; Description=Integrase core domain
  Pfam annotation: Domain name=zf-H2C2; Domain location=947-988; Score =22.5; E_value=0.00037; Accession=PF09337.1; Description=His(2) -Cys(2) zinc finger
  Pfam module annotation: Pfam domain module=Chromo::RVT_1::Retrotrans _gag::rve::zf-H2C2; Domain location=1203-1251::519-688::106-196::1006- 1161::947-988
MADSTRSKANTDRLEDAIAKLTISLNDTLHGLTHKIDELIIHLQKPNPNSNSPSSSPSSSAPPVMTTSPHRIKLVPIFDGSDSLGWIFKINQFFEYHLTPEHERLTIASFYMDGRALSWFQWMTSNGQFTSWPSFLQALQSQFAPSQYEDPTSTLFKLMQRGTVNSYLSEFEDLANRIVGLLAPFLLSCFISGLSPEIRREVQALQSLTMAQAAGLAQLQEEKLRDARRQTRNRYGPPQLPHSSHSSPLVTQAPPSPISSNPIFTPPSPNSLILPTPLKLPPPNPNPIPLRRLSPANTHNFIQAPLAKSLGLPSRATTLLNVMVGNGQQLHCDQLCEGVKLLIQNTSFMVDLHLLPLSGANVVLGVQWLKALGPILTDYNTLSMKFFQDGQLVELKGEDASTLHLISQPQLHRLLRKDGASAYFHIDITSELPSNPNTSPSNTSPIPSEIQPLLTKFTSLFQPPQSIPPFRTTNLHIHLQPHSEPVNVRPYRYPHFQKQEIENQIEDMLQKGLIRPSTSPFSSPVLLVKKHDGSWRLCIDYRGLNAITIKDRYPIPTIDELLDELGGASWFSKLDLLQGYYQIRMHEPDVAKTAFRTHHGHYEFKVMPFGLCNAPSSFQATMNDIFWPYFRRFLIVFFDDILIYSRTLPEHLVHLEQIFEVLLRNQFVLKLSKCFFAQRQVEYLGHVVSEHRVTPVASKVHDIQQWPILRTTRALRSFLGLAGFYRKFIRGYASIAAPLVKLTTKDSFEWTSEADQAFKALKGALTSAHVLMLPDFSLPFTLETDASRVGIGVVLSQKGHPIAFFSKPFSPKLLQASTYVREFLKELMTQIVQTPEQQMYLARLMGYDYSIQYRSGNTNLVVDALSRLKEESEGTMLLLSVPCLTFLDEFKKQLKQEPTFIEFRKNILAQPTAFPEYSVTCGLILQGNRIWLPEGIPFIQTLLMEYHSTSTGGHMGVTKTLARLTENFYWPGIRKYVKQFVAACVDCQHTKYETKKTVGLLCPLPIPSRPWEDLSLDFITGLPPFRRNTTILVVVDRFSKGIHLGMLPTQHSAHSVAVLFMEIVEKLHGMPRSLDLFRMSSMKLRMSSAYHPQTDGQTEVLNRVIEQYLRAFVHQNPSSSLMGGSPPIGRSTSQVLRRKKLQKAQETMKLTADKKRREVQFHVGDMVMVRLWPRRQPFHSPVSANTSPTLALPLLIVDNEPVISPKSIVGTRYTSDSKTPKLQVLVQWEGLLPKDTTWEDWEQLQANYHLEGKVILEGPGDDRNREDASIRPKRKSSAPSYLKDYI

SEQ ID NO: 155260 - protein, 244 aa, Glycine max
  Coding DNA Sequence Number=SeqID_38482
  Homolog annotation: Hit_ID=Q69IX0; Match level="QueryCoverage=48%, HitCoverage=55%, E-value=2e-21, Identity=47%"; Hit description =Putative AtRer1A
  Pfam annotation: Domain name=Rer1; Domain location=1-143; Score =111.6; E_value=2.2e-30; Accession=PF03248.4; Description=Rer1 family
MDTGGGGASPTAAMSRWKFAAWRQYQHLLDKSTPHVGRRWLGFAAVALLYLLRVYFVEGFYVVSYGLGIYILNLLIGFLSPQVDPETAILNADDPILPIAASDEFRPFVRRLPEFKFCQNVEICGLSALRLCPDLATIFCGIKDCEEMAILSATAAILKPWCFLHSSHMALNVQSRDVRLLHSSHMALNVQSRDERLVLGINSKVRLARYAKNYKRTHAAMMTLIVATIVTEVEIANSRNSTMQ

SEQ ID NO: 155261 - protein, 120 aa, Glycine max
  Coding DNA Sequence Number=SeqID_38483
  Gene Ontology: Mol. function=helicase activity; Biological process =viral genome replication
  Homolog annotation: Hit_ID=Q9ZQR0; Match level="QueryCoverage=97%, HitCoverage=13%, E-value=7e-19, Identity=34%"; Hit description =Putative helicase
  Pfam annotation: Domain name=DUF889; Domain location=1-120; Score= -39.2; E_value=7.7e-09; Accession=PF05970.5; Description=Eukaryotic protein of unknown function (DUF889)
MRLQSNQSNTSVEELQQFSEWLLAVGNGQVGGANDDYVEIEIPYGFLIIEFDDPIDAIVNNTYPNLMQEYKNEALQAITPEFLHGLKTFGLPNHKIKLKLRTPIMLLRNLYQAKGLCNGT

SEQ ID NO: 155262 - protein, 485 aa, Glycine max
  Coding DNA Sequence Number=SeqID_38484
MGPAPDTIDLEGYDDVRAILKPKGSNSKDCRLERRWKRFENSGSNKQLKHNHSDSGTRSTVKSHGKVASLTIKKGHMSEDEVDEDYKFFLLTYDPHIDVVSDSDVDGSDDDINIGHNNDHNDHPYREEESLHNNPKLDKGSKQRDETGNQRNKGSDSVGKQTSGSMKAKQNLEAKRGLSKKRPHENVSGVPNNNAQTNMELIVVDEDYQIFLNSCRDDYIPSESIGKQNLEAKRGLSKKRPHENVSGVPNNNAQTNMELIVVDEDYQIFLNSCRDDYIPSELIGKRSNVIQNSLVSDYVLSEVDEDYLQYLNSVLIVDGEVGCRPERNTSKTDNVDGDSNSSEPDVILLEPDQIHENTPFVSSKTYDSSWFETEKNPKDNWQLPAYGNSQFRRRLMNDLQRPYDQEECDRLLLEVRQKKQKERHRETRHGVVKFCRTRGVSESYLDLYPDLAKAIAEFKKPEKVLFLLRGFIFWLQVMGSYGMEF

SEQ ID NO: 155263 - protein, 117 aa, Glycine max
  Coding DNA Sequence Number=SeqID_38485
  Subcellular localization annotation: CTP_CleavageSite=42; ConfidenceScore=5.22e-01
MYPATLARSLSKSLGCFRKRLSVNSLDFSAVIMKYSATPWSRCSFGSDVPLYLSMFNDFQVMGKEPESEVDCGFLPITIRGELGMDFLGTCFDMGGWLRRQRSVVELGVGDEWQALL

SEQ ID NO: 155264 - protein, 76 aa, Glycine max
  Coding DNA Sequence Number=SeqID_38486
MAHTHPHSKCTCAKWPSTMCIVFAFWVWGGGDGVTWQIFVFSQVATRGSTTEVGNGVRCDNMERGVGYCLVGGVGF

SEQ ID NO: 155265 - protein, 51 aa, Glycine max
  Coding DNA Sequence Number=SeqID_38487
MASGPGKSPYVVARGPQVYPSNLPNNWYKSRWFKLVTDSDEYASTAGGQNG

SEQ ID NO: 155266 - protein, 297 aa, Glycine max
  Coding DNA Sequence Number=SeqID_38488
  Gene Ontology: Mol. function=RNA-directed DNA polymerase activity; Biological process=RNA-dependent DNA replication
MSSPLNVLGMIISMTHLTMKFPNLKGDIITIRVNQMENHECYARSLLVKPCTFTSEKHPRAVDIKTPGEPTQEEMKKTNLLRQAGSTSTHRGKFLGFMITYKGIKANLDKYKYFHSDIKGINPVNQDNPVVVSIVIANLMVSMVLIDQGSFPDILERVETRRYVDLITTFDQGKLSRSFTIKYLLVDPNTSYFALIGRKMLNTEILTIKVDQKQARHYYAKSLKVAPYPPIWKLTMPYPIAAEGTQVMTVDKGSQIRALTICNMGKEFDIDPRDDTSDRGPKPIEELVQLQLGPKPR

SEQ ID NO: 155267 - protein, 190 aa, Glycine max
  Coding DNA Sequence Number=SeqID_38489
MGAQTVKVVRKNVWHVYKLLTSYASPGKVEAVCPDYWPIVANLHRFGGVHPVLFLLFSSHNFLNIYGEGLEHLLDDGLEVSDLLGARQLGEPGMSTSYPVWLFEALKLSLRACSRVILSKPLRMIPAPLRFTAELTASSTIGRYRSRGAPGLGRLKTAKWRRKKYDWRRHFKEKMSQEEAHHHKNPWIRA

SEQ ID NO: 155268 - protein, 420 aa, Glycine max
  Coding DNA Sequence Number=SeqID_38490
MSSFLSDFIIGLDRSDSGGSIQQPIMDREVILISGFSSKDTHRGASDSESSSSERERTSCQTSGGISCPCGRVRPSVAVGEPVSVTVILPSFASGGARRAGGDRDVRSSPCIRPSVSFGSLSSTPAIAGYEWVRDDLLKYKFCLTLATSVTALQHQMKLVNPKDSGRGALLPILLAHSLPPTTVVQETAPAAVEAAGSAIQADFVVLSLSTVVAPLLSAYMVTTCAPTVSSPSSLAPVVLLAIVLAAMASPSSSSFPRVSLDHLYTSSDAESLWGATYKLEQKTPIGFVLAFDMNLIRLAGVQNATNSAKVFLQKSLAILEDNGLWHQEVVQKVVSWEAEVAKWMATSWTLWRVERPKVANAIIAFVEVVMAEKMDLGDKMESMAAEKDDIAKRIVELEARLRESEFRLEESELWAAKER

SEQ ID NO: 155269 - protein, 35 aa, Glycine max
  Coding DNA Sequence Number=SeqID_38491
MAVPSTFSNRASVWNDPQAEENTQTTFFKDKSYEK

SEQ ID NO: 155270 - protein, 147 aa, Glycine max
  Coding DNA Sequence Number=SeqID_38492
MECLLSVRDHIVELIPSWQTFPDGSQLEVIPSFPLFVYRAQEEWSKMKHITIVNTIDSRIVYLSTDKLVGDWVGRPLRKWWVAPISRVVWVQHSRWNQWWQTREQAWWVDLELSRLIPFCAQKLALPFVLRKHDAVMFFERMLILEF

SEQ ID NO: 155271 - protein, 671 aa, Glycine max
  Coding DNA Sequence Number=SeqID_38493
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component =mitochondrion; Biological process=protein metabolic process
  Homolog annotation: Hit_ID=Q2QXL4; Match level="QueryCoverage=89%, HitCoverage=88%, E-value=1e-131, Identity=38%"; Hit description=Rf1 protein, mitochondrial, putative, expressed
  Pfam annotation: Domain name=PPR; Domain location=132-166; Score =21.2; E_value=0.0038; Accession=PF01535.11; Description=PPR repeat
  Pfam annotation: Domain name=PPR; Domain location=203-237; Score =53.7; E_value=6e-13; Accession=PF01535.11; Description=PPR repeat
  Pfam annotation: Domain name=PPR; Domain location=238-272; Score =40.6; E_value=5.5e-09; Accession=PF01535.11; Description=PPR repeat
  Pfam annotation: Domain name=PPR; Domain location=273-307; Score =35.6; E_value=1.7e-07; Accession=PF01535.11; Description=PPR repeat
  Pfam annotation: Domain name=PPR; Domain location=308-342; Score =43.3; E_value=8.2e-10; Accession=PF01535.11; Description=PPR repeat
  Pfam annotation: Domain name=PPR; Domain location=343-377; Score =41.2; E_value=3.5e-09; Accession=PF01535.11; Description=PPR repeat
  Pfam annotation: Domain name=PPR; Domain location=378-412; Score =50.2; E_value=6.8e-12; Accession=PF01535.11; Description=PPR repeat
  Pfam annotation: Domain name=PPR; Domain location=413-447; Score =48.7; E_value=2e-11; Accession=PF01535.11; Description=PPR repeat
  Pfam annotation: Domain name=PPR; Domain location=448-482; Score =21.8; E_value=0.0024; Accession=PF01535.11; Description=PPR repeat
  Pfam annotation: Domain name=PPR; Domain location=483-517; Score =39.5; E_value=1.2e-08; Accession=PF01535.11; Description=PPR repeat
  Pfam annotation: Domain name=PPR; Domain location=518-552; Score =41.2; E_value=3.5e-09; Accession=PF01535.11; Description=PPR repeat
  Pfam annotation: Domain name=PPR; Domain location=553-587; Score =40.7; E_value=5e-09; Accession=PF01535.11; Description=PPR repeat
  Pfam annotation: Domain name=PPR; Domain location=82-116; Score=4.5; E_value=2.2; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=132-166::203 -237::238-272::273-307::308-342::343-377::378-412::413-447::448 -482::483-517::518-552::553-587::82-116
  Subcellular localization annotation: CTP_CleavageSite=69; ConfidenceScore=5.64e-01
MTLSVRASSKPFITLNEARFLFPFSFFSSSTVQYTNKFLFHAAVAEPQLLVRVLNTVRHRPAVALRFFRWAERQTGFKRSELTYAVILDILARNGLMRSAYCVMEKVVSVKMENGVVDVVSSSEASMSSVKLILDLLLWIYAKKSMLEKCLLVFYKMVSKGMLPDLKNCNRVLRLLRDRDSSIDVAREVYNVMVECGIRPTVVTYNTMLDSFCKQGKVQEALQLLLQMQKMGCLPNDVTYNVLVNGLSHSGELEQAKELIQEMLRLGLEVSAYTYDPLIRGYCEKGQLDEASRLGEEMLSRGAVPTLVTYNTIMYGLCKWGRVSDARKLLDVMVNKNLMPDLVSYNTLIYGYTRLGNIGEAFLLFAELRFRGLVPSVVTYNTLIDGLCRMGDLDVAMRLKDEMIKHGPDPDVFTFTILVRGFCKLGNLPMAKELFDEMLNRGLQPDRFAYITRIVGELKLGDPSKAFGMQEEMLARGFPPDLITYNVFIDGLHKLGNLKEASELVKKMLYNGLVPDHVTYTSIIHAHLMAGHLRKARAVFLEMLSKGIFPSVVTYTVLIHSYAVRGRLKLAILHFFEMHEKGVHPNVITYNALINGLCKEALRLYKDMLDREIQPDSCTHSALLKHLNKDYKSHVVRHLENVIAAGVNSPDRIMYIFLTVMVEDACGVLDD

SEQ ID NO: 155272 - protein, 65 aa, Glycine max
  Coding DNA Sequence Number=SeqID_38494
MAYDLSYRTIIVKTDCTEVVIKLVEDPKYHEGQFVDLASKIAKTKESLLLVPLSIFHENGYNYKC

SEQ ID NO: 155273 - protein, 240 aa, Glycine max
  Coding DNA Sequence Number=SeqID_38495
  Gene Ontology: Mol. function=DNA binding; Cellular component=nucleus; Biological process=regulation of transcription, DNA-dependent
  Homolog annotation: Hit_ID=Q2HUH8; Match level="QueryCoverage=67%, HitCoverage=42%, E-value=1e-23, Identity=37%"; Hit description =Histidine triad (HIT) protein; Homeodomain-like
  Subcellular localization annotation: CTP_CleavageSite=61; ConfidenceScore=5.53e-01
MWYMHPSSNVEPPTSGSSQNPQIYSQPSTPTNSNTCYRLSLSNIVLPSNEIESPVGVDGIQLDEGDENSSGKKSRTAFSVTEDVILIRSWLNVSKDSIIGVDQTSKQYWARIKNAYNNDDMRQSGQFCERSWTQLKSRWNKIHPLVQKFNGCYKQADKPRRSGSSEKDVLADAHMIYSQDTETPIEVEEYDRPSPMSRPIGQKAAKRKSKGKECHNTLNLSSIESVMKNKNMNTSILIQL

SEQ ID NO: 155274 - protein, 178 aa, Glycine max
  Coding DNA Sequence Number=SeqID_38496
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P24095; Match level="QueryCoverage=85%, HitCoverage=19%, E-value=6e-55, Identity=61%"; Hit description=Seed lipoxygenase
  Pfam annotation: Domain name=Lipoxygenase; Domain location=1-178; Score=-313.8; E_value=0.002; Accession=PF00305.9; Description =Lipoxygenase
LDGSVPRFSSHSNHFALVLTIEYDNDSVFGVSFISIDYSMEMSSAVYKNWVFTGQSLPTNLIKRGLAVQDHTSRHGLPLVIKDYPYVVDGLEIWDAIKTWAVEEDTELQAWWKEVVEKGHSDLKDNKWPKMKTCQELTDSCTITIWVGLALHAVVNFRQYPYGGCILNRPTESRRLLP

SEQ ID NO: 155275 - protein, 67 aa, Glycine max
  Coding DNA Sequence Number=SeqID_38497
MNSGRYLPACLIIQTGGLSTGKFVIQDINRQIATEVKELLMLAVSDNKSGKSICVLQYLKRSETVFS

SEQ ID NO: 155276 - protein, 79 aa, Glycine max
  Coding DNA Sequence Number=SeqID_38498
  Subcellular localization annotation: CTP_CleavageSite=18; ConfidenceScore=5.44e-01
MASPPASPPPPSSPSDASASPFAVKRTRKASRGRHLRELEGGPYCLEGPNLGGYSGCAQKGTGHPEAEHCPPRAVSWGL

SEQ ID NO: 155277 - protein, 366 aa, Glycine max
  Coding DNA Sequence Number=SeqID_38499
  Homolog annotation: Hit_ID=Q5N9R6; Match level="QueryCoverage=96%, HitCoverage=35%, E-value=2e-17, Identity=33%"; Hit description =Transducin family protein / WD-40 repeat family protein-like
MAAMKAAIGFKVHCLDVEKLNRMYEGRILRAAIEYFWIGGLQVDVQLKSPFSCYIEGNSSYVEKELTYWGTNIIWSLNQYQCHDKPLVLWDIIAALSTFKDNNLKYAEHLLIKWISSSFLQLDMDLYPEKVLSFFSSSLSDIPSRLLHLLNIICRRVMLAELDADQITGIHKNFQKLEEVCPAMEKQITKWTKVLLSSERELRERLVGFSFSAFRTSMSNPETNSKSGCWYPVGLAQMEQWIALDQEHIHDQLKAIASEVKHEKRFLSSRCSAVETCSFCSASVPFESPEFGFCQGENSTSGDVKNHRSGFRLAPEPLFRMSSFHLDSDSSSKSFTQAVSSKPFCPFCGILLRRKQPDFLLSPTPV

SEQ ID NO: 155278 - protein, 114 aa, Glycine max
  Coding DNA Sequence Number=SeqID_38500
MCRHNQDKKLSIALSHQAIFVAINYAIGCDIHRIYPMIPNSGFVGRQQKKLPCDGGGRTFRARDDAGGLISSMVGCACVRWWYIRSGGGAGATNGTGTIGGTSRGTSSMVEEKK

SEQ ID NO: 155279 - protein, 143 aa, Glycine max
  Coding DNA Sequence Number=SeqID_38501
  Subcellular localization annotation: CTP_CleavageSite=31; ConfidenceScore=5.04e-01
MGLFDAPDFNLRAICESNRRQVYTTSTTTTSSMMRGVRDKSRGILGRCGKGSKVIDTALALKLELNDDGPSAIVGCPSEFFAQDQWNNGKSHNETQGECGSHEKSSKPQSKQPNGRWKKARQKRRVTREKLLTSELHVPKRHY

SEQ ID NO: 155280 - protein, 169 aa, Glycine max
  Coding DNA Sequence Number=SeqID_38502
  Homolog annotation: Hit_ID=P29357; Match level="QueryCoverage=40%, HitCoverage=10%, E-value=2e-17, Identity=66%"; Hit description =Chloroplast envelope membrane 70 kDa heat shock-related protein
MNPTTRIKNEKVLLNITNGLLVKPINNGSHGRQVDSSHHIEPRIDTNILGGLTLWVVEVNRHRDNHIPYGGGRWRKCLCFGVPALPLALQNPWKAESAWSAQFVKPWYRTRLANGSGYSQNQPQGIELDVHKEKVCAKTEGMGPAEVVVDGWLCGEEETRRGGPVGGVV

SEQ ID NO: 155281 - protein, 71 aa, Glycine max
  Coding DNA Sequence Number=SeqID_38503
MAKLMDRAIGGVVAILGGRHHHLELLKVDAPVDVCNLYCGDDDADKWVDAQIGHYIGIDAPSSRIEQMLEA

SEQ ID NO: 155282 - protein, 403 aa, Glycine max
  Coding DNA Sequence Number=SeqID_38504
  Homolog annotation: Hit_ID=Q5N9R6; Match level="QueryCoverage=71%, HitCoverage=30%, E-value=5e-47, Identity=38%"; Hit description =Transducin family protein / WD-40 repeat family protein-like
  Pfam annotation: Domain name=WD40; Domain location=201-246; Score =30.9; E_value=4.4e-06; Accession=PF00400.22; Description=WD domain, G-beta repeat
  Pfam annotation: Domain name=WD40; Domain location=315-353; Score =6.3; E_value=6.8; Accession=PF00400.22; Description=WD domain, G -beta repeat
  Pfam module annotation: Pfam domain module=WD40::WD40; Domain location=201-246::315-353
MAAPWRNSGKGGIAAFFVFFRAQQHDPAAETEQQHDPAAATSSDDRQQHDPAKQRPAAPRMAVTNGSANGSTTHGSTMAKTNERGRQSAVCNSEGHVKIYRPPFCDYCAEWIEKNSSDQTDSMYEENGTLLSADQYASRSAMLCSLVVSWSPLLRLASELYPVCDSVSLLAVGGKSGKISLWRFHPTDCYTIEDREVPTTVKFVGLLQAHNSWVTTISWLLFAFDSSNPQILLASGSSDGSVKIWLADNDKLLKSSKVDQTSFSLLKEVITVNAVPVSVLSVTTHVQYPSKMLLATGKVSGSFEIWLCDISSGEFDKLGSYNAHDLVVTGLTWAFGGRFLYSCSQGAIAEMLNLNPKEIVLRIHTLVPYEDGCRRGQSVNKIAVRIEKGMVPKLQGKLSMSPE

SEQ ID NO: 155283 - protein, 91 aa, Glycine max
  Coding DNA Sequence Number=SeqID_38505
MKENFKQRIGKEEYMSQRIKRENITQKRIVTQVISGEASDSQLHPVPRRVKGATLLSGFISILLVEIKAQTCVKVDVNSLWICTTYGLVLI

SEQ ID NO: 155284 - protein, 80 aa, Glycine max
  Coding DNA Sequence Number=SeqID_38506
  Gene Ontology: Cellular component=integral to membrane
  Homolog annotation: Hit_ID=Q1H8M6; Match level="QueryCoverage=93%, HitCoverage=28%, E-value=2e-20, Identity=55%"; Hit description =Cytochrome B561-related protein
MKLKFMIAVLLATAGAIMSIKNFNNLFNNSHQRLGVALYGVIWLQVLLGIFRPQRGSKRSVWFFAHWILGTAVTFLGVLN

SEQ ID NO: 155285 - protein, 81 aa, Glycine max
  Coding DNA Sequence Number=SeqID_38507
MNSLSEADWLSEPHSLSEAVSSLSEAVSSLSGCKTIEEDKSEISTLSAQPARPARTLSLPPLKHLVGGKPKVTKLDTAEAM

SEQ ID NO: 155286 - protein, 73 aa, Glycine max
  Coding DNA Sequence Number=SeqID_38508
  Subcellular localization annotation: CTP_CleavageSite=35; ConfidenceScore=5.18e-01
MDSSSAAQLCQDVFPLARTWNSATSSTIYGGGLVRARALTTDEAVHLANLYNSSSSRVFLALSPRVLRLADAR

SEQ ID NO: 155287 - protein, 51 aa, Glycine max
  Coding DNA Sequence Number=SeqID_38509
MEWGGGDDNNNDGEDGGGSCVDDNSGGGCTSDDDGDNNGSDDSGGDDNDNG

SEQ ID NO: 155288 - protein, 177 aa, Glycine max
  Coding DNA Sequence Number=SeqID_38510
  Gene Ontology: Cellular component=nucleus; Biological process=cell division
  Homolog annotation: Hit_ID=Q9LME2; Match level="QueryCoverage=96%, HitCoverage=22%, E-value=5e-28, Identity=40%"; Hit description =Synaptonemal complex protein 1
MKNQELRKNVDELQKVHESTLVQLTEGSRLAAEKFQILESESETLISGLKDAEQGLLLKVSALETESKENTQRLHTEILKKSEEIDTMPNERIKLEQHADSLDKEVIQLQNALEEKEKCILHYKEQEKNLEDQITQNLSLLTAIESKLSEAKKQYDQMVENKQLQLSKHLKEISQRT

SEQ ID NO: 155289 - protein, 1060 aa, Glycine max
  Coding DNA Sequence Number=SeqID_38511
  Gene Ontology: Mol. function=RNA-directed DNA polymerase activity; Cellular component=chromatin; Biological process=chromatin assembly or disassembly
  Pfam annotation: Domain name=rve; Domain location=856-992; Score =20.8; E_value=0.00011; Accession=PF00665.16; Description=Integrase core domain
  Pfam annotation: Domain name=zf-H2C2; Domain location=797-838; Score =13.1; E_value=0.0066; Accession=PF09337.1; Description=His(2)-Cys(2) zinc finger
  Pfam module annotation: Pfam domain module=RVT_1::rve::zf-H2C2; Domain location=410-699::856-992::797-838
MADATHSRISTDPLQDAITKLSASQLAMNTKIDNLLQRMTQLEANQQPPQTPPSSSAGQTLPAYNPVHRLKLDVPRFDGSDPTDPTGLLCKLQQRSSVSAYLLEFESLVNRVAVTYARLQEGKLLDARRSQAPRPSTTISAPTNSRPAMGKDDELVSGIILPHPPLPTENLIPEPPPAQLSLHALSGHSAPKTLRLKGSINELHISILIDGGSTHNFLHHRVVTTLGLTTKEIAPLKVTVGNEDEIRCQQLCTAVKIQIQEHAFMVDFHILPLCDYTSSSMKFITEGKLVELHGEREKVGEPMSPSQLRRLLHTSPSSTFFHIRVEANSQPVATPQTFPEISKLITKYSSLFQPLTNIPPSRSTVHSITLLPNATPVNVKPYRYPYYQKQEIEDQVSAMLAKGFIQPSSSPFSLPVLLVKKKDGTWRFCVDYRALNAITMRDHFPIPTVDELLDELRGACWFSKLDLMQGYHQILMNKEDISKTAFRTHHEHYEFRVMPFGLCNAPSSKMIVDHLLHLENAFRILVSGCATNAGEGSGHTDLAHSTLTSSLKGFSWPCGILWRFIRGYATLAAPLTKLLSHGQFQWSPEVNDAFQKLKDAITTAPVLTLPNFKAPFVVETDASGTGMGAVLSQGGHPIALFSKQFCPRMANSSTYVRELAAITAAVKKWRQYLLGHKFTIMTDHRKQHRYLVRLLGFDYTIQYRSSQTNIVVDALSRANEEMPASLYLLSMPRFIFMEDLRKELASSPAFKELHEQIQADPATYSEYSLTSGLILHKGRIWLPSTSPFIKMLLEEFHQSPVGGHMGVQKTLHRLHENFTWSSIREDVRAFVANCLTCQYAKYDNRNPGGLLCPLLVPAQPWEDLSMDFIVGLPAYKGNTCILVVVDCFSKGLHLGMLPTHHTAYTVAMTFMEMVGKLHGMPRSIVSDRDPLFISKFWRELFALSVTYGRKPPSFPQYITGTSKIDVVDNILSQREAVFEFVHRKLRKAQRRMKATTDKHHRDQEFEVGLTPEDTSWEEWSELKSLHHLEDKVLFDGQGSVTQNTGGVSLARKQQKTNSSE

SEQ ID NO: 155290 - protein, 155 aa, Glycine max
  Coding DNA Sequence Number=SeqID_38512
MVFNQFLSDFWDVIGKEVGKYITQVYAIGNVSFDLSSFIPGRGVGDNALVAREIVHHMHKEQGKLGLCVDWNFLQLTLHEFRFPSSIVKLIMNCDVSSIGACRPWIFFINGFLCFLMSDCSGMDKEKDEWRRHFKEKMIQEEAHHHRKPWIKAWR

SEQ ID NO: 155291 - protein, 185 aa, Glycine max
  Coding DNA Sequence Number=SeqID_38513
MVCNDQAEMTGRLLAGSLTFDNLILMWVFLTGRQIDWAHLVRYQMHKALRANAPLPYPQLITLFLHHFQIPLDDEPFVQVKRSFAIGASAVTFFGYRKDRNGQWLKKDALPPQDERTPSPPPQRDDSALMTEVLSELRGLRSYVGERFDSLDTRFAVMDIRLTQLEEDVGYIRQSFDLPPPPPPS

SEQ ID NO: 155292 - protein, 101 aa, Glycine max
  Coding DNA Sequence Number=SeqID_38514
  Subcellular localization annotation: CTP_CleavageSite=25; ConfidenceScore=5.38e-01
MKAKILENVLIMSRLLRSFSRISFRSNSSSSSSSRNTNLLNDQDNQTQEVAPKHNLFDEEVRFEDINQNMDDWNIPEIPQDQLYVPETIKDKHNFDYIIKT

SEQ ID NO: 155293 - protein, 81 aa, Glycine max
  Coding DNA Sequence Number=SeqID_38515
MYIVVVKQGQDHLGLPSEVETKRERQKPIKVGYLRTDASRDGVTTDRSLPLLWARQAENVAARQPRILCILQLSFTICKNK

SEQ ID NO: 155294 - protein, 191 aa, Glycine max
  Coding DNA Sequence Number=SeqID_38516
  Gene Ontology: Mol. function=nucleic acid binding; Biological process= RNA-dependent DNA replication
  Homolog annotation: Hit_ID=Q1SU57; Match level="QueryCoverage=59%, HitCoverage=72%, E-value=1e-22, Identity=39%"; Hit description=Zinc finger, CCHC-type
MENKAKTPIRLKRDLIRENLARINFQNGNPSKPMFHTDDSVFEGQCIPWQDALVVKLLGKTIGYNILKANSRGYGNSRFPGLNLYFYDESILLALATRVGSPIKANENTLDFTRGRVARVCVEVDLNKPVIGKVWMKGHWYKVEYEDKDVGVNGIDDPVQSDENLVEQSDAMELVLGDVPTNEIYPGPTSI

SEQ ID NO: 155295 - protein, 373 aa, Glycine max
  Coding DNA Sequence Number=SeqID_38517
  Gene Ontology: Mol. function=RNA-directed DNA polymerase activity; Cellular component=chromatin; Biological process=chromatin assembly or disassembly
  Pfam annotation: Domain name=RVP_2; Domain location=230-355; Score= -37.4; E_value=0.00082; Accession=PF08284.2; Description=Retroviral aspartyl protease
  Pfam module annotation: Pfam domain module=RVP_2::Retrotrans_gag; Domain location=230-355::1-85
MEGPAFAWFQWMHRNAQLSSWSAFLHALHSCFASSTYEDPTGLLCKLQKHSSVSAYLSEFESLANRIVGLPATFVLSCFISGLSPAIHREVQVLQPVFLVQAVTYARLQEEKFLNAHQPPTHRSPTTTVTTTASQSPTTNATSPLLPNPSRTSAPSIPFKRLTPEELAVHREKGLCFHCEDKYSRGHKCSPLLFMLVAEDDELASEVTSLQPPSPTADLLPEPPPAQLSLHALSGHSAPENLRLKGAINELHISILIDGGSTHNFLHHRVVTVLGLSPKEIAPLRVTVGNRDKIYCHQLCMAVKVQIQRYSFTVDFHILPLCGADVILGVEWLKTLGPVLTDYTSLTMKFITDGKLIELHGDREKDEEPLSPS

SEQ ID NO: 155296 - protein, 403 aa, Glycine max
  Coding DNA Sequence Number=SeqID_38518
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=98%, E-value=3e-58, Identity=36%"; Hit description =Integrase, catalytic region
  Pfam annotation: Domain name=Chromo; Domain location=353-403; Score =17.1; E_value=0.0093; Accession=PF00385.14; Description='chromo' (CHRromatin Organisation MOdifier
MVGEGVRPMPEKVQAIQTWPTPRSPRALRGFLGLAGFYWRFIRGYAALATPFTKLLYMVPFVVETDASGAGMGAVLSQGGHPIAFFSKQFCPRMANSSTYICELAAITVAVKKWQQYLLGHQFIIMNDHRSLRELMNQEDTRAFIASCLTCQYTKYDNRKPGGLLCPFPGLHLGMLPTHHTAHIVAMLFMEMVGRLHAYRPQSDGQTEVANRISEQYLRAFVHQKPSAWGRYLLWVEWSYNTSCHSMTGMIPFEVTFGRKPPNFPQYISSTSKIDAVDDILSQREAVFELLRRKLSKAQIRMKATSDKQRRDQEFKVGDWVLVKLRPHRLTSATVLRDIADLPPMALENHPVITPLAIVASKMIPSETSPKHMVLVQWKGLAPEETLWEEWLEFKSLHHLEDK

SEQ ID NO: 155297 - protein, 77 aa, Glycine max
  Coding DNA Sequence Number=SeqID_38519
MVAFAVVASLLPVASYAEEDRQFSYSWRAEMLHPGMSHVHHYCVMKAPMLHLFSRPKYPPKRRERKMRNSVFFIASQ

SEQ ID NO: 155298 - protein, 70 aa, Glycine max
  Coding DNA Sequence Number=SeqID_38520
MLLPSAVHVFSIIKCEASGDWEARYSVVFQIGSFAKRKKGRSRDESRHHGKAGRTKSVSYLCFPLISDER

SEQ ID NO: 155299 - protein, 77 aa, Glycine max
  Coding DNA Sequence Number=SeqID_38521
AILIFWDSVCAQIIGKSTVDLGDIVIQAGEDYQKQYPKDLDNNMLGLTLALKHNAKADKAMCDITEDIQYATVKLNT

SEQ ID NO: 155300 - protein, 71 aa, Glycine max
  Coding DNA Sequence Number=SeqID_38522
MWTKLKEKSETIFSSAGWNPSHLEPSQGIQEKEKSSTGLAVVAGQQHMQVHTPRLMYSEASVSMLVECFSA

SEQ ID NO: 155301 - protein, 55 aa, Glycine max
  Coding DNA Sequence Number=SeqID_38523
MYQLLQASKWSGNECCPPLEAMKAPVDGGQGLEIFLEFEARKIPPEIKRGKGTKE

SEQ ID NO: 155302 - protein, 93 aa, Glycine max
  Coding DNA Sequence Number=SeqID_38524
  Gene Ontology: Mol. function=N-acetyltransferase activity; Biological process=metabolic process
  Homolog annotation: Hit_ID=UPI00005F917B; Match level="QueryCoverage =87%, HitCoverage=75%, E-value=1e-14, Identity=56%"; Hit description =COG0454: Histone acetyltransferase HPA2 and related acetyltransferase s
  Pfam annotation: Domain name=Acetyltransf_1; Domain location=1-67; Score=30.1; E_value=8e-06; Accession=PF00583.14; Description =Acetyltransferase (GNAT) family
MAGRRRLAAGRFRRDYSCLYVDPAFQGQGVGSALLNAVQQRFTSTGALKCLLQNEAALQFYQQHGWQREALGESEQGQYVLMHLPLASRTSGS

SEQ ID NO: 155303 - protein, 889 aa, Glycine max
  Coding DNA Sequence Number=SeqID_38525
  Gene Ontology: Mol. function=signal transducer activity; Biological process=G-protein coupled receptor protein signaling pathway
  Homolog annotation: Hit_ID=O81225; Match level="QueryCoverage=93%, HitCoverage=95%, E-value=0.0, Identity=48%"; Hit description=Extra -large G-protein
  Pfam annotation: Domain name=G-alpha; Domain location=461-844; Score=- 13.6; E_value=9.6e-17; Accession=PF00503.10; Description=G-protein alpha subunit
MASLVRKLRPSSVPTVTVETEDSLSSYEYSLAVVYNGPPLSYSIPEIPAFKIDQIPIATIASLSHDDVSVPVIQPLGKSLHKRKQNHWVTDSVVLSSLDSCAVDSPPAPDGVDGDMHKSSPDTLEFPDDRDGTFLHTTSDTTESGPGSVTTSLFAPSDEICSFREEEQTPSPTPKHVKRVSAVTFCDPESNYMVETDSDEFGDSQVESVPVMERAVRPGKKGSCYRCLKGNRLTPKEVCIVCSAKYCRSCVVRAMGSMPEGRKCVTCIGYRIYERNRSKLGKCSRMMKLLLSELTVTQVMDDERSCEANQIPPELVCVNLQPLNREQLKLLLNCRNPPKQLKPGSYWYDKASGFWGKDGQPPSQIISPQLDVGGRLHKNASNGNTNVIINDREITQKERLILQLAGVPCEGTPNFWVNADGSYREEGQRNDRGCIWDKRVARLACAILSLPVPSKSVALSCEGETANTDSVHRKILHKFLLVGSVNSGACTIFKQAKLLYNDPFSENELQNIKSVIQSNLFTYLGILLEGRAHFEEESLLENRKRRSVDESTSSGNIGSDDVETTLYSIGSRLKAFSDWLLKYMVSGNLDTIFPAATREYGPMVEGLWKDKAIQATYDRRNELKMLPRSANYFLDRAVEISKTDYEPSDTDILYAEGISLSNSLTSMEFCFPKSNSEDSLFPEYQHESSLRYQLIRVHPKSLGENCKWLEMFEETDVVMFSVALSDYDEYTTDSKGVSTNKMLVAKNLFENIISHRSFHNKKFLLVLTKFDLLEEKIEHIPLAQCEWFSDFQPFISPNQKKGCSNGNNNSSLAQCAFQYIAVKFKRLFLSITGRILFVSLVNGLEPDTIDEALRYGREVMEWEKWDPSIVTDPKSENTSTSIDEQSYLC

SEQ ID NO: 155304 - protein, 74 aa, Glycine max
  Coding DNA Sequence Number=SeqID_38526
METKPQNLNTKAADILGKRELGSEKRETKNGRRENGGFGRKEVVNEKQVLLTALIYTQEETQRTGPEQLVCSGL

SEQ ID NO: 155305 - protein, 138 aa, Glycine max
  Coding DNA Sequence Number=SeqID_38527
MEIKTVGNVDPPSKPPTELDEEAQEKEQATRESESSPNKTMHEEGYVNMQAQSNPSSILQKCTPTHVTSTIQSNPMEKEPSSIAHTNNKATVRVQEVTKNPFLLLKLISSDSTISKGSDTSVPKPTSNQIFEQAITYF

SEQ ID NO: 155306 - protein, 333 aa, Glycine max
  Coding DNA Sequence Number=SeqID_38528
  Gene Ontology: Mol. function=RNA-directed DNA polymerase activity; Biological process=RNA-dependent DNA replication
KVLKISFSNSRLFPHVDDPLLQETSFELMEHRRCGRSGSCLAPLTECCGRMLENNMFSGVAHEDLMQYLRKFIKFKNIRIVSLHATSAKYVFKEVFLSMKTKQYIWDIGNFVQREQASIPKAWEKLQEKLGITDLEPTNITLHLADRSVVYLRRVIEDVLVKVDKFIISANFVSLDMENDEDVLIILGCPFLSTCDLLIEVRLGRLTLRLRDERVSVDIVDALIKGAFPSVGMPNPLKTVLTNEDLDWELNLELKPPIDEPTELELKPLPSNFKYVFINQPSSLPIMISAGLHETKEDKLLRVFRDKKETFGWNIHDMNGSNPTLSTHKINTK

SEQ ID NO: 155307 - protein, 38 aa, Glycine max
  Coding DNA Sequence Number=SeqID_38529
MTRQQIYTSQHHDTYGGSNLGRRWVGFTGKGNYEEWAH

SEQ ID NO: 155308 - protein, 67 aa, Glycine max
  Coding DNA Sequence Number=SeqID_38530
MTVAWVIVGSGDVMEGGDLVFGCAGVNSNGITSPKKVSNDMDELSWHYWHQKLKRPWTKMGQPGTVK

SEQ ID NO: 155309 - protein, 465 aa, Glycine max
  Coding DNA Sequence Number=SeqID_38531
  Gene Ontology: Mol. function=RNA-directed DNA polymerase activity; Cellular component=chromatin; Biological process=chromatin assembly or disassembly
GLKIYPKAHENPRAFPWISSPIYLESSTQCPCGIGLHQIPPSRSKELGPIVTDYTSRTMPFTWLGAPVQLTADVPLLPAPASVHQFHRLVHTQGVTALFQLTHMPDPHPPTINSSPSDTPPAILPILYRYGHLFQEPSTLPPPRPISHHIHLQPNSQPDGSWRCCVDYRALNAITIKDHFPMPTIDELLDELPNASYFSKLDLRQGFHQIPTASTNIHKIAFRTHQGHYEYKVMPFGLCNAPTTFQATMNQLFKPFLCRFVAVFFNDILVYSPTLETYLEHLQAVMEALAQHQFLLHLNKSRVAPDPSKISATVDWPLPHTASELREWSYNTSVHSATGVSPFEATFGKPPPSLPSYLAGDFSIEVVDSILASRTQLHAVLQRRLAKAQTAMKKQADSHRRDAHIGTVAYHLQLPSASKIHPVFHVSLLKSYKGPTPWDHSLDPPVQKVLVQWASLAPEDTSWKD

SEQ ID NO: 155310 - protein, 431 aa, Glycine max
  Coding DNA Sequence Number=SeqID_38532
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=79%, HitCoverage=25%, E-value=1e-179, Identity=87%"; Hit description =CMP/dCMP deaminase, zinc-binding; Bacterial bifunctional deaminase- reductase, C-terminal
  Pfam annotation: Domain name=DUF1768; Domain location=262-418; Score =253.2; E_value=5.6e-73; Accession=PF08719.1; Description=Domain of unknown function (DUF1768)
  Pfam annotation: Domain name=RibD_C; Domain location=22-227; Score =194.0; E_value=3.6e-55; Accession=PF01872.8; Description=RibD C -terminal domain
  Pfam module annotation: Pfam domain module=DUF1768::RibD_C; Domain location=262-418::22-227
DAQKECLLVNAPLICRAALRVPFSVLKYAMTLDGKIAATTGHASWISCKQSRNLVFELRGRSDAVIVGGNTVRRDNPRLTARHGGGHMPMRIVMTQTLDLPEKANLWDMSEVSTIVVTQRGARRSFQKLLASKGVEVVEFDILNAREVMEYFHDRGYLSILWECGGTLAASAISSGVIHKVYAFVAPKIIGGKNAPSPVGDLGMVEMSQALNLIDVCYEQVGPDMLISGFLQPLPDMVPVIPSPDETFVADPTVSPYDSRIIFFYKTWDPYGAFSNFSPHPIQMPDENGDYVTWMSVEHYYQAHKFIGVDDPLAQDCVEMIKSAKSPEEAARIGRSMQKQKPYLIRSDWDNIKIDVMYRALKCKFSIYPHLNSMLLSTAGSVLVEASPHDLFWGGGRDGEGLNYLGRLLMKLRSEFLGESSSSSETPSLTV

SEQ ID NO: 155311 - protein, 88 aa, Glycine max
  Coding DNA Sequence Number=SeqID_38533
  Gene Ontology: Mol. function=structural constituent of ribosome; Cellular component=intracellular; Biological process=translation
  Homolog annotation: Hit_ID=Q018B0; Match level="QueryCoverage=56%, HitCoverage=14%, E-value=5e-08, Identity=52%"; Hit description=[S] KOG1685 Uncharacterized conserved protein
MVPETVSKAVDALLKWRRSQLEIQKPKLLDEDEEFVEEHCAAPAAASGEEFFQEEEDFGAGGPEEGELEGAGGEGLLVRHAVHEDGDL

SEQ ID NO: 155312 - protein, 119 aa, Glycine max
  Coding DNA Sequence Number=SeqID_38534
MAVSVTRGSEKGTIASSHRKLLTNGLPPVLNRQVYRIAQDLTITHKLISSSQNGFRFELASLQIFTQQNLSELSGTWTFLSLELPKHAKASSQGQTLVHAEASSRKMPNSLCKSDFRLK

SEQ ID NO: 155313 - protein, 104 aa, Glycine max
  Coding DNA Sequence Number=SeqID_38535
MKYNPRLSSRRHHQVDPCYEDARKKSSDGSYLAEIKNYTHAAEDSLRGTSKILLVSCLNPSFCQDTIYMVSLASRSCHWICRAFLDSTKRNASSAKQMVNSHKN

SEQ ID NO: 155314 - protein, 75 aa, Glycine max
  Coding DNA Sequence Number=SeqID_38536
  Subcellular localization annotation: CTP_CleavageSite=44; ConfidenceScore=5.26e-01
MFQLGRQVSRAQCVSSRNARSSRGVGAVKSTSSTSIEEQQVGCCCQRDSGVNMVEQNVRKEARVHKVVDECTEKG

SEQ ID NO: 155315 - protein, 423 aa, Glycine max
  Coding DNA Sequence Number=SeqID_38537
  Gene Ontology: Mol. function=hydrolase activity, acting on glycosyl bonds; Cellular component=nucleus; Biological process=metabolic process
  Homolog annotation: Hit_ID=Q3WAZ6; Match level="QueryCoverage=99%, HitCoverage=50%, E-value=1e-109, Identity=48%"; Hit description =Alpha-L-rhamnosidase
  Pfam annotation: Domain name=Bac_rhamnosid; Domain location=1-423; Score=476.0; E_value=4.5e-140; Accession=PF05592.2; Description =Bacterial alpha-L-rhamnosidase
MELTDVVAEVLGTDLVRTGWFECSDPRLEQLHRNIVWGARGNFLDLPTDCPQRAERLGWTGDIQVFARTANFLFDTSGFLAGWLEDLAAEQRDDGSVPWIVPDVYPGEWVPAAGWGDAATLLPVRLHDAFADDEMLARQYASMKGWVDRIAGLADDRGVWFATGQIGDWLDPDAPAEDPAAAKADPAVIATAYLYRSAGAVAEAARRLGHTDDAAAYEQLASRVAEGFLAEFVDDDGRVRSDCQTVYAIAITFGLLSDPSLLARAGRRLADLVEAADATVSTGFLGTPHILDALHLTGRTDLSFRMLTQTRCPSWLYAVEMGATTMWERWDALQPDGHVHPGSMTSFNHYAYGAVADFLHCRIGGLRPLTPGYRRFAVEPVPGDLVSAAVALDSAAGRIEVRWSRDDQGFAMQVVVPVGATAE

SEQ ID NO: 155316 - protein, 202 aa, Glycine max
  Coding DNA Sequence Number=SeqID_38538
MSETRWRDTECHAQEPVAAGRSRRQRYGREAVSSGESTERWRPERGERDACDRVHGHGGDAVITTQEIAARMCGEQLPLLTIEEFFDGNAQKESLAPNQWGYGRPTLVEIAARLRALETQDDVAWVRVELHPDSEVDKRDGEVWGESIVIGTTAPAAELERRVDVESLRSDGIVESGTGSLDDVCDVPAVEGHERVVFLVWD

SEQ ID NO: 155317 - protein, 120 aa, Glycine max
  Coding DNA Sequence Number=SeqID_38539
  Gene Ontology: Mol. function=nucleic acid binding; Biological process= DNA integration
MAGISYSSVVGSLMYAMVCTRPDIVDVVGVQFLQQLGMKQESYMIHYESQSALDLSKNVMYHSLTNHIDVRYHLLQREVEEQHFKLEKIHIDKNPTNMMSKVVAREKLQLCVELIDMDCL

SEQ ID NO: 155318 - protein, 163 aa, Glycine max
  Coding DNA Sequence Number=SeqID_38540
MSMLLHIPLRMNSALRLEEGYHHASISRQTSAVPDENGMKNIQPKQLEIQEMGRRESALGKDIEQQPTLLEEYHLRNKLERSPATYISSHGFTENSHFPEGKEEIYEKKLKDAAARELMLAEEATMLDRELKRERAKASVAIKSLRQKMEDKLKTELEQKVHN

SEQ ID NO: 155319 - protein, 133 aa, Glycine max
  Coding DNA Sequence Number=SeqID_38541
MRLPPLEDAPVSPALPSRRRANRFKSLLNPKPLNSSNGAGGKSTWGKLLDIDIDSHINVNDPNYDGGELLETSTTQITGILTYEWILEDGLLRDRCGKSTLSTTLPSKTVANRHRRLVTINVESSFCTRVYRV

SEQ ID NO: 155320 - protein, 385 aa, Glycine max
  Coding DNA Sequence Number=SeqID_38542
  Gene Ontology: Mol. function=protein dimerization activity; Cellular component=nucleus; Biological process=regulation of transcription, DNA-dependent
  Homolog annotation: Hit_ID=Q1SIQ3; Match level="QueryCoverage=87%, HitCoverage=86%, E-value=1e-122, Identity=69%"; Hit description=CAMP response element binding (CREB) protein
  Pfam annotation: Domain name=ATG16; Domain location=86-267; Score= -50.6; E_value=0.079; Accession=PF08614.1; Description=Autophagy protein 16 (ATG16)
  Pfam annotation: Domain name=bZIP_1; Domain location=183-247; Score =35.3; E_value=2.1e-07; Accession=PF00170.11; Description=bZIP transcription factor
  Pfam annotation: Domain name=bZIP_2; Domain location=183-237; Score =34.0; E_value=5.3e-07; Accession=PF07716.5; Description=Basic region leucine zipper
  Pfam module annotation: Pfam domain module=ATG16::bZIP_1::bZIP_2; Domain location=86-267::183-247::183-237
  Subcellular localization annotation: CTP_CleavageSite=42; ConfidenceScore=5.86e-01
MATQTQDPPSNPNPNPNATSATPSSSFFFRAGGANGASVAPVAGSGESHSHHRRAQSEVSFRLPEDMMDLSPSDPFNGGSSTASFEEIGSEDDLFSTYIDVEKLSGGANGAGRGGNGSDQSGYGNGAGTSGHNDGEKSSSAAAARPRHRHSSSVDGSTSTCMFGEIMDAKKAMPPDKLAELWNIDPKRAKRILANRQSAARSKERKARYIQELEHKVQTLQTEATTLSAQLTLYQRDTTGLSSENTELKLRLQAMEQQAQLRDALNDALMKEVERLKIATGEALNQSESFNLGMHQMPYAGPNFFSIPPHSGPSGHQNMQLPPFGHSQSTVPTHQLQQTNSHQMSDILQNDQLGRLQGLDISSKGTPMVKSEGPSISANESSTTF

SEQ ID NO: 155321 - protein, 254 aa, Glycine max
  Coding DNA Sequence Number=SeqID_38543
MGKFWGDLVVEEESDTGKEDQDALAFGAQFQRVISKSKKRSWSKGRRKLTPKGSTIPAVGMILYPSLGFCAPHLHPDVTSSSLQLLSCSLIWNNRCVHINAIYAATSHLVRRNLWNSLSALLNANRDPWILNGAKTRQSHLFGEWLDFWSSLTCSTLQRSQSNHFSHSGGHGKGDYKKIIEQVWGQSILSCPMFILTHKLKLLKVALKSWNKDSFGNIPDLVDRAKNELSLIKLFLTGFLRGTATPPFIRWLKL

SEQ ID NO: 155322 - protein, 311 aa, Glycine max
  Coding DNA Sequence Number=SeqID_38544
  Gene Ontology: Mol. function=translation initiation factor activity; Cellular component=cytoplasm; Biological process=regulation of translational initiation
  Homolog annotation: Hit_ID=Q2R678; Match level="QueryCoverage=92%, HitCoverage=58%, E-value=6e-94, Identity=69%"; Hit description =Expressed protein
MYVNQPMNKKGQNKARRRDPLLDSLHLLQLVLEGSFNYVSHGTRIKTRKRNIAAPLDPAAFSDAVVQIYLDNAGDLELIAKSIESSDLNFSRYVPWVFNELFGNQFWIVIIENWMHNSWLRCCPIYQDLLNVAFTGGRTQPGTTKPDEGDRHPYSIIECEPKREVILPSVIYIQKILRRRPFLIKNLENVMRKFLQSLELFEENERKKLAIFTALAFSQKLSGLPPETVFQPLLKDNLVAKGLVLSFMTDFFKEYLIDNSLDDLISILKRGKVEEDLLDIFPPTKRSIEAFSEHFTPLDIASSNSFVDLNM

SEQ ID NO: 155323 - protein, 163 aa, Glycine max
  Coding DNA Sequence Number=SeqID_38545
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=97%, HitCoverage=12%, E-value=2e-62, Identity=76%"; Hit description =CMP/dCMP deaminase, zinc-binding; Bacterial bifunctional deaminase- reductase, C-terminal
  Pfam annotation: Domain name=dCMP_cyt_deam_1; Domain location=30-128; Score=25.1; E_value=2.3e-06; Accession=PF00383.13; Description =Cytidine and deoxycytidylate deaminas
MALSCLTLTANPSSIICKFKASLPTAPHALDATYIRRAAHLADKSAGFTSPHPNFGCVIVSPSGKVAGEGYLYAQGTAAAEVQAVKAAGELCRGATAYLNMEPGDCHGDHSAVSALLQGGVKRVVVGMRHPLQHLRGNAVRALRNQGLHVDLLGEDLTSNLIE

SEQ ID NO: 155324 - protein, 263 aa, Glycine max
  Coding DNA Sequence Number=SeqID_38546
  Gene Ontology: Mol. function=zinc ion binding
  Homolog annotation: Hit_ID=Q1T1D9; Match level="QueryCoverage=96%, HitCoverage=90%, E-value=2e-41, Identity=38%"; Hit description=Zinc finger, RING-type; RINGv
  Pfam annotation: Domain name=zf-C3HC4; Domain location=65-111; Score =45.4; E_value=1.9e-10; Accession=PF00097.15; Description=Zinc finger, C3HC4 type (RING finger)
MPVYIMGDHVTVSTTQQHIAIPIEKLNALSLEVAKEEKHVTDDAYVDNVQKPEEKDEETQEKGDCRYCQEEDFIFNMESPCNCNGSVKYVHKRCIDQWYNSKGRMILCEICRKPYNPNDYPLPELHYDDDDTEITILRQVISTYCSSIMEEWTIPGTSIEIWSPLVLADRATKGLIDSMNKDFSLKNPSGGVIFGMSLVIFIAVLLIKDAYECAPPKEEKFARFLYCAVMTISVPVYILSWVLQCQAYRKSERGRERERHRNA

SEQ ID NO: 155325 - protein, 67 aa, Glycine max
  Coding DNA Sequence Number=SeqID_38547
MARSVSALCPYSKDLYGRELTRLLVIIPKAVISLLKVSRGIIPFEEHIAAVGTTSNNTFSKRKTLDE

SEQ ID NO: 155326 - protein, 339 aa, Glycine max
  Coding DNA Sequence Number=SeqID_38548
  Gene Ontology: Mol. function=protein binding; Cellular component =integral to membrane; Biological process=defense response to fungus
  Homolog annotation: Hit_ID=Q949G9; Match level="QueryCoverage=97%, HitCoverage=35%, E-value=1e-50, Identity=36%"; Hit description =HcrVf1 protein
  Pfam annotation: Domain name=LRRNT_2; Domain location=14-54; Score =47.6; E_value=4.3e-11; Accession=PF08263.3; Description=Leucine rich repeat N-terminal domain
  Pfam annotation: Domain name=LRR_1; Domain location=107-132; Score =10.1; E_value=3.7; Accession=PF00560.23; Description=Leucine Rich Repeat
  Pfam annotation: Domain name=LRR_1; Domain location=134-156; Score =17.3; E_value=0.054; Accession=PF00560.23; Description=Leucine Rich Repeat
  Pfam annotation: Domain name=LRR_1; Domain location=187-208; Score =11.4; E_value=2.1; Accession=PF00560.23; Description=Leucine Rich Repeat
  Pfam annotation: Domain name=LRR_1; Domain location=213-235; Score =4.6; E_value=39; Accession=PF00560.23; Description=Leucine Rich Repeat
  Pfam annotation: Domain name=LRR_1; Domain location=237-262; Score =1.5; E_value=1.5e+02; Accession=PF00560.23; Description=Leucine Rich Repeat
  Pfam annotation: Domain name=LRR_1; Domain location=264-287; Score =10.2; E_value=3.5; Accession=PF00560.23; Description=Leucine Rich Repeat
  Pfam annotation: Domain name=LRR_1; Domain location=289-311; Score =13.2; E_value=0.97; Accession=PF00560.23; Description=Leucine Rich Repeat
  Pfam annotation: Domain name=LRR_1; Domain location=313-335; Score =9.8; E_value=4.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=14-54::107 -132::134-156::187-208::213-235::237-262::264-287::289-311::313-335
LWLFSLPCRESVCIPSERETLLKIKNNLIDPSNRLWSWNHNNTNCCHWYGVLCHNVTSHVLQLHLNTSDSAFYHDHDGYLYSDFDEEAYEKSQFGGVISPCLADLKHLNYLDLSGNEFLGEGMSIPSFLGTMTSLTHLNLSYTGFTGKIPPQIGNLSNLVYLDLGGYLTDLGFLFAENVEWVSSMWKLEYLDLSSANLSKAFHWLHTLQSLPSLTHLYLSRSLLPHYNEPSLLNFSSLQTLHLSLTSYSPAISFVPKWIFKLKKLVSLQLSYNFQIQGPIPCGIRNLTHLQNLDLSFNSFSSSIPNCLYGLHRLKFLNLGETNLHGTISDALGNLTSLC

SEQ ID NO: 155327 - protein, 64 aa, Glycine max
  Coding DNA Sequence Number=SeqID_38549
  Subcellular localization annotation: CTP_CleavageSite=26; ConfidenceScore=5.56e-01
MELTSGDVSSTSRTSQSLTDSSHGLRMASSSNSGACTAHPSSRFFLTLSRKSGALSGWLVKSAD

SEQ ID NO: 155328 - protein, 87 aa, Glycine max
  Coding DNA Sequence Number=SeqID_38550
MIQEKKMKKKNKEKAQQWEKCSQVEIQQESILQVNTPPHQLIAKEERHGKHEKVISVILSLITSTSLAMIWKVFPKYMSFMESFAKR

SEQ ID NO: 155329 - protein, 73 aa, Glycine max
  Coding DNA Sequence Number=SeqID_38551
MGIKHFEVIKRRSHADKQWFSDEIRNTGRHYGGNRVGNVGPRQKIMEGQNKIEGVELNVPAFKGRNNPNAYLD

SEQ ID NO: 155330 - protein, 311 aa, Glycine max
  Coding DNA Sequence Number=SeqID_38552
  Gene Ontology: Mol. function=chitin binding; Cellular component =extracellular region; Biological process=chitin metabolic process
  Homolog annotation: Hit_ID=UPI000044A8F0; Match level="QueryCoverage =60%, HitCoverage=99%, E-value=7e-30, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PHLPHFKTKVACICIPKNHVLAFRGLHALAFRGLHALAFRRLHVLAFRGLHALAFRGLHVLAFRGLNAITFRGLHVLAFSRLHALAFTGLHALAFIGLHVLAFKGLHVLPFRGLHVLAFRGLHALVFTGMHVLAFRRLHVLAFRGLHVLAFRGLHVLAFRRLHVLAFRGLHVLAFRGLHVLSFGGLHILAFRGLHALAFSGLHVLTFTGLHIRAFRELKDRSHKTPSGPEEVQQGPGVSSSDYGPLSILRSARRPQQGRRRARHHNSLGKASSEQQTHHHHLQNPPQFIYKGWSVAYDTWSTSRRPSPKPQ

SEQ ID NO: 155331 - protein, 356 aa, Glycine max
  Coding DNA Sequence Number=SeqID_38553
  Gene Ontology: Mol. function=transcription factor activity; Cellular component=intracellular; Biological process=regulation of transcription, DNA-dependent
  Homolog annotation: Hit_ID=P75989; Match level="QueryCoverage=66%, HitCoverage=97%, E-value=2e-85, Identity=64%"; Hit description =Putative HTH-type transcriptional regulator ycgE
  Pfam annotation: Domain name=MerR; Domain location=14-51; Score=48.4; E_value=2.4e-11; Accession=PF00376.13; Description=MerR family regulatory protein
MEVLSVRELMAYYSIGEVAERCGINPVTLRAWQRRYGLLKPQRSEGGHRQFDDEDILRIEEIKRLMKSGVSVGKVKALLENKEVLTQGNWLAFQEEMMTVLRYASPAKLRAKVGEFRRDHPMDALIDNIISPVRQRMNQDQNTVRHMASLFDGVLIEFAIASLAESRKKAGKDALLIGWECDDRTHLWLEAARLSQKGWHIDVLAEPIDSPRPELFPGQKIFVWTGKSPTPRQQEQLDHWREQGFAFRISVHTLWGDLKISTASDDQDAKDATESFYKSYLSAFGSDDARPYPADELRKYVSADTIARIDAIQEINEQELIESDYFTYTQDYSREWIPALRVENARPFLNGEVVHL

SEQ ID NO: 155332 - protein, 76 aa, Glycine max
  Coding DNA Sequence Number=SeqID_38554
MELTSRVGRVGVVPSWEKRLLDSSKGIRAISGRFFTGRFFLRLELMQDLNRQRDEALQESGLQQGLFVVGQMSFAG

SEQ ID NO: 155333 - protein, 58 aa, Glycine max
  Coding DNA Sequence Number=SeqID_38555
MLDILVSHEGEYLYLEACHSVWSSLETEVDHLGGRGVACAQQGDLDTYCPVFLSESVV

SEQ ID NO: 155334 - protein, 68 aa, Glycine max
  Coding DNA Sequence Number=SeqID_38556
MKLAYEISLLIKHWREALCEHCGISWDLLLSFGFEEVIIRDYKDLMMSWKEALCEAAGISRVVVLNSW

SEQ ID NO: 155335 - protein, 99 aa, Glycine max
  Coding DNA Sequence Number=SeqID_38557
MDIANKIDYFVERWREGLFVAIRISWRGSLITEKLTDLLVKHWRETLCEALCEAVGFDGADLYYRETVMVDKIELLVVNWSKALCEAVSILGGAHLNSK

SEQ ID NO: 155336 - protein, 68 aa, Glycine max
  Coding DNA Sequence Number=SeqID_38558
MHHAHRSAQLEPAAPDEADNEKLNGTQQQKPDAEHHEPAAAVLPAPRQTKGRAAVAPKESPAAECRPG

SEQ ID NO: 155337 - protein, 263 aa, Glycine max
  Coding DNA Sequence Number=SeqID_38559
  Gene Ontology: Mol. function=malate dehydrogenase (acceptor) activity; Cellular component=membrane; Biological process =tricarboxylic acid cycle
  Homolog annotation: Hit_ID=Q390Q5; Match level="QueryCoverage=97%, HitCoverage=46%, E-value=1e-93, Identity=65%"; Hit description =Malate dehydrogenase
  Pfam annotation: Domain name=DAO; Domain location=27-262; Score= -57.4; E_value=0.039; Accession=PF01266.14; Description=FAD dependent oxidoreductase
  Pfam annotation: Domain name=Mqo; Domain location=22-263; Score =227.5; E_value=3e-65; Accession=PF06039.5; Description =Malate:quinone oxidoreductase (Mqo)
  Pfam module annotation: Pfam domain module=DAO::Mqo; Domain location =27-262::22-263
MSNTAVNLALAAAGMESTHLQERKDVDVLLIGAGVMSATLGTWLQDLEPDWSIEMVERLDDVAVESSNGWNNAGTGHAALAELNYTPERADGSIDIAKAVAINESFQISRQFWAYHVQKGNLSNPQSFIHSTPHMSFVWGEANVAFLRKRFQALQKSTLFRGMNYSEDRDQIAEWIPLVMNGRDRKQKVAATWTDMGTDVNFGEVTRQLIAALEKKENFRLRLRQEVRDIKRLSDGRWQVSLHNLASGESRVLTARQLFIGAG

SEQ ID NO: 155338 - protein, 190 aa, Glycine max
  Coding DNA Sequence Number=SeqID_38560
  Gene Ontology: Mol. function=structural molecule activity; Cellular component=integral to membrane
  Homolog annotation: Hit_ID=Q6D4K1; Match level="QueryCoverage=97%, HitCoverage=100%, E-value=6e-56, Identity=56%"; Hit description =UPF0059 membrane protein ECA2389
  Pfam annotation: Domain name=DUF204; Domain location=108-179; Score =91.2; E_value=3.2e-24; Accession=PF02659.6; Description=Domain of unknown function DUF
  Pfam annotation: Domain name=DUF204; Domain location=6-82; Score =98.1; E_value=2.6e-26; Accession=PF02659.6; Description=Domain of unknown function DUF
  Pfam annotation: Domain name=DUF981; Domain location=1-158; Score= -78.5; E_value=0.048; Accession=PF06168.2; Description=Protein of unknown function (DUF981)
  Pfam module annotation: Pfam domain module=DUF204::DUF204::DUF981; Domain location=108-179::6-82::1-158
MTFIATLILAFGMSMDAFAAALGKGASLYRPGFKEALRTGLIFGVIEMLTPLVGWAIGLAASHYIMAWDHWVAFGLLGILGGRMIMEGFRQTADEPCEAPQRHGFMVLALTAVATSLDALAVGVGLAFLQVNIVLTALTIGAATTIMATTGVLVGRFIGPVMGKWAEVLGGVVLISIGCTILIEHLGLFR

SEQ ID NO: 155339 - protein, 224 aa, Glycine max; identical to SEQ ID NO: 125230
  Coding DNA Sequence Number=SeqID_38561
  Gene Ontology: Mol. function=oxidoreductase activity; Cellular component=membrane; Biological process=metabolic process
  Homolog annotation: Hit_ID=Q2SKG5; Match level="QueryCoverage=99%, HitCoverage=88%, E-value=3e-79, Identity=67%"; Hit description=Short- chain alcohol dehydrogenase-like protein
  Pfam annotation: Domain name=KR; Domain location=7-193; Score=-61.4; E_value=0.00085; Accession=PF08659.1; Description=KR domain
  Pfam annotation: Domain name=adh_short; Domain location=4-176; Score =81.2; E_value=3.3e-21; Accession=PF00106.15; Description=short chain dehydrogenase
  Pfam module annotation: Pfam domain module=KR::adh_short; Domain location=7-193::4-176

SEQ ID NO: 155340 - protein, 244 aa, Glycine max
  Coding DNA Sequence Number=SeqID_38562
  Gene Ontology: Mol. function=protein binding; Cellular component =integral to membrane; Biological process=defense response to fungus
  Homolog annotation: Hit_ID=Q1SWI6; Match level="QueryCoverage=85%, HitCoverage=92%, E-value=1e-41, Identity=44%"; Hit description =Leucine-rich repeat, plant specific
  Pfam annotation: Domain name=LRRNT_2; Domain location=27-67; Score =50.1; E_value=7.2e-12; Accession=PF08263.3; Description=Leucine rich repeat N-terminal domain
  Pfam annotation: Domain name=LRR_1; Domain location=118-143; Score =7.1; E_value=13; Accession=PF00560.23; Description=Leucine Rich Repeat
  Pfam annotation: Domain name=LRR_1; Domain location=145-167; Score =16.5; E_value=0.094; Accession=PF00560.23; Description=Leucine Rich Repeat
  Pfam annotation: Domain name=LRR_1; Domain location=169-194; Score =11.6; E_value=1.9; Accession=PF00560.23; Description=Leucine Rich Repeat
  Pfam annotation: Domain name=LRR_1; Domain location=196-218; Score =14.2; E_value=0.49; Accession=PF00560.23; Description=Leucine Rich Repeat
  Pfam module annotation: Pfam domain module=LRRNT_2::LRR_1::LRR_1::LRR_ 1::LRR_1; Domain location=27-67::118-143::145-167::169-194::196-218
MNSSSIYILVFVQLWLLSLPCRESVCIPSERETLMKFKNNLNDPSNRLWSWNHNNTNCCHWYGVLCHNLTFHVLQLHLHTSDSVFYHYYDSYSHFDEEAYRRWSFGGEISPCLADLKHLNYLDLSANEFLGEGMSIPSFLGTMTSLTHLNLSHTGFNGKIPPQIGNLSKLRYLDLSGNYLLGGGMSIPSFLGTMTSLTHLDLSGTGFMGKIPSQIWNLSNLVYLGLGGDSDVEPLFAENVEWLS

SEQ ID NO: 155341 - protein, 125 aa, Glycine max
  Coding DNA Sequence Number=SeqID_38563
MKVTSTQNMSKASSSSCNLLQKEVDQMNLYQLFERKATNTGRHIRPSIVKKRLSFELQNVAVGLSSAAGLSAYPPLSTLSAKENLIEHQDQRPCAKRDINALSVAGAFSQAKFEIGAKPNFTYSR

SEQ ID NO: 155342 - protein, 118 aa, Glycine max
  Coding DNA Sequence Number=SeqID_38564
MPARRKKAISLFWVIPLHGEDSQSGQSLGTRIGPSKTNRNGVIGIPRKHLEEKVKALADQGEWSSFIDVLVLLVFGVVLFSNMDGLVDLAVIYAFLAYHHSKESPVVAVLADAYDTFD

SEQ ID NO: 155343 - protein, 178 aa, Glycine max
  Coding DNA Sequence Number=SeqID_38565
MECGANKRIRSLGEAVMGSSAETPEESEEVQALKVELERAQAVKEKFKTMAIKVHKECDELRDINIATTEALEWETKRARKEEWGQNKTKENMWAIIDQYKEKLNLAATHEQRLEDEYAKVSVLQVEREARERVIYSLHREVMMWMDRFAFTLNGSQELPRLLAKAKAMADVYSAPEE

SEQ ID NO: 155344 - protein, 115 aa, Glycine max
  Coding DNA Sequence Number=SeqID_38566
MAAVRLQLAAAGLPPAAGHAIFLYEGFANGRPDKLGGSDQHFIELAQDHDQSRKPQCPVGLLQVHWNVAEQQRHPNLCKGGHTSAHDLHPSPSYALGKVLPQNAQQLADGLLIEA

SEQ ID NO: 155345 - protein, 111 aa, Glycine max
  Coding DNA Sequence Number=SeqID_38567
RVHLLGVCYTENKRGYISCGSAQVEGTSTWFFKENKGGYIPCGYLACKGFYKVERNLKNQLVAWGLDVGTGCDQTSKKELISWSVKVVVALSELSGLSVYPSLSAASTRLA

SEQ ID NO: 155346 - protein, 264 aa, Glycine max
  Coding DNA Sequence Number=SeqID_38568
  Homolog annotation: Hit_ID=Q6CQE5; Match level="QueryCoverage=14%, HitCoverage=35%, E-value=3e-09, Identity=79%"; Hit description =Protein TAR1
YALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGDFGPGPPLRTLLQTTIRTPRATDFHGGLFPGSLAVTKGNPWSSMGPELTRLARDWSRAWLIHHFITAKSAMNPDFQPNPRGGRALGLMASGATCVQRLDGSRDSAIHTKYRISLRSSSMQEPRYPLPRVI

SEQ ID NO: 155347 - protein, 522 aa, Glycine max
  Coding DNA Sequence Number=SeqID_38569
  Homolog annotation: Hit_ID=Q936B2; Match level="QueryCoverage=46%, HitCoverage=66%, E-value=7e-58, Identity=47%"; Hit description =Heptosyltransferase
AVLRLAANQLDLTVGRVRQQPLRQLNKVVDRPAAQRFGSAHLKADQDLARRFGARRESDANEHRRVIGAAAQLPHHIQLALNQMAAGAAADAGQPALHAARFVAINVFEQVLAAGGDGDQHIVRRLRVQDDRQLRPVFSQAPDNAQHVFGLVVPVNHVMKAGAAFDQLPVFMAGDQRDLRVGIAFAQCANGGRVEHQIAEGAGGENHDALKGLLRIEACYGPEIARDAGIETQPGVGRRYFPLFRHCSSLPLEIGGHRLAPRRIIQARQRRANGPQQIATDANRVARIAGDLAALIAGAVHHADERGMGVAAEFLELMHDAQRRAGVGFFRRHRQPDAFAAHALVHLFRLRVGIGIEAERAIEKGLGLRRHAVPVNRRAEYRAVGRQEVLQKQLGVAIGRWRRVAFIAQKTAQVIIEKMQAGGRAGFGGARQNRLRQRGAIAVAARAADQHHQTFGLMSCIHVMFLAQLISRGFAMFATLPVNALRTFESAARLRSFKLAAAELAVTPTAISHQIKALEQQL

SEQ ID NO: 155348 - protein, 207 aa, Glycine max
  Coding DNA Sequence Number=SeqID_38570
  Gene Ontology: Mol. function=protein binding; Cellular component =integral to membrane; Biological process=defense response to fungus
  Homolog annotation: Hit_ID=Q1T435; Match level="QueryCoverage=84%, HitCoverage=81%, E-value=6e-38, Identity=46%"; Hit description =Leucine-rich repeat; Leucine-rich repeat, cysteine-containing type
  Pfam annotation: Domain name=LRRNT_2; Domain location=33-75; Score =44.9; E_value=2.8e-10; Accession=PF08263.3; Description=Leucine rich repeat N-terminal domain
  Pfam annotation: Domain name=LRR_1; Domain location=108-130; Score =13.6; E_value=0.74; Accession=PF00560.23; Description=Leucine Rich Repeat
  Pfam annotation: Domain name=LRR_1; Domain location=133-155; Score =15.4; E_value=0.21; Accession=PF00560.23; Description=Leucine Rich Repeat
  Pfam annotation: Domain name=LRR_1; Domain location=157-180; Score =6.6; E_value=17; Accession=PF00560.23; Description=Leucine Rich Repeat
  Pfam annotation: Domain name=LRR_1; Domain location=182-204; Score =17.5; E_value=0.05; Accession=PF00560.23; Description=Leucine Rich Repeat
  Pfam module annotation: Pfam domain module=LRRNT_2::LRR_1::LRR_1::LRR_ 1::LRR_1; Domain location=33-75::108-130::133-155::157-180::182-204
MERMRGIESVVLVSRGSILGFNSLPNSAEIKCIESERQALLNFTHGLIDDSGILSTWRDHDTNRDCCKWKGIQCNNQTGHVETLHLRGQDTQYLIGEINISSLISLENIEHLDLSYNLFEGSHIPELMGSFTNLRYLNLSDSSFGGSIPSDIGKLTHLLSLDLGKNFYLQGKIPYQLGNLTHLQYLDLSDNDLNGELPYQLGNLSQL

SEQ ID NO: 155349 - protein, 728 aa, Glycine max
  Coding DNA Sequence Number=SeqID_38571
  Gene Ontology: Mol. function=protein binding; Cellular component =integral to membrane; Biological process=xylan catabolic process
  Homolog annotation: Hit_ID=Q949G8; Match level="QueryCoverage=90%, HitCoverage=91%, E-value=1e-115, Identity=33%"; Hit description =HcrVf2 protein
  Pfam annotation: Domain name=LRR_1; Domain location=119-141; Score =14.4; E_value=0.41; Accession=PF00560.23; Description=Leucine Rich Repeat
  Pfam annotation: Domain name=LRR_1; Domain location=148-170; Score =5.6; E_value=25; Accession=PF00560.23; Description=Leucine Rich Repeat
  Pfam annotation: Domain name=LRR_1; Domain location=15-40; Score=7.1; E_value=13; Accession=PF00560.23; Description=Leucine Rich Repeat
  Pfam annotation: Domain name=LRR_1; Domain location=172-195; Score =13.6; E_value=0.71; Accession=PF00560.23; Description=Leucine Rich Repeat
  Pfam annotation: Domain name=LRR_1; Domain location=197-220; Score =10.5; E_value=3.1; Accession=PF00560.23; Description=Leucine Rich Repeat
  Pfam annotation: Domain name=LRR_1; Domain location=221-243; Score =2.9; E_value=81; Accession=PF00560.23; Description=Leucine Rich Repeat
  Pfam annotation: Domain name=LRR_1; Domain location=245-268; Score =15.4; E_value=0.2; Accession=PF00560.23; Description=Leucine Rich Repeat
  Pfam annotation: Domain name=LRR_1; Domain location=270-292; Score =2.2; E_value=1.1e+02; Accession=PF00560.23; Description=Leucine Rich Repeat
  Pfam annotation: Domain name=LRR_1; Domain location=315-333; Score =0.0; E_value=2.8e+02; Accession=PF00560.23; Description=Leucine Rich Repeat
  Pfam annotation: Domain name=LRR_1; Domain location=341-362; Score =11.1; E_value=2.4; Accession=PF00560.23; Description=Leucine Rich Repeat
  Pfam annotation: Domain name=LRR_1; Domain location=365-387; Score =14.2; E_value=0.47; Accession=PF00560.23; Description=Leucine Rich Repeat
  Pfam annotation: Domain name=LRR_1; Domain location=389-411; Score =8.9; E_value=6.1; Accession=PF00560.23; Description=Leucine Rich Repeat
  Pfam annotation: Domain name=LRR_1; Domain location=413-435; Score =11.2; E_value=2.3; Accession=PF00560.23; Description=Leucine Rich Repeat
  Pfam annotation: Domain name=LRR_1; Domain location=438-460; Score =13.2; E_value=0.97; Accession=PF00560.23; Description=Leucine Rich Repeat
  Pfam annotation: Domain name=LRR_1; Domain location=44-67; Score=7.1; E_value=13; Accession=PF00560.23; Description=Leucine Rich Repeat
  Pfam annotation: Domain name=LRR_1; Domain location=462-484; Score =14.1; E_value=0.51; Accession=PF00560.23; Description=Leucine Rich Repeat
  Pfam annotation: Domain name=LRR_1; Domain location=540-562; Score =13.0; E_value=1; Accession=PF00560.23; Description=Leucine Rich Repeat
  Pfam annotation: Domain name=LRR_1; Domain location=564-586; Score =17.4; E_value=0.053; Accession=PF00560.23; Description=Leucine Rich Repeat
  Pfam annotation: Domain name=LRR_1; Domain location=588-610; Score =18.3; E_value=0.029; Accession=PF00560.23; Description=Leucine Rich Repeat
  Pfam annotation: Domain name=LRR_1; Domain location=612-633; Score =10.2; E_value=3.5; Accession=PF00560.23; Description=Leucine Rich Repeat
  Pfam annotation: Domain name=LRR_1; Domain location=70-92; Score =12.7; E_value=1.2; Accession=PF00560.23; Description=Leucine Rich Repeat
  Pfam annotation: Domain name=LRR_1; Domain location=95-117; Score =16.5; E_value=0.094; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR_1; Domain location=...
  Pfam module annotation: Domain location=119-141::148-170::15-40::172 -195::197-220::221-243::245-268::270-292::315-333::341-362::365 -387::389-411::413-435::438-460::44-67::462-484::540-562::564 -586::588-610::612-633::70-92::95-117
  Subcellular localization annotation: CTP_CleavageSite=77; ConfidenceScore=5.87e-01
MTSSVFQGGFNFSSKLQNLYLRSCSLTDRSFLMSSSFNMSSSSSLVSLDLSSNLLKSSTIFYWLFNSTTNLHHLFLYKNMLEGPIPDGFGKVMNSLEVLYLWGNELQGEIPSFFGNMCALQSLDLSNNKLNGEISSFFQNSSWCNRYIFKGLDLSYNRLTGMLPKSIGLLSELEDLNLAGNSLEGDVNESHLSNFSKLQSLDLSENSLSLKLVPSWVPPFQLKYLGIRSSKLGPTFPSWLKTQSSLYELDISDNGINDSVPDWFWNNLQYMRDLNMSFNYLIGVIPNISVKLPMRPSIILNSNQFEGKIPSFLLQASQLILSENNFSDMFSFLCDQSTAAYLTTLDVSHNQIKGQLPDCWKSVKQLVILDLSSNKLSGKIPMSMGALINMNALVLRNNGLMGELPSSLKNCSSLFMLDLSENMLSGPIPSWIGESMHQLIILNMRGNHLSGNLPIHLCYLKRIQLLDLSRNNLSSGIPSCLKNLTAMSEQTINSSDTMNLIYGNGKTYVVLNGDIFGGYTLDITWMWKGVERGFKDPELELKSIDLSCNNLMGEIPKEVGYLLGLVSLNLSRNNLSGEIPSQIGNLGSLESLDLSRNHISGRIPSSLSEIDDLGKLDLSHNSLSGRIPSGRHFETFEASSFEGNIDLCGEQLNKTCPGDGDQTTEEGQEPPVKGDDSVFYEGLYMSLGIGYFTGFWGLLGPLLLWRPWRIAYIRFLNRLTDYVYVCLW

SEQ ID NO: 155350 - protein, 123 aa, Glycine max
  Coding DNA Sequence Number=SeqID_38572
MLIVADVLHASDQRRNHCWQLQELTTYSYSRTIITVPDLHFIELFHISKNIMTNSCFPKLMYALVLLLLRASGSILGFNWLSNGVEIKCIEMERQALLKFKQGILVEPGILSTWSDDDRNSDC

SEQ ID NO: 155351 - protein, 88 aa, Glycine max
  Coding DNA Sequence Number=SeqID_38573
DEWIKGFCGHIGFADILKAELLGLHFGLRIAWEENCSNVLCVSDSLLHAGGVEAFSGRGESVCGCPSQEKGDHVPRSSSFGVSFLTLG

SEQ ID NO: 155352 - protein, 56 aa, Glycine max
  Coding DNA Sequence Number=SeqID_38574
MVVGGEYSRRWVLVFLGWWWGDRSSKGLTPTNHKNKVANHEIVREGHLRKRVTHSL

SEQ ID NO: 155353 - protein, 99 aa, Glycine max
  Coding DNA Sequence Number=SeqID_38575
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q5EMP6; Match level="QueryCoverage=56%, HitCoverage=21%, E-value=6e-13, Identity=68%"; Hit description =Senescence-inducible chloroplast stay-green protein 2
MCGARVLTFDQIEGLKNPDVQCWGTEEGVDENQHLGNLPRTYTLTHTDITAKLTLAISQTINNSQQKFSEEDADVVAKQKKPVYLTFLLCKRTLFGPKG

SEQ ID NO: 155354 - protein, 154 aa, Glycine max
  Coding DNA Sequence Number=SeqID_38576
YIYLDCYTENKRGYISCGSVQVERTSTWLFKENKEGYIPCGSLLVKDFTRLLEISRIGGCLGTGFPGQRRVWQIIFKKSYSFSNKKKMKALSQRRKKIILQKKMTPSTKMKMIVLVDDPAWVGDPEDADELFLIVDSVRANLKLFPELLLALRE

SEQ ID NO: 155355 - protein, 90 aa, Glycine max
  Coding DNA Sequence Number=SeqID_38577
MTGLSLLSLTIGSWYCVVGGILEVVSNPWRFILVKWFCDVDLVSPIGIDRVLIEKDLLADSYLDLEASILDEKEFPIDGILILNQISKTI

SEQ ID NO: 155356 - protein, 87 aa, Glycine max
  Coding DNA Sequence Number=SeqID_38578
MHTEERSSVFEKTLHLLPLSPMVSQTKKRKVSYPKTTLNYIILADKGGGEIQTTNLDDRRNKRTKKLEQRATMAEEKVARCMEENDF

SEQ ID NO: 155357 - protein, 168 aa, Glycine max
  Coding DNA Sequence Number=SeqID_38579
MKQYLHPEKEKYFTSSIEEEGEITMSRNINNFTPLPGSWQRGFRSFDDHTFNHRESNEVPVFYGSHSTHATDGRSSGVLARQRFSDFRNPLGFHSIPNFPAPPPRRQQIHAHNEDMGRLREIFLHPPQRSTFQTSTQALPVVEITKSTALSKLKKVVYDPPPKRYARR

SEQ ID NO: 155358 - protein, 37 aa, Glycine max
  Coding DNA Sequence Number=SeqID_38580
MLFMVLSSGVDSAASPHFVTPSPDSRERVASPTSGGS

SEQ ID NO: 155359 - protein, 82 aa, Glycine max
  Coding DNA Sequence Number=SeqID_38581
  Subcellular localization annotation: CTP_CleavageSite=64; ConfidenceScore=5.15e-01
MGVSVFSSLFMWGGISPVGSDLEWQSQSKNHFKNGFSLCRRSFTSPKIYLHSLFALPLGDSTVLFFGGKDEDSLHGPRFKVA

SEQ ID NO: 155360 - protein, 125 aa, Glycine max
  Coding DNA Sequence Number=SeqID_38582
MELIENMVASDHAILRDRAHIPTKRSLLELSSQDALLAQNKLLSKQLEALTETLNRPLSNFGANREKNPKEECKAVMTRSKMVSMNEGEKRIGEEKQQLVTEPKIDLVVEPLSETEEEVEAEDDQ

SEQ ID NO: 155361 - protein, 49 aa, Glycine max
  Coding DNA Sequence Number=SeqID_38583
MERSNNFNNGKKSQEVSPTLKCYKCNQSEKEINLLSKDYESDENISQED

SEQ ID NO: 155362 - protein, 183 aa, Glycine max
  Coding DNA Sequence Number=SeqID_38584
  Gene Ontology: Mol. function=structural constituent of ribosome; Cellular component=ribonucleoprotein complex; Biological process =translation
  Homolog annotation: Hit_ID=P42794-2; Match level="QueryCoverage=98%, HitCoverage=98%, E-value=1e-74, Identity=80%"; Hit description =Isoform 2 of P42794
  Pfam annotation: Domain name=Ribosomal_L5; Domain location=1-64; Score=68.9; E_value=1.6e-17; Accession=PF00281.9; Description =Ribosomal protein L5
  Pfam annotation: Domain name=Ribosomal_L5_C; Domain location=68-167; Score=213.2; E_value=6e-61; Accession=PF00673.11; Description =ribosomal L5P family C-terminus
  Pfam module annotation: Pfam domain module=Ribosomal_L5::Ribosomal_L5_ C; Domain location=1-64::68-167
MREIKVQKLVLNISVGESGDRLTRAAKVETPSHLAASTNVLEQLSGQTPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 155363 - protein, 189 aa, Glycine max
  Coding DNA Sequence Number=SeqID_38585
  Gene Ontology: Mol. function=nucleic acid binding; Cellular component= mitochondrion; Biological process=DNA integration
  Homolog annotation: Hit_ID=Q1ST43; Match level="QueryCoverage=98%, HitCoverage=16%, E-value=4e-44, Identity=44%"; Hit description =Integrase, catalytic region; Peptidase aspartic, catalytic
MDYSMKLQMNSGNPLSDKSSSSYRRLIGKLIYLTNTRPDIAYEVQQLSQYMSAPTTIHLQSKKQSTVSRSSSEAEYRALASTTCELQWLTYLLQDIRSTFIQPATLYCDNQSAIQIATNPVFHERTKHIEIDCHIVRHKVTSGLIKLLPVSSSLQLADIFTKALTPAIFQHLCNKLGMMNIHSQLEGGS

SEQ ID NO: 155364 - protein, 183 aa, Glycine max
  Coding DNA Sequence Number=SeqID_38586
  Gene Ontology: Mol. function=cysteine-type endopeptidase activity; Cellular component=endoplasmic reticulum; Biological process =proteolysis
  Homolog annotation: Hit_ID=Q9AUC7; Match level="QueryCoverage=97%, HitCoverage=52%, E-value=8e-63, Identity=63%"; Hit description =Cysteine proteinase
  Pfam annotation: Domain name=Peptidase_C1; Domain location=48-182; Score=138.4; E_value=1.9e-38; Accession=PF00112.13; Description =Papain family cysteine protease
MNGNKPYKLGVNLFADLTLEEFKDFRFGLKKTHEFSITPFKYENVTDIPEAIDWREKGAVTPIKDQGQCGSCWAFSTVAATEGIHQITTGNLVSLSEQELVSCDTKGEDQGCEGGYMEDGFEFIIKNGGITTEANYPYKGVNGTCNTTIAASTVAQIKGYETVPSYSEEALQKAVAPTCVSFH

SEQ ID NO: 155365 - protein, 600 aa, Glycine max
  Coding DNA Sequence Number=SeqID_38587
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=72%, E-value=2e-72, Identity=42%"; Hit description =Integrase, catalytic region
  Pfam annotation: Domain name=zf-CCHC; Domain location=205-222; Score =9.6; E_value=0.025; Accession=PF00098.13; Description=Zinc knuckle
  Pfam annotation: Domain name=zf-CCHC; Domain location=241-258; Score =7.6; E_value=0.056; Accession=PF00098.13; Description=Zinc knuckle
  Pfam module annotation: Pfam domain module=RVT_2::Retrotrans_gag::zf -CCHC::zf-CCHC; Domain location=436-599::36-151::205-222::241-258
MVTALSAKNKVEFIDGSAPEPLKIDRTYGAWRRCNNMVVSWIVHSVATSIRQSILWMDKAEEIWRDLKSRYSQGDFLRISDLQQEASTMKQGSLSVTEYFTRLHVIWDEIENFRPDSICSCNIRCSCIAFTIIAQRKLEDRAMQFLRGLNEQYANIRSHVLLMDPLPAISKIFSYVAQQERQLLGNAGPNINFEPKDISINAAKTICDFCGRIGHVESVCYKKHGVPASYGGRNKNNNGRKTCTHCSKIGHTVDVCYRKHGYPPGYKPYDGRTTVNNVVAVESKATDDQAQQHESQKVVRFSPEQYKGITCLNPAAAGRKHGTQPVQTELNLPVESHPSQPIIPMHSCDEHSNKQAPSHLRRSTRSRHSPTYLQDYHRDLASSTPKASTIVRYPLSSMLSYSRLSTAHRNFVMTISSATEPSSYVEASRHDCWIKAMKVELQALQSNNTWRLTLLPPHKTAIGCRWIYKIKYRADGSIERYKACLVAKGYTQMEGLDYLDTFSPVVKLTTVCVLLALAALNRWHLRQLDVNNAFLHGELEEEVYMQVPPGLSVENPKLICRLQRSLYGLKQASRQWFTKLSSFLTSHGFQQSNSDHSLFL

SEQ ID NO: 155366 - protein, 397 aa, Glycine max
  Coding DNA Sequence Number=SeqID_38588
  Gene Ontology: Mol. function=cysteine-type endopeptidase activity; Cellular component=endoplasmic reticulum; Biological process =proteolysis
  Homolog annotation: Hit_ID=Q6F6A4; Match level="QueryCoverage=81%, HitCoverage=90%, E-value=1e-122, Identity=66%"; Hit description =Cysteine protease
  Pfam annotation: Domain name=Inhibitor_I29; Domain location=38-95; Score=107.5; E_value=3.9e-29; Accession=PF08246.2; Description =Cathepsin propeptide inhibitor domain (
  Pfam annotation: Domain name=Peptidase_C1; Domain location=121-328; Score=414.6; E_value=1.4e-121; Accession=PF00112.13; Description =Papain family cysteine protease
  Pfam module annotation: Pfam domain module=Inhibitor_I29::Peptidase _C1; Domain location=38-95::121-328
MAFTCQKQHMLALFLLLAVVISQVMCRKLHETSMRERHEQWMTEYGKVYKDAAEKEKRFQIFKDNVEFIESFNADGNKPYKLGVNHLADLTVEEFKASRNGFKRPHEFSTTTFKYENVTAIPAAIDWRTKGAVTPIKDQGQCGSCWAFSTIAATEGIHQITTGKLVSLSEQELVDCDTKGVDQGCEGGYMEDGFEFIIKNGGITSETNYPYKAVDGKCNKATSPVAQIKGYEKVPPNSETTLQKAVANQPVSVSIDADGAGFMFYSSGIYNGECGTELDHGVTAVGYGTANGTDYWIVKNSWGTQWGEKGYVRMQRENPSLSQLCYRRLWGSQYRRTLILGYYLDAFSNYLLHTWQPNVYRGHDNWHTEADIEVSNLFVNVSFGEDQPIIPRVTFTR

SEQ ID NO: 155367 - protein, 222 aa, Glycine max
  Coding DNA Sequence Number=SeqID_38589
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=97%, HitCoverage=62%, E-value=2e-83, Identity=68%"; Hit description =Peptidase C1A, papain
  Pfam annotation: Domain name=Peptidase_C1; Domain location=18-221; Score=357.7; E_value=1.8e-104; Accession=PF00112.13; Description =Papain family cysteine protease
WVETSTQTSFRYESVTKIPATIDWRKRGAVTPIKDQGRCGSCWAFSAVAATEGIHQITTGKLVPLSEQELVDCVKGESEGCIGGYVDDAFEFIAKKGGIASETHYPYKGVNKTCKVKKETHGVAEIKGYEKVPSNNEKALLKAVANQPVSVYIDAGTHAFKYYSSGIFNVRNCGTDPNHAVAVVGYGKALDGSKYWLVKNSWGTEWGERGYIRIKRDIRAKE

SEQ ID NO: 155368 - protein, 220 aa, Glycine max
  Coding DNA Sequence Number=SeqID_38590
  Gene Ontology: Mol. function=transketolase activity; Cellular component=type II protein secretion system complex; Biological process=protein secretion by the type II secretion system
  Homolog annotation: Hit_ID=Q5PN39; Match level="QueryCoverage=98%, HitCoverage=68%, E-value=1e-101, Identity=85%"; Hit description =Putative transketolase C-terminal section
  Pfam annotation: Domain name=Transketolase_C; Domain location=90-210; Score=142.2; E_value=1.4e-39; Accession=PF02780.10; Description =Transketolase, C-terminal domain
MSLDYQRNNVKVIASDAGVSACHNGGTHMSFEDMGIVRGLAHSVVLEVTDATMFADILRQLMDLRGFYWVRTIRKQATRIYQEGSRFTIGKGNLLRDGDDITLIANGIMVAEALKAAQRLAQQGVSAAVIDMFTLKPIDRELIKTYAAKTGRIVTCENHSIHNGLGSAVAEVLAEECPTQMRRVGVKERYGQVGTQAFLQQEYGLTAEHILEAAGQLLAR

SEQ ID NO: 155369 - protein, 101 aa, Glycine max
  Coding DNA Sequence Number=SeqID_38591
MGACQSVWNFLETQVDHHVGKVACARQGDHNTCCLVLLSESVMWTCLGYFLINDTTLNFRVESAFNGTQEHDSVPIPLTGEQVLERVDDINTVFGKTSLLV

SEQ ID NO: 155370 - protein, 69 aa, Glycine max
  Coding DNA Sequence Number=SeqID_38592
  Subcellular localization annotation: CTP_CleavageSite=52; ConfidenceScore=5.06e-01
MVYNNGINLKILMSHLTTAFKIAPCVVSLGHTVLNGMPQGSSMICTCCVQVISSEKWRLRKPSRGYGYH

SEQ ID NO: 155371 - protein, 103 aa, Glycine max
  Coding DNA Sequence Number=SeqID_38593
  Subcellular localization annotation: CTP_CleavageSite=25; ConfidenceScore=5.15e-01
LITSLRQFYGVPVAPNRVMRPLLTRLSSRSTTPSGRNRGTLVDDWKFDYSIHDARRMVYNDQADMTGRLLVGSLTFDCRIMHFIIVRILLPVLLTLLKPPTRI

SEQ ID NO: 155372 - protein, 256 aa, Glycine max
  Coding DNA Sequence Number=SeqID_38594
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=5e-41, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGSLLQGHDERQRLLHHALASRGLHVLAFRGLHALAFRELHVLTFRGIHILAFRGLHVLTFKGLHVLAFRGHHVFTFRGLHVFAFIGIHVLNFRALHALAFSGLHVLSFKRLHVLVFKGPHVLAFRGLHVLAFRGLHVLAFRGMHTLTLEDYASSPSEDCTSSPSQDCTSLPSEDYTSSTSEDYTSSPSEDYTSSPSEDYMSSPSEDYTSSPSEDYTSSPLEGYTPSPSEGYTSSPSEGYTPSPLEDYTSSPSEDC

SEQ ID NO: 155373 - protein, 212 aa, Glycine max
  Coding DNA Sequence Number=SeqID_38595
MYNYHEKGRAPNLESVLADFMTYQASSKVDSMQQAFKRAETQIGKLVDDMIKVVVRREKEYVEIETHQESILQVNTIHHQLITKEEKDEVSIILEYPCIATTGYVVGKDKGRLELSAEDQKISFDLFEAMKHPDMSDACFEEEEVEHEITLSASTMLDDPKDNFVGHVVLEELEKIRPTEKPKAELKILPAHLKYVFLEDNETKPVIISSSL

SEQ ID NO: 155374 - protein, 170 aa, Glycine max
  Coding DNA Sequence Number=SeqID_38596
  Gene Ontology: Mol. function=zinc ion binding
  Homolog annotation: Hit_ID=Q2HTH7; Match level="QueryCoverage=86%, HitCoverage=54%, E-value=3e-42, Identity=57%"; Hit description=Zinc finger, RING-type
  Pfam annotation: Domain name=zf-C3HC4; Domain location=122-159; Score= 34.7; E_value=3.2e-07; Accession=PF00097.15; Description=Zinc finger, C3HC4 type (RING finger)
MDSVGRGQRRRRTLKERLRFTGIGCCGATWVFRPIVRDEGGGAQAQQQPQETNAGQDPNHTGPEHVGPSQSSSGMNLAAALAAERQFREGEGTPLRVSLMRLLEETEGGDAAVEAVGNDWVCCVCMGRKKGAAFIPCGHTFCRVCSRELWLNRGTCPLCNRSILEILDIF

SEQ ID NO: 155375 - protein, 56 aa, Glycine max
  Coding DNA Sequence Number=SeqID_38597
MDSVHLIVENKGSSTNMSFNLGKDLNYLVLPYSDEENLKGSSSKRHFDGNWDEAEM

SEQ ID NO: 155376 - protein, 108 aa, Glycine max
  Coding DNA Sequence Number=SeqID_38598
MAQATTIEPRSLPSLKEVVISKPKKKMGTNITLSEFNNCSFDYGLMRDETFTLLTSPKELISPPMIAPTVARSTATAATMKAHEGGGRRQKVLHWIEERLRRIFVQAL

SEQ ID NO: 155377 - protein, 97 aa, Glycine max
  Coding DNA Sequence Number=SeqID_38599
MELLVGEEADGGGAGCGCVQRWEIGCECGKDDRAVPRERLGEHAKIEGIESVNEKVREHLHDDIVYKKIGTKPALHRNNYKTHAIHFQNFHCKKERF

SEQ ID NO: 155378 - protein, 76 aa, Glycine max
  Coding DNA Sequence Number=SeqID_38600
MVVVGVGFRPRGRVALSGGSEWWLVVALSGGSRPMVVVRGGGKGLLSGGSWWLGCWYSDCSYSPLPSLSPSDMHSN

SEQ ID NO: 155379 - protein, 114 aa, Glycine max
  Coding DNA Sequence Number=SeqID_38601
MKLAKYRLKAQVEKDEGPKFLSGFLVEPIIRLIKVILVASTRTYLPSPEVASIPTYLPSPEVASNLTYLPSPEVVSILTYLPSLEVASSKTSVACIKRSAPTQVRIIWYQSFGS

SEQ ID NO: 155380 - protein, 243 aa, Glycine max
  Coding DNA Sequence Number=SeqID_38602
YIMNSVIKVLYLNGRVYEENDGVIFEGSKKAIQIKRGISFNALKKKLEKRFLVSGKYVALQICDDEDVETMLESFQQQDQMLVPELYIEKDVDGGSMFHSANSLTSCGNNLSNNGAQPPRNVSNLHGDEDDGDDDDYYLVSNSYVEESLDEDDSIDGISDTDDEVTDMIQPVRIVHPTEGVQGIQNPFWNDALHYNNTKWSHPDEEDICGLEMSSSFNVGQELYVGMNFDSKDAVKNASNNML

SEQ ID NO: 155381 - protein, 204 aa, Glycine max
  Coding DNA Sequence Number=SeqID_38603
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-17, Identity=34%"; Hit description= UPI00006A17C9 related cluster
  Subcellular localization annotation: CTP_CleavageSite=77; ConfidenceScore=5.37e-01
GLHVLAFKGSCTFNFRGLHVLAVKGSCAFTFVGLHALTLGTSYPHRQRTTRPRLERTTRPHHQRAARPHLQRTTCPRLERATRPHLGTTRPRLERTTRPHHQRATRPRLQRTSSPRHQRAARPHLQRTISPRLERATRPHLGGLHVLAVKGSCAFTFVGHALTFRGLHVLAIIGLHSLAFERRHVLNFRGLHALAFRGLRVLTF

SEQ ID NO: 155382 - protein, 129 aa, Glycine max
  Coding DNA Sequence Number=SeqID_38604
  Subcellular localization annotation: CTP_CleavageSite=22; ConfidenceScore=5.01e-01
MQWWFQSQKRCKDKLKLTRNKRRTMVTSKENKSWKIPPRLKGSSRCGVSMENNDSLWWLMVAVGDGERSWNVGNGFGRKKGEEMAFFQRYLDYKAQNAQVSNALGSENIAHTPDIFLKIPTVRSWTSVL

SEQ ID NO: 155383 - protein, 75 aa, Glycine max
  Coding DNA Sequence Number=SeqID_38605
MKKNCPRFQKWLEKKDKSISLVCYESNMADVNVNTWWIDSRSTIPIANSLQGIQNLRKLVGSGNKLGSPVKAIGT

SEQ ID NO: 155384 - protein, 66 aa, Glycine max
  Coding DNA Sequence Number=SeqID_38606
MVVNECVIDICSDITCHVRPKRILRSLGLGGKDTRFECSFKPMLIPCGWGILAKQSNPDWSPYDVT

SEQ ID NO: 155385 - protein, 78 aa, Glycine max
  Coding DNA Sequence Number=SeqID_38607
MYIVVVKQGQDHLGLPSGVKTKHERQKPIKVLKDERKRGWGHDRPIVTLLCAKQAGNVAARQPRILCILQLSFTICLF

SEQ ID NO: 155386 - protein, 129 aa, Glycine max
  Coding DNA Sequence Number=SeqID_38608
MAGTNSEGLCGAVTASLSSEEKERDQSRVDGLILKDELRVCLRSKRSLSQRLCEAETNMLAIISKYQEELDLATAHEHKVADEYARVYADGPVCSYIEWESRASLIVGKGQSYGRHLLRPRGDPRAPPL

SEQ ID NO: 155387 - protein, 144 aa, Glycine max
  Coding DNA Sequence Number=SeqID_38609
  Gene Ontology: Cellular component=mitochondrion
MGAGEALRSRISRGLRGGGLPCGGCQRFESAYLQLVNLVDTKLYDSTSIFPIRQFDLCYDLSFMDVDKILPSSSTLGWHSLKVKGEVQTKKGLWWIPRHPETRKGVVSDEMLRGVENKRRSGDSRYRSTFRTAAESTGRQETTW

SEQ ID NO: 155388 - protein, 143 aa, Glycine max
  Coding DNA Sequence Number=SeqID_38610
  Gene Ontology: Mol. function=oxidoreductase activity; Biological process=antibiotic biosynthetic process
  Homolog annotation: Hit_ID=Q9Z587; Match level="QueryCoverage=53%, HitCoverage=33%, E-value=1e-29, Identity=83%"; Hit description =Putative oxidoreductase
APVASVSISCPSCSATDGVGELELHRGGGRSRTSGSPGLQEFDEPRRSGGAHPAPSSDAAGRAGTGAVRELGGRAACQCRVVRVRCLEARSQGSRRCASRRGGAARSAGDLGLPGTDGDASSLSIPSTSRGGPVPAFVPFSEG

SEQ ID NO: 155389 - protein, 220 aa, Glycine max
  Coding DNA Sequence Number=SeqID_38611
  Gene Ontology: Mol. function=DNA binding
  Homolog annotation: Hit_ID=Q1S0F5; Match level="QueryCoverage=89%, HitCoverage=40%, E-value=6e-17, Identity=31%"; Hit description=IMP dehydrogenase/GMP reductase
MGQLQRQAFCKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVGVPRKCLEEKGKRPWQIKANGLSFIDILAVLIFGVVLFPNMEGLVDLAAIDAFLAFHHGKESPVVAILAMILSSCEGCPMRGVPSDESITPFIARGFSDHNARVLQGVRKAWDAA

SEQ ID NO: 155390 - protein, 93 aa, Glycine max
  Coding DNA Sequence Number=SeqID_38612
MEDSIRENNKSHINQSRGSALDGEEHIGEWRINRENNKDHISHSRGSALDGEEHIGEWRNPIGKITNITFPSHEGPLLTVKNTLENGGIQLGK

SEQ ID NO: 155391 - protein, 62 aa, Glycine max
  Coding DNA Sequence Number=SeqID_38613
MTIICLHMSSGSPPLDDKRRRMTIIYLCVPSDTIVSGWKKGQYDRDCGAADKSEALAPTYPQ

SEQ ID NO: 155392 - protein, 69 aa, Glycine max
  Coding DNA Sequence Number=SeqID_38614
MKQKGKRKKDREGRHVIVKKYKSFVKSKRIFWKQGTDTKSLFSGITEIRMGEFNELMKEHNLETLGLFV

SEQ ID NO: 155393 - protein, 202 aa, Glycine max
  Coding DNA Sequence Number=SeqID_38615
MERWEGSTKYKSNRVTWKMSFLAGRLAGKEAAYFFQESKQAVGKLAQKNPLPKTNNNNLNFHEGYDHADVLPEVLRHSLPSKVFRNDEATSFSFSASKWVLHSDPKTQSSVSPDALNPLRAYLSLPQVTFGPKRWQLPEAANTVSASTANESRLDRYATHVNPEKLKAAGEGLAHDNGLWKTEVVDKAHHNLRLSCDPSYRM

SEQ ID NO: 155394 - protein, 176 aa, Glycine max
  Coding DNA Sequence Number=SeqID_38616
MWSEIVKAQSLKKVINGGGQGVNDSGKVDLTEVWPRRSMPVGESSSLEWQPWKAAMGSQREHQMLGAVSQDNIVFEEPVHPEGNKEKRKKGYAHNKMDSALWNWQASRGQDCQEPLADINNLNASDVAFTTTLTEHPAVPPLPSFSQCLWHQVRRPIGDTTNRRNPLLLQANITDL

SEQ ID NO: 155395 - protein, 97 aa, Glycine max
  Coding DNA Sequence Number=SeqID_38617
MLGAVNQDNLVFEEPVPPEENKEKRMKGILALCSFCWALPLAPPLSPSSYHSLTLVQNNERKWENTKRKKGSVIVIHRKSPPATMIDGRSENCKDGY

SEQ ID NO: 155396 - protein, 138 aa, Glycine max
  Coding DNA Sequence Number=SeqID_38618
  Gene Ontology: Mol. function=catalytic activity
  Homolog annotation: Hit_ID=Q10G25; Match level="QueryCoverage=81%, HitCoverage=25%, E-value=2e-32, Identity=56%"; Hit description =Expressed protein
  Pfam annotation: Domain name=DUF860; Domain location=1-124; Score= -56.0; E_value=9.8e-10; Accession=PF05898.4; Description=Plant specific of unknown function (DUF860)
FDLEKRVKTWVENWQKLPYVSPYEDAFHLDSNSDQAEKWTVAILHELLSLLVSKKTERDNLLCFGECLGLALRFKKALVHHPGIFYLSNKIRTQTVVLREAYRKDFLVKNHPLVVVGSGTNATGVINQTIAGEWSGHL

SEQ ID NO: 155397 - protein, 226 aa, Glycine max
  Coding DNA Sequence Number=SeqID_38619
  Homolog annotation: Hit_ID=Q1RZZ2; Match level="QueryCoverage=37%, HitCoverage=49%, E-value=3e-13, Identity=46%"; Hit description =Ribonuclease H
GDVNRSDNDRNISSGGNVDDGGINDDGSGNNVSGDGGGGDNGDSDDIDSGGDSNINDDADVSGYDDDSDGGSSDNDDSTNGVVLVVAMLVVMVMLVLTVVTMTIRVVVVVLMVTTNYGDDIDGVVGVSLCFIVLNTDGSVQGQNLKAGGFAKKIGICYAFVAELWGVYEGLKLAFIEGCSCLEVQVDSKAVVASIKGGKQGCVMGMRLIVGIRQLLAQRTINGQLF

SEQ ID NO: 155398 - protein, 38 aa, Glycine max
  Coding DNA Sequence Number=SeqID_38620
MTVIATKSILLKPLGRDGTVRRHLAEEIPIVVPRYKFL

SEQ ID NO: 155399 - protein, 94 aa, Glycine max
  Coding DNA Sequence Number=SeqID_38621
MEGSQQNTHYPKEKLPKIITHKWKFSNLLEAPNTLPMKGLFVTKLESNEVLLSPIALKVVGPFLLDSNSSRDGINPPSNSLYGNPQTWKQRDKQ

SEQ ID NO: 155400 - protein, 179 aa, Glycine max
  Coding DNA Sequence Number=SeqID_38622
  Gene Ontology: Mol. function=methyltransferase activity; Cellular component=nucleus; Biological process=protein kinase C activation
  Homolog annotation: Hit_ID=Q2QWV0; Match level="QueryCoverage=61%, HitCoverage=32%, E-value=2e-23, Identity=40%"; Hit description =Pentatricopeptide, putative, expressed
  Pfam annotation: Domain name=PPR; Domain location=60-94; Score=45.6; E_value=1.7e-10; Accession=PF01535.11; Description=PPR repeat
MKPNSSTFSGLLSACPTSGAIQKLKLDAVLGTTLVDVCAKCGFLDEAMDIFDRMEDKDVKSWTAMISGLGVHGQPNNAIRLFNRMEKEGFKPNELTFLAILTACSHGGLVVEGIIYRDVKLGKCVKDVLKSIYAEHPTNSLLISSTYAVVGRIVDFTRMQEMKQRNTKFKWTLLNDKID

SEQ ID NO: 155401 - protein, 264 aa, Glycine max
  Coding DNA Sequence Number=SeqID_38623
  Gene Ontology: Mol. function=sugar binding; Biological process =ubiquitin cycle
  Homolog annotation: Hit_ID=Q1SGL1; Match level="QueryCoverage=99%, HitCoverage=99%, E-value=1e-39, Identity=35%"; Hit description =Cyclin-like F-box
  Pfam annotation: Domain name=F-box; Domain location=3-50; Score=22.7; E_value=0.0013; Accession=PF00646.23; Description=F-box domain
MDTITKVLPEECVATIISLTSAKDACQLSPVSPSLKAIADSDAVWANFLPSDCEDIIDQSSTPTLNLLSKKQIYAYLCDYHVLFDNGNMTLSLEKATGKKCIMVSAKGFKISSGDKPCYWYWESTPKSRFYEVAMLKYMWWLEILGSLEAKFLSANTNYGVYFIFNFENHGSEFIYLNQYFQPRTYGDLVVCEGNINGYRKRVCLDPPGEEVHEREDGWMEVEMGEFFSEDHEDNLVGFKLWDMNSQLTRFLVVEGVEFRPKNM

SEQ ID NO: 155402 - protein, 71 aa, Glycine max
  Coding DNA Sequence Number=SeqID_38624
MTDKKMYKFSNDESFMRVIIEGGDKTHFQSASPKPGGSWTMAKSGHCETSPETNLRPIHPNKRKPPGDTRR

SEQ ID NO: 155403 - protein, 137 aa, Glycine max
  Coding DNA Sequence Number=SeqID_38625
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=99%, HitCoverage=6%, E-value=2e-39, Identity=50%"; Hit description=RNase H, putative
MNLGVGEERKEVKVGTGMTTLIRDELVVLLRNYHDIFAWSYQDMPGLNPDIDEAGNVLKNQRRGEKAVRCWFLVVARVANIVPVPKKDGKVRMCMDYRDLNRANPKDNFPLPHIDVLVDNTTNFALFSFMDEFSGYN

SEQ ID NO: 155404 - protein, 81 aa, Glycine max
  Coding DNA Sequence Number=SeqID_38626
  Homolog annotation: Hit_ID=Q1SRN1; Match level="QueryCoverage=73%, HitCoverage=3%, E-value=5e-15, Identity=58%"; Hit description =Integrase, catalytic region
MEPKFAKQALTDPTWLAAMKAEYDAFIHNGTWTVVSLPPNRVPIGCKWVFRIKDNPHAVVPGAEMPHHQKDSQYWKAQGSE

SEQ ID NO: 155405 - protein, 105 aa, Glycine max
  Coding DNA Sequence Number=SeqID_38627
  Gene Ontology: Mol. function=DNA binding; Cellular component=oxygen evolving complex; Biological process=DNA integration
MSILEDTRMLACKPSAVPMEADLKLNAESGSQLPDLETYRRLIGRLLYLTISRPDICYIVHKLSQFVSDPRSGHMNAANILLRYLKHTAGQGVLFKAKSDTSIQA

SEQ ID NO: 155406 - protein, 78 aa, Glycine max
  Coding DNA Sequence Number=SeqID_38628
MELEPLKWGTSSFTGGGVFRKECYQNAFYTFLPHRSSSKDLCVLLTQAAIEVLDIVLALGWWVHEFVSWWVCGLVFVV

SEQ ID NO: 155407 - protein, 101 aa, Glycine max
  Coding DNA Sequence Number=SeqID_38629
  Gene Ontology: Mol. function=RNA-directed DNA polymerase activity; Biological process=DNA integration
  Homolog annotation: Hit_ID=UPI000034F0FA; Match level="QueryCoverage =81%, HitCoverage=6%, E-value=1e-13, Identity=50%"; Hit description =kinase
MDLNNTWTITQLPPNTKPITCKWLNKSIYGLKQASRSWFNKFCSTLTSQKYIQSKHDYTLFTKGTCSSFIAILVHVDDIVIASRDKIAIHSEKSCFNNSSN

SEQ ID NO: 155408 - protein, 367 aa, Glycine max
  Coding DNA Sequence Number=SeqID_38630
  Gene Ontology: Mol. function=nucleic acid binding; Cellular component= beta-galactosidase complex; Biological process=DNA integration
  Homolog annotation: Hit_ID=Q1ST43; Match level="QueryCoverage=99%, HitCoverage=30%, E-value=2e-47, Identity=30%"; Hit description =Integrase, catalytic region; Peptidase aspartic, catalytic
MATPMINPSQDPTNPLHLHHSDGPGLVITSQPLDHKNYTTRSRAMQVALSVKNKTTFINGTLLKPDEDAPIYAAWTRANNVVISWLYNSVSKDIITSILFVNIVKEIWDDLNTRFLRENGPRIFQLKRQLMLLQQGTDDINTYYTKLKSIWEELTGYKPTFSCTCGGQILLSDPLPSIGNVFSLILQEEAKREIVVTHSPTNASDNIAFSVNSVSKNQYDSTKGKYMKKERPKCAHCDMLGYTKDKCYKLVGCPPNYFKNCTINSVNQVHDTPESSPSVQAPPFTATECQQLIYFLTNHMKIETTIDAVATNVIVICMNDAFNNDHHTWIIDTGATSHICCFKELFNSYTATFNSHVLLPNSTKVKV

SEQ ID NO: 155409 - protein, 143 aa, Glycine max
  Coding DNA Sequence Number=SeqID_38631
  Gene Ontology: Mol. function=sugar binding; Biological process =ubiquitin cycle
  Homolog annotation: Hit_ID=Q9ZVQ8; Match level="QueryCoverage=85%, HitCoverage=39%, E-value=1e-26, Identity=46%"; Hit description =Putative phloem-specific lectin
  Pfam annotation: Domain name=F-box; Domain location=3-50; Score=31.7; E_value=2.6e-06; Accession=PF00646.23; Description=F-box domain
MDTITKVLPEECVATIISLTSPKDACQLSLVSPSFKEIADSDAVWANFLPSDCEDIIDQSSTPTLNLLSKKQIYAHLCDYHVLFDNGNMTLSLAKATGKKCIIVSAKGFKISWGDKPCDWYWESTPESRFYFQSLILFHKIFK

SEQ ID NO: 155410 - protein, 444 aa, Glycine max
  Coding DNA Sequence Number=SeqID_38632
MDEKRRKKLEEATQSGSTEAVIDRPSPIRQHKKWKMTRTKKNGQMMFEAAKEIAEKIVRFIGGAGVIGFLCPPWTPGCPDCCHWRLEHLGRVRAVGAGVTIKQYFEPAQRTSCTSSSIAPEELKQSTQQIRDQLEESITEKVTRQLMLSLSQIQSQFQSQMQSQGLALPSEPEVGPSTTRVSTKRSYFDPSANDPDMGDSDKCGLYIEENPPRLVALGRVYEGSIIVHNIPLLHDQVKVGVEEELNTFLAWPTHLVKRLSEQVMWDATLFGLFNSDFPLYIKHEDLSEIAQVVNVAASMLYSCGFFIHNLLCVNNNRHLTETSMRLGNFDVYRFLESQSIQRSGQSQFESESYIKNWMQNSKRDVYLGAYLNGAHGQMVVILPKENLVVCALKGLDDTPQPKSKVGARWIVVKYFNDVRPLESNTLKALRIQWANYYLKVRNET

SEQ ID NO: 155411 - protein, 56 aa, Glycine max
  Coding DNA Sequence Number=SeqID_38633
MEVEMGEFFSGGHEDNLVDIKLWNISSQLTRFLVVEGVEFRPKNIESGLLSERIYI

SEQ ID NO: 155412 - protein, 56 aa, Glycine max
  Coding DNA Sequence Number=SeqID_38634
FSFNPVQTKPYYLLLHAHYLAAGRSLEAGAPGGGVWLPTGASGATEAQETEGSARV

SEQ ID NO: 155413 - protein, 69 aa, Glycine max
  Coding DNA Sequence Number=SeqID_38635
MPPSLLVEVFKDVIVAAGEEDKCDSTQNPGKISGPKGSAKGQRDGKNSSTNVPTYSVISVLSVSEIVLI

SEQ ID NO: 155414 - protein, 101 aa, Glycine max
  Coding DNA Sequence Number=SeqID_38636
  Homolog annotation: Hit_ID=Q5IBC5; Match level="QueryCoverage=96%, HitCoverage=4%, E-value=1e-12, Identity=43%"; Hit description =Separase
MLASKPFSVKFQRLRLIHCLESCGLFDEAQLEGVGVLEKLPPTKRKGKLLLEIDKGNGEGKELCSLVVDIVVSLLRCVAAGLAKEDAHFRKVLQLVEEVNP

SEQ ID NO: 155415 - protein, 101 aa, Glycine max
  Coding DNA Sequence Number=SeqID_38637
MNLLVVRVRQAQRQQGQGHQGQQRNEEQFEPIIRNLLEQAGFLVVEQIPFFPFDNHLMMELVECWRPESPHFTYGEAVTGGGVHNWGEVCRSWELFQIILT

SEQ ID NO: 155416 - protein, 123 aa, Glycine max
  Coding DNA Sequence Number=SeqID_38638
MDKEALRKERKRLESERIRVWSGLEMREDSEGLTAECSDKPLLPHGTQQTLSSSNPLNAAYRYLNHSNASNPIQTEPWYLLLHAHYLGVGRSLEAGAPSGGVWLPAGASGAAKAQDSKGSARV

SEQ ID NO: 155417 - protein, 97 aa, Glycine max
  Coding DNA Sequence Number=SeqID_38639
MVGNDVEALGHCELTMTLMVNHEAHELTTTKLLSSYYGRPAYTVVGNVQFTMAIDASSIGACRPRIFFINGFLCFLEDEWQRNGEGRERGDTTSRRI

SEQ ID NO: 155418 - protein, 85 aa, Glycine max
  Coding DNA Sequence Number=SeqID_38640
MEPVHKCLLTELSNLPSHLKPNPKKEDVNVVMTRRKRIQEDFEEKEDSPPKVVDDVLTKEDQETKEIEVPTEKEGDKMKEILTSP

SEQ ID NO: 155419 - protein, 665 aa, Glycine max
  Coding DNA Sequence Number=SeqID_38641
  Gene Ontology: Mol. function=phenylacetaldehyde dehydrogenase activity; Cellular component=mitochondrial nucleoid; Biological process=metabolic process
  Homolog annotation: Hit_ID=P80668; Match level="QueryCoverage=63%, HitCoverage=84%, E-value=1e-167, Identity=73%"; Hit description =Phenylacetaldehyde dehydrogenase
  Pfam annotation: Domain name=Ada_Zn_binding; Domain location=611-665; Score=93.1; E_value=8.4e-25; Accession=PF02805.6; Description=Metal binding domain of Ada
  Subcellular localization annotation: CTP_CleavageSite=22; ConfidenceScore=5.30e-01
ASSALATRIRLTTGPNTSSRVRFSRSSGVDHQRWRNVEAVGIRPGRAADKLGVFRPGVVQVGRHLVAVRERHQRVDLRAGIHPRPDRQRFHRLFETCHQLVINRRFNINSRAGGAHLPLIEEAAEHQAFDHLLRIGIFQHDGRVFTAQFQRHAGQAIRRRARDAFAHRRGAGKADFGDQRMFGQRLAAHGAAAGDHVEHARRHAGFARQFGDAQQGERGGFRRLDDDGAACGQRRHHFPHAYHQWEVPGHDAGDHANRLFTGINLIFGARRHRNGDVQRLAGDFGRQPGGVTHPVQGAADFEGAGDVDGLALLQGFQLRQLLGVLLHQIGEAQQDAFSFYRQTLRPDAFAEGFVGGLHRQRDVLLVGVGGGGDLLPIGGVIHRQAAFRGGRAPLAVDIQPMLTIEKTRHAIQHGYGIVRHTSSDQAHQGKPRPAGAGREGSRAQGRQTGSEAEEQQADEAVAELRQAFLVIEEMRQHRAGEDQRTHVDKADGFEDQRQNGERQPGAQRQRFAQNAVAAFNLLLLRLRLLHEGGVEDFCAEEQQVNRAEKTHQGKQERRGADQRSHADIGAEDQDRIADEHAERRGVAGAHAARYAGFHEERMMKNVIDSADPRWLAIVSRDKHADGRFIYAVKTTGVYCSPSCPSRQPNRQNVELFDDAEQAEAA

SEQ ID NO: 155420 - protein, 220 aa, Glycine max
  Coding DNA Sequence Number=SeqID_38642
LLYGGGGARHVGPALKYAVAGAKITWWPSHSVGTMKSYRHILVLIHDERDGLPLLRQTVAMVRGLPIAITVGHLNADYAELEYGSDALVKDRQAQEVIAAKAMLSRLVSAVDAPVAVKEIVTIRRFKDVNDFIHQAGIDLVVVGHQNRLILPANSVRQSGLFPRLCRLKGDSMRISLDLAWAIGKNLRPYFYRSFTMFLKRTLLACSLALIFPALPSYAE

SEQ ID NO: 155421 - protein, 66 aa, Glycine max
  Coding DNA Sequence Number=SeqID_38643
MAKRERGSREEIRLAEIEVELGVAPLLVFYHRRNNGVKLWTPSGVGVDDMVLLVLPDVQRSGRGIR

SEQ ID NO: 155422 - protein, 129 aa, Glycine max
  Coding DNA Sequence Number=SeqID_38644
MQSKINAFFKSTTSDSSSASLDIWENQQHHIINTYTRRRPKLNAVIPSVVKNKKRSYAQFHLDFGQSDFLLRACSTCRFKFTPRLSQILHPGDSIQSWTKENVFPPPSVETGRIILVSENDLTSHRKKC

SEQ ID NO: 155423 - protein, 231 aa, Glycine max
  Coding DNA Sequence Number=SeqID_38645
MITLQVKESLDSHHKRFPQINVGGDSAHLSSFGKRTREPCPRSPAKGHVAKVKIDADSLNTFLETPVVLEEGETLPTYSRYYRLPTDHRKIEVAFCIAGMEFILNAKGHPGRILKKDLTTLAQVWSVLSYSNLAPTSHTSDLTVDRARLIFGLVSHMDMNIGALISGQMTSITQSNCCRFWFPALITALCRARRVVSDSLTFERLSPAINLAYIRKYCWNIDYLTVAFQGD

SEQ ID NO: 155424 - protein, 117 aa, Glycine max
  Coding DNA Sequence Number=SeqID_38646
TLVSIATPLGLQFIPQVKELLDEDLVRKSLNPCALLVPKIGVPMNPRRIKVIPEWPTPPTPLIELVRNHVPSWEDAQEMGFQTLPYFNIPNTTNIYVFVLVTGVEEKSPEFQEPRDL

SEQ ID NO: 155425 - protein, 215 aa, Glycine max
  Coding DNA Sequence Number=SeqID_38647
MTCKDKIWSFCTFMSSRGGGPDDMQRQNLVIPHPFAIQTQSCPMARRDKIWSFCTLCHPEAAGPMTCGDKIWSFRTPLPFRHSHVRWHAETKFGHSAPFCHPEAAGPMTCGDKIWSFRTPLPFRHSRVRWHAETKIGHSAPFCHPEAAGPMTCGDKIWSFRTPLPFRHSRVRWRAETKIGHSAPFVIQRRGPDDTRRFTSSSALTRSVILTFESR

SEQ ID NO: 155426 - protein, 263 aa, Glycine max
  Coding DNA Sequence Number=SeqID_38648
  Homolog annotation: Hit_ID=Q8TGM6; Match level="QueryCoverage=45%, HitCoverage=97%, E-value=1e-09, Identity=43%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAYWICLNSAGSPA

SEQ ID NO: 155427 - protein, 255 aa, Glycine max
  Coding DNA Sequence Number=SeqID_38649
  Homolog annotation: Hit_ID=Q47522; Match level="QueryCoverage=24%, HitCoverage=83%, E-value=8e-22, Identity=75%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLNSILEVDEAVGQVERGIGVQLPVGADRVLHAVAVRQGRVAQLGAAHGCLVMGDTGAQQQVLAVFVVGAQRNTVGIFPLLADALVDQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 155428 - protein, 173 aa, Glycine max
  Coding DNA Sequence Number=SeqID_38650
GQRFVPVYSIHPFVELGRVMCPFRCPRPHFGIKESWCFSCGLAGISWTALVVRVGGSQTETHVVGSLFVSIPTRVGSMRMEDGHDRVWQESSLPFSKTTSRPPSLPKMKNSHPCYESAVKRNLRSLVDRHEPGESESLSVLSADLTSFHRKPISYSAYKKKWWTIFSALFDLP

SEQ ID NO: 155429 - protein, 144 aa, Glycine max
  Coding DNA Sequence Number=SeqID_38651
MTINCLRMSSGSPPMDDQKVRNDHNLSPHVIGLTASGLQKEQNDHNLSLRATEHDRFGWQKAQNDHNLSLRAMGLDRLRMVKRCGMIIICLRMSLGSPALDDKRRRMTINCLCVASVTIVSDCRKLVRNDHNLSLHMMGLTASG

SEQ ID NO: 155430 - protein, 304 aa, Glycine max
  Coding DNA Sequence Number=SeqID_38652
MRGAPVEESLSLFLVRDFGVQSFKVIQRVHKAWESPLRKDKELRCIRNGIIGGYHEWLKVRTRGLDWLSKLKIINEENFEAPEEDEEVRALKTELGKARLAKEKFKLVATNVRKECAGLREENAATARALEQETKRARKEEHGHDKFRGALWGSNSELKLRREEIDQSRAHSMFLKEELAACSRPKRNLPQCLCETETNMFAIVSKYQEELNLATAHEHKVADEYAQVYTEKEARGRVIDALHQEATIWMDRFALTLNGSQELPRLLAKAKAMADTYSAPEEIPRLLGYCQHMIDLMAHIIRNR

SEQ ID NO: 155431 - protein, 251 aa, Glycine max
  Coding DNA Sequence Number=SeqID_38653
  Gene Ontology: Mol. function=DNA binding
  Homolog annotation: Hit_ID=Q1SFS3; Match level="QueryCoverage=95%, HitCoverage=44%, E-value=1e-29, Identity=32%"; Hit description =Lambda repressor-like, DNA-binding
MVEEFEEILGCPLGGRKPYLFTRFYPSLARISKIVQILVQELDHRKQVENGVVGIPRKYLEAKARILAGKGEWAPFIDILALLIFGGVLFPNVDGLVDLAAIDVFLTYHNHKESPVVAMLADLYDTFDRRCEESNARIVCCTPALYVWLVSHLFRQEVRHACPLESHRSCTEKGGANWDQLLASKEGASVNWFPRWKEGRTGVLISCGGFPNVPLMVMRGCISYNPILAIRQLGYPMRGAPLEDGLAPVIS

SEQ ID NO: 155432 - protein, 132 aa, Glycine max
  Coding DNA Sequence Number=SeqID_38654
MPPTRHPLDLDKSNRALGFPTLITGLCQSFGVPVIPSKVIRPPITRAFIEKYCTPRQAQGDAPQAADAPPPPHQADPAGSLGMERYLQHLPRDWLKDQTEEAPAGAPDDAEDARMDEEMTDLLSFLGGSGAT

SEQ ID NO: 155433 - protein, 75 aa, Glycine max
  Coding DNA Sequence Number=SeqID_38655
MASKKEDDRHAGKEKGRRCGLSRYNKRHWVAKANSSVSGQQPSHSSLVAASAEAYAFSSVPFLGSPVDCPARVTP

SEQ ID NO: 155434 - protein, 289 aa, Glycine max
  Coding DNA Sequence Number=SeqID_38656
  Homolog annotation: Hit_ID=Q47522; Match level="QueryCoverage=12%, HitCoverage=45%, E-value=8e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRSNSTILALQDCHLLGDLNKDFWHKTQQSINSTNTLSSSEGEKLHNLLSATLTNHDTCLNSLHETTSSPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 155435 - protein, 158 aa, Glycine max
  Coding DNA Sequence Number=SeqID_38657
MPIYPCRSISWSVPSRHRDRAHKTPSGPGEVQQGLGVSISGYGPLSFLQGVRTPRQGIAPAGHLVDPKKSNRVLGLPALIMGLCQFYGVPVTPSKVIMPPTNLAFIKKNCAPKQAEGETPQQPGDGQQQATNAPPPPPEPLSSSTKRLEYCLRHMDDK

SEQ ID NO: 155436 - protein, 195 aa, Glycine max
  Coding DNA Sequence Number=SeqID_38658
  Gene Ontology: Mol. function=transporter activity; Cellular component= integral to membrane; Biological process=transport
  Homolog annotation: Hit_ID=Q4BAA3; Match level="QueryCoverage=62%, HitCoverage=20%, E-value=2e-38, Identity=60%"; Hit description=Major facilitator superfamily
MAAVQLIGQRLADGDQQAAAHALQGAPADQRADAVGVAGAEGAQHEQRQRQQEHPPPTDALRQPGAERDHQRQAENIAVADPRQLADRRPHRLADGGVGDVGDKHIDQIDEKAEQIDDCHFAAIRHGASAGERAGGVTAGAQHPAAVADRRRRTLLPAQPATAAGGGKRAGRRAPRSPRAERRAAHHQYAGVWRA

SEQ ID NO: 155437 - protein, 74 aa, Glycine max
  Coding DNA Sequence Number=SeqID_38659
  Subcellular localization annotation: CTP_CleavageSite=18; ConfidenceScore=5.31e-01
MAGLAQPGQAEQQQRQRRAGAQQPFAVERFARRRRRFRAQPPRRQRQGQGRQRQVGEKHPAPVQPIDEPAAQRR

SEQ ID NO: 155438 - protein, 204 aa, Glycine max
  Coding DNA Sequence Number=SeqID_38660
MAFLGETSSQTIVNSRLAFIYPNGSIIHNDTGVYFQTSTPVPIRVPNRCDFASLKTRIHNTLQLSDKQFLDEIHYRKPVTDTGNQIRFECIKLINDDDVNTMLMCNDQFSCVGPIELLCTVGRTPDGIINLLERTMPRIHDAILYYNGKWNMPPQNKFVGCAFTGKNPKKFQIPSTCTIDELKNLIKQVAPKGIPPLGIHESQT

SEQ ID NO: 155439 - protein, 196 aa, Glycine max
  Coding DNA Sequence Number=SeqID_38661
  Subcellular localization annotation: CTP_CleavageSite=55; ConfidenceScore=5.20e-01
MVQPKPSAGLKGKSLQHALTFMPSCIKKKSKAWVPMPKSCFGIYPNFRKLSTYPKMSIKRYQWKARNQRIVHLLVWGGKDTKIEAKSTQWWPRVSKNQNLVSACVLKCFDDNKDDDKGDDKKLKGQSKNEFKMFKIESRTLQDSRGKLKNTSRFKRKVKFKNQESRFKDQAFKTQDSRIKRRLNQDKYEKVFSKTE

SEQ ID NO: 155440 - protein, 438 aa, Glycine max
  Coding DNA Sequence Number=SeqID_38662
  Gene Ontology: Mol. function=metal ion binding; Cellular component =integral to membrane; Biological process=ubiquitin cycle
  Homolog annotation: Hit_ID=Q940Q4; Match level="QueryCoverage=96%, HitCoverage=84%, E-value=9e-80, Identity=44%"; Hit description=RING -H2 finger protein ATL4K
  Pfam annotation: Domain name=PHD; Domain location=129-171; Score= -0.6; E_value=0.066; Accession=PF00628.19; Description=PHD-finger
  Pfam annotation: Domain name=zf-C3HC4; Domain location=127-168; Score= 35.2; E_value=2.3e-07; Accession=PF00097.15; Description=Zinc finger, C3HC4 type (RING finger)
  Pfam module annotation: Pfam domain module=PHD::zf-C3HC4; Domain location=129-171::127-168
  Subcellular localization annotation: CTP_CleavageSite=28; ConfidenceScore=5.11e-01
MGHRATQNSHHIFLSEPNPPFPPTTTVRSDSFSLNDRALKVSPSILLIIIILAIVFFISGLLHLLVRFLWRPQTREPDELDNVTALQGQLQQLFHLHDAGVDQSFIDTLPVFLYKAIIGLKKYPFDCAVCLCEFEPEDKLRLLPKCSHAFHMECIDTWLLSHSTCPLCRASLLPDQFSATNACSPIVLVLESGSSESSREIVPERVGASAAVGRTSSVMTTDSRLGCRGDSEFGSTRVDLMKSGELLSEIPDPTVPNGVEKVVTVKLGKFRSVDGGGEGGEGSSSSTSTNNVDARRCFSMGSFAYVMDESSSLQVPIRTPIKKQSSKKKSGLPLTPGHRPAMSECDCESRRDFKFAGFDATTIIVEDDAATSTGATTSSTTCNGNSAAAIGRSRKESFSISKIWLRGKKDKPNSVADSSRRAVSFRFPAKSSVVTAAS

SEQ ID NO: 155441 - protein, 54 aa, Glycine max
  Coding DNA Sequence Number=SeqID_38663
WENGGGSEFDYDDENQSCYSLDSSQARAPSFARRTLLWLTGGRQNKVVHSASNL

SEQ ID NO: 155442 - protein, 218 aa, Glycine max
  Coding DNA Sequence Number=SeqID_38664
  Homolog annotation: Hit_ID=Q8L900; Match level="QueryCoverage=40%, HitCoverage=49%, E-value=2e-20, Identity=52%"; Hit description =Putative RING zinc finger protein
MVRPLRRVMYRSTGIESHGCAARGACGDLKEPRVDAPAVKHVPARSKLSAPLGVMECVQADDAIGVGSGLGSIGDTKAGELVDFARGEAVGGGGFGGNGGAEAKAVEGAAEEEEVEEEEGSEAEEEEEEGGEKEHDDWFEEQRKEIDRAEEENRFEESKGVNEGATSESGTQILGSNPTEREREKSVGSGLFGCGLWIVDLDRRYVGASVFYNLYPFH

SEQ ID NO: 155443 - protein, 307 aa, Glycine max
  Coding DNA Sequence Number=SeqID_38665
  Homolog annotation: Hit_ID=Q1RTH7; Match level="QueryCoverage=99%, HitCoverage=100%, E-value=2e-42, Identity=37%"; Hit description=IMP dehydrogenase/GMP reductase
MTESGGVSGWWCDSLTPLKVIVESLRIMAWNKVMFASIMVLTTLPLSTLLISQSIYTHPLTSQIQHLEALARFTSTRFESRHVWQESRHEALSLLRIKALFSLPSYLLSLAAALAAVHSTLLSLHTTPSLHSAAAAFRLHSARLLATTIFVYAILFAFSPLPRFLAFLSPSPATRLLLLASASALEVYLMAVMSVALVVSVAEERFGWDAIRVGSALMEGSRVRGWVLSGLFVLGSSLIGSKLEHLMDGQDSIAVKDKAGLIVSYGLLVLWSYVVITVFYCDCRKRHPIREPQPDDDDHPQQQLSVI

SEQ ID NO: 155444 - protein, 108 aa, Glycine max
  Coding DNA Sequence Number=SeqID_38666
WGWRKEQDASIVANRTRGQAFQVLVASGKEGSKDDVVMVDPVEAKRLAAKQMEKIKAKEKLKRRRQIEAINGAWAMIGLTAGLVIEGQTGKSILTQVKFGNASFYMFL

SEQ ID NO: 155445 - protein, 353 aa, Glycine max
  Coding DNA Sequence Number=SeqID_38667
GIYHTELDEFKAELERCNFHKRLTNLVDSSIDLALVKEFYANLYSSEDPSPKEVRVRGPLVRIDADSLNTFLETPGYPRKILKKDLMTLARVWSVLSYSNLAPTSHTSDLTIDRARLIFGLVSQMDMNVGALISGQITSIAQSNSSRLGFPALITTLCKARGVNSDSLVFECLSPVINLAYIRKNYWNPDDLVVSIKGARQAKMRLTEPPSTSTAPIPACTSAAPSVPAFTGFQHLEAMLQSVHRGQIILLQSLQVVAPPGSIPSVEQEDEGPTTQVPQHVEDGSSEATILEPFVIGEEAEETQVRQVVAATPERSLEATSEPSAQGEDIPSPQPATNPSNPLLEMPEDPTTS

SEQ ID NO: 155446 - protein, 164 aa, Glycine max
  Coding DNA Sequence Number=SeqID_38668
  Homolog annotation: Hit_ID=O21999; Match level="QueryCoverage=40%, HitCoverage=40%, E-value=1e-22, Identity=78%"; Hit description=LacZ -alpha
GFPGIKQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMSFGAEYLIPKPFDPRLMLVVAPAVAKAAAECGVAQRPIQDMDAYREHLKTFV

SEQ ID NO: 155447 - protein, 80 aa, Glycine max
  Coding DNA Sequence Number=SeqID_38669
MKKEEGRKMKRRMDSKNPKGSVVAPHAAEGDARRRGKVVALGTTEGDVGGAMHLTEVEVEGEGRGEGERGLCGLEKVYLA

SEQ ID NO: 155448 - protein, 670 aa, Glycine max
  Coding DNA Sequence Number=SeqID_38670
  Gene Ontology: Mol. function=transferase activity; Cellular component= alpha,alpha-trehalose-phosphate synthase complex (UDP-forming); Biological process=trehalose biosynthetic process
  Homolog annotation: Hit_ID=Q1RTI3; Match level="QueryCoverage=97%, HitCoverage=78%, E-value=0.0, Identity=77%"; Hit description =Glycosyl transferase, family 20; Trehalose-phosphatase
  Pfam annotation: Domain name=Glyco_transf_20; Domain location=1-362; Score=472.5; E_value=5.2e-139; Accession=PF00982.11; Description =Glycosyltransferase family 20
  Pfam annotation: Domain name=Hydrolase_3; Domain location=410-652; Score=-85.2; E_value=0.035; Accession=PF08282.2; Description =haloacid dehalogenase-like hydrolase
  Pfam annotation: Domain name=Trehalose_PPase; Domain location=411 -646; Score=359.6; E_value=5.2e-105; Accession=PF02358.7; Description= Trehalose-phosphatase
  Pfam module annotation: Pfam domain module=Glyco_transf_20::Hydrolase_ 3::Trehalose_PPase; Domain location=1-362::410-652::411-646
MRQVTEVINPDEDYVWIHDYHLMILPTFLRKRFHRVKLGFFLHNTFPSSEIYRTLPVREDILRAFLNCDLIGFHTFDYARHFLSCCSRMLGLDYESKRGYIGLDYYGRTVTVKILPAGIHMGLLESVLSLPQTALRVKELKEEYEGKIVILGVDDMDLFKGISLKFLALGKLLEVDESLRGRVVLVQILNAARSKGKDIQDVKNESEAIAREINEKYSQPGYQPIVYINGPISTQEKAAYYAVSECCVVNAVRDGMNLVPYEYTVCRQGSVALDKALGVEGEDKKAPKQSVIIVSEFIGCSPSLSGAIRVNPWNIDDVAEAMNSAVTMSEAEKHLRHEKHYKYISSHDVAYWARSFDQDLDRACREHYSKRYWGVGLGLGFRIVALDPTFRKLSVDHIASAYRDTHSRLILLDYDGTMMPQATINKTPSREVIAVLNYLCSDPENMVFIVSGRDKDCLGKWFSPCEKLGLSAEHGYFTRWSKDSPWETCGLATDFEWKMIAEPVMSLYTEATDGSFIEHKESAMVWHHQEADPYFGSCQAKELLDHLESVLANEPVVVIRGQHIVEVKPQGVSKGKVVEDLISIMRSKGKSPDFLLCIGDDRSDEDMFESIARSASNPALPTIPKVFACTVGQKPSMAEYYLDDTSEVMKLLEGLATASAPSASIASQEL

SEQ ID NO: 155449 - protein, 255 aa, Glycine max
  Coding DNA Sequence Number=SeqID_38671
  Gene Ontology: Mol. function=trans-aconitate 2-methyltransferase activity; Cellular component=nucleus; Biological process=metabolic process
  Homolog annotation: Hit_ID=UPI00005F873E; Match level="QueryCoverage =94%, HitCoverage=93%, E-value=2e-82, Identity=61%"; Hit description =COG4106: Trans-aconitate methyltransferase
  Pfam annotation: Domain name=Methyltransf_11; Domain location=36-128; Score=65.4; E_value=1.9e-16; Accession=PF08241.2; Description =Methyltransferase domain
  Pfam annotation: Domain name=Methyltransf_12; Domain location=36-126; Score=52.5; E_value=1.4e-12; Accession=PF08242.2; Description =Methyltransferase domain
  Pfam module annotation: Pfam domain module=Methyltransf _11::Methyltransf_12; Domain location=36-128::36-126
MQDWNPQLYRQFESERTRPAQELLARIPVNEVRFATDLGCGPGNSTELLAQAWPQAHITGIDSSEAMLEQARQRLPDCDFLQADIRSWQPEQPQQVIYANASLQWLTDHETLLPHLVNQLAPGGALAVQMPDNLQEPSHRLMREVAASSRWQAHISPQAAERKRLLSSDCYYDLLGDAGCQVDIWRTTYYHPMADAQAIISWLRATGLRPFLAALDERSRLTFYTTIIRRCCSAYPTRSNGTGFAGPFRVYLWWR

SEQ ID NO: 155450 - protein, 121 aa, Glycine max
  Coding DNA Sequence Number=SeqID_38672
  Gene Ontology: Mol. function=protein kinase activity; Biological process=protein amino acid phosphorylation
  Homolog annotation: Hit_ID=Q7CL48; Match level="QueryCoverage=99%, HitCoverage=34%, E-value=1e-49, Identity=79%"; Hit description =Putative periplasmic binding protein of ABC transporter
MKTYPDLKGIIGFGSLGPIGAGQAVQQKRAKNKIAVVGIAMPAQAAPYLMRGDIKKVLLWDPKDAGYALVSVADQLLQGKEVTKDLSIEGLGKADVDMDKKVIRFNKILEVTPENAKSLGF

SEQ ID NO: 155451 - protein, 393 aa, Glycine max
  Coding DNA Sequence Number=SeqID_38673
  Gene Ontology: Mol. function=DNA binding
  Homolog annotation: Hit_ID=Q1RUD8; Match level="QueryCoverage=90%, HitCoverage=73%, E-value=1e-37, Identity=31%"; Hit description=IMP dehydrogenase/GMP reductase
MGTNQTGKRFYQVKVKSLDTTSIKELGRLMEPLQMQAFRKTYGKILELTIAEVSIEVVASLTQYYDQPLRCFTFGDFQLVPTIEEFEEILGCPLGGRKPYLSSGCLPSLSRIATVVKDSARGLDRIKQTRNGIAGLPRKYLEDKARGMAQSRRLGPIYGCVSFANFRDLAAIDAFLAYHHSKESLVVAVLADLFDTFDRRCEKSSARIICCLPALCVWLVSHLFQQDTRHPCPLLSHRSCTEKGRIDWDQLLAGIGGRTISWFPRWKEGKEGVLFSCGRYPNIPLVGTRGCINYNPALAIRQLGYPMRGAPTEESMSPFLVRDLGAQNSKTIQRIHKAWETPLRKDQELRGIRNGIIGGYHEWLKVHIRGLDWLAKLKVVSEENFEAPEEDEE

SEQ ID NO: 155452 - protein, 94 aa, Glycine max
  Coding DNA Sequence Number=SeqID_38674
MASVDISAMVKSKIFPYALRKACIWRGDTDPPLVCQREGIKAKLVHDAYAKGTTRGLARSVFAPCPYFRDLHGRELKGPFSDNSQGGHISLDGL

SEQ ID NO: 155453 - protein, 181 aa, Glycine max
  Coding DNA Sequence Number=SeqID_38675
  Homolog annotation: Hit_ID=Q66BM1; Match level="QueryCoverage=62%, HitCoverage=98%, E-value=2e-42, Identity=73%"; Hit description =Possible phage-related protein
  Pfam annotation: Domain name=GPW_gp25; Domain location=79-178; Score =128.2; E_value=2.4e-35; Accession=PF04965.4; Description=GPW  gp25 family
ALSVSGIKTADVQASESITASTKVVIVTADKITLDAPEVVCTNKLTTGTLEVQKGGAMRGNIEHSGGSAKYIGMNRGTGRTLTDIEHIRQSVADILITPQGSRPMRRAYGSLLSELLDQPQNDALRLQIMAACYSAILAWEPRVKLTGIAFNTTYDGKMVIDITGTRTDAPGALSLSVPVS

SEQ ID NO: 155454 - protein, 1034 aa, Glycine max
  Coding DNA Sequence Number=SeqID_38676
  Gene Ontology: Mol. function=protein binding; Biological process =protein metabolic process
  Homolog annotation: Hit_ID=Q1RTI7; Match level="QueryCoverage=99%, HitCoverage=100%, E-value=0.0, Identity=74%"; Hit description=IMP dehydrogenase/GMP reductase
MRAGLSTIQQTLTPEAASVLNHSIAEAGRRNHGQTTPLHVAATLLASPSGFLRQACIKSHPNSSHPLQCRALELCFSVALERLPTSQNTGSSMEPPISNALMAALKRAQAHQRRGYPEQQQQPLLAVKVELEQLIISILDDPSVSRVMREASFSSPAVKATIEQSLNAVPATVNSGLGFRPSAVAPVNSAPGRNLYLNPRLQQQGSAAQHRGDEVKRILDILHRTKKRNPILVGESEPEAAIKEVIKKIENKELGEGGFANAHVIHLEKELPSDKAQIPARLQELGDLIESRIGNSGCGGVFVDLGDLKWLVEQPVGFGVGGGLGNMQQLTLAEAGRAAVAEIGRLVSKFGEGGAGRLWLLGTATCETYLRCQVYHPTMENDWDLQAVPITSRAPLPGIFPRLGTNGILGTSLESLLPLKTLSTTTIPSLRRASENIDPSAVSICCPQCMQSCEQEVAEMLEETKKSDTELKSEAAKPSLPQWLQNAKTNNDNGKVMDQAQNQEVNVKKRTKEIQKKWHDSCLSLHPKFHQLNVSTETLVPTPLSMTGLYNMNLLGRQFQPKILRNKNLGTSLQLSSNPTPIHPPEHAVSPKQMPVTTDLVLGQTKPADAVPEETHKEGINDFLSCLSSESQDKFDELQSKKLIDADSFKKLLKGLTEKVWWQQDAASAVASTVTQCKLGNGKRRSKGDTWLLFVGPDRIGKKKMAAALSELASGSNPIIIPLAQRRGDAGDSDAPHLRGKTALDRIAEAIRRNPLSVIVLEDIDEANILLRGSIRRAMEQGRFPDSHGREISLGNVMFILTANWLPEDFRCLSNESLLDEEKLENLAKGGWQLRISAGKRASKRRPSWLSDEDRSLKPRKEVNSGVSFDLNEAAADAAEDDRGDGSLNSSDFTVEHEDNYHDVGGSLSAVPRELLDSVDDAIVFKPLNFDLLRRNFSSSIAKRFSSVVGNGVSIEVQGEALDKITSGVWLGQTTIDEWMDKVLVPCFHQLKKNLNSSTHDHDSSMLFRLEDDGYSDRRGSQEWLPATVRVVGE

SEQ ID NO: 155455 - protein, 71 aa, Glycine max
  Coding DNA Sequence Number=SeqID_38677
MRNGHPPLSHGTATPTQKNPKHGLCFDVLVDGTGERDYFFLGSLTSKHEKWLPSLSHGTATRMQKIPNMGT

SEQ ID NO: 155456 - protein, 607 aa, Glycine max
  Coding DNA Sequence Number=SeqID_38678
  Gene Ontology: Mol. function=transporter activity; Cellular component= membrane; Biological process=oligopeptide transport
  Homolog annotation: Hit_ID=Q8LG02; Match level="QueryCoverage=90%, HitCoverage=94%, E-value=0.0, Identity=64%"; Hit description=Nitrate transporter
  Pfam annotation: Domain name=MFS_1; Domain location=61-532; Score =33.0; E_value=1.1e-06; Accession=PF07690.6; Description=Major Facilitator Superfamily
  Pfam annotation: Domain name=PTR2; Domain location=123-516; Score =393.1; E_value=4.2e-115; Accession=PF00854.12; Description=POT family
  Pfam module annotation: Pfam domain module=MFS_1::PTR2; Domain location=61-532::123-516
MAIWSAYSVPSLSQDVVFIRPVLVASHGEEEKGAEGIAAVDFRGHPVDKTKTGGWLAAGLILGTELAERICVMGISMNLVTYLVGVLNLPSADSATIVTNVMGTLNLLGLLGGFIADAKLGRYVTVAISAIIAALGVCLLTVATTIPSMRPPVCSSVRKQHHECIQASGKQLALLFAALYTVAVGGGGIKSNVSGFGSDQFDTTDPKEERRMVFFFNRFYFFISIGSLFSVVVLVYVQDNIGRGWGYGISAGTMVIAVAVLLCGTPFYRFKRPQGSPLTVIWRVLFLAWKKRSLPDPSQPSFLNGYLEAKVPHTQKFRFLDKAAILDENCSKEENRENPWIVSTVTQVEEVKMVIKLLPIWSTCILFWTIYSQMNTFTIEQATFMNRKVGSLVVPAGSLSAFLIITILLFTSLNEKLTVPLARKLTHNAQGLTSLQRVGIGLVFSSVAMAVAAIVEKERRANAVKNNTISAFWLVPQFFLVGAGEAFAYVGQLEFFIREAPERMKSMSTGLFLSTLSMGYFVSSLLVAIVDKASKKRWLRSNLNKGRLDYFYWLLAVLGLLNFILFLVLAMRHQYKVQHNIKPNDDAEKELVSANDVKVGVDGKEEA

SEQ ID NO: 155457 - protein, 407 aa, Glycine max
  Coding DNA Sequence Number=SeqID_38679
  Gene Ontology: Mol. function=alkaline phosphatase activity; Biological process=metabolic process
  Homolog annotation: Hit_ID=Q9FII0; Match level="QueryCoverage=89%, HitCoverage=81%, E-value=1e-153, Identity=68%"; Hit description =Arabidopsis thaliana genomic DNA, chromosome 5, P1 clone:MDH9
MPIWDAVVDFHPQIFIWLGDNIYGDFKRPFKIFGQERTVGPWKNVPRFVPSSEQEMKAGYEKAKSNPGYARLQQNAKVIGTWDDHDYGLNDAGKEFHGKITNQKLLLDFLDEPQDSPRRKQAGVYASYTYGPVGRDIKIVLLDTRYHRDPVGSDGTILGNSQWLWLETELKGPPTALTIIGSSIQVISNLSATIHPLFAMESWGRFPKERDRLFKLIADSKRAGVFFISGDVHFGEITRYDCALDYPLYDLTSSGVTQSVEEVVPPFLRSFVRFVAWLTPSTMRVKDENCRYKSCIYGQPNFGTIEIDWDSHPVTLKFKVRDKDSVTVTGVDVSLTELQPSNSEILDRVKAEHNNSKHCTLEVSLPWIFTLASDFADLKAAKESTIDTHRYVHSQQKGACVIISSPL

SEQ ID NO: 155458 - protein, 74 aa, Glycine max
  Coding DNA Sequence Number=SeqID_38680
  Subcellular localization annotation: CTP_CleavageSite=66; ConfidenceScore=5.08e-01
MSGLLLPLLQYFSQVVADKRQYSSTSSLHTLPTVINIKGDFSCPRQKKNFCFQTTMELHSAESVIRDAPLNAVR

SEQ ID NO: 155459 - protein, 273 aa, Glycine max
  Coding DNA Sequence Number=SeqID_38681
  Gene Ontology: Mol. function=hydrolase activity, hydrolyzing O -glycosyl compounds; Cellular component=integral to membrane; Biological process=polysaccharide catabolic process
  Homolog annotation: Hit_ID=O48766; Match level="QueryCoverage=81%, HitCoverage=42%, E-value=1e-89, Identity=68%"; Hit description =Endoglucanase 11 precursor
  Pfam annotation: Domain name=Glyco_hydro_9; Domain location=4-265; Score=37.3; E_value=1.5e-15; Accession=PF00759.9; Description =Glycosyl hydrolase family 9
MTTPLPPLVAAISLVHLNIIIVFRNLFDENHILHPIGLDLEIKHELFPNGVDPLVADEELWLRKFLSEEKHKKHRDILEEYKSKAEYYICSCLNKNNDSNNVERTPAGLIYVRQWNNMQYVSTAAFLLSIYSDFLQNTNQKLNCHGGTVDHEEILNFAKSQVDYILGSNPMNMSYLVGYGPNYPKRVHHRGASIVSYKKNKGFIGCTQGYDNWYGSQAPNPNVLVGALVGGPDGKDNFEDRRNNFMQTEACTYNTAPLVGVFAKFLHIENQKL

SEQ ID NO: 155460 - protein, 348 aa, Glycine max
  Coding DNA Sequence Number=SeqID_38682
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=O48766; Match level="QueryCoverage=76%, HitCoverage=50%, E-value=1e-128, Identity=79%"; Hit description =Endoglucanase 11 precursor
  Pfam annotation: Domain name=Glyco_hydro_9; Domain location=41-348; Score=371.0; E_value=1.8e-108; Accession=PF00759.9; Description =Glycosyl hydrolase family 9
MEPHKKHHFGTSNIPMLVQHCCLISIFIFTFFTATTTQAFDYADALSKSLLYFEAQRSGRIPYNQRVTWRDHSGLTDGLEEGVDLVGGYYDAGDHVKFGLPMAFTITMLSWSAIEYRQQIEDAGELEHTLEAIKWGTDYFIKAHTSPNVLWAEVGDGDTDHYCWQRPEDMTTSRRAFKIDENNPGSDLAGETAAAMAAASVVFRKTNPHYSQLLLHHALQLFEFGDKYRGNYDASVEVVKNYYASVSGYMDELLWAATWLYKATNNKMYFEYVISNAHTFGGTGWSISEFSWDVKYAGLQLMVSKVIHSWSMHELRHKNEKVYPSTRPCAVSALALQHRAIKVKCREP

SEQ ID NO: 155461 - protein, 597 aa, Glycine max
  Coding DNA Sequence Number=SeqID_38683
  Gene Ontology: Mol. function=transporter activity; Cellular component= integral to membrane; Biological process=transport
  Homolog annotation: Hit_ID=Q9SHZ3; Match level="QueryCoverage=99%, HitCoverage=100%, E-value=0.0, Identity=79%"; Hit description =Putative membrane transporter
  Pfam annotation: Domain name=Xan_ur_permease; Domain location=26-511; Score=76.7; E_value=7.2e-20; Accession=PF00860.11; Description =Permease family
MADITHLPMEQLQDLECCLDSNPPWAEAILLAFQNYILMLGTSVMIPSWIVHAMGGSDGDKARVIQTLLFVAGINTLLQTLFGTRLPTVVGGGSSAYIYPIAYIITDSSLQQISDSHEGVHQLKSAAQRIIPSSMYFIGQYWLGAVRMGGGVGVKAFHHVSQLQSSDTVWWDVRIQLKDMELESHIGSMRFYCERFIQTMRAIQGALIVASSIQIILGYSQVWGLFSRFFSPLGMAPVVGLVGLGLFQRGFPVLGDCVEIGIPMLLLVIGLSQYLKHVRPFRDIPIFERFPVLICVPFVWIYAVILTASGAYRHKPDITQHSCRTDRANLISTAPWFMFPYPFQWGPPTFSVGHSFAMMSAVIVSMVESTGAYMAASRLAIATPPPAYVLSRGIGWQGIGVLLDGLYGTAIGSTISVENVGLLGLTRVGSRRVVQISAGFMIFFSILGKFGAVFASIPFPIFAALYCILFGLVASIGISFLQFTNMNSIRNLIIIGLTLFLGISVPQFFNQYWTPSRRGLVHTNAGWFNAFLNTLFSSPPTVGLIVAVFLDNTLEVERSKKDRGMPWWVKFRTFKGDNRNEEFYTLPFNLNRFFPPT

SEQ ID NO: 155462 - protein, 91 aa, Glycine max
  Coding DNA Sequence Number=SeqID_38684
MQDPNLKPTLLSLFLRMFGYGGQIFCEYDAHRKCNRLRITIVPYRGIPYDEFGRPRVDAADIKHGHHWPPPQHHHNHHTLVLGLADVLLLR

SEQ ID NO: 155463 - protein, 43 aa, Glycine max
  Coding DNA Sequence Number=SeqID_38685
LEFHGSTLRQDQSMQFNPLLARNLVKPVWLHVTCDDTDARIMI

SEQ ID NO: 155464 - protein, 138 aa, Glycine max
  Coding DNA Sequence Number=SeqID_38686
MDSAHVIVENKGSSTNISFNLSKDLNYLVLSYSDEENLKEAASVYVTISLHNETKILSKKEVTYVSIIAIKIYHVDDDKVSVESSMESKSKCWWSLVSFTTNMWTSDSIEDFTLTWLITYDLLGALSVFSKLYCSWAP

SEQ ID NO: 155465 - protein, 81 aa, Glycine max
  Coding DNA Sequence Number=SeqID_38687
MLKPQGYIKAWATDFEQAEADEAMAHATTIEPRNLPSLKEGLTRDEMFALLTSPKERFAKEMQFNIMAVISPPTILWRSLA

SEQ ID NO: 155466 - protein, 90 aa, Glycine max
  Coding DNA Sequence Number=SeqID_38688
MGQQSRDRAEERAHVVAQRHTLGESRSRRRRGHDRARPADALTRARPPPHSPTRVEAHTRQPRPRQTTPDRPPPHQKIQQHPTSGTRGIL

SEQ ID NO: 155467 - protein, 88 aa, Glycine max
  Coding DNA Sequence Number=SeqID_38689
  Homolog annotation: Hit_ID=Q6NK37; Match level="QueryCoverage=82%, HitCoverage=84%, E-value=1e-09, Identity=45%"; Hit description =Putative phage protein
  Subcellular localization annotation: CTP_CleavageSite=9; ConfidenceScore=5.03e-01
MTSGATGCRAAVEVTRSTVRCCTPRPTGGSGWGRAEARGASTPGRSDPTGTEPARGVLGLALLPVRVAILDELTRRLPFPRHRYPSRA

SEQ ID NO: 155468 - protein, 138 aa, Glycine max
  Coding DNA Sequence Number=SeqID_38690
  Homolog annotation: Hit_ID=Q014K3; Match level="QueryCoverage=82%, HitCoverage=42%, E-value=2e-23, Identity=49%"; Hit description =Homology to unknown gene
MFLESTILDLPDMKPVVSCPYSLLGETPIDGRTDTNPEGLIAAYGKWASIVAARLNVGGLSCKVLDKEVFQKQMLEKLIWICSVMLVGAPHGGVLVGVADKEFRTELSSLITELASAASSEKGLTFEEAMEERLCAYS

SEQ ID NO: 155469 - protein, 173 aa, Glycine max
  Coding DNA Sequence Number=SeqID_38691
MVKEECKEVSVSSKRLAKKERHFEIKTNIKEIPLLRQPPHFLLCKKTLVSIATSLRLEFIPQVKELLDEGLVRKRLNPCALLVPKIGIIRHQIPKIGGVMNALGGATLFCKITRAPNIFMICVHRDSLGRNNQHENTEKGVPMNPKRIKVIPEWPAPPSVLRKKAQSFKNLGI

SEQ ID NO: 155470 - protein, 208 aa, Glycine max
  Coding DNA Sequence Number=SeqID_38692
  Gene Ontology: Mol. function=transcription factor activity; Biological process=regulation of transcription, DNA-dependent
  Homolog annotation: Hit_ID=Q8UD08; Match level="QueryCoverage=91%, HitCoverage=97%, E-value=1e-76, Identity=77%"; Hit description =Transcriptional regulator, TetR family
  Pfam annotation: Domain name=TetR_N; Domain location=18-64; Score =74.4; E_value=3.7e-19; Accession=PF00440.13; Description=Bacterial regulatory proteins, tetR family
MTNAHERKKQPEVVRRNLLDCAAKLAAEQGVAALSVQAVADAAGVTKGGLFHHFPSKQVLLEAVMTDLLAALDNEIDALISQDREASGSFTRAYVNAVFSDRGRDSGRQWAAISVSMVGEPSLRRMWNSWIEGRLVRHKETDDGVVLEMVRLAADGIWFADLLADGWQSGWRQGGSEGPDDRPDEEGYVTMNTAVFTYGALVAAIVCE

SEQ ID NO: 155471 - protein, 101 aa, Glycine max
  Coding DNA Sequence Number=SeqID_38693
  Gene Ontology: Mol. function=serine-type D-Ala-D-Ala carboxypeptidase activity; Biological process=proteolysis
  Homolog annotation: Hit_ID=Q2K7R2; Match level="QueryCoverage=84%, HitCoverage=24%, E-value=9e-20, Identity=58%"; Hit description =Probable D-alanyl-D-alanine carboxypeptidase protein
MSGMIKRGMAGAWIFALAFFCAILSLHASPAQAGYAHFIMDANTGKVLAARNADVLNHPASLTKMMTLYLTFEALHAGKLRWDQKITMSKNGASVIPSKLY

SEQ ID NO: 155472 - protein, 562 aa, Glycine max
  Coding DNA Sequence Number=SeqID_38694
  Gene Ontology: Mol. function=transporter activity; Cellular component= periplasmic space; Biological process=transport
  Homolog annotation: Hit_ID=Q1R3I2; Match level="QueryCoverage=82%, HitCoverage=89%, E-value=1e-142, Identity=53%"; Hit description =Putative conserved protein
  Pfam annotation: Domain name=SBP_bac_5; Domain location=15-384; Score= 219.9; E_value=5.6e-63; Accession=PF00496.12; Description=Bacterial extracellular solute-binding proteins, family 5
  Subcellular localization annotation: CTP_CleavageSite=63; ConfidenceScore=5.12e-01
LYQRLIQSDPHNPIDLKPTLASSWQAGADNRSLTFSLRPDARFASGNPLRPEDVIFSLSRVVKLNLEPSFILTQLGWNAKNVEQHLSKVDDHQVKISWSENVSPAFVLSLLSAPVSSIVDAKEALAHQQGDDLGHQWLNSHSAGSGPYKIRTYVPHEVVVLDANPGSPEGAPTLKTILIKNVPDPAARRLLIEQGDADIARNLGADQMAALKGKPGVKPLAIPYASLYFLQFNAKASPALGNPAFWEAARWLFDYQGIADDLLKGQFQSHQAFLPDGYLGALKDQPYSFNPQKAKEILAKAGLSNVSFRLDVNNQPPYLDIAQALQASFAQGGVKVELVPGISSQVSTKVKALNYDATLTSWGPDYFDPNTNAAAFAYNPEDGSKTLAWRANWQIPALSKLTLAATAENDTAKRVADYQQLQKQVQQSSPFVIGLQARSLIAVRDNLKGYVQGINPDMVAGDHASEATYAQVRHELGLDQPLPVQFWRYLVHLAHGDLGISRITAQPVLSDLLRTFPATVELATCAIILGALGGITLAFLAVLKPGSWLDNAARLLSLIGYS

SEQ ID NO: 155473 - protein, 372 aa, Glycine max
  Coding DNA Sequence Number=SeqID_38695
  Gene Ontology: Mol. function=identical protein binding; Cellular component=cellulose and pectin-containing cell wall; Biological process=negative regulation of enzyme activity
  Homolog annotation: Hit_ID=Q1SX49; Match level="QueryCoverage=89%, HitCoverage=42%, E-value=1e-120, Identity=63%"; Hit description =Protease-associated PA; Proteinase inhibitor I9, subtilisin propeptide
  Pfam annotation: Domain name=Peptidase_S8; Domain location=120-371; Score=-66.9; E_value=0.0034; Accession=PF00082.12; Description =Subtilase family
  Pfam annotation: Domain name=Subtilisin_N; Domain location=21-109; Score=45.6; E_value=1.7e-10; Accession=PF05922.7; Description =Subtilisin N-terminal Region
  Pfam module annotation: Pfam domain module=Peptidase_S8::Subtilisin _N; Domain location=120-371::21-109
MAASSLFKLLLSSIMLCTILQPYTHALRKAKHSHGPSPSLRDLESATNSHYDLLASVLGSHEKAKEAVIYSYNKHINGFAALLEEEEASEIEKKASVISVFMSKEYKLHTTRSWDFLGLEKYGGIPAESAWWNGNFGENTIIANFDSGVWPEHTSFNDNGYSPVPSKWRGNGVCQIDHFRPSNKTFCNRKLIGARVFSEAYEAQYGKLDPLKRTARDFVGHGTHTLSTAAGNFAPGATFFGNGNGTAKGGSPKARVAAYKVCWSTNDAGSCHEADILQAFDYAVYDGVDVISASVGGSNPYIEAFFTDGVSIGAFHAVTRNIVVVCSAGNDGPAPRTVTNVAPWSFTVAASTIDRDFLSNISLGNKHYLKVT

SEQ ID NO: 155474 - protein, 248 aa, Glycine max
  Coding DNA Sequence Number=SeqID_38696
  Gene Ontology: Mol. function=protein binding; Cellular component =cytosol; Biological process=transport
  Homolog annotation: Hit_ID=P39163; Match level="QueryCoverage=88%, HitCoverage=96%, E-value=2e-79, Identity=64%"; Hit description =Cation transport protein chaC
  Pfam annotation: Domain name=ChaC; Domain location=64-233; Score =252.5; E_value=8.6e-73; Accession=PF04752.3; Description=ChaC-like protein
SVVAREDEKSYSREVVTVLTRDFLQKADCKTAFGAIEESLLLTPEQRAASLACTLSRRPDHSPVWVFGYGSLMWNPVFESEEVRPAILQGWHRAFCMRLTAGRGTLHQPGRMLALKEGGQTTGLAFRLPESTLREELELLWKREMITDCYVPTWCELQLEGGEAVTALVFVMNPQHPLFEADTSHQVIAPLIASASGPLGTNAQYLFALDNELKHHGMQDDCIGDLVRYVQQWLQQNRPGAFGAEATA

SEQ ID NO: 155475 - protein, 188 aa, Glycine max
  Coding DNA Sequence Number=SeqID_38697
  Gene Ontology: Mol. function=acyltransferase activity; Cellular component=cytoplasm; Biological process=electron transport
  Homolog annotation: Hit_ID=Q39W15; Match level="QueryCoverage=61%, HitCoverage=42%, E-value=1e-35, Identity=57%"; Hit description=WxcM -like protein
  Pfam annotation: Domain name=FdtA; Domain location=1-89; Score=4.6; E_ value=1.2e-08; Accession=PF05523.2; Description=WxcM-like, C-terminal
  Pfam annotation: Domain name=Hexapep; Domain location=131-148; Score =11.5; E_value=3; Accession=PF00132.14; Description=Bacterial transferase hexapeptide (three rep
  Pfam annotation: Domain name=Hexapep; Domain location=149-166; Score =16.9; E_value=0.072; Accession=PF00132.14; Description=Bacterial transferase hexapeptide (three rep
  Pfam annotation: Domain name=Hexapep; Domain location=73-90; Score =6.6; E_value=23; Accession=PF00132.14; Description=Bacterial transferase hexapeptide (three rep
  Pfam annotation: Domain name=Hexapep; Domain location=99-116; Score =12.3; E_value=1.8; Accession=PF00132.14; Description=Bacterial transferase hexapeptide (three rep
  Pfam module annotation: Pfam domain module=FdtA::Hexapep::Hexapep::Hex apep::Hexapep; Domain location=1-89::131-148::149-166::73-90::99-116
MDIPHIINFSKIGSQDLGYITVAETQKDTPFEIKRVYWTYYTPQDVIRGGHAHKELQQVIFATSGEGTYIWQFCVILKDAEIGSNCNINCQPGVQIWDGITIEDDVFIGPNATFTNDLFPKSKNKHFKLEHTLIKKGASIGANATILAGVTIGENSLIGAGSVVTKNIPANEIWVGNPAKFLKKNTHD

SEQ ID NO: 155476 - protein, 171 aa, Glycine max
  Coding DNA Sequence Number=SeqID_38698
  Gene Ontology: Mol. function=identical protein binding; Cellular component=cytoplasm; Biological process=negative regulation of enzyme activity
  Homolog annotation: Hit_ID=Q69V48; Match level="QueryCoverage=94%, HitCoverage=19%, E-value=1e-34, Identity=46%"; Hit description =Putative subtilisin-like proteinase
VFVVNGKQSGGTLLAEPYPIPGANVDVSQDKDIDEHEWFEKGGSDTNNSRKLVAYMTVARTYLGIKPAPIVAGFSSRGPNAVQPLILKPDIIAPGVNILAANSLAASPSNQPSDRRRVPFNIQQGTSMSCPHVAGVVGLLKTLHPDWSPAAIKSAIMTTAFRLTELADVTN

SEQ ID NO: 155477 - protein, 136 aa, Glycine max
  Coding DNA Sequence Number=SeqID_38699
  Gene Ontology: Mol. function=identical protein binding; Cellular component=cytoplasm; Biological process=negative regulation of enzyme activity
  Homolog annotation: Hit_ID=Q1S4Q1; Match level="QueryCoverage=98%, HitCoverage=18%, E-value=3e-33, Identity=54%"; Hit description =Protease-associated PA; Proteinase inhibitor I9, subtilisin propeptide
MDPGLVYDMRTRDYLNFICAHDHNQYFLKYSHRSSYNCPKSYNIENLNYPSITVANRGMKPISVTRTVTNVGTPNSTYVVKANVLEGFKVLVQPSSLAFKTIGEKKSFRVILEGTSWPSHGFPVFGNLSWTDGRNS

SEQ ID NO: 155478 - protein, 1005 aa, Glycine max
  Coding DNA Sequence Number=SeqID_38700
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=96%, HitCoverage=96%, E-value=0.0, Identity=45%"; Hit description =Tyrosine protein kinase, active site
  Pfam annotation: Domain name=LRRNT_2; Domain location=28-68; Score =37.7; E_value=3.9e-08; Accession=PF08263.3; Description=Leucine rich repeat N-terminal domain
  Pfam annotation: Domain name=LRR_1; Domain location=121-143; Score =5.5; E_value=27; Accession=PF00560.23; Description=Leucine Rich Repeat
  Pfam annotation: Domain name=LRR_1; Domain location=145-167; Score =14.7; E_value=0.34; Accession=PF00560.23; Description=Leucine Rich Repeat
  Pfam annotation: Domain name=LRR_1; Domain location=169-191; Score =15.5; E_value=0.19; Accession=PF00560.23; Description=Leucine Rich Repeat
  Pfam annotation: Domain name=LRR_1; Domain location=193-215; Score =13.4; E_value=0.82; Accession=PF00560.23; Description=Leucine Rich Repeat
  Pfam annotation: Domain name=LRR_1; Domain location=217-239; Score =17.4; E_value=0.05; Accession=PF00560.23; Description=Leucine Rich Repeat
  Pfam annotation: Domain name=LRR_1; Domain location=241-263; Score =16.0; E_value=0.14; Accession=PF00560.23; Description=Leucine Rich Repeat
  Pfam annotation: Domain name=LRR_1; Domain location=265-287; Score =7.0; E_value=14; Accession=PF00560.23; Description=Leucine Rich Repeat
  Pfam annotation: Domain name=LRR_1; Domain location=289-311; Score =13.0; E_value=1.1; Accession=PF00560.23; Description=Leucine Rich Repeat
  Pfam annotation: Domain name=LRR_1; Domain location=313-335; Score =7.3; E_value=12; Accession=PF00560.23; Description=Leucine Rich Repeat
  Pfam annotation: Domain name=LRR_1; Domain location=361-383; Score =4.7; E_value=38; Accession=PF00560.23; Description=Leucine Rich Repeat
  Pfam annotation: Domain name=LRR_1; Domain location=385-407; Score =7.1; E_value=13; Accession=PF00560.23; Description=Leucine Rich Repeat
  Pfam annotation: Domain name=LRR_1; Domain location=409-431; Score =8.0; E_value=8.9; Accession=PF00560.23; Description=Leucine Rich Repeat
  Pfam annotation: Domain name=LRR_1; Domain location=433-455; Score =15.5; E_value=0.19; Accession=PF00560.23; Description=Leucine Rich Repeat
  Pfam annotation: Domain name=LRR_1; Domain location=457-479; Score =19.4; E_value=0.013; Accession=PF00560.23; Description=Leucine Rich Repeat
  Pfam annotation: Domain name=LRR_1; Domain location=481-503; Score =8.2; E_value=8.4; Accession=PF00560.23; Description=Leucine Rich Repeat
  Pfam annotation: Domain name=LRR_1; Domain location=505-527; Score =4.3; E_value=45; Accession=PF00560.23; Description=Leucine Rich Repeat
  Pfam annotation: Domain name=LRR_1; Domain location=529-551; Score =12.9; E_value=1.1; Accession=PF00560.23; Description=Leucine Rich Repeat
  Pfam annotation: Domain name=LRR_1; Domain location=553-575; Score =14.3; E_value=0.45; Accession=PF00560.23; Description=Leucine Rich Repeat
  Pfam annotation: Domain name=LRR_1; Domain location=577-596; Score =13.9; E_value=0.58; Accession=PF00560.23; Description=Leucine Rich Repeat
  Pfam annotation: Domain name=LRR_1; Domain location=598-619; Score =13.3; E_value=0.86; Accession=PF00560.23; Description=Leucine Rich Repeat
  Pfam annotation: Domain name=LRR_1; Domain location=72-95; Score=2.7; E_value=91; Accession=PF00560.23; Description=Leucine Rich Repeat
  Pfam annotation: Domain name=LRR_1; Domain location=97-119; Score =16.6; E_value=0.091; Accession=PF00560.23; Description=Leucine Rich Repeat
  Pfam annotation: Domain name=Pkinase; Domain location=723-989; Score =133.1; E_value=7.8e-37; Accession=PF00069.15; Description=Protein kinase domain
  Pfam annotation: Domain name=Pkinase_Tyr; Domain location=717-989; Score=58.8; E_value=4.4e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=28-68::121-143::145-167::169-191::193-215::217-239::241 -263::265-287::289-311::313-335::361-383::385-407::409-431::433 -455::457-479::481-503::...
  Pfam module annotation: Domain location=505-527::529-551::553 -575::577-596::598-619::72-95::97-119::723-989::717-989
LHYSHLFTFSSFAFAAITANEVAENQEMEASESALLEWRESLDNQSQASLSSWTSGVSPCRWKGIVCDESISVTAINVTNLGLQGTLHTLNFSSFPKLLTLDISHNSFSGTIPQQIANLSSVSQLIMSANNFSGPIPISMMKLASLSILNLEYNKLSGSIPEEIGEFQNLKSLILQWNQLSGTIPPTIGRLSNLVRVDLTENSISGTIPTSITNLTNLELLQFSNNRLSGSIPSSIGDLVNLTVFEIDDNRISGSIPSNIGNLTKLVSMVIAINMISGSIPTSIGNLVNLQFFVLYENNISGVIPSTFGNLTNLEVFSVFNNKLEGRLTPALNNITNLNIFRPAINSFTGPLPQQICLGGLLESFTAESNYFTGPVPKSLKNCSRLYRLKLNENQLTGNISDVFGVYPELDYVDLSSNNFYGHISPNWAKCPNLTSLKMSNNNLSGGIPPELGQAPNLRVLVLSSNHLTGKFPKELGNLTALLELSIGDNELSGNIPAEIAAWSGITRLELAANNLGGPVPKQVGELRKLLYLNLSKNEFTESIPSEFSQLQSLQDLDLSCNLLNGEIPAALASMQRLETLNLSHNNLSGAIPDFQNSLLNVDISNNQLEGSIPSIPAFLNASFDALKNNKGLCGKASSLVPCHTPPHDKMKRNVIMLALLLSFGALFLLLLVVGISLCIYYRRATKAKKEEDKEEKSQDHYSLWIYDGKIEYKDIIEATEGFDDKYLVGEGGTASVYKAKLPAGQIVAVKKLHAAPNEETPDSKAFSTEVKALAEIKHRNIVKSLGYCLHPRFSFLIYEFLEGGSLDKVLTDDTRATMFDWERRVKVVKGVASALYHMHHGCFPPIVHRDISSKNVLIDLDYEAHISDFGTAKILNPDSQNITAFAGTYGYSAPELAYTMEVNEKCDVFSFGVLCLEIIMGKHPGDLISSLFSSSASNLLLMDVLDQRLPHPVKPIVEQVILIAKLTFACLSENPRFRPSMEQVHNEFVMPKSSSLDPLPMITL

SEQ ID NO: 155479 - protein, 109 aa, Glycine max
  Coding DNA Sequence Number=SeqID_38701
MAAIYTPLYGIAIRELLRAPSIIAGAPNKQRSGENALPGNTYPEEPYSGIIPEDSASENLPEEPSSGRRNIVSGSTQTLFPEERHPKFFRKKLLPEDILLLPEEGSSRS

SEQ ID NO: 155480 - protein, 327 aa, Glycine max
  Coding DNA Sequence Number=SeqID_38702
  Gene Ontology: Mol. function=catalytic activity; Cellular component =cellular_component; Biological process=biosynthetic process
  Homolog annotation: Hit_ID=Q1S7I7; Match level="QueryCoverage=93%, HitCoverage=98%, E-value=1e-115, Identity=69%"; Hit description =Phenazine biosynthesis PhzC/PhzF protein
  Pfam annotation: Domain name=PhzC-PhzF; Domain location=20-306; Score= 327.2; E_value=2.8e-95; Accession=PF02567.7; Description=Phenazine biosynthesis-like protein
MAKKPVKYSLTICAEFELDKQVDAFTESVFKGNPAAVCFLEEKRDKKWLQGVAAEFNLSVTCYLTRITESHGTTSYPRFDLRWFTPVSEINLCGHATLAAAHTIFSSGLVDTDVVEFVAISGILTAKKIPAINITSASDLQKGEAQDGFYVELNFPADPVVEFNFDETSQISGALNGASIIDIKRTQDGGDLVVVVTSGRVVEELQPQLDAIVKCPGRGLIVTGIAPPGSEFDFCSRFFCPKLGVNEDPVCGGAHCALAPYWSKKLGKCDFKAYQASARGGVLNVHLDEQNQRVLLRGKAVKVMEGPCVWSHQFKSMPNWEKMIYGY

SEQ ID NO: 155481 - protein, 566 aa, Glycine max
  Coding DNA Sequence Number=SeqID_38703
  Gene Ontology: Mol. function=catalytic activity; Biological process =cellular metabolic process
  Homolog annotation: Hit_ID=Q9LUY6; Match level="QueryCoverage=63%, HitCoverage=92%, E-value=1e-111, Identity=57%"; Hit description =Induced upon wounding stress-like protein
  Pfam annotation: Domain name=NAD_binding_4; Domain location=15-246; Score=-100.0; E_value=0.037; Accession=PF07993.2; Description=Male sterility protein
MATTTIEETKNVAIIFGVTGLVGRELARRLLLLEPSWKKVYGIARNPETLPTLIISPCYHFISCNMLNPLETQKKLSCLQDVTHMFWVTWASQFPSETQESCEQNKAMMCNALNTMLSVAKNLKHVSLQTGTKHYISLHPPFDEEKLQFYYYHEEFPRMSKSLNFYYALEDLLMEKLSGKVSWSVHRPGLLFGSSVRSFYNFMGSLCVYGAICKHLRLPFVFGGTRKCWEESYIDGSDARLVADQHIWAAKNSDMISTNGQAFNSINGPSFTWKEIWPIIGKKLEVQVPQEMLVESFWFSKAMAGKEDVWEEIVEENGLVHTSVENLANWEFLDALFRFPLKLLGSRDKVDGLGFGARLALLEVLRPRDTTTTCEIRGTFKHWVVGDDTYTPEHLEGDKVVPIELLGAPSSHGVMLVWTKFQELPITLLKQDITPMIVGLGNHPFPCAAKPDGERPYKAREGIMPMALCLVELYQYFAKCRMLYHRFGKSPVKHRRARARTGSEKPCHDWKQWNRVSHGGDTLPSKIWRPSLQFWEMGRLVTKSMQMSCETFFGDGKGCNNPGFLA

SEQ ID NO: 155482 - protein, 184 aa, Glycine max
  Coding DNA Sequence Number=SeqID_38704
MVKSVFSTMIGSVTSVKVEGEGVKVTVTSTISPDLFAAIIGQTVKENSHNKDKTRASNANQEENNNNNTDVSYGQNIFKGHRVEGTINLQELIKTNKMKQLELVQNLRIKFNHEKKDDDDDEASQKEIPPPPPPPPPEPQEFPDPIDPPSVPSSPSECNYQLPTAKTINVSSSSKRIIMRGHNK

SEQ ID NO: 155483 - protein, 254 aa, Glycine max
  Coding DNA Sequence Number=SeqID_38705
  Gene Ontology: Mol. function=catalytic activity; Cellular component =cellular_component; Biological process=biosynthetic process
  Homolog annotation: Hit_ID=Q1S7I7; Match level="QueryCoverage=83%, HitCoverage=80%, E-value=3e-81, Identity=65%"; Hit description =Phenazine biosynthesis PhzC/PhzF protein
  Pfam annotation: Domain name=PhzC-PhzF; Domain location=21-254; Score= 108.7; E_value=1.7e-29; Accession=PF02567.7; Description=Phenazine biosynthesis-like protein
MAKKICEVLCGMFLGELQWKPAAVCFLEEERDEEWLQAVATEFNVPVKLCGHATLAAAHTLFSYGLVNFNIIEFFTASGVLTTKKIPPINNCTSGSNLQNGVARDGFYIELDLPAHPIIEFNCDESSQISGALNGASIVDIKRTLIGDDILVVVTSGENVTEVQPQFDAISKCPGRGIIVSGIAPPGSGFDFYSRFFCPKDGVNEDHVCGSAHCALASYWSKKLGKCDFNAYQGVFWFSPVPSTEEYEVVNCLG

SEQ ID NO: 155484 - protein, 114 aa, Glycine max
  Coding DNA Sequence Number=SeqID_38706
MAIKNFVVDAFPELPFKGNPAAVCFLEEEEERNHHYSFPSHDFVNTNLRKNIYTSEESGKEREKGWVQLESEGGRLGKRGVGEGNKRKREDVGRRSFGGRVDCWIFLDFLPIKV

SEQ ID NO: 155485 - protein, 404 aa, Glycine max
  Coding DNA Sequence Number=SeqID_38707
  Homolog annotation: Hit_ID=Q1S7J8; Match level="QueryCoverage=90%, HitCoverage=100%, E-value=1e-175, Identity=82%"; Hit description =Cyclin-like F-box
  Pfam annotation: Domain name=F-box; Domain location=38-85; Score =29.6; E_value=1.1e-05; Accession=PF00646.23; Description=F-box domain
MSKGTSLYRNEITMLPKHCMPHYWPIHRIIVMAVAPVESITSLSSDLFYDILRRLDGPTLASAACTCASFSSISKEESLWENVCSSVWPSTNREDVKSLISSIGGYRKFYADCFPLIVNKEVGEYQWNNNLQYPDDWTEAEYYGDMIEFESISPSDFVSIVDIRFKEKPICSKVLWGIPNANGYDEWFFNCPFRIDLLSCADRDDNNDGVVTLSVSDGLPPITSMEREKKDGKLWQELRDGLLLSWIIVNKKIKQSANLASWSPLDGQRHWPTDKDFVFRFGSVLSAKGILPSEAVQCILIMKFRVVHIEEEGVQTNLKATELSMQLEDMECAHVNGRNSLLILKEALSCRRSNNFSEVLESCLMYSKVQNKLKEEKIKNESRLDTLCILSGIVAVMTFWYYVL

SEQ ID NO: 155486 - protein, 149 aa, Glycine max
  Coding DNA Sequence Number=SeqID_38708
MEAMKEQMITMMEAMMSMRKLVEANMATVVVTSTATEVDPTHPSGLKQVQSKHSFQPYGLPPNYTPPNVAHALEENVNNSTPITIESQQPRSGHAPVPQPMGETHEIPQDHALADLEPYLKYATEGQAFGGIPLPNTFGDPQHRPQSQL

SEQ ID NO: 155487 - protein, 339 aa, Glycine max
  Coding DNA Sequence Number=SeqID_38709
  Gene Ontology: Mol. function=malate transporter activity; Biological process=response to aluminum ion
  Homolog annotation: Hit_ID=Q9LS22; Match level="QueryCoverage=94%, HitCoverage=56%, E-value=6e-56, Identity=38%"; Hit description =Arabidopsis thaliana genomic DNA, chromosome 5, BAC clone:F10E10
  Pfam annotation: Domain name=UPF0005; Domain location=54-332; Score =264.6; E_value=2.1e-76; Accession=PF01027.11; Description =Uncharacterised protein family UPF0005
MESTHVISITNGEENVAPTKNAKTFQFSLSLPPVFSRLRENKLIQFSLFPITSYLRQKKDTKKIIHSIKVGISLVLISLLYFVDPLYEQVGDNAIWAIMTVVVTFEFSAGATLGKGLNRGMGTILGGGLGCIAAVLAQNVGGGIGNSIIIGTSVFIFGTIATYCRLFPSVKKRYDYGVMIFILTFNLVVVSGVRIQDQKVWKIASERLLTIVMGFVVCICVSFLVFPLWASDELHDSTVSRFQHLANALQGCLEEYVKFATEKENKKAGASFTVCKSLLDSKSKDEMLANFAKWEPWHGKFGFFYPWEKYLKIGEVLRELAAIILALGGCLQASTTVVK

SEQ ID NO: 155488 - protein, 624 aa, Glycine max
  Coding DNA Sequence Number=SeqID_38710
  Gene Ontology: Mol. function=transcription regulator activity; Cellular component=nucleus; Biological process=regulation of transcription
  Homolog annotation: Hit_ID=Q9FEA1; Match level="QueryCoverage=98%, HitCoverage=97%, E-value=1e-176, Identity=55%"; Hit description =Anthocyanin 1
  Pfam annotation: Domain name=HLH; Domain location=442-491; Score =56.3; E_value=9.8e-14; Accession=PF00010.16; Description=Helix-loop -helix DNA-binding domain
MTAPLDTGLQSMLQAAVQSVHWTYSLFWQLCPQQVILVWGDGYYNGAIKTRKTVQPMEVSAEEASLQRSQQLRELYESLSVGETNPPTRRPCAALSPEDLTESEWFYLMCVSFSFPPGVGLPGKAYARRQHLWLTGANEVDSKTFSRAILAKTVVCIPLLDGVVEFGTTDKVQEDLSFIQHVKTFFIDHLIPLRPKPALSEHSTSNPTSSDHIPTVMYTMVDPPAAKCNLNDDMDEDIEEEEEEEEEDEVESGSEDETGDGIACQTLRPSTVAEPSELMQLEMPEDIRLGSPNDGSNNLDSDFHLLAVSQGGNEARQAESTRRWSSSQEPMQVQLPTSEDLTQEDTHYSQTVSNILQNQTTRWLASPSSIGYNTYSTHSAFAKWSSRASHHFHPAADGTSQWLLKYILFTVPHLHAKNPGESSPHTAADTKLRGKGTPQDELSANHVLAERRRREKLNERFIILRSLVPFVTKMDKASILGDTIEYVKQLRRKIQELEARNRLTEERSKLPEVAVQRTSSSSSKEQQRSGVTMMEKRKVRIVEGVAAKAKAVEVEATTSVQVSIIESDALLEIECRHREGLLLDVMQMLREVRIEVIGVQSSLNNGVFVAELRAKVKEHANGKK

SEQ ID NO: 155489 - protein, 281 aa, Glycine max
  Coding DNA Sequence Number=SeqID_38711
  Gene Ontology: Mol. function=calcium ion binding; Cellular component =intracellular; Biological process=small GTPase mediated signal transduction
  Homolog annotation: Hit_ID=Q6ATR5; Match level="QueryCoverage=83%, HitCoverage=29%, E-value=8e-59, Identity=51%"; Hit description =Expressed protein
  Pfam annotation: Domain name=EF_assoc_2; Domain location=178-260; Score=91.2; E_value=3.2e-24; Accession=PF08356.2; Description=EF hand associated
MNYTIKHIYTLDASPRNKDYTLVKVPVIVVGCKLDLRDENQLVSLESLTTHIMKHFIEVVTCVECSAATLYQGCGFILFLDIVGNCRQMWPMLSQLQWWTPLKPLNIVGEIADANVPQVFYFAQKEVLHPVDPLFDYKRHALTDPCVRALRRIFVLCDHDMDGALNDEELNEFLVRCFSAPLQPSEIAEVKTIVEQKVPEGVNSIGLTFPGFIYVHNMFLKKGQTETLWAVLRKFGYDNDLKLWDDFLPVPSKQASDQVVLFFSFLVLAVYEVPFWSSCLI

SEQ ID NO: 155490 - protein, 194 aa, Glycine max
  Coding DNA Sequence Number=SeqID_38712
  Homolog annotation: Hit_ID=Q2HS22; Match level="QueryCoverage=82%, HitCoverage=49%, E-value=2e-09, Identity=33%"; Hit description=IMP dehydrogenase/GMP reductase
MAAIHDDGQVGFEEGMLWLPSHVLDEACDTKVCLRNRHQKLQNHQQMHQKRHHKSPGEPKSQYSKSAYQRPKLATNGGPGMRAIFLGSGHRSCGTGVFLPQRAGTNFQPSKRPACAPILLPARVVQALNLNVQALGVLISPPQVQRYNPRCREAYNNNSTEKKSDQKDASKQCRFISQNECSSPEIFLPKEWTY

SEQ ID NO: 155491 - protein, 72 aa, Glycine max
  Coding DNA Sequence Number=SeqID_38713
MAKCIGRAVKPHNLFVPILILYFLLEQGHDVLIQELWMHRLQNLPPSDPSGESGLFKYILNWVHDRGRIQIK

SEQ ID NO: 155492 - protein, 56 aa, Glycine max
  Coding DNA Sequence Number=SeqID_38714
MNEERTKNSVGINHGSDSEAPWPHEAEPLPLAPSCLFIGNEGRRLNSSLPRRAHLA

SEQ ID NO: 155493 - protein, 155 aa, Glycine max
  Coding DNA Sequence Number=SeqID_38715
  Gene Ontology: Mol. function=calcium ion binding; Cellular component =intracellular; Biological process=small GTPase mediated signal transduction
  Homolog annotation: Hit_ID=Q9LYA8; Match level="QueryCoverage=86%, HitCoverage=24%, E-value=7e-33, Identity=49%"; Hit description=Rac -GTP binding protein-like
  Pfam annotation: Domain name=EF_assoc_1; Domain location=16-82; Score= 86.8; E_value=6.6e-23; Accession=PF08355.2; Description=EF hand associated
MYGINVPTMNAFYVNPWNDAPYKDAAEKTDMGYISLNGFLSQTLLEPQRSLANLIDIGYNGNPTAALRVTHRRSVDHKKQTTEKNVFQCYVFGSKHAGKSALLYSLPGKVTRKILILHEIPEDGLLQFLSNQDCLAACDVAVFCGTCIFYIALVV

SEQ ID NO: 155494 - protein, 89 aa, Glycine max
  Coding DNA Sequence Number=SeqID_38716
MALGVIAARPGELSLQPEVSQRLAWASQVSQPTLRWEGDTGLTGASSKKGKCAESPPTFIRGKRRKNQKRWSTKSVKRFGSCFYARGRY

SEQ ID NO: 155495 - protein, 136 aa, Glycine max
  Coding DNA Sequence Number=SeqID_38717
MIMRGQDIYSSQDEATTSPSSSGSEEAKREEYSEEIYPQEEGQPLMVKEECKEVSVSSKRLAKKESHFAIKTNIKKTSPLRQSPHLLLCKKTIVSTATPIGLEVIPQVKELLDEGLVRKSLNPWALLVPTIGIIRH

SEQ ID NO: 155496 - protein, 63 aa, Glycine max
  Coding DNA Sequence Number=SeqID_38718
VTQALGVFTTPSFEHSRTQTAQRKKQHHQLLHHSLIFALVGAAMAVAGLTACRVRAVKKNTTA

SEQ ID NO: 155497 - protein, 280 aa, Glycine max
  Coding DNA Sequence Number=SeqID_38719
  Homolog annotation: Hit_ID=Q10NR6; Match level="QueryCoverage=61%, HitCoverage=43%, E-value=5e-15, Identity=33%"; Hit description =Expressed protein
MSYSSICQGLQSSVEPWLMEPRVLKLKLAPPGSNSNTSTHSPVTPPPNNTNNEHGNKNHSEQGGCNNWSFLQSLSNISHCKEPQTENVYVHPSVKRSSSMLSAKSLELCTESLGCETGSNASDNSDDLSLFSLESCPSLRSNNTSVTNKNSESRRLNRGSNFPPPLTSMGGVRVRSHREDGKLILEAVTSSSPQPYFQAERGDGRLRLRLFESVASAYEDEALNQEEDADVEEDLEEYVGNAEDEIGMTKLVRPSRCKESGKRVIFGDGYFEHPPLSLCL

SEQ ID NO: 155498 - protein, 217 aa, Glycine max
  Coding DNA Sequence Number=SeqID_38720
  Homolog annotation: Hit_ID=Q47522; Match level="QueryCoverage=28%, HitCoverage=83%, E-value=6e-22, Identity=75%"; Hit description=LacZ protein
  Pfam annotation: Domain name=Thiolase_N; Domain location=1-153; Score= -91.3; E_value=7.4e-07; Accession=PF00108.13; Description=Thiolase, N- terminal domain
VLQWLLFLSAVPPVQLLTGWCVTAKAPPDISAGKCSGHAARRVPFAIQAAQLLGRAIGAGLFAITPAGERGMCCKAIKLGNARVFPVTTLNSINRNGEEKSVTISVDDGIRPGTTVSDLGRLKPVFKKDGSTTAGNSSQVTDGASAVLLMIKLIDTVDLEGGPVGKPVVPAALMNRPTRGERRFAYWALAECILAYYVGTDEGVSEVLHVAGEKRLH

SEQ ID NO: 155499 - protein, 182 aa, Glycine max
  Coding DNA Sequence Number=SeqID_38721
MARVLVIRTLLSRILDELSSLKLWKEKLERKVKGKERVKINQDEREQIREEERRKIPKELRKEKHASYSSHNSCKSLSEEIRDYYEGRHRSHLRPHSHRRENERKPQKANINLPYFHGKDNVEAYLDWEIRVKQKRKRKSTLKSYGSHSYPKNDQGLGILGAAPSKPKDDKGKTIEKQPPEA

SEQ ID NO: 155500 - protein, 83 aa, Glycine max
  Coding DNA Sequence Number=SeqID_38722
MFATTFNTQPSAYNLAPSSSCYRSSLPTQIRDKSHEDEDEDEDNDNNNDDDNDGEGDDDDDKGGHHVSQQQWTITCEHPRTRG

SEQ ID NO: 155501 - protein, 184 aa, Glycine max
  Coding DNA Sequence Number=SeqID_38723
MATSQQEDATVSTTGVHQPNKEVQLAKFDIGEATKVKTKVMSTVATRWRQFKSTLTSKFVFAKSEGQQTQDVVTKYGLDPEAWKQFEETRLTPNWEGIRKRAQSIQKHNDCPHVLSCGGYDLLEKKLLDQKRKRIQEEALLSENAASLDEPPSPIKRHVKWKIARTRAVGNMTSESAQEIADKI

SEQ ID NO: 155502 - protein, 88 aa, Glycine max
  Coding DNA Sequence Number=SeqID_38724
MAHHPPLFSLNNLVDVPSTITDPQEMYLLLFSVNNPSRCTLYWYHKGCTLQCVKTKFSGGRRETQKEFRRLVLGEFFLAKGEGNEKDE

SEQ ID NO: 155503 - protein, 170 aa, Glycine max
  Coding DNA Sequence Number=SeqID_38725
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9SD69; Match level="QueryCoverage=92%, HitCoverage=25%, E-value=2e-58, Identity=69%"; Hit description=Beta -D-glucan exohydrolase-like protein
  Pfam annotation: Domain name=Glyco_hydro_3_C; Domain location=1-170; Score=48.7; E_value=1.9e-11; Accession=PF01915.12; Description =Glycosyl hydrolase family 3 C terminal domain
MVVTCMTPTISGTTILDAVQATVGAETEVIYEKYPSENTIERNEFSFAIVAIGEAPYAETLGDNSELTIPLNGADIISLVADRIPTLVILISGRPLVLEPLLLDKIDALVAVWLPGSEGEGITDVIFGSHGFKGKLPVTWFRRVEQLDQPADAVNSCEPLFPLGFGLAYN

SEQ ID NO: 155504 - protein, 387 aa, Glycine max
  Coding DNA Sequence Number=SeqID_38726
  Gene Ontology: Mol. function=DNA binding; Cellular component =intracellular; Biological process=DNA integration
GKVVEEVGTGVKGFRFWDPVSKKIVINRDTMFDEQSMLLEVVETTVSVSDGASPSSMEIQVDFEQLLVILEREYNIVKDRDLRTIILVRYGFEELAKLVAFALLISARDPSTFLKAMNNQEKDKWMGAMVEEMESLEKNQTLELGKIQGLPVEKGYAQQKGVDYDETFSPVVRHTSIKEVQALVVSHDLHLKQMDVKITFLHDGLEEQIYMERAEGFSKDKINISNVKPVSTPLTKHLSQCPKTDAEVESKSKVPYVSAVDCLMHAIMCTRPDLTLDQGDPSVVGYVDFDYVGDLDGKRSTTRYVFTLAGGPVCWKSIIQSLATMSTTGAKYMAVAEVSKEAVWLARLAKELGIEPDGVEIVVHDSFYRRTNVGAKRKGHLCWIKKQ

SEQ ID NO: 155505 - protein, 106 aa, Glycine max
  Coding DNA Sequence Number=SeqID_38727
  Gene Ontology: Mol. function=hydrolase activity, hydrolyzing O -glycosyl compounds; Biological process=carbohydrate metabolic process
  Homolog annotation: Hit_ID=Q9SD73; Match level="QueryCoverage=61%, HitCoverage=10%, E-value=5e-25, Identity=75%"; Hit description=Beta -D-glucan exohydrolase-like protein
PHRDLAREAVQKSLVLLKNGKDPSKPFLPLTKNAKKILVAGTHANDLGYQCGGWTKTWYGMSGQITVAYSPSLFSPILVGPPVLASIFVLAYYKEEILAIEIILVL

SEQ ID NO: 155506 - protein, 91 aa, Glycine max
  Coding DNA Sequence Number=SeqID_38728
  Homolog annotation: Hit_ID=Q1RVB5; Match level="QueryCoverage=91%, HitCoverage=6%, E-value=9e-09, Identity=32%"; Hit description =Peptidase, cysteine peptidase active site; Zinc finger, CCHC-type; Peptidase aspartic, ...
  Homolog annotation: Hit description=catalytic; Polynucleotidyl transferase, Ribonuclease H fold
  Pfam annotation: Domain name=zf-CCHC; Domain location=1-18; Score =17.6; E_value=0.0013; Accession=PF00098.13; Description=Zinc knuckle
MKCYKCKQNGHFNRNFLKLKKSGERAFHSTNVIETNDYYSERDVYYSEGDVLSSSCNQLTDAWILDSRCFYNMTPNKEWFTTYKLGANCYG

SEQ ID NO: 155507 - protein, 123 aa, Glycine max
  Coding DNA Sequence Number=SeqID_38729
  Gene Ontology: Mol. function=protein binding
  Homolog annotation: Hit_ID=Q9SBS1; Match level="QueryCoverage=88%, HitCoverage=20%, E-value=2e-34, Identity=73%"; Hit description=Ran GTPase activating protein
MTLLQKLLLLWLPDEGAVLISKALEGGHGQLIEVDLSTNSITWSGAKLVAEAVVGKPGFKLLNINANFISDEGIDELKNIFKNSPDMLGPLDENNPDGEDTDEEAEEDADHDELESKLKGLGI

SEQ ID NO: 155508 - protein, 303 aa, Glycine max
  Coding DNA Sequence Number=SeqID_38730
  Gene Ontology: Mol. function=carbohydrate binding; Cellular component= chloroplast; Biological process=translation
  Homolog annotation: Hit_ID=P37706; Match level="QueryCoverage=56%, HitCoverage=75%, E-value=2e-70, Identity=78%"; Hit description =Ribosome recycling factor, chloroplast precursor
  Pfam annotation: Domain name=RRF; Domain location=95-259; Score =269.5; E_value=6.7e-78; Accession=PF01765.9; Description=Ribosome recycling factor
  Subcellular localization annotation: CTP_CleavageSite=67; ConfidenceScore=5.72e-01
MATSFSPTASVGSIIFQNPPKGLLLLSQQQQQRSFASSASYATLKLPRAFALSPRPLLSKGRTTLVRAATIEEIEAEKAAIEKDAKTRMDRTIDNVRTNFSSIRTGRANPSMLDKIQVEYYGSPVSLKSIAQISTPDASSLLVQPYDKSSLKAIEKAIVSSDLGMTPNNDGELIRLSIPQLTSDRRKELSKIVAKQAEEGKVALRNIRRDALKAYDKLEKEKKLSEDNVKDLSSDLQKLTDEYMKKVDTIFKQKEKKLSSFAHLDNGASDLTVVINNLLEIYMLLWLGREICKQEVIIDYNYI

SEQ ID NO: 155509 - protein, 46 aa, Glycine max
  Coding DNA Sequence Number=SeqID_38731
MTDEISTDRFNNSIPIKHRLRKSNNHCKITQNTASRAAAARDARSM

SEQ ID NO: 155510 - protein, 449 aa, Glycine max
  Coding DNA Sequence Number=SeqID_38732
  Gene Ontology: Mol. function=actin binding
  Homolog annotation: Hit_ID=Q10LQ3; Match level="QueryCoverage=98%, HitCoverage=80%, E-value=2e-63, Identity=35%"; Hit description =Expressed protein
  Pfam annotation: Domain name=DUF827; Domain location=1-295; Score =108.9; E_value=1.5e-29; Accession=PF05701.2; Description=Plant protein of unknown function (DUF827)
LVEDLKSKIQKEESEANLNLQMGKCDKKSVVDENEEKENQVNQLNVLQPSREGFIPYPSSTPGLILMKLKQAKLNLTKTTNDLADVRTSVESLNKRLEKERISLKKTCERLAQNTSKISSLEEELNQTRLRLQIAKDAEIKGALDDPLDITRELQRLSYEAKNFKRMGESAKSKVLRTMSEIEQTKTMLRTTEIRLVAARKMKEAARAVEAFALAEINVVSNHDSSPGNQVTLSFEKYTALTCKARDSEEQSKKRVASAMLEVDETNLSNMDILKRVEEATEEVKTSKKALEEALERVEAANRDKVAVEEALRNWRSEGQKRRSSIHNSTKFKNCCLSHHWRDPQLLDVNGLHLVNDEAKPVKPTLSIGQILSRKLLQPQKFEAGEGISMKQNVSLGQMFGKQNNDRPIDRQVEKETGHKLFSTKSQKFGFARFSHILSKQKKKPTLNL

SEQ ID NO: 155511 - protein, 1214 aa, Glycine max
  Coding DNA Sequence Number=SeqID_38733
  Gene Ontology: Mol. function=protein binding
  Homolog annotation: Hit_ID=Q9LUW1; Match level="QueryCoverage=99%, HitCoverage=91%, E-value=2e-86, Identity=26%"; Hit description =Arabidopsis thaliana genomic DNA, chromosome 3, P1 clone: MCB17
MDRTRESRRSSMATSTNGFPRRRHRTIALRDSSEEGAVELREGASKRGRNRDRDRDSANRSKRRRGSHSQSTEESVGNEQDVDVVDVGVSKIRSPNYTTSSFASDHNHRRSFTPAKPPSFKITDEMIGVTVPRKARSASAKRSHESWISASSGGEELNFRQRSNSPGGQSVEPASPSSSNVSRRKKMKEIEPVSKPSKSSSSDLEIEIAELLYGLKTSKSHESSKKFEASVSPSDDGEKKKMEDNDNSSTLVPNNSTKELSRIPIEQHADVDYHVCPSLEAPKEDIGEDRMNSSAGFGDASADGRSVSPTKESPSCSKLDAEKPYSSSNRVMSAFPEAKAQRVGKFEIDLMAPPPMGLSPEVDDLSRGDFISETKALAPDVEMKKEDSVKVERPVKKEKTPEEIEEAKMVTFKEKFDVLKHDFEKQNNANDIKTNNKLEEQDGNRELATISSNPKEEITVQSTSMPLSTAESGRQSSLSPIGHKPPLQPVSKTDKTTGSLTLKHANFVLSQRQPKRCATHYYIACNILHQQCTKMKPPLPAAIGSGSVCDTKHNNVNCVPYAESMAFGKQSQKHLPIVNQNASQEKGWAATSIPSLTAAKGSNNVKPMDSAHRVQLVLQQGPNPGPTGNLVHGPAFLYPPGQHQASVTATSNQAGAVNSPNSTSSYNKSHSSVGGSPGTSSTLPVVAPGISFSYPNFSANGSSPYMTIVHNNGYSFPFSTSLGATAAIRGASPPQATHVLSGPFYSSQMFHPQQHPQSQALVQPSYLNASTSSSSSSHKQSPGAQVNGSNILTSTTMELQSQKRQTSLSHLRKHETEMGGGNAPSVANRTSYSQKNVHGQNFTIPVQPVNFSFKPSATSDIVGNGGCFGDKQQQQQALKGGVENIPSQAFAISFAAFNGTSVPSNLNFSSMAQNPVILQSLPDMAWQGYQAASIPQTTQQKTCSITEAKSGGNSSHQDDEKKITHAKSSSNGPTTLVFDNSSKNLNFVLSTTNGNWSNHTIPSTAITSVPLSSNASSSQQPPHLLQLPKQHAMQQQQAAMASRYKASSANSTPAAKFANNAPVFSQTPSQCRSSNQASHSKASGRTTDSHVHHTSIITSNAPTLKSFSQEQGRVLPGHMQISFGGNYITPLPPQGQPLLSNNQPLCTTAQGTPYSGANAKSNLEGSKASSSVNASQLQQTENSAGSGQKSSPVCGRNVPSILSSCPSHLSELKY

SEQ ID NO: 155512 - protein, 146 aa, Glycine max
  Coding DNA Sequence Number=SeqID_38734
  Gene Ontology: Mol. function=signal transducer activity; Cellular component=intracellular; Biological process=signal transduction
  Homolog annotation: Hit_ID=Q6YTU7; Match level="QueryCoverage=78%, HitCoverage=32%, E-value=2e-42, Identity=72%"; Hit description =Putative WD repeat domain 5 protein
  Pfam annotation: Domain name=WD40; Domain location=103-143; Score =17.9; E_value=0.037; Accession=PF00400.22; Description=WD domain, G -beta repeat
  Pfam annotation: Domain name=WD40; Domain location=58-99; Score=39.0; E_value=1.7e-08; Accession=PF00400.22; Description=WD domain, G-beta repeat
  Pfam module annotation: Pfam domain module=WD40::WD40; Domain location=103-143::58-99
MLMNDINLELRDVNGSVGGINYWTQVQVSHPNGKYILEGRPGSGEMLLLLKLWNYGSGKFLKIYSGHVNRVYCITSTFSVTNGRYIVSGSEDRCVYIWDLQAKNMIQKLEGHTDTVISVTCHPTENKIASAGLAGDRTVRVWVQDS

SEQ ID NO: 155513 - protein, 182 aa, Glycine max
  Coding DNA Sequence Number=SeqID_38735
  Gene Ontology: Mol. function=signal transducer activity; Cellular component=intracellular; Biological process=signal transduction
  Homolog annotation: Hit_ID=Q9SY00; Match level="QueryCoverage=91%, HitCoverage=88%, E-value=1e-68, Identity=44%"; Hit description =Putative WD-repeat protein
MGYEYGAGNGIGLRFHFKIGGENELAVGGEFGEGDSGGLIFDEGLQEIAGSGVPNLAGAIVAGGDDEGSVAVVVDGGDGHGVALYSVDAFPGLHIPNLNGLVEGTRDNVAGLGVEVYAENDVVVAAEDLDAVAAGGVPDAEGVVVGGGADVVGVGGPGQVGDALGVAHEAVAEGEGGGGPYD

SEQ ID NO: 155514 - protein, 197 aa, Glycine max
  Coding DNA Sequence Number=SeqID_38736
  Homolog annotation: Hit_ID=Q8RYE6; Match level="QueryCoverage=39%, HitCoverage=44%, E-value=8e-09, Identity=42%"; Hit description =Expressed protein
  Subcellular localization annotation: CTP_CleavageSite=32; ConfidenceScore=5.11e-01
MFSAKKAELHPPKTVLQIKQDDKFFSRLLSKESSMSKPSFRMAVAVPFVWESQPGTPKYTFSEDTLPPLTPPPSYFVNFITKKNKPLKKRSRSNLFLALFPKLNLKKKNILSPSSPSSPSSLWSTSDHSSKVVPMGKHGRRRFLSFGSSFDFRGDDEEESASASATTTSTTSKLCFGISRSTSTLASIGFRGSSRRS

SEQ ID NO: 155515 - protein, 99 aa, Glycine max
  Coding DNA Sequence Number=SeqID_38737
  Subcellular localization annotation: CTP_CleavageSite=56; ConfidenceScore=5.07e-01
MEITTGLSMSSQSTTKLKQRRFGLGLPGFPNCGILDQTLVSVQTFIAWGTRKKYANGSLGWSHAQSRKIMSPDEVPIALLIEVAIINPAFGDVISLTER

SEQ ID NO: 155516 - protein, 43 aa, Glycine max
  Coding DNA Sequence Number=SeqID_38738
MDELRSGLVSSWRKVTHPCGKLLGEWQVFVPTNRRVVIQSHGR

SEQ ID NO: 155517 - protein, 498 aa, Glycine max
  Coding DNA Sequence Number=SeqID_38739
  Homolog annotation: Hit_ID=Q7REJ8; Match level="QueryCoverage=25%, HitCoverage=15%, E-value=4e-39, Identity=62%"; Hit description=O1, putative
  Pfam annotation: Domain name=DUF926; Domain location=369-482; Score =229.6; E_value=6.9e-66; Accession=PF06047.2; Description=Domain of Unknown Function (DUF926)
MGRPSSTIEIPHERHRHNGRRTPDSDISDDYRRRRSPSYDSYDRHTERHRRCSESPEHRSPRHTNGTHNDNTLPKKFGRRNGAYLDRDRGDWQRSDSESDEELKGLNYEEFRRLKRQKMRKSLKHCIWNVTPSPPRRDNEDPEDYSKPDEISDRDDGAGKIDKEIKAKAKAKSESESDSDSESEKSVSSESDGSRSRKKKRKSSAGSSRRSYSESESESESESESESESESEEEERRRRKSRRNRRKRSNRSRKKRRYSDSDEREDSESDDSDSSGRKKKKRSSSSKSRSKRIRRSRKRTNRSPETEGEGSDLEEENGSGSGDAKSKTTVDEVMKTEINAEAIKLKELFESQKKPALDNEPAVGPMPLPRAEGHISYGGALRPGEGDAIAQYVQQGKRIPRRGEVGLSAEEIQKFESLGYVMSGSRHQRMNAIRIRKENQVYSAEDKRALAMFNYEEKAKREHKVMADLQRLVQRHIGQDVGPTHDPFAAKASDGADA

SEQ ID NO: 155518 - protein, 76 aa, Glycine max
  Coding DNA Sequence Number=SeqID_38740
MESFKYSDCEMNRKGMEHLQIECPFRVGRRERVRSWTLLGWVPEKEKKNCPEELDGNENKKRKEFCRKKMMMMKLP

SEQ ID NO: 155519 - protein, 730 aa, Glycine max
  Coding DNA Sequence Number=SeqID_38741
  Gene Ontology: Mol. function=zinc ion binding; Biological process =metabolic process
  Homolog annotation: Hit_ID=Q6ZA58; Match level="QueryCoverage=61%, HitCoverage=33%, E-value=2e-64, Identity=34%"; Hit description=PHD finger transcription factor-like
  Pfam annotation: Domain name=AT_hook; Domain location=186-198; Score =15.8; E_value=0.042; Accession=PF02178.9; Description=AT hook motif
  Pfam annotation: Domain name=AT_hook; Domain location=208-220; Score =10.1; E_value=0.42; Accession=PF02178.9; Description=AT hook motif
  Pfam annotation: Domain name=PHD; Domain location=567-603; Score =33.1; E_value=9.8e-07; Accession=PF00628.19; Description=PHD-finger
  Pfam module annotation: Pfam domain module=AT_hook::AT_hook::PHD; Domain location=186-198::208-220::567-603
MREGLRSRTRLGTASGGEGVDHKKTVAVKSEAVDLGDEGLEVQKSTIEKKGEVECGVKQECGFDLNVSPSADVDLAEDGSGKSCLNGGGSILVAEEDRKAKKKHDSNDGVLVGGRVLRPRSKSGDCKRLYYGENDDVVSGDNGEHSGCERVKVKKEHEEADDFLADSCEKEIIKPKKEGDGRRKLKRKRGRPPKIDLKGEDEPGDQLPRKRGRPPLAGRQNHLVTVVTHNRKGKATLRKGKKGLTKSDGAKVNAIGDTNSRNSTGGELEKKEDSLVKRNAVKQLVRDQIKEQLSAAGWTVDFRPRNGREYHDAVYVSLDGHTHWSITLAYKRLKEYYEAGNGEGKAYKPGFKFTPIAEEDFKMLTKVMNKQRKKGGKGGKKVDGVNGKKNKEKSGYGAGMGKSMKRKMKRKTSPNRMPVVRDHKRQKTQNKKRCAPLARNAEEIDSETEGYVLYCGKRTLLAWMIDSGTVLQNGKVHYMPHKSKSAVLDGEITGNGIHCGCCDKIFTISDFELHAGSKLADPLKNIYVGEGTSLLQCLLDSWNKQDESERKGFHFVDVAGEDPNDDTCGVCGDGGDLICCDGCPSTFHQGCLDIKITDPVLRQMMPILMIPGMSSFVETDVKRLEMLLGVKHEMEDGYSWTFIRRSDVGFDASQIKPQMVECNSKLAVAVSIMDECFMPYIDHRSGINLIHSILYNRGVLKQENVEYRLAPLRGLEEGLGGRLKSIKALK

SEQ ID NO: 155520 - protein, 54 aa, Glycine max
  Coding DNA Sequence Number=SeqID_38742
  Subcellular localization annotation: CTP_CleavageSite=28; ConfidenceScore=5.28e-01
MDASAQATPPGVVLMSKLFLSSAPITPSASSLVAVFDGVFLRLRSLWLFLAHGV

SEQ ID NO: 155521 - protein, 117 aa, Glycine max
  Coding DNA Sequence Number=SeqID_38743
  Subcellular localization annotation: CTP_CleavageSite=32; ConfidenceScore=5.17e-01
MTFVPLKSILRKKDKNKLTNVQFSKNYVSLISSSQLRNTLFKHEVKVLKQNVVLSHSDISAPIQYDRLKANCSSLKLDEKPPTYGVHHAVGRRGKEVEEMLLLLLSKIMHMLKKKTK

SEQ ID NO: 155522 - protein, 155 aa, Glycine max
  Coding DNA Sequence Number=SeqID_38744
  Homolog annotation: Hit_ID=Q1SCJ5; Match level="QueryCoverage=44%, HitCoverage=11%, E-value=5e-28, Identity=79%"; Hit description=Major facilitator superfamily MFS_1
  Subcellular localization annotation: CTP_CleavageSite=58; ConfidenceScore=5.33e-01
MSGRAMISCFSPPSTTPCSAPIPLWRRNHLLHATPPPSLHLLSRRSHLVAGGRRVWVNVKSEKNLSESPKYEDDVVVQKKKKRGLDNVEEEARWWQVFPKRWVIVVLCFSAFLLCNMDRVNMSIAILPMSAEYNWNPSTVGLIQSSFFWGYLLTQ

SEQ ID NO: 155523 - protein, 426 aa, Glycine max
  Coding DNA Sequence Number=SeqID_38745
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9SD73; Match level="QueryCoverage=96%, HitCoverage=63%, E-value=1e-164, Identity=67%"; Hit description=Beta- D-glucan exohydrolase-like protein
  Pfam annotation: Domain name=Glyco_hydro_3; Domain location=105-342; Score=264.0; E_value=2.9e-76; Accession=PF00933.12; Description =Glycosyl hydrolase family 3 N terminal domain
MACVYKNPEEQIEARVKDLLSRMTLREKIGQMTQIERTVATSSAIRDLSIGFELVGGWNEFDERPPLRVCLENCYRSILSSGGSAPFENALSSDWADMVDGFQKSALQSRLGIPLIYGIDAVHGNNSVYGTTIFPHNIGLGATRDSDLVQRIGAATALEVKACGIHYNFAPCVAVLNDPRWGRCYECYSEDTEIVRKMTSIVSGLQGQPPQGHEHGYPFVAGRNNVIACAKHFVGDGGTYKGVNEGNTILSYEDLEIIHMAPYLDCISQGVSTIMASYSSWNGRQLHADHFLITEILKDKLGFKGFVISDWEGLDRLCLPHGSDYRYCISSAVNAGIDMVMVAFRFKVFIEELTSLVESGEVPISRIDDAVERILRVKFAAGLFEFPLSDRSLLDIVGCKFYTHRSFPHIIKKIISVVPYGWITLF

SEQ ID NO: 155524 - protein, 104 aa, Glycine max
  Coding DNA Sequence Number=SeqID_38746
MVQKAIDEGRLELEEKPIKIDIDLFHIEANYIEPIQIMIEVNRALEEFEKEEESFFVPVGESLVEFLSKKQKVEKEVMLCPRYSVVFDKSTAKAFKASQIQKNY

SEQ ID NO: 155525 - protein, 216 aa, Glycine max
  Coding DNA Sequence Number=SeqID_38747
  Gene Ontology: Mol. function=transferase activity; Biological process= DNA integration
  Homolog annotation: Hit_ID=Q1SAV4; Match level="QueryCoverage=41%, HitCoverage=23%, E-value=1e-26, Identity=57%"; Hit description =Integrase, catalytic region
MSTVYYPQTDGQTEVMNCVLEQYLRSFIHSQQTSWYRYLALAEWSYNTSLHSNSGLTPFEVIYGKSPPAIPHYIPGMTTNKAVDSLVQTRQRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155526 - protein, 145 aa, Glycine max
  Coding DNA Sequence Number=SeqID_38748
  Homolog annotation: Hit_ID=Q1SAV4; Match level="QueryCoverage=37%, HitCoverage=20%, E-value=3e-12, Identity=64%"; Hit description =Integrase, catalytic region
MAGGDLPYITSNGVRPELEWRDVLYDHSAIHDLGLAIGLRIVHRAHAQPCAGETNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 155527 - protein, 169 aa, Glycine max
  Coding DNA Sequence Number=SeqID_38749
  Gene Ontology: Mol. function=transcription factor activity; Biological process=regulation of transcription, DNA-dependent
  Homolog annotation: Hit_ID=UPI00006B21F2; Match level="QueryCoverage =54%, HitCoverage=44%, E-value=6e-22, Identity=53%"; Hit description =RNA polymerase sigma-70 factor, ECF subfamily protein
  Pfam annotation: Domain name=Sigma70_r4; Domain location=109-158; Score=35.7; E_value=1.6e-07; Accession=PF04545.6; Description=Sigma -70, region 4
  Pfam annotation: Domain name=Sigma70_r4_2; Domain location=103-153; Score=42.2; E_value=1.8e-09; Accession=PF08281.2; Description=Sigma -70, region 4
  Pfam module annotation: Pfam domain module=Sigma70_r4::Sigma70_r4_2; Domain location=109-158::103-153
MGSTNSKFAIMPKIQADVLLNFEKNVDFYHSYYFLAGVEGTNKYIAPKVGVTLFGLLDLTAGLKSKNIKVSETTFETDEYTIFDLIREPSENIEDHLVTNQIQEDLLRMLQYLPQNQQEVITLRFFDGLSFKEIADHTDMSINTTLGRVRYALINLRKIMEENNIILTR

SEQ ID NO: 155528 - protein, 207 aa, Glycine max
  Coding DNA Sequence Number=SeqID_38750
  Gene Ontology: Mol. function=DNA-directed RNA polymerase activity; Cellular component=mitochondrion; Biological process=transcription
  Homolog annotation: Hit_ID=O47884; Match level="QueryCoverage=98%, HitCoverage=19%, E-value=4e-70, Identity=65%"; Hit description=RNA polymerase
MSFVDLYNCVPVTQDASASAYQLMAYFLLDKNFAKLTNLFDTGSGEIFDIYSHMRIELISFIKDSLSEENPELCAILDRVLTRSIVKQIYMPIIYGKTANSTTKDLIVSLCQDLLPKECTILSVLCFKFWQEKYSFMYSFIQLISLVGRVCSYLDRPVLYSTEYFSTSQDYKKMEKHSVRVFNSYLKKAHNVTLSFPSKERDKRKSG

SEQ ID NO: 155529 - protein, 111 aa, Glycine max
  Coding DNA Sequence Number=SeqID_38751
MRLKLKYLQDSPLNEGFAPTVKSSSHELHHRHAAVARDSQVSAMAILPCHAEVAVTWSLSSHFVKPSCNPRRRAAAINSSPPSPTPPCPRQLCFPFLAHILCQIFNQVPTS

SEQ ID NO: 155530 - protein, 254 aa, Glycine max
  Coding DNA Sequence Number=SeqID_38752
  Homolog annotation: Hit_ID=Q7XEG8; Match level="QueryCoverage=77%, HitCoverage=99%, E-value=5e-11, Identity=33%"; Hit description =Expressed protein
MEKTSMIQINGGLRWKLCLRRKLSEKVSVVDLNRLCALGSSGLSLCNSLSDSVIVVMETLFVVEQHKNQYCSRSKSQGHARFGGSPSMGFRDINCRTFESGRTGILPTPLKSHGSPKTPPNSDNKMVGKVKVTPKSTPIPINGKACRKEESEDVPNGGGVLLSELWAGPTYSNSPPPSSLPIPKFSVRPKRTVSLDLPGSSSPGIEMRLVAKSAPSSPSRERLDLPFTRDLFDDNADSATKTLCRILNLNINDD

SEQ ID NO: 155531 - protein, 86 aa, Glycine max
  Coding DNA Sequence Number=SeqID_38753
MEQIEYSFFFDSNINWGGAITIKEGWRRLSKQQEDVGFGVLCDIDKEINQSVACNLIEKRYGDRTWSLVPELDPICFNMGIEKPLH

SEQ ID NO: 155532 - protein, 373 aa, Glycine max
  Coding DNA Sequence Number=SeqID_38754
  Gene Ontology: Mol. function=protein binding; Cellular component =germline ring canal inner rim; Biological process=red or far red light signaling pathway
  Homolog annotation: Hit_ID=Q338Q9; Match level="QueryCoverage=89%, HitCoverage=96%, E-value=1e-122, Identity=61%"; Hit description =Kelch motif family protein, expressed
  Pfam annotation: Domain name=F-box; Domain location=43-90; Score =24.4; E_value=0.0004; Accession=PF00646.23; Description=F-box domain
  Pfam annotation: Domain name=Kelch_1; Domain location=131-187; Score =36.4; E_value=1e-07; Accession=PF01344.15; Description=Kelch motif
  Pfam annotation: Domain name=Kelch_1; Domain location=189-235; Score =56.1; E_value=1.2e-13; Accession=PF01344.15; Description=Kelch motif
  Pfam annotation: Domain name=Kelch_1; Domain location=316-370; Score =32.8; E_value=1.2e-06; Accession=PF01344.15; Description=Kelch motif
  Pfam annotation: Domain name=Kelch_2; Domain location=127-187; Score =10.5; E_value=1.6; Accession=PF07646.5; Description=Kelch motif
  Pfam annotation: Domain name=Kelch_2; Domain location=189-235; Score =31.7; E_value=2.6e-06; Accession=PF07646.5; Description=Kelch motif
  Pfam annotation: Domain name=Kelch_2; Domain location=316-370; Score =16.8; E_value=0.081; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=43-90::131 -187::189-235::316-370::127-187::189-235::316-370
MGDFEGINARVLEYLYCPHDFHIELDRWTSDLRSFGSVIVMSGLIEGLPDAVAIRCLAWVPFYLHPKLELVSRAWRAVVRGPELFKARQELGSSEDLLCVCAFEPENLWQLYDPLRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEMYDPEKDVWIPMPDLHRTHNSACSGVVIGGKVHVLHKDMSTVQVLDNAGQWTVEEYGWLHGQMAVIRDALYVISYGLIIKQDKKMRKVVGSASEFRRRIGFAMIGLGDELYVIGGVIGPDRWNWDIKPLSDVDVLTLASDRPTWRQAAPMTRCG

SEQ ID NO: 155533 - protein, 203 aa, Glycine max
  Coding DNA Sequence Number=SeqID_38755
  Homolog annotation: Hit_ID=Q1SW56; Match level="QueryCoverage=46%, HitCoverage=8%, E-value=1e-10, Identity=32%"; Hit description =Polynucleotidyl transferase, Ribonuclease H fold
EIKLPKHHPAPCPGNLWKKLWTVPTIPKCLNLAWRCCQDILPIKSNLVKRGLDVDPICPRCGQCAETVVHSLLLCEESKRACAWAWVTWSLWLGYVGFFGPFVERNRMSKWTKPPNECIKANLDVAVRRNTGSGLGVIYGDQSGEMDLEGSSSSQIARDLLMVGTTGKSEAEGIIEPSGDSADEPEGEPTGAVEGVVGPLPAI

SEQ ID NO: 155534 - protein, 185 aa, Glycine max
  Coding DNA Sequence Number=SeqID_38756
  Gene Ontology: Mol. function=structural constituent of ribosome; Cellular component=intracellular; Biological process=translation
  Homolog annotation: Hit_ID=Q9LT09; Match level="QueryCoverage=99%, HitCoverage=100%, E-value=1e-69, Identity=72%"; Hit description=50S ribosomal protein L24
  Pfam annotation: Domain name=KOW; Domain location=15-48; Score=46.7; E_value=7.8e-11; Accession=PF00467.19; Description=KOW motif
MGWKAAEKLIRHWKILRGDNVMITRGKDKGETGIIKRVIRSQNRVIVESKNLVKKHIKQGQGHEGGIFTVEAPLHASNVQVLDPVTGKPCKVGVKYLEDGTKVRVSRGIGTSGSIVPRPEILKIRTTPRPAVLVDKTWPEPIENREKVRRKMNLNYEKVGPKNTPMNLVLEKTCNAKTGRGMPEL

SEQ ID NO: 155535 - protein, 86 aa, Glycine max
  Coding DNA Sequence Number=SeqID_38757
  Homolog annotation: Hit_ID=Q1RYG7; Match level="QueryCoverage=50%, HitCoverage=23%, E-value=2e-07, Identity=64%"; Hit description=Plant lipid transfer protein/Par allergen
  Subcellular localization annotation: CTP_CleavageSite=23; ConfidenceScore=5.32e-01
MSLIRKAGNGPTTPSTAPVGSPSGSSAESPEGSIIPSASDFPSGAGSKTVPSIDGGSSDGNAIKVPSHLVLYLLALVSCVLTFTKF

SEQ ID NO: 155536 - protein, 360 aa, Glycine max
  Coding DNA Sequence Number=SeqID_38758
  Homolog annotation: Hit_ID=Q1S375; Match level="QueryCoverage=98%, HitCoverage=27%, E-value=1e-114, Identity=61%"; Hit description =Globin-like
MQNLKLQTMKESYLPEMNEMYQKIANKLHQHDSLPQQPKLDQIDKLRAYKSMLERMMALLQIPKNNILPNFKEKLGSYEKQIINLLINSNRPRKGMNSVQAGHHPPTHMSSMQQPQSQVTQVHSHENQMNSQLQSTNLQGSVPTMQQNNIASMQHNSLSGVSTGQQNMMNSMQPGTNLDSVHGNSVNSLQQIPMNSLQQNPVSTAQQTNINSLPSQGGANVIQPNALQSGSSALQHQLKHQQEQQMLQSQQLKQQYQRQQLMQRQLLQQQQQLHHPGKPQLSSQLQTHQMPQLHQMNDINDIKMRQGMGVKSGVFQQHLTSGQHSTYSHQQLKQGSAFPVSSPQLLQAASPQIQQHSSPQ

SEQ ID NO: 155537 - protein, 232 aa, Glycine max
  Coding DNA Sequence Number=SeqID_38759
MTEKHINASTYLLMFLEEFFESDTTASVDQEHFVVEVRTLTLEFFAAYLFVRDLAAAANPIAVATVQTECESVALIAVVNPVVVTAVNEVTTNLMYFVVIVAALEPLVVATCVQSDDLFACQHCQIHVQANVAAVTQGHYFPIVDVYLLGCFADLLTVVSVAEGFVVVAASEIEAASASNAAVGKDIAVNSVGEQSAAFLAFVSENQETYSVEMQHCFEHFEIEAADVAGAD

SEQ ID NO: 155538 - protein, 109 aa, Glycine max
  Coding DNA Sequence Number=SeqID_38760
MGQVLGHTWWQTGTEVKNCLKYYLEEGWTHENRLDKRKCVRAHGSMLGSGASRSDPKMLSRSSNGDFDLIRATLAAKSGSYAQWNHWEKKKAARAKKILKMWQLRRQLQ

SEQ ID NO: 155539 - protein, 99 aa, Glycine max
  Coding DNA Sequence Number=SeqID_38761
MVERSKSRSRVRLMACNGLRCWLVVGFPSLAIGAGDVSRSGVAMRRSGDSDIGVLVDGGSGGAEFPLLSAVGGGGVLFAISRWRREGVRDRVNLGKTTK

SEQ ID NO: 155540 - protein, 234 aa, Glycine max
  Coding DNA Sequence Number=SeqID_38762
  Gene Ontology: Mol. function=serine-type endopeptidase activity
MLSVAFSGISPVVIGAVWCFIVALCFTIIALVHCLCCCCCRKKKPRTDYSRKTYAISLIFLSVFLIMTIIGGGFLYTGLGKFQATAHDVSDILVTRATTVVDIIQNVIDNLHATKDIQVASFYLPDDIKGAIEKAEKFSTQTDYIKNQSEETARISMEFLGAISESLIIVGTMMLILAAVGFVISILGWKVIVYILLFFGWILVTCTFILSGISLVVHKLLVLDLGYSMSRWKS

SEQ ID NO: 155541 - protein, 52 aa, Glycine max
  Coding DNA Sequence Number=SeqID_38763
MGFQGSKIQSSVAVNHVNGVLYFSHNINVGSHDEDGLKHNAYGPTRKRVALF

SEQ ID NO: 155542 - protein, 99 aa, Glycine max
  Coding DNA Sequence Number=SeqID_38764
MKIDGKATRSTKEVNVLLQAKEGSTRDVLDTPHLHQKSQGIGYLGHNSYISFIESFPNQCFDGCLLDLETKSKERAKWSFSQDFRHSFAQASNQLAWAN

SEQ ID NO: 155543 - protein, 183 aa, Glycine max
  Coding DNA Sequence Number=SeqID_38765
MKANMEAIKQQMTTMMEAMMSMRKMMEDNTATVVAVSTAIEMDLIHLADFNQVNRLVSDVVCQGGEATKNACGPYHVQVQSKHSFPSYGLPPNYTPPTVVYTSGENIINFAPVLIENQQPQFDHVHVSQPMGETHKVPQDHTLAGFGVYLEYTNERQAFSGILVLNAPGISQCHLEYQNPCIL

SEQ ID NO: 155544 - protein, 144 aa, Glycine max
  Coding DNA Sequence Number=SeqID_38766
MTSLSQQGQQEGNYYALAWNLTHSEEEATTRIHLRVIGECLSDCEMPRRGGGIHLPVTGKCTVSLELDRAGLVDEDTTKGKDHEALEGPMTKGILKKAQHSDEDTTKGKDHEALERPMTRDKLKQAQHVIETRLVICIAAIDDD

SEQ ID NO: 155545 - protein, 171 aa, Glycine max
  Coding DNA Sequence Number=SeqID_38767
MKERPLSDAKRNRREAHDRGCSDLVGCPLCGKLEWLNNLSIYEGMLKHFNSSMVMYLTTPMFHTLDVVYVRGGGGCSDLVRCPLFGKLEWLKNLSISKGMLRHFNSSMVMYLTTPTFIHRKIDCNNINEIREERMQTQFYTGSENSVPTSSTQGQPIPYVQMLYNKRLTVS

SEQ ID NO: 155546 - protein, 400 aa, Glycine max
  Coding DNA Sequence Number=SeqID_38768
  Gene Ontology: Mol. function=inositol or phosphatidylinositol phosphatase activity; Cellular component=intracellular; Biological process=abscisic acid mediated signaling
  Homolog annotation: Hit_ID=Q1RYG3; Match level="QueryCoverage=99%, HitCoverage=77%, E-value=0.0, Identity=78%"; Hit description =Inositol polyphosphate related phosphatase
  Pfam annotation: Domain name=Exo_endo_phos; Domain location=76-357; Score=55.7; E_value=1.6e-13; Accession=PF03372.13; Description =EndonucleaseExonucleasephosphatase family
FQEIVPLNAGNILGTEDNGPARKWLALIRKTLNSLPGTSGECHTTSPLPDPIVELDADFEGSMRQKTTSFLHRRSFQSLSHSMRMDNEMSLPQACLDRRLSVCDRMMFGHRTSDYDPSYRWASSDDENGPSDSPVVTHYSPMTYRCCFSMEDRDRQTGKSRYCLVASKQMVGIFLTVWVKSDIRDDVLNMKVSCVGRGLMGYLGNKEGDELRRNSDVMEILRKTRFPRVQGMGDESSPQTILDHDRIIWLGDLNYRIALSYRAAKALVEMHNWKLHIERRQGRVFEGWNEGKIYFPPTYKYSNNSDRYAGDERQSKQKRRTPAWCDRILWYGRGLRQLSYVRGESRFSDHRPVYSMFLAEVESISRNRIKKCSSCSSSRIEVEELLPHSHGYSYTDLSFF

SEQ ID NO: 155547 - protein, 199 aa, Glycine max
  Coding DNA Sequence Number=SeqID_38769
  Homolog annotation: Hit_ID=Q8H612; Match level="QueryCoverage=73%, HitCoverage=28%, E-value=9e-29, Identity=43%"; Hit description =Pentatricopeptide (PPR) repeat-containing protein-like
MASLKSVLSLDSNYNFDELQWVVQIRRTLEEELDEDEVQACSSKQSLKLDNIVDQLTKLEQRIRACHHKFLDFNGETSVWMMTVDASFLLEFLQVFYCAIQDGTKVARGKSYHNAILRDIVMLENQIPMFLLRNILEFKFSSLEAVDDTLMLEFISLFKEVSPFKMMEEYPTIQVSECTSTRFPISHDCPQYVRTPRYN

SEQ ID NO: 155548 - protein, 84 aa, Glycine max
  Coding DNA Sequence Number=SeqID_38770
  Gene Ontology: Mol. function=inositol or phosphatidylinositol phosphatase activity; Biological process=abscisic acid mediated signaling
  Homolog annotation: Hit_ID=Q1RYG3; Match level="QueryCoverage=100%, HitCoverage=15%, E-value=1e-31, Identity=76%"; Hit description =Inositol polyphosphate related phosphatase
MRDENSKKSKLSWPKTLVMKWFNIKSKNEDFQADDVLYAGVNEEWRNNCSQRDEDAIKRTKTERAKKRHSDRMRRGKIDRDAAQ

SEQ ID NO: 155549 - protein, 336 aa, Glycine max
  Coding DNA Sequence Number=SeqID_38771
  Gene Ontology: Mol. function=DNA binding
  Homolog annotation: Hit_ID=Q1SDS1; Match level="QueryCoverage=89%, HitCoverage=68%, E-value=4e-22, Identity=26%"; Hit description=IMP dehydrogenase/GMP reductase
MAEVPTEAIASLVQYYDQPLRKPYLFAGFYPSLARISKIVQISAQELDHRKQVENGVVGVPRKCLEAKARILAGKGERAPFIDILALLIFGGVLFPNVDGLVDLAAIDAFLAFRDRKESLVVTILAYLYDTFDRRCEKSSTRIVCYTLALYIWLVLHLFRQEKEGRTRVLILCGGFPNVPLMGTRGCISYNPVLAIRQLGYPMRGAPLEGELTPIIARGFNNTNVEALQKVCKAWEMVQKKDKELRGSNNGPIGGYHRWLKAHMQGLDWLPSLRTTKGVEVRAPEEDEEVQALRAELKQAQTVKERFKSAALKIQKENAELRDINIATTKALEQET

SEQ ID NO: 155550 - protein, 550 aa, Glycine max
  Coding DNA Sequence Number=SeqID_38772
  Gene Ontology: Mol. function=methylcrotonoyl-CoA carboxylase activity; Cellular component=mitochondrion; Biological process =metabolic process
  Homolog annotation: Hit_ID=Q42777; Match level="QueryCoverage=99%, HitCoverage=72%, E-value=0.0, Identity=95%"; Hit description =Methylcrotonoyl-CoA carboxylase subunit alpha, mitochondrial precursor
  Pfam annotation: Domain name=Biotin_carb_C; Domain location=171-297; Score=157.3; E_value=4.1e-44; Accession=PF02785.9; Description =Biotin carboxylase C-terminal domain
  Pfam annotation: Domain name=Biotin_lipoyl; Domain location=484-547; Score=44.5; E_value=3.6e-10; Accession=PF00364.12; Description =Biotin-requiring enzyme
  Pfam annotation: Domain name=CPSase_L_D2; Domain location=1-164; Score=201.2; E_value=2.5e-57; Accession=PF02786.7; Description =Carbamoyl-phosphate synthase L chain, ATP binding domain
  Pfam module annotation: Pfam domain module=Biotin_carb_C::Biotin _lipoyl::CPSase_L_D2; Domain location=171-297::484-547::1-164
GMRIVHTPDEFVESFLAAQREAAASFGVNTILLEKYITRPRHIEVQIFGDKHGNVLHLYERDCSVQRRHQKIIEEAPAPNISADFRAQLGVAAVSAAKAVNYYNAGTVEFIVDTVSDEFYFMEMNTRLQVEHPVTEMIVGQDLVEWQILVANGEALPLSQSQVPLSGHAFEARIYAENVQKGFLPATGVLHHYHVPVSSAVRVETGVKEGDKVSMHYDPMIAKLVVWGENRAAALVKLKDSLSKFQVYLNFCIACAIVNCEVIMIVIEGLPTNVNFLQKLANHRAFANGNVETHFIDNYKEDLFVDANNSVSVKEAYEAARLNASLVAACLIEKEHFILARNPPGGSSLLPIWYSSPPFRIHHQAKRRMELEWDNEYGSGSSKIMKLTITYQPDGRYLIETEQNGSPVLEVKSTYVKDNYFRVEAAGVINDVNVAVYSKDQIRHIHIWQGSCHHYFREKLGLELSEDEESQHKPKVETSANPQGTVVAPMAGLVVKVLVENKTRVEEGQPVLVLEAMKMEAPSSGYVHGLQLMVGEQVSDGSVLFSVKVR

SEQ ID NO: 155551 - protein, 72 aa, Glycine max
  Coding DNA Sequence Number=SeqID_38773
MVRTKDIARHNNQALVPVNEPLFDALHQLARYMTKLTVTGYSYKRKLKREYSGYLTYTINRRILYHEPKATP

SEQ ID NO: 155552 - protein, 64 aa, Glycine max
  Coding DNA Sequence Number=SeqID_38774
MGNNSLINAVGLLPLKACTYCGKDNHTVEKCYRKNGFPPNYTFRGGRSSRRGSGKGSSDRRGSK

SEQ ID NO: 155553 - protein, 75 aa, Glycine max
  Coding DNA Sequence Number=SeqID_38775
MKEVQMIQWLVWNVATYLRKGVRAKSQRRQLCDANDRLRLSFTKKKRLPMMNGEDECAQKNKGGPLRIHRSHSNL

SEQ ID NO: 155554 - protein, 61 aa, Glycine max
  Coding DNA Sequence Number=SeqID_38776
MTIEPTCAKKVVLHQVYQQNSTAVTPHHPNPNKTGRRGKQERKPILCLTNGQNEEKKADKK

SEQ ID NO: 155555 - protein, 65 aa, Glycine max
  Coding DNA Sequence Number=SeqID_38777
MTCGDTQVVIRAKALLLILTREVRWQAEITQVVIHTHTVLLPRRVRSQDSTSFALVVGQVKIQLK

SEQ ID NO: 155556 - protein, 202 aa, Glycine max
  Coding DNA Sequence Number=SeqID_38778
  Homolog annotation: Hit_ID=Q1S0F5; Match level="QueryCoverage=65%, HitCoverage=24%, E-value=2e-10, Identity=33%"; Hit description=IMP dehydrogenase/GMP reductase
MARVAKVVKISAQELDRVKKNRNGEVGIPRKLLEEKAKALVDQGEWTSFIDVLALLVFGIVLFPNVDGLVDLAVIDAFLAYHHSKESLVIAVLADAYDTLDLRCEKSSTRIVHCTPPLYVWLVSHVFRHENILVCPLQGRHMCVEKGKANWEELLAVKAMQKYFRKSEKHGMRWKEKIRSLREAAMVSSAAIINGGRLRCQG

SEQ ID NO: 155557 - protein, 223 aa, Glycine max
  Coding DNA Sequence Number=SeqID_38779
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q3BRB7; Match level="QueryCoverage=99%, HitCoverage=58%, E-value=4e-49, Identity=47%"; Hit description =Sensor protein
  Pfam annotation: Domain name=HATPase_c; Domain location=120-219; Score=102.2; E_value=1.5e-27; Accession=PF02518.16; Description =Histidine kinase-, DNA gyrase B-, and HSP90-like ATPase
  Pfam annotation: Domain name=HisKA; Domain location=12-75; Score =31.3; E_value=3.3e-06; Accession=PF00512.15; Description=His Kinase A (phosphoacceptor) domain
  Pfam module annotation: Pfam domain module=HATPase_c::HisKA; Domain location=120-219::12-75
MTRQLARYDKELRTSHVAMAHELRSPLNAAMVRLQALLDGVFSADSRQLALIMAQLSCLHRLIDELHLLSLADAGQLTLEKVRCNPADILRERLQWIKPQLDEARISTGVALAEETLLPVDPFRLGQVFTILLENALRYAGSGSQLQLRTRNTVDHYEIIVQDNGPGVPAAFLALMFERFARGEASRARHSGGSGLGLSIARAICQAHGGTINATLPATGGLQ

SEQ ID NO: 155558 - protein, 153 aa, Glycine max
  Coding DNA Sequence Number=SeqID_38780
MTSEAAKEIANKIDSLEEQASQSSFVAHGCHDVLIVAIGGPKHPSRSQVQSQELALPSELEVGPSATHVSTKESCVDPFENDPDTGDSEKCGLYVEENPPRLVALGRLYEGSTTVHSIPLRHDQVKVGVEEVRDAYAPIPVPTKKVQLVGAST

SEQ ID NO: 155559 - protein, 115 aa, Glycine max
  Coding DNA Sequence Number=SeqID_38781
  Subcellular localization annotation: CTP_CleavageSite=51; ConfidenceScore=5.15e-01
MSILTLGSKKGKEGDFQSKRKQKEKKGNSQSKSGRKQKEKKGNSQSKNGRNVSSKWSFRNEMLNIQNLICGYEKISSADSPSQHVRILAKKTSRLFLVSQVIQNYVGLSSSLEDT

SEQ ID NO: 155560 - protein, 112 aa, Glycine max
  Coding DNA Sequence Number=SeqID_38782
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=95%, HitCoverage=18%, E-value=1e-25, Identity=52%"; Hit description =Isoflavone conjugate-specific beta-glucosidase
APQLSNAKISYLTDSLSNSSYNDMSFIFVIVVVRDGKPIGLNVASNWLYVYPRGFRDVLLYTKKKYNNPLIYITENGINEYDDSSLSLEESLLDIYRIDYHYRHLFYLQEAI

SEQ ID NO: 155561 - protein, 87 aa, Glycine max
  Coding DNA Sequence Number=SeqID_38783
  Gene Ontology: Mol. function=nucleoside-triphosphatase activity
  Homolog annotation: Hit_ID=Q1SGD5; Match level="QueryCoverage=48%, HitCoverage=9%, E-value=8e-16, Identity=93%"; Hit description=AAA ATPase, central region; MIT
  Pfam annotation: Domain name=Vps4_C; Domain location=24-84; Score =55.4; E_value=1.9e-13; Accession=PF09336.1; Description=Vps4 C terminal oligomerisation domain
MSRNLTDCASILSFDFRHVPKLHKLPNDGCQAPHKDQTKVACHQAKILPPPISRTNFDKVLARQRPTVSKSDLDVHERFTKEFGEEG

SEQ ID NO: 155562 - protein, 156 aa, Glycine max
  Coding DNA Sequence Number=SeqID_38784
  Gene Ontology: Mol. function=unfolded protein binding; Cellular component=phagocytic vesicle; Biological process=protein folding
  Homolog annotation: Hit_ID=Q00NU9; Match level="QueryCoverage=71%, HitCoverage=16%, E-value=4e-49, Identity=84%"; Hit description=Heat shock protein 90
  Pfam annotation: Domain name=HSP90; Domain location=1-153; Score= -266.2; E_value=5.7e-05; Accession=PF00183.9; Description=Hsp90 protein
MRDKLGIWCPIGDLEASLRTLKLGINEDSQNKTKLAELLKYDSSKSGDEMTSLKDYVTRMKEGQNDIYYITGESKKAVENSPFLEKLRKKGYEVLYMVDAIDEYVVGQLKEFEGKKLVSTTKEGLKQVVIPLSHVQMLLLEAVDSASFVAYIDYAE

SEQ ID NO: 155563 - protein, 95 aa, Glycine max
  Coding DNA Sequence Number=SeqID_38785
  Gene Ontology: Mol. function=identical protein binding; Biological process=negative regulation of enzyme activity
  Homolog annotation: Hit_ID=Q1RYB7; Match level="QueryCoverage=83%, HitCoverage=10%, E-value=7e-12, Identity=40%"; Hit description =Protease-associated PA; Proteinase inhibitor I9, subtilisin propeptide
  Pfam annotation: Domain name=Subtilisin_N; Domain location=1-55; Score=31.5; E_value=2.9e-06; Accession=PF05922.7; Description =Subtilisin N-terminal Region
MDPHQSLSEAKVAALHHYNKSFQGFSAMITPEQASQLAEYESVLSVFESKMNKLHTTHSWDFLGLETISKNNPKALDTASNVIVGEYLLKLNENY

SEQ ID NO: 155564 - protein, 391 aa, Glycine max
  Coding DNA Sequence Number=SeqID_38786
  Gene Ontology: Mol. function=transition metal ion binding
MAAQARQVFYVEDPCDSRWAVVLQGRTICIGHDVDGLTLDVTDMPSFSKDIPSTTVEQEEDDVYANRTNHDEGLWENIRMTRQSTRLRSLTSRYLDGPQLVVNVNPTTGRGSEPHKEKFHSYLGVVAREKVPIVHANWNVVPDDLKSLIWKDILPKFDIPEGENAKKKVMSTVAARWRQFKSSLTSKFVFADNEGQQISDPTVKYGLDPETWAEFAKSRKTPNCQGIRKKAQEIQKFNDCPHVLSRGGYELLDKKLMEEKSKRGHEEHLCTESPTLNIDPPSPVVRHLKWKIACKKRHGQMTSEVAQEIADKIDILNTALGRPEHPGHVRVAGTGVTISQYFGQASRASSTSSPSINQQQLAYIIGGIKDDIRKQLQDEIRKEEQDEIRKE

SEQ ID NO: 155565 - protein, 114 aa, Glycine max
  Coding DNA Sequence Number=SeqID_38787
MKKICSNLQGKDNAPPPPPQWIEAKYFSDGTTLDTDTMTTLRKKWTTYFLEVGKWMSVFDMFLLGSFSLPQPSHTLVQEIIGKAPQQYAAKGGPDFFFVINIQMLGSPMYSLGR

SEQ ID NO: 155566 - protein, 122 aa, Glycine max
  Coding DNA Sequence Number=SeqID_38788
  Gene Ontology: Mol. function=ubiquitin-protein ligase activity; Cellular component=ubiquitin ligase complex; Biological process =protein ubiquitination
  Homolog annotation: Hit_ID=Q84VE7; Match level="QueryCoverage=87%, HitCoverage=20%, E-value=7e-12, Identity=33%"; Hit description=Arm repeat protein
MCLDEIDTVAENFHRLTGELSILLDMFPLQDLNLNDDVRELVLLNEIVPDQAHLASIFEKLEIRDALSCKVEIGSLEEEIHNRCEEQPKTYLIALIGLVCFTKCVLYGASTPSQKTVTLRWN

SEQ ID NO: 155567 - protein, 111 aa, Glycine max
  Coding DNA Sequence Number=SeqID_38789
MACTHIPVEDSQAILPQISASPHQLDFAPCASRSYSAQWNAPRLLPDKHTLRSSRIIRKWRLRKPTPGLWLPLHYQVDKGALCCKIPSLVGVLVRAKVVFVIGSAVDRLCG

SEQ ID NO: 155568 - protein, 131 aa, Glycine max
  Coding DNA Sequence Number=SeqID_38790
DDDLDLNASPQALDKLLGHVLAFKVRIQSRFKNLVVLKYSKDLDLINAVLEMLPDSETCFKIDPSNVDCNDATHAECQFLSATADHDPVAGLPLTPKRRMSSDEANDELGSSQISPAQILSNKLTRHSHRS

SEQ ID NO: 155569 - protein, 94 aa, Glycine max
  Coding DNA Sequence Number=SeqID_38791
MKQEKELNKCTKILLRPCKSCVGDLEKSEAKLPCYPITFVHTKGGSVSNLMPPDALPSPGMSPIGEVIPLVKPPAVAASKQSRQQQERDAPRRH

SEQ ID NO: 155570 - protein, 309 aa, Glycine max
  Coding DNA Sequence Number=SeqID_38792
  Gene Ontology: Mol. function=hydrolase activity; Biological process =aromatic compound metabolic process
  Homolog annotation: Hit_ID=Q10QA5; Match level="QueryCoverage=83%, HitCoverage=83%, E-value=8e-97, Identity=69%"; Hit description =Hydrolase, alpha/beta fold family protein, expressed
MEQSKKNQNLKQGQSPRISGPVTLWKILSRIISTHAPGLARASPRATGKAQSQAGEPGMKEHSSAGGGPPCPATGCCSFRRCGPSWDVNQTQNPPQVAVEHRPRHEQRDVRPHVEQRPGKLPHRRGNIRSHRQRRETVHPGLVVRLHCRKHLLDLSLLKSPVVVLVIQESEKLNQQLVKKLGGAYEDEFGEEVGAADGGQHADHGGDGVADVDAAGDAEGVEDVEEVVDVGVEGGVAAVVEVVGVDAAGADEVVENDAVVAGEVREHALPRGLVCAEAVGQEKVLIAGTFHADVQGVENGSAHRESYLT

SEQ ID NO: 155571 - protein, 183 aa, Glycine max
  Coding DNA Sequence Number=SeqID_38793
MSVTVVPKGMKYSLLYYHFEDQMTSPTLHLLEIREQHDEQPKCCLKLKEKLEEVLAFTCPTPLSCICIGCYLGCCILVHLIFVLHHTTSCCLIIDYKIELVTCFPTLNPFFRSFSEGYLTPVATYPSVGGRRVTRGMRVPRKEYARSRHQRLFEENVGKTGKDAIYELLSERFGSCIYAQGRC

SEQ ID NO: 155572 - protein, 72 aa, Glycine max
  Coding DNA Sequence Number=SeqID_38794
MYKDKWTQPCPMGSKIYPEVHQNPRAFFNSSNPIFLEPLTHGYGLKQLFSTTQGTGNRLPETDCKRAFQKGF

SEQ ID NO: 155573 - protein, 150 aa, Glycine max
  Coding DNA Sequence Number=SeqID_38795
ASTFNFKRSDILRDSIGHPSKKLLLFEFAQSFGIPFRASRYITGLIQTSEASVFHFERLDILRDSIRHPSKKLLSFEFAQGFGIPFRAFRYITGLNQTSEASTFNFELFDILQDSIRHLSKKLLSFEFAQSFNIQFRAFRYMTGLNQTSE

SEQ ID NO: 155574 - protein, 113 aa, Glycine max
  Coding DNA Sequence Number=SeqID_38796
MSRATVLAARCSKITLNGAPRTTSLIDATFTKKACFCSAQLLKQKLSVQHEAANKPFCFYPNLPYPQAHMLPSSPTTFISIPGNSSDQPTPATPHENSSHPAIPFWGRLAAPL

SEQ ID NO: 155575 - protein, 78 aa, Glycine max
  Coding DNA Sequence Number=SeqID_38797
MLGGGMGMLAALDHLERIPNNCIRGDIGGTPIEKMTPKQLWWFGLWTCTKKAIEAPMRRVNCMVFSPVKRREGDQEGH

SEQ ID NO: 155576 - protein, 227 aa, Glycine max
  Coding DNA Sequence Number=SeqID_38798
MDPSGDVARSKRGILFFAIGIQFFWSRERPESCVVVVVVILLVEAQPEPLGEGGIVTNHNMLGILLHLVFKKKGKIKWLSCYGAYGGGGMTRKIDFNNDIVEKTMHEHSRRGNMGLLVVLRFVATTDFDHVVFELGCKMNWENIVVERRKILVTHPSYGIGFVKRRANGVAHELARVAPLFPSLYSVDHVIPCTEHLIHGENDIIKSSYKMLKTRGIHGYGLPTNPN

SEQ ID NO: 155577 - protein, 104 aa, Glycine max
  Coding DNA Sequence Number=SeqID_38799
  Subcellular localization annotation: CTP_CleavageSite=48; ConfidenceScore=5.03e-01
VDSRGSHTRKSPTGPWGFQLWLRASISPIGCPYPPGKGSRLQDTQWTRRSPTGSWSCQALITGLYQFYGVPVTSSKGIRPPTDRAFIKKYCVPRQAQGETPQQH

SEQ ID NO: 155578 - protein, 192 aa, Glycine max
  Coding DNA Sequence Number=SeqID_38800
MDDVRFKYGIRISLVVAWKARMIARAIMDRDVLLVQDIRKIDVNKWIFISDQQKEAWEDKMLQLKEIKQDAYEWLIKTVDTNAWCKHAKLEKYVGEIMPKPKKRLDMEIEHTRNWIIVYSAHKIVEVTHALNGEKFVVNLIDRTRYSWYSMLPCSGCRKEPPVSNDGATADASTTANRNQVDENQNATVSNQ

SEQ ID NO: 155579 - protein, 67 aa, Glycine max
  Coding DNA Sequence Number=SeqID_38801
MDLFSGANTKEEEPTNLRSNPLQGGEDDAILPKKRLVTRAISKRLQEDWARAAEEGPRVLMNLRVDF

SEQ ID NO: 155580 - protein, 130 aa, Glycine max
  Coding DNA Sequence Number=SeqID_38802
MCALCPPGRGNPQSPDPWSPMTPPDSSLRLPRRERNIVLYVTEYDEFRRELERRCWHKSLTRQMDGHIDVALELSKTFFQHLTVGILKITTFDLLLGENGALSAIPTKEGIALSAPRCAKPNSNQRGNCA

SEQ ID NO: 155581 - protein, 84 aa, Glycine max
  Coding DNA Sequence Number=SeqID_38803
  Subcellular localization annotation: CTP_CleavageSite=44; ConfidenceScore=5.47e-01
MVALWQRFSFFFSSSFFFSLLSLQSFTYGFHNLPLSPSSFLFIEKQGIWGHDSSPRRAGYFTMRLFGGLGEPEASLAEPGVRKV

SEQ ID NO: 155582 - protein, 132 aa, Glycine max
  Coding DNA Sequence Number=SeqID_38804
  Subcellular localization annotation: CTP_CleavageSite=10; ConfidenceScore=5.02e-01
MGNKSSSTSKAQYSSNSQGEKVASTQLQYVAAPHPRKISTNNPKDVSQTQQHGKKPLGNDEAFTTYIKDARVKMKSKSNIGVHHEDRNNVIPVDVANETNKEYEKDHFSDFIQNARKKLRTVTRRSSSIRRG

SEQ ID NO: 155583 - protein, 81 aa, Glycine max
  Coding DNA Sequence Number=SeqID_38805
  Subcellular localization annotation: CTP_CleavageSite=21; ConfidenceScore=5.33e-01
MQYVNTLNPKVLIYKGARPTRVESLPSRSTITFSDTKQRRCSENTFSGTNLERKRRGNKPQNQIGFQVVRYREDEMMMTLQ

SEQ ID NO: 155584 - protein, 97 aa, Glycine max
  Coding DNA Sequence Number=SeqID_38806
VPVTSSKGIRPPTNRAFIKKYCASRQAQGETPQHPGDGRQRATDTPPSPLEFTSAHPQKGSKIPWTRMTSPLSPAVHGGLPLGSNPDIYHDQPFYKP

SEQ ID NO: 155585 - protein, 51 aa, Glycine max
  Coding DNA Sequence Number=SeqID_38807
MEMTKSMMWMRWHDACARNMVGSMGAWMMPIGNFKDGKPLSQGTSYNQTAI

SEQ ID NO: 155586 - protein, 80 aa, Glycine max
  Coding DNA Sequence Number=SeqID_38808
MEKVKKEEEIKGSRKKISNEEIETKGDTVSKRVIREFIVSSGGGDNERAQKPDDDPFVLLLIGNLLPLEPPVSSTLFGSS

SEQ ID NO: 155587 - protein, 83 aa, Glycine max
  Coding DNA Sequence Number=SeqID_38809
MPPACISPAGLAIPSLHASRRCCWQNPRGLHLAVDAGGIYIMHAGWMAHGRRMDAWEAKVSLTNRNDGIRGIKDSPTGMAEHL

SEQ ID NO: 155588 - protein, 425 aa, Glycine max
  Coding DNA Sequence Number=SeqID_38810
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-59, Identity=30%"; Hit description= UPI00006A17C9 related cluster
GLHSLAFRGLHVLAIRGLHALAFKELHVLAFKGLHVLAFKGLHALAFRGLHALAFIGQHVHAFGGLHVVAFRGLHVIVFRGLHVLAFRGLHVLAFRGLHALIFKGLNVLTYRGLHVHAIRGLHVLNFRGLHVLTIRGLHAPTFRGLHVLAFKGLHGLAIRGLHVLANRGLHALAFQGLHILAFRQLHALTFRGLHALTFRDYTGLNILAIRGLHAPTFRGLHVLAFKGLHGLAIRGLHILAIRGLHALAFQGLHVLAFRQLHVLAFRGLHVLTFRGLHAFAFRGLHVLAFKELHALALRGQHALTFRGLHVLAFRGLHVLAFRGRYVLAFRGLHALALRGLPVLTFRGQHVLAPRGLHALAFRGLHILAFRRLQVLAFRGLLVLAVLTFRGLHVLTFRGLHVLAFRGLHALTSRGQDALTFRGLH

SEQ ID NO: 155589 - protein, 385 aa, Glycine max
  Coding DNA Sequence Number=SeqID_38811
  Gene Ontology: Mol. function=transition metal ion binding; Cellular component=nucleus; Biological process=electron transport
EAIEFCSEYIEKAKPVGLPKSRHDKRVRVRHEALVKESNLKMTKNRMLKEHNKTFLNWFKDAIFGYNNASETLRKLTDRPKRNVITWEGYDINKYLFYTKLQDDESTMQNSGVSLRAESQHFTTVHDDNLHVASMHYFRVIDEIWELNYVKFIVCDFKYLKKFAYQNEPFIMAEQAKYVFYVQDPCNERWSVVLHEKIIGVNVEDDDSITSHLATPPNSPPCPLEPVIHVDPATGKADGPRKKKLRMYLGIIARDKVDVTIDNWKQVHVAQKDLIWEDIQAEFDIPEASDLRTKKKILQTYDISKEKWNQFCQSRRDPSWEDVRKKAQTIQKQNTAFHVLSYVGYYFLEEKFMEDKKKKQLEEIAQFGITNTIIDPSSAIRRHMK

SEQ ID NO: 155590 - protein, 76 aa, Glycine max
  Coding DNA Sequence Number=SeqID_38812
  Homolog annotation: Hit_ID=Q8LE51; Match level="QueryCoverage=41%, HitCoverage=24%, E-value=5e-09, Identity=84%"; Hit description =Yippee-like protein
MNNLVTQVMGRLFVVNLEGKIYSCKHCHTHLALYDDIYSRHGFKLRSATATSSYFDTPQSNNDGNCNRIFQQLTAM

SEQ ID NO: 155591 - protein, 152 aa, Glycine max
  Coding DNA Sequence Number=SeqID_38813
  Gene Ontology: Mol. function=arginyltransferase activity; Biological process=regulation of protein catabolic process
  Homolog annotation: Hit_ID=Q9ZT48; Match level="QueryCoverage=90%, HitCoverage=24%, E-value=4e-10, Identity=28%"; Hit description =Arginyl-tRNA--protein transferase 1
WVPFDIARPLLDRKPYVVLSDSSILQNGESSLPQITDDVMGRDFDDVGQEDANDVPMLDEEEMVDSESECSDDEPDLETTSDDDPEIVDVSKVLLGIKGSHVKYKDLWVVFDPEQRSYLESRLRRYRKVVGPALSERMGALLVLFVALRVAH

SEQ ID NO: 155592 - protein, 43 aa, Glycine max
  Coding DNA Sequence Number=SeqID_38814
  Homolog annotation: Hit_ID=Q1SXA1; Match level="QueryCoverage=75%, HitCoverage=8%, E-value=5e-09, Identity=75%"; Hit description=Zinc finger, SWIM-type
MVVEKETSPIPCISGFQYCNPIVQVDGIWLYDKYKGTLLVAVA

SEQ ID NO: 155593 - protein, 107 aa, Glycine max
  Coding DNA Sequence Number=SeqID_38815
MLKFIAVQLVDNEDMKVKPFSSTRPNKPEFTTEPGLPNKELCPFSEDEDEVLHNQTQEDDDEEEVDPVSPTHSYHHATYHHTCKILKNLIFKILNMVIAWIAKKSNI

SEQ ID NO: 155594 - protein, 144 aa, Glycine max
  Coding DNA Sequence Number=SeqID_38816
  Gene Ontology: Cellular component=nucleus
MHCMAHVRVGVKPSRFDEVYDLSDAAGADEGSWRFKVFHAMNCIKDGALRAASVVGVGLSGSAQVEEVADGDVGEGVESRGGGAMEPRGVTELRHGEAGDGAAEVVGRGSCPVIGHELLGWKIWISASGIVWSPLGIECFGDCN

SEQ ID NO: 155595 - protein, 69 aa, Glycine max
  Coding DNA Sequence Number=SeqID_38817
MLNVIDEDGHNLSELHGPNESDSLPLDSFDQLANIVKIRQNNSLGYVLPHCIITTGEPRVALRHIGIET

SEQ ID NO: 155596 - protein, 490 aa, Glycine max
  Coding DNA Sequence Number=SeqID_38818
  Gene Ontology: Mol. function=fatty-acyl-CoA synthase activity; Cellular component=peroxisome; Biological process=jasmonic acid biosynthetic process
  Homolog annotation: Hit_ID=Q9M0X9; Match level="QueryCoverage=100%, HitCoverage=93%, E-value=0.0, Identity=63%"; Hit description=4 -coumarate--CoA ligase-like protein
  Pfam annotation: Domain name=AMP-binding; Domain location=56-454; Score=352.3; E_value=7.9e-103; Accession=PF00501.18; Description=AMP- binding enzyme
  Subcellular localization annotation: CTP_CleavageSite=57; ConfidenceScore=5.05e-01
MQKAGYGGDGIYRSLRPCLVLPNDPNLSLVSFLFQSVSSFPSKIALVDSHSSQTLTLAHLKSQVAKLAHGFLKLGINKNDVVLLLAPNSIHYPICFLAATAIGAVVSTANPIYTVNEISKQVDDSNPKLLITVPELWDKVKNLNLPAVIIDTETAQGLVSFEAGNEVSRITSLDAVMEMAGPATELPESGVKQGDTAALLYSSGTTGLSKGVVLTHRNFIAASVMIGMDDDLAGEQDDVYLCVLPMFHVFGLAVVTYAALRRGSAVVVMERFELEALLKAIEKQRVTKLWVVPPILLGLAKQSVVGNYDLSSLRRIGSGAAPLGKDLMEECGRRFPHVAICQGYGMTETCGIVSVENPRVGVRHTGSTGTLVSGVEAQIVSVDTQKPLPPRQLGEIWVRGPNMMQGDLGYFDEDGQLYVVDRIKELIKYKGFQVAPAELEGLLVSHPEILEAVVVPYPDDEAGEVPIAYVVRSPNSSLTEEEIQKFIAKQ

SEQ ID NO: 155597 - protein, 181 aa, Glycine max
  Coding DNA Sequence Number=SeqID_38819
  Gene Ontology: Mol. function=lactoylglutathione lyase activity; Cellular component=cytoplasm; Biological process=carbohydrate metabolic process
  Homolog annotation: Hit_ID=O49818; Match level="QueryCoverage=94%, HitCoverage=92%, E-value=7e-86, Identity=85%"; Hit description =Lactoylglutathione lyase
  Pfam annotation: Domain name=Glyoxalase; Domain location=22-166; Score=104.8; E_value=2.5e-28; Accession=PF00903.15; Description =GlyoxalaseBleomycin resistance proteinDioxygenase superfamily
MESPSNNPGLHTTPDQATKAYFTQQTMFRIKDPKVSLDFYSRVLGTYLLKRLDFLEMKFSLYFMGYEDTTKAPSNPVERTVWTFSQKATMELTDNWGTENDPEFKGYHNGNSEPLGYGHIGIAVDDTYKACERFQNLGVEFVTKPDDGEIKGLAFIKDPDGYWIELFDLKILGGEQAAAHA

SEQ ID NO: 155598 - protein, 46 aa, Glycine max
  Coding DNA Sequence Number=SeqID_38820
MTREKESGCTRGSENDIVSGGTATEKKRCTTTEREEEARKRPIKLI

SEQ ID NO: 155599 - protein, 66 aa, Glycine max
  Coding DNA Sequence Number=SeqID_38821
  Gene Ontology: Mol. function=transferase activity; Cellular component= integral to membrane; Biological process=vesicle-mediated transport
  Homolog annotation: Hit_ID=Q6UA11; Match level="QueryCoverage=79%, HitCoverage=26%, E-value=5e-20, Identity=94%"; Hit description=Fiber NTGP1-related protein
  Pfam annotation: Domain name=Synaptobrevin; Domain location=2-58; Score=4.8; E_value=0.016; Accession=PF00957.11; Description =Synaptobrevin
MQDPAEADKLMKIQRELDETKIILHKTIDSVLARGEKLDSLVEKSSDLSAASQLLKCGYGHIIEHA

SEQ ID NO: 155600 - protein, 81 aa, Glycine max
  Coding DNA Sequence Number=SeqID_38822
MVRTKKSGQITSEAVKNITDRIDSLEEHASHRRQDVLPIAIRRPEHPGHVHAGGASVMIKQYFGPTSKSPRTSVSMAPEDL

SEQ ID NO: 155601 - protein, 161 aa, Glycine max
  Coding DNA Sequence Number=SeqID_38823
  Pfam annotation: Domain name=Transposase_23; Domain location=37-102; Score=-12.8; E_value=0.028; Accession=PF03017.5; Description =TNP1ENSPM transposase
MQSQGLALLPEPKVGPSTARVSTKESCVDPLGQDPNMGDLQKCRLYVDENPPCLVALGRVCEALIIVHNIPLGNDQVKVGVKEVRDVDAYVPVPTQEDKQRSEGPAKPADRPDPDVNPLYLMTLTILQFFLKPLHMTETSMRAENAFVYGFLESQSIQKSG

SEQ ID NO: 155602 - protein, 91 aa, Glycine max
  Coding DNA Sequence Number=SeqID_38824
EAFYKADVNLAIATSEILQQEIVHLTSSSSTGLAATTDDFHGRLATSTGGIQLAAVSPFILAASSTCRHASDTAMQASGIGWGLHRKTDPT

SEQ ID NO: 155603 - protein, 160 aa, Glycine max
  Coding DNA Sequence Number=SeqID_38825
MTEDQMLAHVTQFHEARQKRKAEEEEIVVVTMKDVASIQAEAFAKVVDETIVCGVIIDLTNTGVMNETPKASNATIAYEVEHNVIEPASKQSITSNEATSRDKGEPDVVIVYSTNSGPTPLNYAQPTTATRDQVQDMIGQVISIKFIEFSYAFCDVYLAF

SEQ ID NO: 155604 - protein, 515 aa, Glycine max
  Coding DNA Sequence Number=SeqID_38826
  Gene Ontology: Mol. function=monooxygenase activity; Cellular component=integral to membrane; Biological process=electron transport
  Homolog annotation: Hit_ID=Q1I1D7; Match level="QueryCoverage=93%, HitCoverage=86%, E-value=1e-174, Identity=72%"; Hit description =Cytochrome P450
  Pfam annotation: Domain name=p450; Domain location=88-515; Score= -23.5; E_value=6.6e-10; Accession=PF00067.12; Description=Cytochrome P450
NGFFANTSLVRRHLLHRRPLIPPPRVPPPSVPPPAGEPRPAVDRRDAAADIGVQERQSGAFHRRARGAVRFDLHDARVRRADGVLGGPGGEPVHSAERREAVGLQLSRFDIEPARKTLSSVDERCSPQENALSHNELRQLLHHQGSSSSPHRPPHLPQPRCLVRHCLSHGSGKKACDCDVRNGNGGGDSDSMVRYNESNFLAHEPLHLVNLNEKITFELTVKQLMSFDPDEWTENLRKEYVLVIEGFFTLPFPLFSTTYRRAIKARTKVAEALALVVRQRRKEYGENKEKKSDMLGALLASGDHLSDEEIVDFLLALLVAGYETTSTIMTLAIKFLTETPLALAQLKLGFTEPVNRMDVAAWNPTLHPVYVHDHDHHNSTEEHDQIRAKSHPGAPLEWTDYKSMAFTQCVVNETLRVANIIGGIFRRATTDINIKGYTIPKGWKVFASFRAVHLNPEHYKDARSFNPWRWQSNSSETANPGNVYTPFGGGPRLCPGYELARVVLSVFLHRIVTRF

SEQ ID NO: 155605 - protein, 168 aa, Glycine max
  Coding DNA Sequence Number=SeqID_38827
MVLPVEQFILPEEPSPGEATRRSSSGNLSGRRFFRMNNLFYRKNLLPEASPEEGSSDRINCSSGPEESSPGRINCSSERTFFRMNKLFYQKNLLSEAFQKKVLPVEYKLFFRKKVLPESFRKKVLPESFRKKGSFGRAQIVLPEEGSSEKTQIVLPEEGSSGRRNYLF

SEQ ID NO: 155606 - protein, 806 aa, Glycine max
  Coding DNA Sequence Number=SeqID_38828
  Homolog annotation: Hit_ID=Q9FFK6; Match level="QueryCoverage=96%, HitCoverage=97%, E-value=0.0, Identity=57%"; Hit description =Arabidopsis thaliana genomic DNA, chromosome 5, P1 clone:MJJ3
MRITLEPSSEPSPSPSPSRSQTPKEEVEWVPLPKHPLFTAHGGATTAAASRNLLAWDGASRLYFWDSNKRCLHRLSLRLGDPDPSSVLAASPSKVLQSDAVLDFDVRKISINRKGTAILLFGSETLSVMYLYGRASKKDVNLICRTITIGSQTYCTGGNDIRVLQALWHPYSDTHLGILSSDSVFRLFNLAVDPLQPEQEYYLQPVEPGRTRKASSLCPVDFSFGGDHLWDRFSVFILFSNGAIYVLCPVVPFGSLFKCESLVEIYNDAHTFGKISANSVAASNSKLAISWLEAAFPELQNQETKGDSLSLLKAHSYALFDASLVLQGPLRRVGQDGNEDSVGRSAECEGRAVSFLYNLVSKDSILVTAWSGGQLQIDALADEIQPVWSVGSPPRLRVDSHDQILGLAMICESIASSSLWKLDHNAWLGNPPPLLRLAIVDLALPRKAESGYNISLFIDTLMPERIYSLHDGGIDSIVLHFLPFTSQTNGKDDTMKTPSVHPVLNTCQSGFTSEPSLCGFVSLSDSFGYSWIVTITLSLECVVLEMKSWNLLLPVSIDMEKKPISSEGESKGRDIPTIISKELLSGPREVLVPQASPSLRSVAADSIEGRSTLHQYFKLFHETYVEYAHKVYLELKHHAPQLKKIINDQHSRIGDAQQKLLKVDEKEAILQKRIDRAIQMHNSLEERLQQLRNLPCVHKKPLSRAERKFKSELDHFKEVELDALHSSVDAVSARLRRHLQASKANHQQQKTPGKKSYAGDDQMSLLKSSLEKLSLLNTENSKKVELVESSLRNKERSSREPSLPMP

SEQ ID NO: 155607 - protein, 142 aa, Glycine max
  Coding DNA Sequence Number=SeqID_38829
  Gene Ontology: Mol. function=RNA-directed DNA polymerase activity; Biological process=RNA-dependent DNA replication
MRMLRWMCGKTRQDKIRNEAIRERVGVAPIVEKMVENRLRWFGHVERRPVDSVVRRVDQMERRQTIRGRERPKKTIREVIKKDLEINGLDRSMTCGCTALSYFGHQNKNISWRSSSNPYPFIIKRIITLFIGFTLPQNPLLA

SEQ ID NO: 155608 - protein, 248 aa, Glycine max
  Coding DNA Sequence Number=SeqID_38830
  Homolog annotation: Hit_ID=Q1RYI2; Match level="QueryCoverage=47%, HitCoverage=21%, E-value=2e-14, Identity=34%"; Hit description =Ribonuclease H
MELQLLGGERILLRILKSWKVLFFAGKRLFQNYLDINWSGLMNLLLLRILERLYSLWVILKPRELIVSKQFYKGNWEIVGKEFCKVLWDGEVLDKFQPSRRIRHILCRPFTCLFHFAKKLINTVEILSGGYYKCKKIPLAKLDFVCFPKRDGELGLRKVGLMNQALLMKCENDTLPVIDSRRSESNLWRGIVNGWDSLKTNLKWKVGNGRATKLWKNWWIWKNFKSKDKTIKTTSCGEVIWDCKSVFG

SEQ ID NO: 155609 - protein, 150 aa, Glycine max
  Coding DNA Sequence Number=SeqID_38831
  Gene Ontology: Mol. function=catalytic activity
  Homolog annotation: Hit_ID=Q5VQE5; Match level="QueryCoverage=60%, HitCoverage=15%, E-value=2e-12, Identity=43%"; Hit description =Alpha/beta hydrolase-like
VYSLCDGPRLSHGPYLGITTMCSVLSLMFVSFKAVYIFSVSGIDRSGYVRATEIALFVCSCALAVGHVVVAYRTSCRERRKLLVYKIDIEAPKITAFNVVMMPFQLAPCKLKISACKNGYPRATAIHHIMSLRASRDATVYPKDASNLDT

SEQ ID NO: 155610 - protein, 231 aa, Glycine max
  Coding DNA Sequence Number=SeqID_38832
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=8e-31, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVIAFRRLDVLTLRGQHDLTLRGLHVLTFRGLDILAFRGLHVLAFRGLHLLTFRGLHLLTFRGLHALDFRGQHVLAFIGLDTLAFVGLHPLDFRGLHVLTFRGLNILASRGLQVIAFRGLHVLAFRGLHFVAFRGQHALAFRRLHVLDFRGLHALTFRGLHFLAFRGLQTINFRGLHIFAFRGVDALPFRGLHVLAFSGLHALAFRWLEALALPSEGYTPTPSDGYMHSP

SEQ ID NO: 155611 - protein, 117 aa, Glycine max
  Coding DNA Sequence Number=SeqID_38833
  Gene Ontology: Mol. function=nucleic acid binding; Biological process= DNA integration
  Homolog annotation: Hit_ID=Q1SJY4; Match level="QueryCoverage=92%, HitCoverage=28%, E-value=6e-14, Identity=30%"; Hit description=Zinc finger, CCHC-type
MSNGDIPITRPEAEWTNDDLAIMKLNTKAIYTLTCTEDVRLRKVGTLTRHYESFIMKDKESVEDMFGRLQVLLNNLEALGQTYSKTQINLKVLDSFPKVWEPKATSIQEARDLKNLA

SEQ ID NO: 155612 - protein, 51 aa, Glycine max
  Coding DNA Sequence Number=SeqID_38834
MVTRDDSNSEKSSGSDNEQANICLMLDTDDKVKTIKSFTKIVKISSGLLED

SEQ ID NO: 155613 - protein, 99 aa, Glycine max
  Coding DNA Sequence Number=SeqID_38835
MQVAGLTNHHIINCIRFKESTSNAKAIGKESSLNSKVKEKANEEPTEVVVRGDELIVECTKLIQRYDEGSKKRNKEGEYNGVKPEWRMEDNSCNEILFF

SEQ ID NO: 155614 - protein, 62 aa, Glycine max
  Coding DNA Sequence Number=SeqID_38836
MAYGTPDDACQKGSFSSLRDADCSTASLSDPMYREKNWVVSNKTLKPVGQDNWVVSHKAYLG

SEQ ID NO: 155615 - protein, 622 aa, Glycine max
  Coding DNA Sequence Number=SeqID_38837
  Gene Ontology: Mol. function=nucleoside-triphosphatase activity; Cellular component=membrane; Biological process=transport
  Homolog annotation: Hit_ID=Q84ZB2; Match level="QueryCoverage=93%, HitCoverage=93%, E-value=0.0, Identity=82%"; Hit description =Putative iron inhibited ABC transporter 2
  Pfam annotation: Domain name=ABC_tran; Domain location=433-598; Score= 149.9; E_value=6.7e-42; Accession=PF00005.17; Description=ABC transporter
  Pfam annotation: Domain name=ABC_tran; Domain location=94-312; Score =94.2; E_value=3.9e-25; Accession=PF00005.17; Description=ABC transporter
  Pfam annotation: Domain name=Miro; Domain location=96-202; Score= -8.1; E_value=0.033; Accession=PF08477.3; Description=Miro-like protein
  Pfam module annotation: Pfam domain module=ABC_tran::ABC_tran::Miro; Domain location=433-598::94-312::96-202
  Subcellular localization annotation: CTP_CleavageSite=31; ConfidenceScore=5.10e-01
MVSDASKKKAAQKKAAAAAKRGGKAAAAAVMAATSSKAADKVANGIADIQISDRTCTGVLCSHPLSRDIRIESLSVTFHGHDLIVDSELELNYGRRYGLLGLNGCGKSTLLTAIGCRELPIPDHMDIYHLTREIDASDMSALEAVISCDEERLKLEKEAEALAAQDDGGGESLERIYERLDALDAATAEKRAAEILHGLGFDKQMQAKKTRDFSGGWRMRIALARALFMNPTILLLDEPTNHLGILSALERVPLVFVNNFYMSYALVGWGDLEACVWLEESLKKFERILVVISHSQDFLNGVCTNIIHMQSKKLKLYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDMEMSALQFMIKEYPGNEEEKMRAAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGDIMEFKAHLKSKAGLSD

SEQ ID NO: 155616 - protein, 136 aa, Glycine max
  Coding DNA Sequence Number=SeqID_38838
  Homolog annotation: Hit_ID=Q8S8L5; Match level="QueryCoverage=50%, HitCoverage=55%, E-value=1e-12, Identity=55%"; Hit description =Expressed protein
  Pfam annotation: Domain name=Auxin_inducible; Domain location=25-128; Score=54.9; E_value=2.7e-13; Accession=PF02519.5; Description=Auxin responsive protein
MAELNVRSSSSKRRVLGGILKLKGVLEKLQKSILFRRNNKSSCSYCGEYDYEEGDHNTVCVQEGHFAVIAEHEEEITKRFLVPLSCLNNSTFLSLLEKAAQEYGFDQHGALTIPCRPSELERLLLAQQWKERGRFF

SEQ ID NO: 155617 - protein, 154 aa, Glycine max
  Coding DNA Sequence Number=SeqID_38839
  Subcellular localization annotation: CTP_CleavageSite=78; ConfidenceScore=5.15e-01
MALPSADEKLLDTCYLTYVKLQLQRRRLSTVSSALAETAASMAVAVTVVGAAATLLVKRSKTSESSQQYASVPLKNPPCFSVQEHENLWKASPVQIQFKACEDCGGSGICSECKGEGFVLRKRSDESAEKARVQAKNMATRFTAGYYVVTSLFP

SEQ ID NO: 155618 - protein, 806 aa, Glycine max
  Coding DNA Sequence Number=SeqID_38840
  Gene Ontology: Mol. function=nucleoside-triphosphatase activity; Cellular component=nucleus; Biological process=protein transport
  Homolog annotation: Hit_ID=Q9LZF6; Match level="QueryCoverage=97%, HitCoverage=97%, E-value=0.0, Identity=90%"; Hit description=Cell division control protein 48 homolog E
  Pfam annotation: Domain name=AAA; Domain location=244-428; Score =327.2; E_value=2.8e-95; Accession=PF00004.19; Description=ATPase family associated with various cellular activities (AAA)
  Pfam annotation: Domain name=AAA; Domain location=517-704; Score =336.8; E_value=3.7e-98; Accession=PF00004.19; Description=ATPase family associated with various cellular activities (AAA)
  Pfam annotation: Domain name=AAA_2; Domain location=240-369; Score= -23.6; E_value=0.00056; Accession=PF07724.4; Description=ATPase family associated with various
  Pfam annotation: Domain name=AAA_5; Domain location=244-376; Score =11.7; E_value=0.00023; Accession=PF07728.4; Description=ATPase family associated with various
  Pfam annotation: Domain name=Arch_ATPase; Domain location=221-386; Score=-96.1; E_value=0.06; Accession=PF01637.9; Description=Archaeal ATPase
  Pfam annotation: Domain name=CDC48_N; Domain location=27-113; Score =132.1; E_value=1.5e-36; Accession=PF02359.8; Description=Cell division protein 48 (CDC48), N-t
  Pfam annotation: Domain name=ResIII; Domain location=225-356; Score= -39.4; E_value=0.093; Accession=PF04851.6; Description=Type III restriction enzyme, res subunit
  Pfam annotation: Domain name=Sigma54_activat; Domain location=210 -372; Score=-175.0; E_value=0.0063; Accession=PF00158.16; Description= Sigma-54 interaction domain
  Pfam module annotation: Pfam domain module=AAA::AAA::AAA_2::AAA _5::Arch_ATPase::CDC48_N::ResIII::Sigma54_activat; Domain location =244-428::517-704::240-369::244-376::221-386::27-113::225-356::210-372
MSHQAESSDSKSWKKDFSTAILERKKSPNRLVVDEAVNDDNSVVAMHPQTLEKLQLFRGDTILIKGKKRKDTVCIALADDNCEESKIRMNKVVRSNLRVRLGDVVSVHACPDVKYGKRVHILPIDDTIEGVTGNLFDAYLKPYFLEAYRPVRQGDLFLVRGGMRGVEFKVIETDPGEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRVHTKNMKLSDNVDLERIAKDTHGYVGADLAALCTEAALQCIREKMDVIDLEDESIDAEVLNSMAVSNEHFHIALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSGGDAGGAADRVLNQLLTEMDGMNAKKTVFIIGATNRPDIIDSALLRPGRLDQLIYIPLPDQESRYQIFKACMKKSPVSKDVNLGALAEYTKGFSGADITEICQRACKYAIRENIEKDIEHERKRRENPEAMDEDMEGEDVSEIKAAHFEESMKYARRSVSDADIRKYQAFAQTLQQSRGFGSDFNFPAAVSRTAGSEPFATSAGGADEDDLYS

SEQ ID NO: 155619 - protein, 208 aa, Glycine max
  Coding DNA Sequence Number=SeqID_38841
  Gene Ontology: Mol. function=transporter activity; Cellular component= integral to membrane; Biological process=transport
  Homolog annotation: Hit_ID=Q5K410; Match level="QueryCoverage=100%, HitCoverage=39%, E-value=1e-97, Identity=84%"; Hit description =Nitrate transporter
MADIEGSPGSSMHGVTGREQTFIASVASPMVPTDTTANFALPVDSEHKAKIFKLFSLANPHMRTFHLSWISFFTCFVSTFAAAPLVPIIRDNLNLTKGDIGNAGVASVSGSIFSRLTMGAVCDLLGPRYGCAFLIMLSAPTVFCMSFVNDAAGYIAVRFMIGFSLATFVSCQYWMSTMFNSKIIGLVNGTAAGWGNMGGGATQLIMPM

SEQ ID NO: 155620 - protein, 51 aa, Glycine max
  Coding DNA Sequence Number=SeqID_38842
MRKEPMRFPTAAKDYALNKGVFDVMHFAAYAKKNPWYISKINNGWQLAHDH

SEQ ID NO: 155621 - protein, 82 aa, Glycine max
  Coding DNA Sequence Number=SeqID_38843
ISNDNNEEEVEAVASGGVDSLDLERSRYCEIARGRRLKRCRDSGGFLKWLEMAPFRVAWRKKKKKGLVTRFGLMSHQFDCKL

SEQ ID NO: 155622 - protein, 66 aa, Glycine max
  Coding DNA Sequence Number=SeqID_38844
MGILKKEEKIEIARAAMEAEICESGICGNIPSTSPSGIEREMCSLARLRQPALLALRTVQSISNNI

SEQ ID NO: 155623 - protein, 125 aa, Glycine max
  Coding DNA Sequence Number=SeqID_38845
  Gene Ontology: Mol. function=transition metal ion binding; Cellular component=chloroplast; Biological process=iron ion homeostasis
  Homolog annotation: Hit_ID=O65100; Match level="QueryCoverage=56%, HitCoverage=27%, E-value=2e-16, Identity=60%"; Hit description =Ferritin-3, chloroplast precursor
  Subcellular localization annotation: CTP_CleavageSite=49; ConfidenceScore=5.73e-01
MALSCSKVSSFSLSPVVGGGDVFKNLTFSSFSLSFSNKRVGGIKNLRVRAAASNAPAPLAGVIFEPFQELKKDYLAVPIAHNVSLARQNYADESESAINEQIKYELKIHFLTAENENSTCFVRLF

SEQ ID NO: 155624 - protein, 189 aa, Glycine max
  Coding DNA Sequence Number=SeqID_38846
  Gene Ontology: Mol. function=nucleotide binding; Biological process =fatty acid biosynthetic process
  Homolog annotation: Hit_ID=Q7XYX6; Match level="QueryCoverage=56%, HitCoverage=91%, E-value=6e-38, Identity=70%"; Hit description=AKIN beta3
  Pfam annotation: Domain name=AMPKBI; Domain location=92-181; Score =130.0; E_value=6.6e-36; Accession=PF04739.5; Description=5'-AMP -activated protein kinase, beta subunit, complex-interacting region
MARHLTIYERVNYKEYYKGAAYGTSFWLMVATCKYGASSHYLSCRAEWLIKFGIVHVCKCCLLRLTASSLYALKTKLLFLQDEVTVAGFEVPKSPDSSYNNVYPGNEDEARDPPMVPSHLQHTLLNYPANRDTAGTVPLPQNVILNHLYIENRESPRSVVALGFTHRFHSKYVTVVLYKPVQRRGNTSI

SEQ ID NO: 155625 - protein, 36 aa, Glycine max
  Coding DNA Sequence Number=SeqID_38847
MKVNIDGVFHFQFKGSTVHSEENLALNPYFISSHTT

SEQ ID NO: 155626 - protein, 274 aa, Glycine max
  Coding DNA Sequence Number=SeqID_38848
  Gene Ontology: Mol. function=RNA-directed DNA polymerase activity; Biological process=RNA-dependent DNA replication
MEQLTNHHNEDVHIEDQIDLSSVVRRLQAQVSKMQKHHAKEIVTLRHENAHLQEAHRSQKPEANLPRGEEAESTTATLPPKWKNLTIDKYDGVDPSLVHTATSKLCGLVQHSAMAMHHLITKLRLGPFVNILCKKPTSNLDELRTRVAKYMQMEELADTVLTKKDNDKPNSTVNILTMPKRVNTPPKANHSKHCRCHCNRGHFMEECSALKEKIGELIKLDHLKNSSTGCSCTGPREETNPNLVGEEVENMQDGQKGKGAEADPRRKKRDPSTN

SEQ ID NO: 155627 - protein, 115 aa, Glycine max
  Coding DNA Sequence Number=SeqID_38849
MSSTTVHCTLGFVYATTVALEDVISSFSNTDHAKSEQQSLVLAWVSLTAIVGEEELLSGGVEVDAFAHIWVMSEVAAHGGGWWCSRSEVGMMMISNSAIEESGDKMWRVHRNIMK

SEQ ID NO: 155628 - protein, 128 aa, Glycine max
  Coding DNA Sequence Number=SeqID_38850
MDIYRKQPWRVDKFTQVSLLLIGEGIYSPRHYFAEAQNNKALQVDLDLIEQVRVDVIIMTKAYKWHMTQHFNSKLAPWQFKEGDLVWTILSRVTLLAKVELEDSRTVPSHIPSLVKVEDKDYEQFPPE

SEQ ID NO: 155629 - protein, 48 aa, Glycine max
  Coding DNA Sequence Number=SeqID_38851
MRHGSGVGVILEGPWYNPYILDSKPHAIRPNTKNSLQGPVSKRLQDRR

SEQ ID NO: 155630 - protein, 66 aa, Glycine max
  Coding DNA Sequence Number=SeqID_38852
MHLCEVANLRVFIINKDVYVRELVLIDVISKDDVAPSPQRLVTLIEEPLPEEVEDVEGGKEVGPRD

SEQ ID NO: 155631 - protein, 46 aa, Glycine max
  Coding DNA Sequence Number=SeqID_38853
MVPKGRLGQSRREPKLEKEIYMYEDPKSLSLSNSKNLCKVHDSYLL

SEQ ID NO: 155632 - protein, 45 aa, Glycine max
  Coding DNA Sequence Number=SeqID_38854
MGDRVTNFLDLPTPEQVSTPIHDLTTLQMSPEVVACLQDTSVMEG

SEQ ID NO: 155633 - protein, 258 aa, Glycine max
  Coding DNA Sequence Number=SeqID_38855
  Gene Ontology: Mol. function=nucleic acid binding; Cellular component= nucleus; Biological process=RNA catabolic process
  Homolog annotation: Hit_ID=Q05196; Match level="QueryCoverage=63%, HitCoverage=50%, E-value=1e-20, Identity=34%"; Hit description =Polyadenylate-binding protein 5 (Poly(A)-binding protein 5)
  Pfam annotation: Domain name=RRM_1; Domain location=139-211; Score =20.5; E_value=0.0018; Accession=PF00076.12; Description=RNA recognition motif. (a.k.a. RRM, R
MAVAAICASAVAVPAITLNDAQFENASLYIDDLEGNVNEEQLLDLDQTRQSSLGYAYVNLVHIQDVANAMEHNLGMSMDNKALHDTFAAFHFVLSSKVVIDYNNQSKGVQRKEERKAELKARFELEIIRKYEKLQGANLYLKNLDDNVNDEKLKELFSKLGTITSCKVMLESYRHIKGYTLVVFSTPEDERYGLIQQLLPGMRPGGYSKFHYVVPPIETGSSWAKGGYLKSWKSPTSAAKPDATSLTPTNQGFRYMGN

SEQ ID NO: 155634 - protein, 754 aa, Glycine max
  Coding DNA Sequence Number=SeqID_38856
  Homolog annotation: Hit_ID=Q8T1P1; Match level="QueryCoverage=54%, HitCoverage=44%, E-value=2e-75, Identity=38%"; Hit description =Similar to Arabidopsis thaliana (Mouse-ear cress). Hypothetical 80.1 kDa protein
  Pfam annotation: Domain name=APS_kinase; Domain location=189-281; Score=-105.7; E_value=0.087; Accession=PF01583.10; Description =Adenylylsulphate kinase
MGEVGKILYIVVVEDSEKKESFRYSRPVLQSTLQLMGCKARHAFKRWLREKLGVNGKNVNKKGVPDDAELEAETTYNIRIFLKHYSDCFSFSSYQISQRVFEQTRKENSTDILKLEVEALSGFDAFKKNFVKKDGRSVPFELYKRRTSAFVRRETFLDIACDALAEYKYVGPNQRADLVLACRIRERKESVTVLLCGTSGCGKSTLSALLGSRLGITTVVSTDSIRHMMRSFANEKENPLLWASTYHAGECLDPVAVAEAKARRKAKKLAGVSHSVSKEDVTEGHNSSKSDVRTLEMSSGPTELLSPKQMAIEGFKAQSEMVIDSLDRLITAWEERKESVVVEGVHLSLNFVMGLMKKHPSIIPFMIHITNEDKHLERFAVRAKYMTLDPAKNKYVKYIRNIRTIQEYLCKRAEKHLVPQINNTNVDKSVAAIHATVFSCLRRREVGEQLYDPVRNTVTVVYEEYRNQCAANSLSSKGMFQLIQRKGSSRNLMALVNDDGSVAKAWPVNLVDCNGKPVWCHGPENGVGHPMYGPLRIGKAEPVNLQFGFYGISAWPSDGGTSRAGSVDESRADGTDTGSRYVSSCCSSPRMSDVAAKELKEDFSVHGSDEEIDDQPEVGSDEDFSDDGGKHALEEVGSVDEESTKSDEEYDDLAMQDVLETGYWSDDEEYRIRVDGVSGELGTKMHGGYKYRRNLDIFLRSRSELAEPLCSYSSLLVEKNERKSKLRTRSLSIPALGKHRSAVNDPILSGAPQR

SEQ ID NO: 155635 - protein, 61 aa, Glycine max
  Coding DNA Sequence Number=SeqID_38857
MATRGRPESLSLVDNCGNYFVGFIVLQVPFSTDEVCNTHVTPRKSIRRGGMTTEFVIAGLI

SEQ ID NO: 155636 - protein, 56 aa, Glycine max
  Coding DNA Sequence Number=SeqID_38858
MVRDLVAWLQSMEAELGPFVTWLPHAPGVCGNMALETIGVLGIKVVKPLLRRQLLG

SEQ ID NO: 155637 - protein, 131 aa, Glycine max
  Coding DNA Sequence Number=SeqID_38859
  Subcellular localization annotation: CTP_CleavageSite=36; ConfidenceScore=5.07e-01
MPMQQCQAPMLAPHLATNSKHHVPHVLSSVFNQLSYARAVVSRDNLLSVVVHYGHAMAPHDKLLENRDMTLFKMGVESYGSAMVARKRQPGAFALWTTAKQKMLGIRNQALNVPLRTCTNNPNAGATHPST

SEQ ID NO: 155638 - protein, 123 aa, Glycine max
  Coding DNA Sequence Number=SeqID_38860
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=67%, HitCoverage=5%, E-value=4e-28, Identity=72%"; Hit description =Multidrug resistance-associated protein 3
  Pfam annotation: Domain name=ABC_tran; Domain location=9-122; Score= -28.2; E_value=5.4e-05; Accession=PF00005.17; Description=ABC transporter
MGLKRDRCCLEYELVQVHNNTKLREIPFVMVFELYDKVLGACSLTKDLEVLAFGDQTTIREKGINLSGGQKQIVQIARALYHGCDIYLFDDPFSALDAHTRSHLFKIILFTAIASQDWTLLLC

SEQ ID NO: 155639 - protein, 87 aa, Glycine max
  Coding DNA Sequence Number=SeqID_38861
  Homolog annotation: Hit_ID=Q68UW2; Match level="QueryCoverage=73%, HitCoverage=22%, E-value=2e-08, Identity=58%"; Hit description =Expansin
MGCHPILDPLMDTEFTSPTPPTLVIKTRLKYEWPLIVNLISPLFHTRNPAIITKMFSQCSVALQPFPAIETTSPEGYCVVCLTHNHA

SEQ ID NO: 155640 - protein, 78 aa, Glycine max
  Coding DNA Sequence Number=SeqID_38862
MVLTTQAIVVEKPKPKEPVAGAPQGLTGEKYTDDFVRFCAKKVIHHELLQHFQHQSIYMQADDVNPPSIRFEKIMGTR

SEQ ID NO: 155641 - protein, 205 aa, Glycine max
  Coding DNA Sequence Number=SeqID_38863
  Gene Ontology: Cellular component=nucleus; Biological process =regulation of transcription
  Homolog annotation: Hit_ID=Q5JJP7; Match level="QueryCoverage=38%, HitCoverage=25%, E-value=5e-23, Identity=61%"; Hit description =Putative transcription factor PCF3
  Pfam annotation: Domain name=TCP; Domain location=50-205; Score=83.9; E_value=4.9e-22; Accession=PF03634.4; Description=TCP family transcription factor
MILPYSVTSQKFKLRLCKDLPSLKFECKKNVNIFLHAELSLVKLSKKLAMASETPITLKAINTKLPSLKAKKDRHTKVNGRERRVLLPPLCAARVFQLTYELGYKTHGETIEWLLRQAEPSIIAATGTGILPSSMVVSASTSTPSLCEDESTIGMHTNPMVVSTNSEIESKKEFLPLDLDSLANFDVEFSANEVAILQSLITKLG

SEQ ID NO: 155642 - protein, 339 aa, Glycine max
  Coding DNA Sequence Number=SeqID_38864
MPSIIEDMCSSPYNNSGDMRIMKRGIYRAEIDESQIELGKQMQAQSLKIEILMRAQAQVPITTPQFPTCDKCEIVHGLRECTINDKLVAFMDEINFTRSNPEEEVNVLSAKSGQHMIKLKKRKKATPPPKREALTKEGQEANKEGEKELVTPLQAIAQMSKYVEECSVLTESWQTLLIGLNKECSIVVLRKLPPKLKDLGSIPVSCTIGYLQEDEEIPIILGRPFHYTRGVLIDLQQETIIWRLGDEQEVFKVFNPEINSSSSPICNFVQASNKMKTIVAKPHPSVGKEDPPRKKVIPKDHGWSKKKGDGITIQSLGYGVDDYTKRSVQKRKITLFKGG

SEQ ID NO: 155643 - protein, 131 aa, Glycine max
  Coding DNA Sequence Number=SeqID_38865
  Gene Ontology: Cellular component=endoplasmic reticulum
  Homolog annotation: Hit_ID=Q2PGG6; Match level="QueryCoverage=73%, HitCoverage=11%, E-value=2e-23, Identity=64%"; Hit description =Generative cell specific-1
MALRSAITLIIIFILSSFDVVGIQIISKSKLEKYEKNSNSDDNLNCTTKIILNMAVPSGSVNKSHSHYAPHCVPSGGEASIVAELVEVEENSSRKMQTLRIAPVKTVNKTSAYALLRDEEGHIIEYTQVAF

SEQ ID NO: 155644 - protein, 156 aa, Glycine max
  Coding DNA Sequence Number=SeqID_38866
  Gene Ontology: Mol. function=catalytic activity; Cellular component =nucleus; Biological process=regulation of transcription
  Homolog annotation: Hit_ID=Q5JJP7; Match level="QueryCoverage=50%, HitCoverage=25%, E-value=1e-23, Identity=61%"; Hit description =Putative transcription factor PCF3
  Pfam annotation: Domain name=TCP; Domain location=1-156; Score=80.6; E_value=4.8e-21; Accession=PF03634.4; Description=TCP family transcription factor
MASETPITLKAINTKLPSLKAKKDRHTKVNGRERRVLLPPLCAARVFQLTHELGYKTHGETIEWLLRQAEPSIIAATGTGILPSSMVVSASTSTPSLCEDESTIGMHTNPMVVSTDNEIESKKEFLPLDLDSLANFDVEFSANEVAILQSLITKLG

SEQ ID NO: 155645 - protein, 603 aa, Glycine max
  Coding DNA Sequence Number=SeqID_38867
  Gene Ontology: Mol. function=nucleoside-triphosphatase activity; Cellular component=integral to membrane; Biological process=transport
  Homolog annotation: Hit_ID=Q9FF46; Match level="QueryCoverage=92%, HitCoverage=58%, E-value=1e-171, Identity=51%"; Hit description =Putative white-brown complex homolog protein 29
  Pfam annotation: Domain name=ABC_tran; Domain location=429-603; Score= 103.0; E_value=8.6e-28; Accession=PF00005.17; Description=ABC transporter
  Pfam annotation: Domain name=MobB; Domain location=430-539; Score= -40.6; E_value=0.099; Accession=PF03205.4; Description=Molybdopterin guanine dinucleotide synthesis protein B
  Pfam module annotation: Pfam domain module=ABC_tran::MobB; Domain location=429-603::430-539
MMMNLPKETRKVPFVIVVVLINFIVGPRLIFCQKSGGGGGGLEIIAQEVYRSMSNYTSVFKSAIKKELGYCIVDVDADWNGAFNFTKDLTFLTICAQQLKGDITQRMCTEAEIQAYGQSFASGKSGTRSSFLKPNINCNLSSWVNGCEPGWGCKANQKVDIGSHKKGIPIRSVDCQPCCEGFFCPHGLTCMIPCPLGSYCPRAQLNKTSGVCEPYRYQLPPGKPNHTCGGADIWADIQSSSEVFCSAGYYCRTGSTTQERCFKLASCEPKSSNQNITAYGVLVFAGLCFLLIIIYNCSDQVLATREKRQAKSRERAAQSVRESQAREKWKSAKDTAKKHAVGLQSQLSRTFSRKTSKNPDLKGFGSKHSDSTLPPVGTSKGKKKDKNNLSKIINDIEENPNNSEGFNVQIGDKNVKKQAPRGKQLHTQSRVSAVMGPSGAGKTTFLSALTGKATGCHTTGQVLVNGKESSIRSYKKIIGFVPQDDIVHGNLTVEENLWFSARCRLSADLPKEEKVLVVERVIESLGLQAIRDSLVGTVEKRGISGGQRKRVNVGLEMVMEPSLLILDEPTSGLDSSSSQLLLRALRREALEGVNICMVLHQPR

SEQ ID NO: 155646 - protein, 83 aa, Glycine max
  Coding DNA Sequence Number=SeqID_38868
MAQPPPCERTLREMAAPDFTYESLCIQYPDEGVPYVLKTRLIHLLPKFHGLAGHAGKPKNIDAQYVSFRDTPEIKWKHRCIIK

SEQ ID NO: 155647 - protein, 74 aa, Glycine max
  Coding DNA Sequence Number=SeqID_38869
MGRLKQRIPEFPKVQKEDKTRSKHFRIASVIDSYTVCRSFFDLSSFVLRSSSEESNKVASKDKHCFKINTRLLQ

SEQ ID NO: 155648 - protein, 98 aa, Glycine max
  Coding DNA Sequence Number=SeqID_38870
MSNHKSTESVLKNLEVQNPKEECKVVMARSKRFVEAEDEDSVVHKKKIADKKGTDGKKNKVRGESNQEKEEQIMVKNKELKDQEKEKEVEKEIENEKK

SEQ ID NO: 155649 - protein, 253 aa, Glycine max
  Coding DNA Sequence Number=SeqID_38871
  Gene Ontology: Mol. function=nucleic acid binding; Cellular component= nucleus; Biological process=DNA replication
  Homolog annotation: Hit_ID=Q9FHJ6; Match level="QueryCoverage=62%, HitCoverage=19%, E-value=5e-48, Identity=56%"; Hit description =Replication protein A1-like
  Pfam annotation: Domain name=Rep_fac-A_C; Domain location=121-248; Score=-62.0; E_value=0.023; Accession=PF08646.1; Description =Replication factor-A C terminal domain
MRKNGTEVQKRTLQLKDMSGRSVELTLWGNFCIVEGQRLQTICDAGEFPVLATKAVRLNDFNGKYVETIATSQLYVEADFPEACTLKRWFKNEEKSVPTLSISRELSNLDEKLGTSEKPDWISVFVVVSHIKVDNFCYPGCLLKIGDRQCKVYKGTTTNNLNVAIKHVEARIHDDDKGDEQKAQRSKSNSSESKNISSESRTSQEFKNQEEFKTQEESLESRIKIQDSRSQESRSRFKTQDSRMKKRLNQNKY

SEQ ID NO: 155650 - protein, 82 aa, Glycine max
  Coding DNA Sequence Number=SeqID_38872
  Gene Ontology: Mol. function=nucleic acid binding; Cellular component= nucleus; Biological process=DNA replication
  Homolog annotation: Hit_ID=Q6WG36; Match level="QueryCoverage=87%, HitCoverage=11%, E-value=1e-12, Identity=46%"; Hit description=RPA 70kDa subunit
MSSSIMLFYNVIEAGKVYLISKGSIKPAQKNFNHLHNDQELTLDVASIIQPFLDDNDSITSQTFNYHPLVKLKVWKTTALWM

SEQ ID NO: 155651 - protein, 133 aa, Glycine max
  Coding DNA Sequence Number=SeqID_38873
YIDNILDRRILSERNVELYHSEFDEFKIELEKRNLHKCLANLQEGSIDVAVVKEFYAYFYSLADQAPKCAIIRGHLIKIDADNLNEFLHTLVLLEEGESLPTYSRFCRLRSDPREMEASLCILGKGFILNTEG

SEQ ID NO: 155652 - protein, 134 aa, Glycine max
  Coding DNA Sequence Number=SeqID_38874
MGSEIQHSISRVSIYYGTQSDIREKSYCRLNLLRDSTFNFERLDILRDSIRHPSKKLLSFELAHRFNIQIRASRYITGLNQTSEGSTFNFERLDMLRDSIRHPSKKILSFELAQRFNIQFRASRYITGLNQTSE

SEQ ID NO: 155653 - protein, 91 aa, Glycine max
  Coding DNA Sequence Number=SeqID_38875
  Homolog annotation: Hit_ID=Q1SAS4; Match level="QueryCoverage=91%, HitCoverage=3%, E-value=1e-14, Identity=41%"; Hit description=RNase H, putative
MEFPPELERMVAQEDREMKPHQEETKVVNLGVGEEKKEVKVGTGITTPIRDELVVLLWNYQDIFAWSYQDMPGLNPDNVQHRLPLLIYSNC

SEQ ID NO: 155654 - protein, 117 aa, Glycine max
  Coding DNA Sequence Number=SeqID_38876
MSVKHLNLITKGSYVDKQLSPDEIRGTTDIGLFYHGDMSYALTSYLDSDYATDLDGRRSTIGYTFTFGNSLEKAIIFSIVSRIKSIMRGLSTLTSNTTSSILNRGSKFINLIQGRIS

SEQ ID NO: 155655 - protein, 114 aa, Glycine max
  Coding DNA Sequence Number=SeqID_38877
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1RT14; Match level="QueryCoverage=99%, HitCoverage=10%, E-value=4e-49, Identity=85%"; Hit description =Glycosyl transferase, family 48
MKNGDPSKRGTVVVLLQDMLEVVTDMMVNEIRELAELHQSSKDTGQQVFAGTEAKPAILFPPVVTAQWEEQIRRLYLLLTVKETAAEVPTNSEVRRRVSFFTNSLFMDMPRAPR

SEQ ID NO: 155656 - protein, 221 aa, Glycine max
  Coding DNA Sequence Number=SeqID_38878
  Gene Ontology: Mol. function=metal ion binding; Cellular component =cytoplasm; Biological process=ubiquitin cycle
  Homolog annotation: Hit_ID=Q2QP88; Match level="QueryCoverage=95%, HitCoverage=74%, E-value=5e-57, Identity=48%"; Hit description=CHY zinc finger family protein, expressed
  Pfam annotation: Domain name=Rubredoxin; Domain location=63-92; Score= -3.5; E_value=0.087; Accession=PF00301.10; Description=Rubredoxin
  Pfam annotation: Domain name=zf-C3HC4; Domain location=151-185; Score= 25.0; E_value=0.00027; Accession=PF00097.15; Description=Zinc finger, C3HC4 type (RING finger)
  Pfam annotation: Domain name=zf-CHY; Domain location=18-100; Score =156.2; E_value=8.3e-44; Accession=PF05495.3; Description=CHY zinc finger
  Pfam module annotation: Pfam domain module=Rubredoxin::zf-C3HC4::zf -CHY; Domain location=63-92::151-185::18-100
MEGSVLERLDFGKMGYGCKHYRRRCRIRAPCCNELYFCRHCHNEATSMLSNPFDRHELVRQDVQHVVCSVCDTEQPVAQVCTNCGVRMGEYFCNICKFFDDDLVIVNLIVFYLMLSIGYTLSRPGKNSFIVMIVGFVDLVVVRIIPTAYLFDSLKDIAVMKCGHTMHSECYLEMLKRDKYCCPICSKSVMDMSRAWKRIDEEIEATVMPDDYRYRKVEFYS

SEQ ID NO: 155657 - protein, 177 aa, Glycine max
  Coding DNA Sequence Number=SeqID_38879
MGCGKSKHDVASGNTVLQRKKSGVSSQENGTETKDTNNNNVVDNVSSEVQVEQKGSESVKESDVEVKDDLVVNDVKSEAEKTNVQEKEKLEGGEERSESEKSEDEKDDSLKENEQKINDAETVEATEEKMPAENEKEDASVKKEEDIKDTKTSISEGEEKDLKAEEGQQRIQQPAKM

SEQ ID NO: 155658 - protein, 533 aa, Glycine max
  Coding DNA Sequence Number=SeqID_38880
  Gene Ontology: Mol. function=tetracycline:hydrogen antiporter activity; Cellular component=integral to membrane; Biological process=tetracycline transport
  Homolog annotation: Hit_ID=Q3KK20; Match level="QueryCoverage=97%, HitCoverage=97%, E-value=1e-124, Identity=44%"; Hit description =Major facilitator superfamily MFS_1 precursor
  Pfam annotation: Domain name=MFS_1; Domain location=25-430; Score =99.9; E_value=7.7e-27; Accession=PF07690.6; Description=Major Facilitator Superfamily
MNAQPVAAPAPHPFTLRLALGLVGVLIAALTSGLNDRVTDIALADIRAAVGISYDDGSWIISAYQAAEVAAMMIAPWFAVTFSLRRFALAVSAGFMVCGVLLPFMPTAPLFIALRVVQGLFGGALPPLLMTVALRFLPPPIKLYGLSAYALTATFGPNLAASLAAFWTDDVSWMFVFWQVVPAMLIAMLLIGWGLPQDPLRTERFKQIDLFGMLSGCSGMALLILALTQGERLDWLSSPLFVALLFSALALLIVFFINEWFHPLPLFKLQMLRRRNLSHGLLALAGVLILALSGSALPSAYFGQVEGFRTLQFAPLALTIGLPQLLIAPLVASLLNIRWIDCRWVLSAGVLLLATACLLGMQITTDWARQNFWLMQVLQAFGQPMVILPVLMSATSVVAPPEGPFASAMFNTVRGFASIAASTLVEWFISHREQFHSSVLVDQAASRSWLMTAADSQQASSSLPLLADGSASSATNLSGFATLLKHQAMVLSLSDAYLMLIAFAVGLLVLTLCLAKRVWPPQTLVQPVTKTPE

SEQ ID NO: 155659 - protein, 1072 aa, Glycine max
  Coding DNA Sequence Number=SeqID_38881
  Gene Ontology: Mol. function=nucleic acid binding; Cellular component= nucleus; Biological process=chromatin modification
  Homolog annotation: Hit_ID=Q7G8Y3; Match level="QueryCoverage=92%, HitCoverage=88%, E-value=0.0, Identity=82%"; Hit description =Probable chromatin remodelling complex ATPase chain
  Pfam annotation: Domain name=DEAD; Domain location=193-359; Score= -37.0; E_value=0.0075; Accession=PF00270.19; Description=DEADDEAH box helicase
  Pfam annotation: Domain name=HAND; Domain location=763-853; Score =25.0; E_value=1.9e-08; Accession=PF09110.1; Description=HAND
  Pfam annotation: Domain name=Helicase_C; Domain location=528-607; Score=101.6; E_value=2.3e-27; Accession=PF00271.21; Description =Helicase conserved C-terminal domain
  Pfam annotation: Domain name=Myb_DNA-binding; Domain location=854 -900; Score=23.2; E_value=0.00093; Accession=PF00249.21; Description =Myb-like DNA-binding domain
  Pfam annotation: Domain name=ResIII; Domain location=189-353; Score= -2.4; E_value=7.4e-05; Accession=PF04851.6; Description=Type III restriction enzyme, res subunit
  Pfam annotation: Domain name=SLIDE; Domain location=909-1022; Score =241.9; E_value=1.4e-69; Accession=PF09111.1; Description=SLIDE
  Pfam annotation: Domain name=SNF2_N; Domain location=195-473; Score =475.5; E_value=6.6e-140; Accession=PF00176.13; Description=SNF2 family N-terminal domain
  Pfam module annotation: Pfam domain module=DEAD::HAND::Helicase _C::Myb_DNA-binding::ResIII::SLIDE::SNF2_N; Domain location=193 -359::763-853::528-607::854-900::189-353::909-1022::195-473
MARPSKPHSSSEEALSNASSSSEEEEQVNEQINEEEDEEELEAVARPASSDDDEVAGDNPPDSDEDPAADDDQDGDNVNPEISKREKTRLKEMQKMKKQKILEILDAQNAAIDADMNNRGKGRLKYLLQQTELFAHFAKGDQSSSQKKSRGRGRHASNFTEEEEDEEYLKGEEDGLANTRLVTQPSCIQGKMRDYQLAGLNWLIRLYENGINGILADEMGLGKTLQTISLLGYLHEFRGIKGPHMVVAPKSTLGNWMNEIRRFCPILRAIKFLGNPDERRHIRDELLVAGKFDVCVTSFEMAIKEKSALRRFSWRYIIIDEAHRIKNENSLLSKTMRLYSTNYRLLITGTPLQNNLHELWSLLNFLLPEIFSSAETFDEWFQISGENDQQEVVQQLHKVLRPFLLRRLKSDVEKGLPPKKETILKVGMSQMQKQYYRALLQKDLEVVNAGGERKRLLNIAMQLRKCCNHPYLFQGAEPGPPFTTGDHLIENAGKMVLLDKLLPKLKERDSRVLIFSQMTRLLDILEDYLVFRGYQYCRIDGNTGGDDRDASIDAFNKPGSEKFVFLLSTRAGGLGINLATADVVILYDSDWNPQVDLQAQDRAHRIGQKKEVQVFRFCTEYTIEEKVIERAYKKLALDALVIQQGRLAEQKTVNKDELLQMVRFGAEMVFSSKDSTITDEDIDRIIAKGEEATAELDAKMKKFTEDAIKFKMDDKLLILILSFVAAELYDFDDEKDENRFDIKKIVSENWIEPPKRERKRNYSESEYFKQTMRQGGPTKPKEPRIPRMPQLHDFQFFNTQRLSELYEKEVRYLMQTHQKNQIKDSIDVDEPEEVGDPLTAEELEEKERLLEEGFSSWTRRDFNTFIRACEKYGRNDIKGIASEMEGKTEEEVERYAKVFKERYKELNDYDRIIKNIERGEARISRKDEIMKAIGKKLDRYKNPWLELKIQYGQNKGKLYNEECDRFMICMVHKLGYGNWDELKAAFRTSPLFRFDWFVKSRTTQELARRCDTLIRLVEKENQEYDERERQARKEKKLAKSMTPSKRALARQTESPSSLKKRKQLTMDDYAST

SEQ ID NO: 155660 - protein, 334 aa, Glycine max
  Coding DNA Sequence Number=SeqID_38882
  Gene Ontology: Mol. function=protein serine/threonine kinase activity; Cellular component=membrane; Biological process=protein amino acid phosphorylation
  Homolog annotation: Hit_ID=Q6I5Q6; Match level="QueryCoverage=92%, HitCoverage=61%, E-value=1e-123, Identity=73%"; Hit description =Putative serine/threonine protein kinase
  Pfam annotation: Domain name=Pkinase; Domain location=1-211; Score= -12.7; E_value=8.4e-08; Accession=PF00069.15; Description=Protein kinase domain
  Pfam annotation: Domain name=Pkinase_Tyr; Domain location=5-211; Score=-70.0; E_value=3.6e-08; Accession=PF07714.7; Description =Protein tyrosine kinase
  Pfam module annotation: Pfam domain module=Pkinase::Pkinase_Tyr; Domain location=1-211::5-211
MVIYIWTGYVPVCQNSVNPLEMVLNLPPDKEPLDWNTRMKIAAGAAKGLEYLHDKANPPVIYRDLKSSNILLDEGYHPKLSDFGLAKLGPVGDKTHVSTRVMGTYGYCAPEYAMTGQLTLKSDVYSFGVVFLELITGRKAIDNTRAHGEHNLVAWARPLFKDRRKFPKMADPLLQGRYPMRGLYQALAVAAMCLQEQAATRPLIGDVVTALTYLASQTYEPNAANQSNRVGPSTPRIRDDRRSMADGVDSPDRRLGSPSTHRNSPDFRKRDSRDPSAATELGRIDIGGGSGRKWGLDDNERQESQRDSPVNTARTRETPWNRDLDRERAVAEAK

SEQ ID NO: 155661 - protein, 102 aa, Glycine max
  Coding DNA Sequence Number=SeqID_38883
  Gene Ontology: Mol. function=protein disulfide oxidoreductase activity; Cellular component=chloroplast; Biological process=cell redox homeostasis
  Homolog annotation: Hit_ID=Q9LIF1; Match level="QueryCoverage=99%, HitCoverage=100%, E-value=4e-40, Identity=76%"; Hit description =Glutaredoxin-like protein
  Pfam annotation: Domain name=Glutaredoxin; Domain location=13-75; Score=74.4; E_value=3.6e-19; Accession=PF00462.14; Description =Glutaredoxin
MERITKLASQKAVVIFSKSSCGMSHAIKRLFYEQGVGPAIYELDEDTRGKEMEWALMRLGCNPSVPAVFVGGKFVGSANTVMTLHLNGSLKKMLRDAGALWL

SEQ ID NO: 155662 - protein, 372 aa, Glycine max
  Coding DNA Sequence Number=SeqID_38884
  Gene Ontology: Mol. function=structural constituent of ribosome; Cellular component=intracellular; Biological process=translation
  Homolog annotation: Hit_ID=Q0WWX4; Match level="QueryCoverage=93%, HitCoverage=48%, E-value=1e-131, Identity=65%"; Hit description =RanGAP1 interacting protein
  Pfam annotation: Domain name=Kelch_1; Domain location=143-189; Score =22.9; E_value=0.0011; Accession=PF01344.15; Description=Kelch motif
  Pfam annotation: Domain name=Kelch_1; Domain location=194-240; Score =20.0; E_value=0.0085; Accession=PF01344.15; Description=Kelch motif
  Pfam annotation: Domain name=Kelch_1; Domain location=245-291; Score =18.9; E_value=0.018; Accession=PF01344.15; Description=Kelch motif
  Pfam annotation: Domain name=Kelch_1; Domain location=296-341; Score =18.6; E_value=0.022; Accession=PF01344.15; Description=Kelch motif
  Pfam annotation: Domain name=Kelch_1; Domain location=85-130; Score =37.0; E_value=6.3e-08; Accession=PF01344.15; Description=Kelch motif
  Pfam annotation: Domain name=Kelch_2; Domain location=143-189; Score =25.8; E_value=0.00016; Accession=PF07646.5; Description=Kelch motif
  Pfam annotation: Domain name=Kelch_2; Domain location=194-240; Score =20.2; E_value=0.0075; Accession=PF07646.5; Description=Kelch motif
  Pfam annotation: Domain name=Kelch_2; Domain location=245-291; Score =20.8; E_value=0.0049; Accession=PF07646.5; Description=Kelch motif
  Pfam annotation: Domain name=Kelch_2; Domain location=296-341; Score =2.9; E_value=16; Accession=PF07646.5; Description=Kelch motif
  Pfam annotation: Domain name=Kelch_2; Domain location=85-130; Score =23.7; E_value=0.00066; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=143-189::194-240::245-291::296-341::85-130::143 -189::194-240::245-291::296-341::85-130
  Subcellular localization annotation: CTP_CleavageSite=55; ConfidenceScore=5.20e-01
MFGFSRRHMKLGSRLKVQLSDTTLGTRSPIRHHKRNVNSNGDRVTGTSGHSEKMLSSAAPDMHTCTSGSSENWMVLSISGDKPTPRSYHAAAVIQNKMIVVGGESGSGLLDDVQVLNFDRFSWTMASSKLYLSPSSLPLKLPACKGHCLVSWGGKALLIGGKTDPASDKISVWAFDTDTECWSPMEAKGDIPVARSGHTVVMANSVLILFGGEDVKRRKLNDLHMFDLKSLSWLPLHYTGAAPCPRFNHVAALYDGKILFIFGGASKSRTLNDLYSLDFETMAWSRIKIRGFHPSPRAGCCGVLCGTKWYITGGGSKKKRHGETLVYDVVKSEWSVAITSPPSSITTNQGLGHNGVPKSDSVEYLSGLVLPS

SEQ ID NO: 155663 - protein, 487 aa, Glycine max
  Coding DNA Sequence Number=SeqID_38885
  Gene Ontology: Mol. function=binding; Cellular component=thylakoid; Biological process=photosynthesis
  Homolog annotation: Hit_ID=O82028; Match level="QueryCoverage=33%, HitCoverage=74%, E-value=2e-60, Identity=76%"; Hit description=IVR -like protein
  Pfam annotation: Domain name=TPR_1; Domain location=119-152; Score =6.8; E_value=0.82; Accession=PF00515.18; Description=Tetratricopeptid e repeat
  Pfam annotation: Domain name=TPR_1; Domain location=220-253; Score =20.3; E_value=0.0069; Accession=PF00515.18; Description =Tetratricopeptide repeat
  Pfam annotation: Domain name=TPR_1; Domain location=287-321; Score =6.3; E_value=0.95; Accession=PF00515.18; Description=Tetratricopeptid e repeat
  Pfam annotation: Domain name=TPR_1; Domain location=355-388; Score =9.2; E_value=0.43; Accession=PF00515.18; Description=Tetratricopeptid e repeat
  Pfam annotation: Domain name=TPR_2; Domain location=11-44; Score=4.2; E_value=11; Accession=PF07719.7; Description=Tetratricopeptide repeat
  Pfam annotation: Domain name=TPR_2; Domain location=119-152; Score =5.8; E_value=7; Accession=PF07719.7; Description=Tetratricopeptide repeat
  Pfam annotation: Domain name=TPR_2; Domain location=187-219; Score =9.5; E_value=2.6; Accession=PF07719.7; Description=Tetratricopeptide repeat
  Pfam annotation: Domain name=TPR_2; Domain location=220-253; Score =15.7; E_value=0.17; Accession=PF07719.7; Description=Tetratricopeptid e repeat
  Pfam annotation: Domain name=TPR_2; Domain location=287-321; Score =8.8; E_value=3.2; Accession=PF07719.7; Description=Tetratricopeptide repeat
  Pfam annotation: Domain name=TPR_2; Domain location=355-388; Score =13.6; E_value=0.71; Accession=PF07719.7; Description=Tetratricopeptid e repeat
  Pfam annotation: Domain name=TPR_2; Domain location=85-118; Score =15.7; E_value=0.17; Accession=PF07719.7; Description=Tetratricopeptid e repeat
  Pfam module annotation: Pfam domain module=TPR_1::TPR_1::TPR_1::TPR _1::TPR_2::TPR_2::TPR_2::TPR_2::TPR_2::TPR_2::TPR_2; Domain location =119-152::220-253::287-321::355-388::11-44::119-152::187-219::220 -253::287-321::355-388::85-118
MEGIPSKARNLPMNLLLGRLYRISRHSRAAVAIYKECLRHCPYVLEAITALAELGSTAKDIISLIPQTLNRSGRAPFDHTDSSRWLQRYVEAQCCMASNDYKGGLELFADLLQRFPNNIHIILEMAKVEAIIGKNEEAIMNFEKARSIDPYIVTYMDEYAMLLKLKSDYPKLNKLVHDLLNIDPARPEVFVALSVLWERKDEKKALQYAEQSVRIDERHIPGYIMKGNLLLTMKRAEAAVPAFRAAQELRPDIRSYQGLVHTYLALSKIKEALYASREAMKAMPQSAKALKLVGDVHASNSSGREKAKKFYESALRLEPGYLGAALALAELHVIEGRNGDAVSLLERYLKDWADDSLHVKLAQVFAATNMLQEALSHYQAALRLISILIVEDIHVMLNPQNEAAKRGLERLEKQMKGVDPDAPEEDEDNDVEDADGDQDETELLLMLHGISSRVGALQSGLKFGLTAARVHIRKTKHFTLLHLVVKP

SEQ ID NO: 155664 - protein, 81 aa, Glycine max
  Coding DNA Sequence Number=SeqID_38886
  Gene Ontology: Cellular component=mitochondrion; Biological process =response to cold
  Homolog annotation: Hit_ID=Q9FF87; Match level="QueryCoverage=70%, HitCoverage=12%, E-value=8e-08, Identity=50%"; Hit description =Arabidopsis thaliana genomic DNA, chromosome 5, P1 clone:MRO11
MQGQTLTERRVESSESMNLFMKSVFGDDADEVGGGGAFGEEEVEFGEDNFAGVVGEEVRVCLNDAADLGVGEAVGFEEGED

SEQ ID NO: 155665 - protein, 292 aa, Glycine max
  Coding DNA Sequence Number=SeqID_38887
  Gene Ontology: Mol. function=ATP binding; Cellular component =chloroplast; Biological process=response to heat
  Homolog annotation: Hit_ID=Q1SF16; Match level="QueryCoverage=90%, HitCoverage=47%, E-value=3e-98, Identity=63%"; Hit description=Heat shock protein Hsp70
  Pfam annotation: Domain name=HSP70; Domain location=9-291; Score= -44.6; E_value=5.2e-14; Accession=PF00012.10; Description=Hsp70 protein
MAKEDQKFSIGIDLDTTYSCVGLWLEQHNRVEIIHNQQGHKTTPFVAFTDSNQRLIGDAAKDQAVINPENTVFDAKRLIGRKYSDPTIQKEKILWPFKVVAGINDKPMIVVKYKGQEKHLCAEEISYMVLTKMLKIAEVYLETHVKNVVVTVPAYFNDSQPKATKHDGAIAGLNVMRIINEPTAAAIAYGLDKRANCVGELPGKSHLGREDVDSRKGNYFVADFKKKNKVDISGYPRALRRLRTACERAKRILSFEVATNIDLDARVPLELDNQQLQNYIDKKVEHMQICED

SEQ ID NO: 155666 - protein, 547 aa, Glycine max
  Coding DNA Sequence Number=SeqID_38888
  Gene Ontology: Mol. function=GTP binding; Cellular component =intracellular; Biological process=small GTPase mediated signal transduction
  Homolog annotation: Hit_ID=Q8L7L0; Match level="QueryCoverage=92%, HitCoverage=76%, E-value=0.0, Identity=65%"; Hit description=GTP -binding protein obg-like
  Pfam annotation: Domain name=ATP_bind_1; Domain location=252-417; Score=-63.2; E_value=0.019; Accession=PF03029.7; Description =Conserved hypothetical ATP binding prot
  Pfam annotation: Domain name=Arf; Domain location=238-415; Score= -102.1; E_value=0.071; Accession=PF00025.11; Description=ADP -ribosylation factor family
  Pfam annotation: Domain name=DUF1967; Domain location=452-521; Score =91.6; E_value=2.4e-24; Accession=PF09269.1; Description=Domain of unknown function (DUF1967)
  Pfam annotation: Domain name=GTP1_OBG; Domain location=93-246; Score =238.8; E_value=1.2e-68; Accession=PF01018.12; Description=GTP1OBG family
  Pfam annotation: Domain name=MMR_HSR1; Domain location=248-371; Score= 138.1; E_value=2.4e-38; Accession=PF01926.13; Description=GTPase of unknown function
  Pfam annotation: Domain name=Miro; Domain location=250-371; Score= -3.8; E_value=0.013; Accession=PF08477.3; Description=Miro-like protein
  Pfam module annotation: Pfam domain module=ATP_bind_1::Arf::DUF1967::G TP1_OBG::MMR_HSR1::Miro; Domain location=252-417::238-415::452 -521::93-246::248-371::250-371
LPLKHDYSAPSPLSSPEIKLSETAPPITRLLRNRKPQNIKQDDVVFEYSDSEPESDGEYEAFDFSGDENVGEGEEETPSVKEKGVPAVMRCFDRAKIYVKSGDGGNGVVAFRREKYVPMGGPSGGDGGRGGDVYVEVDGAMNSLLPFRNSVHFRAGRGGHGQGSMQSGAKGEDLVVKVPPGTVVRMSGEDNVLLEMVYPGQKGLLLPGGRGGRGNASFKSGTNKVPKIAENGEEGPEMWLELELKLVADVGIVGAPNAGKSTLLSVVSAAKPAVANYPFTTLLPNLGVVSFDYDSTMVVADLPGLLEGAHRGFGLGHEFLRHTERCSALVHVVDGSSQQPDLEFDAVRLELKLFNPELAEKPYVVAFNKMDLPEAYENWESFKEKLQSRGITPFCMSAVKREGTHEVICAAYELLRKSKEDKEEYEDGRDMVNLNHVAAAVKKQRSASISDFEIFHDSDSNIWHVVGSGLQRFIQMTNWRYIDSERRFQHVLEACGVYKSLMKLGVKEGDTVIVGEMKMIWHDSSDNPGASRMKKISTDSFKWAEWK

SEQ ID NO: 155667 - protein, 322 aa, Glycine max
  Coding DNA Sequence Number=SeqID_38889
  Gene Ontology: Mol. function=transcription factor activity; Cellular component=nucleus; Biological process=regulation of transcription, DNA-dependent
  Homolog annotation: Hit_ID=Q6J9Q2; Match level="QueryCoverage=39%, HitCoverage=40%, E-value=4e-33, Identity=58%"; Hit description =Putative AP2/EREBP transcription factor
  Pfam annotation: Domain name=AP2; Domain location=45-109; Score =105.3; E_value=1.8e-28; Accession=PF00847.10; Description=AP2 domain
  Subcellular localization annotation: CTP_CleavageSite=33; ConfidenceScore=5.11e-01
MSTSRTSDASLKGYESNQTQMNLSLLQRNMSPSGERRGRGKQAEPGRFLGVRRRPWGRYAAEIRNPLTKERHWLGTFDTAQEAALAYDRAALSMKGCQARTNFIYSKDTNTNIFHNALTPMNTQPLLPPSHNTHNTQPTNQSGLSHHLGAISSHIENPSDMSAYGSPQDDNFFFSNDSNSGYLECIVQDNCFRKSNASASSHDLTIGHVNSNSMHVQPHFDTTQEALNMQTTVTSNYADISYPSQGLWNNQQSWDCSSNELAAMFKNPSRAEEGYMCMNALMYPFTDSSSYGFMTQAEAVSSTTFSPSLPPFGDADLGYSPF

SEQ ID NO: 155668 - protein, 103 aa, Glycine max
  Coding DNA Sequence Number=SeqID_38890
  Gene Ontology: Mol. function=structural constituent of ribosome; Cellular component=intracellular; Biological process=translation
  Homolog annotation: Hit_ID=Q1SCP5; Match level="QueryCoverage=55%, HitCoverage=32%, E-value=1e-24, Identity=93%"; Hit description =Ribosomal L18ae protein
  Pfam annotation: Domain name=Ribosomal_L18ae; Domain location=23-103; Score=-13.7; E_value=5.6e-07; Accession=PF01775.7; Description =Ribosomal L18ae protein family
MVTFRVRKIHAILCLISSSFDYDFYEVVVGRALPTEADQHPKIYRMKLWATNEVRAKSKFWYFLRKLKKVKKSNGQVLAINENFDVGLSCFLLDVDSSIVECI

SEQ ID NO: 155669 - protein, 86 aa, Glycine max
  Coding DNA Sequence Number=SeqID_38891
MIPKVSPMSEDEKNREIGIATDNPYYVTFQGVANHFPPQHQHPQAPSANYYQRQGYHVVPVYAVAEGRPVRERRLPCCGLVLGFYF

SEQ ID NO: 155670 - protein, 267 aa, Glycine max
  Coding DNA Sequence Number=SeqID_38892
  Gene Ontology: Mol. function=transcription factor activity; Biological process=regulation of transcription, DNA-dependent
  Homolog annotation: Hit_ID=Q8UDE1; Match level="QueryCoverage=99%, HitCoverage=89%, E-value=1e-151, Identity=99%"; Hit description =Transcriptional regulator, LysR family
  Pfam annotation: Domain name=HTH_1; Domain location=1-33; Score=33.6; E_value=7e-07; Accession=PF00126.17; Description=Bacterial regulatory helix-turn-helix protein, lysR family
  Pfam annotation: Domain name=LysR_substrate; Domain location=57-263; Score=154.3; E_value=3.2e-43; Accession=PF03466.10; Description=LysR substrate binding domain
  Pfam module annotation: Pfam domain module=HTH_1::LysR_substrate; Domain location=1-33::57-263
SAISRQVSALEQDVGVKLFHRHARGLILTEQGELLYRTAHDVLLKLETVKMQLTETTEKPSGKLRVTTTVGLGQGWLTDKVQEFLQLYPEMSIQLILDNEELDVNMRHADCAIRLRQPQQSDLIQRKLFTVHMHVYAAPSYINRHGEPQSVEDLDNHRIISFGEPAPNYLLDVNWLENAGRSSDNTRTPHLQINSQTSIKRACLLGIGIACLPDYIVGRDPGLIQLSLAADIPSFDTYFCYPDEMKNAAKLKAFRDFIVAKARNWNF

SEQ ID NO: 155671 - protein, 67 aa, Glycine max
  Coding DNA Sequence Number=SeqID_38893
AKRKELQEKAANSIQKLVDEKGREGLKAFSASQAIADEAKVMENADQVLTKEMASLKKLYGDLVKNL

SEQ ID NO: 155672 - protein, 102 aa, Glycine max
  Coding DNA Sequence Number=SeqID_38894
  Gene Ontology: Mol. function=metal ion binding; Cellular component =cytoskeleton; Biological process=electron transport
  Homolog annotation: Hit_ID=UPI0000612705; Match level="QueryCoverage =77%, HitCoverage=92%, E-value=4e-11, Identity=32%"; Hit description =UPI0000612705 related cluster
MTGLLDESISYFLIRVDPWVLVPIAFRGMHALTFRGLHVFAFRGLHALTFRGLHAFAFRRLHALAFRGLHALAFKGLHALAFRGLHVLTFRGLHVLAFRGLH

SEQ ID NO: 155673 - protein, 112 aa, Glycine max
  Coding DNA Sequence Number=SeqID_38895
  Subcellular localization annotation: CTP_CleavageSite=41; ConfidenceScore=5.19e-01
MFQKEMSQKNSKWGGKDQFRGCSLTLGPSRPIRKLQHEATSSSRRACCFWRKPPARLGKLGSNLLPHFFYKWMWESEGKGFNTLGIQISLKISEEKKKEGENQGWGASIMLQ

SEQ ID NO: 155674 - protein, 138 aa, Glycine max
  Coding DNA Sequence Number=SeqID_38896
MDFFSDESFECIEALQNSNLIPFMSFNLPVYSELVKAFYSNLEIQESTLISEVFGIKTVIDQSLFYDLTQLSSEGVPFEGALDDDWKFDFFVHDVLRLVCTNQAEMTGRLLAGSLALESRILHYLIIRILLPRSSNIA

SEQ ID NO: 155675 - protein, 230 aa, Glycine max
  Coding DNA Sequence Number=SeqID_38897
  Gene Ontology: Mol. function=helicase activity
  Homolog annotation: Hit_ID=Q2R0W4; Match level="QueryCoverage=92%, HitCoverage=13%, E-value=4e-27, Identity=33%"; Hit description=AT hook motif-containing protein, putative
  Subcellular localization annotation: CTP_CleavageSite=50; ConfidenceScore=5.23e-01
MQNYQHAKRSDSAKARINRKRIMQQKRHGHAQSSSQPTLNCTSEYNMTVSDSSESENSESTQGLTPFEDCQSPTNQPVINTEGYFDLGDQLIQCRYCNAQMWYGERISKNKNCQNPRFSLCCGDDKVELPLLQNPPQYLQQLLFHDDTIDSKNYQHNLRAYNMMFAFTSARIKLDKTINNSRGPLAIRIQGQPCHRIGSLLPMPGKNPKFAQLYIFDTENEVQNRINVMR

SEQ ID NO: 155676 - protein, 71 aa, Glycine max
  Coding DNA Sequence Number=SeqID_38898
YTLNDNLPPLKAIQQGIKHFDKSNFQLTGGLGVDIQRFTLDLRYERGFSDLNKSFKSKPQAFSIGLGYFIF

SEQ ID NO: 155677 - protein, 126 aa, Glycine max
  Coding DNA Sequence Number=SeqID_38899
  Homolog annotation: Hit_ID=O04892; Match level="QueryCoverage=58%, HitCoverage=13%, E-value=4e-07, Identity=53%"; Hit description =Cytochrome P450 like_TBP
RGGRCKTQGASPGGAVVGADLGGTGEARLIALCARTPKGNRPAHPGNGSAGGRVQRLEEHRTSRGVRQGKSAKWIRNLGKRIGSDGWARGSQFPNPSAVGGLLELLPRLERVDACLSGDGLGTGPS

SEQ ID NO: 155678 - protein, 329 aa, Glycine max
  Coding DNA Sequence Number=SeqID_38900
  Gene Ontology: Mol. function=polyamine-transporting ATPase activity; Cellular component=membrane; Biological process=polyamine transport
  Homolog annotation: Hit_ID=Q9I6G5; Match level="QueryCoverage=75%, HitCoverage=73%, E-value=1e-112, Identity=84%"; Hit description =Probable ATP-binding component of ABC transporter
ATRRQAHVVGVVLTLEEVGFADEVGDRPVQRRLVDVAGCADLQHLALAHHRDAVGHGQRFLLVMGDEDKGDPGLVLQALQLDLHFLAQLQVQRRQRLVEQQHLGPAGQRADQGDALLLATGQLVGAALADLRQLHQVEHAAHGGVDLAARAALHLQAEADVLGDAHVREQRITLEHRVDRAAERRQAFHAFAIEADAAGAGLFETGDEAEEGGLAAAGRAEEGEEFAGVDRQADIVDGGEVAEAAGHVADLEQGGRHSSGEAVRSAGGAGCPPVSSSLRCSFARPFRIGSLPDEPCRFPLAPGAPGAQLETLRRARFAHDTLRRLCGIL

SEQ ID NO: 155679 - protein, 212 aa, Glycine max
  Coding DNA Sequence Number=SeqID_38901
  Gene Ontology: Mol. function=two-component response regulator activity; Biological process=two-component signal transduction system (phosphorelay)
  Homolog annotation: Hit_ID=Q47522; Match level="QueryCoverage=24%, HitCoverage=64%, E-value=8e-24, Identity=100%"; Hit description=LacZ protein
  Pfam annotation: Domain name=HD; Domain location=1-64; Score=-0.4; E _value=0.053; Accession=PF01966.12; Description=HD domain
MKEHTLIGFELLRNSHLKVFELGAVISLQHHERWDGNGYPYGLTKEEITPEARIVQVADVFEALTHDRCYRPAWPVEKAIEYMRDMKESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 155680 - protein, 220 aa, Glycine max
  Coding DNA Sequence Number=SeqID_38902
  Gene Ontology: Mol. function=DNA-directed DNA polymerase activity; Cellular component=mitochondrion; Biological process=nucleobase, nucleoside, nucleotide and nucleic acid metabolic process
MTLFRSFCNIPVFAARNDVVAPAEGSTLLSRPEFIDDVFIREDLYMVSYLTNPGKGPSYWDPPKNSAVQLAAAITAGSRIYCPCYTTEESDGNKKVYKYKGPGRNVITPEWYKEQYADPSRSLIKKVTYQFRPNWKELSVKNKESTTTLRTLSNSKRIPFFNEKGKYIHHLILRKEYNEAIVMIFDSRQFMNVGWVVCMENSFFPNYKDQLVLCQMIRDV

SEQ ID NO: 155681 - protein, 47 aa, Glycine max
  Coding DNA Sequence Number=SeqID_38903
MESRAPSGPFLLGYGAQLRANLDPTKGVGRLRQQDGGHGSRNPLRSV

SEQ ID NO: 155682 - protein, 135 aa, Glycine max
  Coding DNA Sequence Number=SeqID_38904
MAEKTKKKLEEAAQSGSTEGVIDPSSSIRRHVKWKMACTKKTRQMTFEATKEIAEKIDSLEEKASQGSFVPYGCQYILTAAIGRQEHPGRVRDARAGVTIKQYFGSAPRTSHSSFSIAPEELEQLTQQIRDQLGG

SEQ ID NO: 155683 - protein, 88 aa, Glycine max
  Coding DNA Sequence Number=SeqID_38905
  Gene Ontology: Mol. function=transporter activity; Cellular component= integral to membrane; Biological process=oligopeptide transport
  Homolog annotation: Hit_ID=Q669J3; Match level="QueryCoverage=82%, HitCoverage=14%, E-value=1e-23, Identity=83%"; Hit description =Putative proton dependent di-tripeptide transporter
MAANQARRQVTQRTRAEPQPHHLAAHSFRRQQRHGRQTNRAQAELTQRQHQNAAHQPERRHAFPAVAQHVFGRQHHQAKCPPRHTGCR

SEQ ID NO: 155684 - protein, 67 aa, Glycine max
  Coding DNA Sequence Number=SeqID_38906
MAASDIAILKDRAHVPTKKSLLELTSQDALLAQNKLLSKQLEALTETLSCTVCHLWWSSQFWLLYPQ

SEQ ID NO: 155685 - protein, 307 aa, Glycine max
  Coding DNA Sequence Number=SeqID_38907
  Homolog annotation: Hit_ID=Q1H174; Match level="QueryCoverage=22%, HitCoverage=6%, E-value=2e-29, Identity=97%"; Hit description =Transposase Tn3
GFPGINRDHQDLFILRSDLPSQWLLFLSAVPPVQLLTWWCVTAKAPPDISAGKCSGHAARRVPFAIQAAQLLGRAIGAGLFAITPAGERGMCCKAIKLGNARVFPVTTLNSIRLGHLGQAQVDRVGQDRGQQQVLVLGQVARFQVREVTGKACPLVHFQQQFGDLDVRQDHGRLVDQRLRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 155686 - protein, 47 aa, Glycine max
  Coding DNA Sequence Number=SeqID_38908
MEAGRRQTSEHDRAQRAKQVPHEPVTTNHYNDDDGGQSAATRVVDRA

SEQ ID NO: 155687 - protein, 89 aa, Glycine max
  Coding DNA Sequence Number=SeqID_38909
MPPTRHPLDSNKSNRALGFPALITGLCQAFEVPVAPSKVIRRPITRAFIKKYCTQRQAQGGDPQAPDAPPPPPQADPAGGQPQGARADP

SEQ ID NO: 155688 - protein, 67 aa, Glycine max
  Coding DNA Sequence Number=SeqID_38910
MTNNEHKTEKNTNLGDLLVMWLHSLPRSRTNLTSPHPRGPHLACREFMRVPLQPGPQANLRAMRPLP

SEQ ID NO: 155689 - protein, 314 aa, Glycine max
  Coding DNA Sequence Number=SeqID_38911
  Gene Ontology: Mol. function=catalytic activity; Cellular component =nucleus; Biological process=metabolic process
  Homolog annotation: Hit_ID=Q13RS6; Match level="QueryCoverage=93%, HitCoverage=54%, E-value=1e-121, Identity=73%"; Hit description =Putative AMP-dependent synthetase and ligase
MGDAGAQLGRGVGQRALHDGRAAVVGDALGADHVEHGLGVELAQADVDAGARRHGPGEAPAVAVEQRQRPQVDRVLGHVPFEDVADGVQVRAAVVVDHALGIAGGARGVVQRDRVPFVGRRAPVEGGGGGGQEGLVVGGAGQGGRGAVQVVHRDHFQVREFGAGALRDLGVFGVDDQRAGLAVAQHEQHAGRVQAGVEGVEHGAQHRHAEMRLDHGGDVRQHHRHRVAALDAGGGQRAGQALRAFVGLGPGTAHGAVHHGQAVAIDLRGAGDEVDRGQGLIVGVTACQAVVERAAHACLLWGAGAPGYAFMRET

SEQ ID NO: 155690 - protein, 61 aa, Glycine max
  Coding DNA Sequence Number=SeqID_38912
  Subcellular localization annotation: CTP_CleavageSite=40; ConfidenceScore=5.30e-01
MAGVGPYMAPTDIFQPTLGNFFYKRWPIMFFYLRTARFFRASSTEGSFRPTLACCSSHLGG

SEQ ID NO: 155691 - protein, 130 aa, Glycine max
  Coding DNA Sequence Number=SeqID_38913
  Subcellular localization annotation: CTP_CleavageSite=68; ConfidenceScore=5.22e-01
MLTDHLIHKLLQASLLRHQWWKGQWCLPRRPMLTMLPRRWTLVRGSWLLFTATRLLFTVVRGSWLLVLCSARKKKNDSGEEGNSARKKTNGSMRGRRKETVGCDERESSGRERVTRFFKKITQGHKRLFI

SEQ ID NO: 155692 - protein, 120 aa, Glycine max
  Coding DNA Sequence Number=SeqID_38914
  Gene Ontology: Mol. function=transcription factor activity; Cellular component=transcription factor complex; Biological process =regulation of progression through cell cycle
  Homolog annotation: Hit_ID=Q1SSF0; Match level="QueryCoverage=88%, HitCoverage=36%, E-value=3e-19, Identity=43%"; Hit description =Transcription factor E2F/dimerisation partner
MTSYLYLLFSQNQEIIAIKAPKASCIEVPDPDEDDRKFEDDSAKRMKLMDPSWNSDPIRKRGVGLLESQHDEKNPSERFSLQGSQAFGIQEITPTGFEMEDDYWFQSDPGVSQTELWGNE

SEQ ID NO: 155693 - protein, 69 aa, Glycine max
  Coding DNA Sequence Number=SeqID_38915
MFITNLLSLFGGRNIKHVKGKDDELDPSEGKTCSSIRIFWFTRLAIALSLFVHDNPHTVSIVPVGRVKD

SEQ ID NO: 155694 - protein, 296 aa, Glycine max
  Coding DNA Sequence Number=SeqID_38916
  Gene Ontology: Cellular component=nucleus; Biological process=rRNA processing
  Homolog annotation: Hit_ID=Q5SY16; Match level="QueryCoverage=56%, HitCoverage=19%, E-value=1e-14, Identity=31%"; Hit description =Nucleolar protein 9
  Pfam annotation: Domain name=NUC156; Domain location=228-295; Score= -30.6; E_value=0.1; Accession=PF08160.2; Description=NUC156 domain
MDSSPSPDINIPEQWLEATESIANSSMPPITLICGAKNCAKTTFSRYLLNVLLNKYTKVAYLDTDVGQPEFTPPAFLSLTIVHKVTSDLTVPCLKTPESDLDDIYHLCWIFVFNCASVSQFRCLFFGDVSCKRDPSTYLSYVFAIYNYYRKEYCISDKGEYPHKIEVPLIVNTPGWVKVKISISSEKKNLPAGEFWSDGEHDETINLIEINSAHQDSLTRSVLVQIDARLLRDLRILTYFKQCFSSDSNISTIKELAHALASHCPYEVPIASIKIQHLHCENLKLHASNPSQAPQE

SEQ ID NO: 155695 - protein, 60 aa, Glycine max
  Coding DNA Sequence Number=SeqID_38917
MEDHLTEILLEISDLKRIVRGIDTVKGVLYVITPVPHSSLERVNLLLQGSVGPQELNQLV

SEQ ID NO: 155696 - protein, 73 aa, Glycine max
  Coding DNA Sequence Number=SeqID_38918
MTSRDQVWSFCTLVSSRGGGPDDTRKYPSDRTLDSMHRLTQSSAPFVPPGTTSHLHAEISWSPATLVNREERN

SEQ ID NO: 155697 - protein, 589 aa, Glycine max
  Coding DNA Sequence Number=SeqID_38919
  Homolog annotation: Hit_ID=Q10C07; Match level="QueryCoverage=64%, HitCoverage=66%, E-value=5e-28, Identity=43%"; Hit description =Expressed protein
  Pfam annotation: Domain name=DUF593; Domain location=318-411; Score =165.7; E_value=1.2e-46; Accession=PF04576.6; Description=Protein of unknown function, DUF593
MGKFTHFVIYVLLEWVLIFILFLDGFLAFLANEFARFFELHIPCWLCTRFDHVMVHRNPDFYYNESVCEAHKKDMSSLAFCHNHKKLSDIRKMCEGCLLSFATEKESDCDTYKSLVGILHKDLECFVQDDQPIQLSLKDDGFMQVDRSNNQKCSCCGEPLKMKSSNSNVKVKHSSSFVRAPTPSPRAFPFSTPISLEPNGPELPHIRYKELKFMADPELQEDEFGFNVNSPNVKSSGDTKSTSLPLLGEVEDLNDESSKFTPTFTRGNKFFGIPLTDSANNSPRWTYRINKKSPLEKTEFASDSNDVNPQTDFDDAILNNLKRQVRLDRKSLMALYMELDEERSASAVAANNAMAMITRLQAEKAAVQMEALQYQRMMEEQAEYDEEALQASNDMLIKREEDLRALEAELEIFRKQYGSLAEENTFSRESNSSLGYNSSSFKLNEGEGNGEKGLNSTQVESPQEENEGVRHNESVRDFKAEKTYLLGRMKKKENRTPLAESGIYSLLSSSDSVNNLDSETGKGGETFLPKELSFLAERVKALEGNSGFLELVSNNDEKDSEGTKILTEISQNLEKLSHLVMTSFEIENA

SEQ ID NO: 155698 - protein, 171 aa, Glycine max
  Coding DNA Sequence Number=SeqID_38920
  Gene Ontology: Mol. function=5-formyltetrahydrofolate cyclo-ligase activity; Biological process=folic acid and derivative biosynthetic process
  Homolog annotation: Hit_ID=Q8L539; Match level="QueryCoverage=81%, HitCoverage=50%, E-value=2e-45, Identity=62%"; Hit description=5 -formyltetrahydrofolate cyclo-ligase-like protein
MRAQTVMTQWCTRAAACGQLRMSTNTNTPKHDDIDAIFKQKRFLRTQVRKTLKSIDPSLKSHQDNTVQDIVLGAPWFRSSRRLCAYISCAALREVDTSKILSQILQHNSTTDGKKLYVPRVEDKNSHMRMLHISRIDDLIANSMDILEPTPVDADGNAREDGTLALPLFSF

SEQ ID NO: 155699 - protein, 117 aa, Glycine max
  Coding DNA Sequence Number=SeqID_38921
  Gene Ontology: Mol. function=5-formyltetrahydrofolate cyclo-ligase activity; Biological process=folic acid and derivative biosynthetic process
  Homolog annotation: Hit_ID=Q8LKF6; Match level="QueryCoverage=77%, HitCoverage=33%, E-value=1e-26, Identity=65%"; Hit description=5 -formyltetrahydrofolate cycloligase
  Pfam annotation: Domain name=5-FTHF_cyc-lig; Domain location=2-82; Score=-43.4; E_value=0.029; Accession=PF01812.10; Description=5 -formyltetrahydrofolate cyclo-ligase family
MQANDPVDLFLLPGLAFDRSGRRLGRGGGYYDTFLKNYQDLAKTRNWKQPLLVALSYSEQILDEGVIPMTSSDLPVDALVSPEGVIPISTTALNSEQFQHGSLTLAVDFTADPEHLQ

SEQ ID NO: 155700 - protein, 137 aa, Glycine max
  Coding DNA Sequence Number=SeqID_38922
MKFTKKTKHIESKPYSVYNCRTPQTQTVDNTSWNCDCLVGRQHKSEVGSGGGGGGEDLGAVVLVGGGGGGGGGGAVLSLAGGGGEVGEGGVIGGGGVGEGRGEMGHSGPNLGERVSGGECGVSDERRIHWKIESFNG

SEQ ID NO: 155701 - protein, 151 aa, Glycine max
  Coding DNA Sequence Number=SeqID_38923
SAVQVSSTWSMELCIMIARLRTQKAILHSSLFWETHDCYCIALFMCPPPSSGELCFTIAKSAVHVSSTFEWGAMFHDFKNADRQFGAMFHDCLSADPQGNPPFSPFFGAPRMLLPRVVHVSSTFEFGAMFNDCLSADPQGNPPFSPFFGDP

SEQ ID NO: 155702 - protein, 379 aa, Glycine max
  Coding DNA Sequence Number=SeqID_38924
  Homolog annotation: Hit_ID=Q9FFL9; Match level="QueryCoverage=37%, HitCoverage=50%, E-value=9e-20, Identity=39%"; Hit description =Arabidopsis thaliana genomic DNA, chromosome 5, P1 clone:MIK22
  Pfam annotation: Domain name=Ank; Domain location=23-57; Score=12.0; E_value=0.58; Accession=PF00023.20; Description=Ankyrin repeat
  Pfam annotation: Domain name=Ank; Domain location=58-90; Score=6.6; E_ value=3.5; Accession=PF00023.20; Description=Ankyrin repeat
  Pfam annotation: Domain name=Ank; Domain location=92-130; Score=12.6; E_value=0.46; Accession=PF00023.20; Description=Ankyrin repeat
  Pfam module annotation: Pfam domain module=Ank::Ank::Ank; Domain location=23-57::58-90::92-130
EWKETEAMIDADRRLATSAISQGRATLLHVAAEANQLHFVKELVKLLSDEDLELQDRKGNTAFCLAAASGNVRIVKVMARRNSRLPTIRRGDGLTPLHMAALQGKNKMAWHLYHDTVQTFNDADWDALFFFCLKTDIYGKSPTLALQLVKCLWETLLSLDGTEMQTIIKVISEPSQVIFIATEVGNFEVLAELDEDKNNLLHYAAKLSPPSKLNLLPGPVLQMKFELMWYEEVKKIMQPCFIEMRNSNGKTPRELFTEEHLELVTKAESWMKSMINSCITISTVTATLVLATAFSIKREDNHKPTITRDFMLYIGIAMISSSISSLIFLSILITSPCVEEDFLKSLLRKIWWGLPINNGISSVSIWVTRQHKPTLLVTQ

SEQ ID NO: 155703 - protein, 86 aa, Glycine max
  Coding DNA Sequence Number=SeqID_38925
MDADADISANVTANENARNAGLCKKLGVCVFLWMLGMLEFGQKVAMKTPAVMSVETSMHLIDVLFVHDSAANPLYPKNLAVNALTM

SEQ ID NO: 155704 - protein, 352 aa, Glycine max
  Coding DNA Sequence Number=SeqID_38926
MNENKEETRSMVAISLYRGNLHRVPDVPRRWPMPAPKITLKDFKSLLARRSKALSRLQNPNSTPLPNGSQPEPPPTVTVNHGEGPSITVAREDGDRNETPLVAVSSAKKPLAGSDSEKPQLDSKIDEASEKKTSDGVAAPEEEQTEPVAENEDLLNEKKKRKKEIEEKLHGLNDNKHNLVLVLKQILNAEEELKRRNSMQVVAMRGPSVPLQGDGTNDTGSMIRHMPPRLGSEGNLVAADVDGGGEGDDFANHTMHSRHVLRTSSMSPSSESTLRRTPSISIQQNVISHPSRANMGAAGSPSRFALSGHQGNPMNLPSVSVSGTSYIASSPSPAASGGTSVFRDARQPSPWK

SEQ ID NO: 155705 - protein, 330 aa, Glycine max
  Coding DNA Sequence Number=SeqID_38927
  Gene Ontology: Mol. function=DNA binding; Cellular component=nucleus; Biological process=regulation of transcription, DNA-dependent
  Homolog annotation: Hit_ID=Q9LSI7; Match level="QueryCoverage=98%, HitCoverage=99%, E-value=1e-52, Identity=38%"; Hit description =Transcription factor-like protein
  Pfam annotation: Domain name=Myb_DNA-binding; Domain location=14-51; Score=0.2; E_value=5.8; Accession=PF00249.21; Description=Myb-like DNA-binding domain
  Pfam annotation: Domain name=Myb_DNA-binding; Domain location=57-102; Score=42.2; E_value=1.8e-09; Accession=PF00249.21; Description=Myb -like DNA-binding domain
  Pfam module annotation: Pfam domain module=Myb_DNA-binding::Myb_DNA -binding; Domain location=14-51::57-102
MARSPSCEKINVKRGLWTTEEDTKKLAFGSKHGSGLKRCGRSCRIRWTNYPRPDLKDDNFTTQEEDLIIKLHAAIGSRWSIIAQQLPGRTDTDVKNYWNSKLKKKLSQLGIDPVTHKPFSKLIADYGNIGGCQKPSTRIASINKDFKNAMMLKSESHQTLPEGFITNINDQPKPPPKMETTGNNFLFNRTHGDDLSMNLDQFQAISMKSGASNCIDFENEIMPVSMFGEDCFSKTSSPSTPSTCSTTAFSWNDFLLEDAFTPLANQEQDLVSQIEDLTWNKIEVKSLQASGSDLQFSSASDISFMEAMLDQENEMFLSFPHLMEEPSKLN

SEQ ID NO: 155706 - protein, 147 aa, Glycine max
  Coding DNA Sequence Number=SeqID_38928
  Homolog annotation: Hit_ID=Q5XMI8; Match level="QueryCoverage=42%, HitCoverage=8%, E-value=2e-16, Identity=74%"; Hit description=Iron reductase
  Pfam annotation: Domain name=FAD_binding_8; Domain location=40-125; Score=-11.2; E_value=0.0073; Accession=PF08022.2; Description=FAD -binding domain
MEAARVQYQVRDRRVIFHLDGTLTSSVGPECVELISIKHNLHVLKRDVVTSGLTYNHTSVMSINTPSISKLQWHPFTVTSNSNLEPNNLSVKLLLKVKELGARSSISFFQLLPQCKHNGSLDSIQNNFLKHKYVKELGEMASIYCYF

SEQ ID NO: 155707 - protein, 93 aa, Glycine max
  Coding DNA Sequence Number=SeqID_38929
  Subcellular localization annotation: CTP_CleavageSite=3; ConfidenceScore=5.25e-01
MLPASHASPSRRRVGCNNNKDNDKKLKRQEHFILPSSSLFMAQCNPKVCSSVSCFIGFRRSLCSWSGFAAIVLAMGKELKEADRASCSKFLHL

SEQ ID NO: 155708 - protein, 422 aa, Glycine max
  Coding DNA Sequence Number=SeqID_38930
  Gene Ontology: Mol. function=RNA-directed DNA polymerase activity; Cellular component=chromatin; Biological process=chromatin assembly or disassembly
  Pfam annotation: Domain name=rve; Domain location=189-345; Score =91.9; E_value=2e-24; Accession=PF00665.16; Description=Integrase core domain
  Pfam annotation: Domain name=zf-H2C2; Domain location=130-171; Score =8.0; E_value=0.032; Accession=PF09337.1; Description=His(2)-Cys(2) zinc finger
  Pfam module annotation: Pfam domain module=rve::zf-H2C2; Domain location=189-345::130-171
MGTVLSQKGHLITFFSKPFTPELLQASTYVRELFAITAAIKKWQQYLLGHHFTILTNHRSLKEIMTQVIQTLEQQTYLARLIGYDYYIQYCSGKLNGTADALSRDLILKGGRIWLLTESSFIPTLLTEYHSSPIGGHIGTTKTLARLSENFTWPGMRKDVKSFMAKCLDCQHTKYETKKMAGLLCHLLVPFRPWEDLSLDFIVGLSPFCGYTAILVVVDRFSKGIHLGMLPTHHTSHSVAILFMDIMGKIHGKPRSLDSDQDPLFISRFWQELFRLSGTTFKMSFAYHPQTDRQTEVLNRVIKQYLRVFIHKKPSSWEKFLNWVEWSYNTSIHSGSGILPYELTFGKKPSTIPQYITGTSNLEAVDDFLKNKKELMGKICLRATCYIEAKEVIVRKRELEKKEAVSSVTSYSPIEFLKPKLS

SEQ ID NO: 155709 - protein, 106 aa, Glycine max
  Coding DNA Sequence Number=SeqID_38931
  Subcellular localization annotation: CTP_CleavageSite=78; ConfidenceScore=5.14e-01
MVAATSAVAKVNPMLPSGLKQMNHPTSNMVGKDLGSTDDPMMCKFKTSTPSHHMACLPTIHHPMWHTLSMKISITPLRYSLRTNNLIRHISLKPWGRHMNSPPQSS

SEQ ID NO: 155710 - protein, 653 aa, Glycine max
  Coding DNA Sequence Number=SeqID_38932
  Gene Ontology: Mol. function=galactosyltransferase activity; Cellular component=membrane; Biological process=protein amino acid glycosylation
  Homolog annotation: Hit_ID=Q10BV0; Match level="QueryCoverage=97%, HitCoverage=98%, E-value=0.0, Identity=60%"; Hit description =Galactosyltransferase family protein, putative, expressed
  Pfam annotation: Domain name=Gal-bind_lectin; Domain location=164 -373; Score=164.5; E_value=2.7e-46; Accession=PF00337.12; Description= Galactoside-binding lectin
  Pfam annotation: Domain name=Galactosyl_T; Domain location=419-607; Score=61.2; E_value=3.3e-15; Accession=PF01762.12; Description =Galactosyltransferase
  Pfam module annotation: Pfam domain module=Gal-bind_lectin::Galactosyl _T; Domain location=164-373::419-607
MMKRKLETLVWLTRKRSIQFLIGVFFLYLVLVTLEIPFVFKTDFASVTTTRPPRLRSEEDSLRKESPARPFKTVSNADSPSQLAHRPNSSVISALVLNDAAFDSHVNDGSSELYKQVKHAREVGRSLWEHLESGKPLTRTVAENRPGSCPGSVSLSGSDVVDVSGVVPLPCGLTLGSHITVVGKPLAAKPDFEPKITVVTENEPVMVSQFVVELQGLKTVDGEEPPRVFHFNPRLKGDWSGKPVIELNTCYRMQWGSALRCDGWKSKADDDTVDRMVKCEKWIRDDEDHLEGSKATWWLNRLIGRTKKVTVDWPFPFSEGKLFVLTVSAGLEGYRVSVDGRHVTSFPYGTGFTLEDATGLSLTGDIDVHSVFAASLPSSHPSFAPQRHLEFSTRWRTQPLPESGVELFIGVLSAGNHFAERMAVRKSWMQHRLVKSGAVVARFFVALHARQEINAELKKEAEFFGDIVIVPYLDNYDLVVLKTVAICEYGVHTVSAKYVMKGDDDTFVRVDAVIDEARKVPDGSSFYIGNINYYHKPLRYGKWAVTYAEWPEEDYPPYANGPGYILSSDIARYIVSEFDMRKLRLFKMEDVSMGMWVEQFNSSKPVHYSHSLKFCQFGCIEDYYTAHYQSPRQMMCLWDKLQRNSRPQCCNMR

SEQ ID NO: 155711 - protein, 413 aa, Glycine max
  Coding DNA Sequence Number=SeqID_38933
  Gene Ontology: Mol. function=aminoacyl-tRNA ligase activity
  Homolog annotation: Hit_ID=Q2PF39; Match level="QueryCoverage=98%, HitCoverage=55%, E-value=1e-99, Identity=52%"; Hit description =Aminoacyl-tRNA synthetase
EKLFTSKNRTEASVGKKVKIDMLPEIEKVHKRKEKLLKKQHRQALLLDNFLGVDGIAPGRSLRDRKPLTFDVAVIADDYDRSINEAIKITKRKPPSPELIPRREAGAKPEALTNGKWSGPSHDPQDLNFGMPSPKSPDSDDMEEENQTDMLDLDRSNRRRQKPKRYSEKDFVEALSDNEADYDSDDDIVGEAVYDEEYLQKRKQRRKASSSSGSEGDEEYHWDEDNVEDEEEDSLSVSEDSDKPRKFKRLAGRTRRETKVRSVGEIQSGLRRSKRAKTKSRINYRRYEISDSETEFIKSDKSNASDDHSDPTENGEYMMESEDSDGNDEEEQETKAVEPVTYPAEENNQSPAVEENEQNQNLPPEKSSSPGQEEVEGTAKRRFLDLNELAPSSGFDDGPNTTTLKDEGGNDDN

SEQ ID NO: 155712 - protein, 172 aa, Glycine max
  Coding DNA Sequence Number=SeqID_38934
  Gene Ontology: Mol. function=aminoacyl-tRNA ligase activity
  Homolog annotation: Hit_ID=Q2PF39; Match level="QueryCoverage=97%, HitCoverage=22%, E-value=5e-22, Identity=41%"; Hit description =Aminoacyl-tRNA synthetase
  Subcellular localization annotation: CTP_CleavageSite=34; ConfidenceScore=5.36e-01
MSQGSPPQDTTEPSPESDSRKEQTTATTTTTAVTAAVDAGAPPAPTRSRPSRACTIRAAARLLSASQPARPKAARREPRREGSPSSPPPPPQLQQCSKIVTPLVEPPPAAQLPRYNLRSMWELASILNFLNLFRPLLNISVEFSAEEFETALLTPNDTLGDIHVPLLKVGAF

SEQ ID NO: 155713 - protein, 156 aa, Glycine max
  Coding DNA Sequence Number=SeqID_38935
  Homolog annotation: Hit_ID=Q9LJR0; Match level="QueryCoverage=75%, HitCoverage=82%, E-value=2e-22, Identity=44%"; Hit description =Arabidopsis thaliana genomic DNA, chromosome 3, TAC clone: K7L4
MPRPFMCKIPKLPLKEESPHCNGNVKHHTSLGKETLKVYVLNKSNHQEKESYYEQQQAREGIRGVNQKLIIGCCPLKLACGLGSVAKHKDLFGVEYHQSSTSKSYCGMKNTHKGIYRRNHLSEFTSKAFNCFLTFNSMEPLPSKPTMVVEIPITSF

SEQ ID NO: 155714 - protein, 187 aa, Glycine max
  Coding DNA Sequence Number=SeqID_38936
MGDISKMKDIYKRWTEYLDSTRSRHFNDNCHLYSMKNSWWEQEIHPYNQYEEEKTPTLESVFVEFTAYHATSTANQNSMQNQEIQVGKSYSMENYQWEQELQPYNQYEEERTSNLDNLLMKDKEVTESTQRAFKSLEIQVGKLAEEVTKFVARREENFVEVETHEESLEEEHDSKEKDEDKSEEKSQ

SEQ ID NO: 155715 - protein, 190 aa, Glycine max
  Coding DNA Sequence Number=SeqID_38937
  Homolog annotation: Hit_ID=Q1T254; Match level="QueryCoverage=83%, HitCoverage=45%, E-value=4e-12, Identity=28%"; Hit description =Peptidase aspartic, catalytic
MKTPDEAMDLIESMTASCKCTICGGAHEYGCCIPNEEQIAHERQWQNHPGNQFNRDQGGSSTRPQQQMPSLYDRTIKMEETLAQFMQVSMSNQMSIESAIKNLEVQVGQLAKQLADRSSSNFSANTEKNPMEECKAVMTRSIMATHVDERKLEKKIGEHKQQLAAEPTLKPVDDLVELEEIVEEAEGDEE

SEQ ID NO: 155716 - protein, 92 aa, Glycine max
  Coding DNA Sequence Number=SeqID_38938
MMDMRMTMMDTMPAPTSTRGDDNGTKRNTKVWLQREWRNIEVSHQRRYNGSRHRWWWRNEGVHYPHEPKFLDLKIEIALHAHTHTLRLLAMH

SEQ ID NO: 155717 - protein, 163 aa, Glycine max
  Coding DNA Sequence Number=SeqID_38939
MQANQGEMEPSFHQFHDKSLSEALDHFYAYTPTKKSLLELTSHDTLLAQNKILAKQIETLTETLNKFPQQLYAVQPPPSLTMQVGGCNICGRALESRICMTQDDASKEGSYMANPNYQGFHQGGLIGYNQGGNLSQGQGWRSHPWDNFKKDQVVHLSDLPIKG

SEQ ID NO: 155718 - protein, 75 aa, Glycine max
  Coding DNA Sequence Number=SeqID_38940
MQNKNIRTTRLDTEHDRLDGEEETLFGTPQAYLEPYNDNGSDIGSREKKTYSEASITVETMKTGVAEVGVAVETM

SEQ ID NO: 155719 - protein, 48 aa, Glycine max
  Coding DNA Sequence Number=SeqID_38941
MTNSKKRSMTMTINWLKLKGTGMTKLKDDTDGHENDDDEHNGTDIDAR

SEQ ID NO: 155720 - protein, 284 aa, Glycine max
  Coding DNA Sequence Number=SeqID_38942
  Gene Ontology: Mol. function=transferase activity
  Homolog annotation: Hit_ID=UPI000016344C; Match level="QueryCoverage =86%, HitCoverage=41%, E-value=3e-36, Identity=33%"; Hit description =protein binding
MKPTPFVQLVECLWNKLLEQDYDETEMRTFISVPSQITFDATQVGNFQFVAALMRSYPDLLWEVDDKNRSIIHIAVIHRHSSIYSLIHELGSFKDFIATFEDDEGNNILHYAAKLTPPDKLGLISGAALQMTHELLWFKEVKELMLLLDVEKKNAKGKTPREIFAEEHKELLTKAESWTKSTSISCMLVSTLITAGVFTATFMLPGGIHKKTQTPNFLHKPAFLAFSLSVAFALISASASILMFLSILISSYAEEECFKLLPKRLLIGMVAQIISITNMMLYAG

SEQ ID NO: 155721 - protein, 110 aa, Glycine max
  Coding DNA Sequence Number=SeqID_38943
  Homolog annotation: Hit_ID=Q010M4; Match level="QueryCoverage=45%, HitCoverage=9%, E-value=1e-07, Identity=52%"; Hit description =Homology to unknown gene
MNDNDFCKNCHHWRVHFFTSVCSITHSLTLMVALTHSPFTHPHGCPHTLTLYPCSASIAIEKLIDVSNGRVKNFGGLVEDILDHAPTVNPIDGPHKNLVPDHCPLLNLLQ

SEQ ID NO: 155722 - protein, 67 aa, Glycine max
  Coding DNA Sequence Number=SeqID_38944
MMTYWPTEKAPKLRSIIEFTPPPAQSEKASITDVFQLPNAFWVSTVCGKTEDYEDKQSGVTSFSGSS

SEQ ID NO: 155723 - protein, 424 aa, Glycine max
  Coding DNA Sequence Number=SeqID_38945
  Gene Ontology: Mol. function=nucleic acid binding; Cellular component= intracellular; Biological process=DNA integration
  Pfam annotation: Domain name=zf-CCHC; Domain location=238-255; Score =8.1; E_value=0.046; Accession=PF00098.13; Description=Zinc knuckle
MLCIFFYKVVSEQGCFALVFTIIMTTVKYEISLLDYNTRFSLRQVKMQAVLAQMDLDEALQGFDKIPSSWTPEEKQCKDRKATSQIHLHLSNQILQDVMKMKSAAALWLKLEQLCMIKSLTNKLHLKHLYSHRMSEGLSLSNHLPVFKEIVADLETMEVKYDEEDLGLILLCLLPQSYTTFRDTILYSRDTLTLEEEYEALFSKEKMKHLLGDSETQPEGLVARGRNQERTSARNENKYCKYCKRKGHAITDCYKLQNKNKATTEPKGKQQTNFGQVSVAEDSCSDGELLTVSDDHSKSSQEWILDSGWTFHKDWFSTYETMSNGTALMGNNASCKIAGPGIVRIKMFDGVVRTLGNVKHVPDLKRNLISLGTLDSKGHKYTGEGGVLKVSKGALILIVEKYPSPTSAASLLGMQLIYLLDNFI

SEQ ID NO: 155724 - protein, 72 aa, Glycine max
  Coding DNA Sequence Number=SeqID_38946
MKRSNIVPPIVIEHKPQDSLRKIQKKKISTALEEKLMQKLEEMESPLSVPDKPSVQYMLNAKKTHEEVQRRA

SEQ ID NO: 155725 - protein, 101 aa, Glycine max
  Coding DNA Sequence Number=SeqID_38947
  Gene Ontology: Mol. function=peptidyl-prolyl cis-trans isomerase activity; Cellular component=nucleus; Biological process=protein folding
  Homolog annotation: Hit_ID=Q94G00; Match level="QueryCoverage=67%, HitCoverage=60%, E-value=4e-18, Identity=63%"; Hit description =Peptidyl-prolyl cis-trans isomerase 1
  Pfam annotation: Domain name=Rotamase; Domain location=33-101; Score=- 19.4; E_value=0.088; Accession=PF00639.11; Description=PPIC-type PPIASE domain
MSLSTLRRSQYSHSLPPPLGFPESWTGDVRASHILINHEGSRRKDLEAYIIKSTTRENAISQLQALRNDFVLGKATFEDIAFRFSNCSSTKHGGDLGQSKN

SEQ ID NO: 155726 - protein, 162 aa, Glycine max
  Coding DNA Sequence Number=SeqID_38948
  Homolog annotation: Hit_ID=Q9LSJ7; Match level="QueryCoverage=73%, HitCoverage=48%, E-value=3e-20, Identity=42%"; Hit description =Arabidopsis thaliana genomic DNA, chromosome 3, P1 clone: MFJ20
MAGTGRGSDSQKQLLSLIRDFAAEKSQGERRVVNLRKQIEKLTSELSEANAELENAKRYKELVEQDLRGFEVQLMLTESSVQTLAARVSLIQGHISAVESDFETLRGAILPQHSSYEWQDKVISFCFDSVPSHSAFTLLEQQEADCIFCYSIEWPPTISLIY

SEQ ID NO: 155727 - protein, 388 aa, Glycine max
  Coding DNA Sequence Number=SeqID_38949
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=95%, E-value=1e-114, Identity=55%"; Hit description =Integrase, catalytic region
  Pfam annotation: Domain name=Chromo; Domain location=325-376; Score =22.2; E_value=0.0019; Accession=PF00385.14; Description='chromo' (CHRromatin Organisation MOdifier
  Pfam annotation: Domain name=rve; Domain location=24-176; Score=93.4; E_value=6.9e-25; Accession=PF00665.16; Description=Integrase core domain
  Pfam module annotation: Pfam domain module=Chromo::rve; Domain location=325-376::24-176
MSADQECSSEARGLTLPSSNFCKTLGRSITRFHRGLPPSRGHSIVLVIVDRFSKGVHLGSLPAQHTAFEVAQLFMEICGKIHGPPRSHVSDRDPLFLSRFWRELFKLSGTTLKMSTAYHPQTDGQTEVMNRVIEQYLRAFVHRKPTTWRRFLMWAEWSYNTSSHSATGMSPYEITFGKKPPHFPQYLAGVSNVEAVDTWISTRDAMIEFLTKKLTKAQLRMKEIADKQRRDVQFDEGDLVLVKLRPRRQSTASEGQYSKLAKKIYGPFRVLQRIGPVAYKLELPPESRIHPVYHCSLLRPYHPSQVTQTRPTPLPKDAEDNQPIISPLAILDTKWNGSDDDKQLLVLVQWAGLLPEDTTWEPWTLLQTTYNLEDKVVLHAQGNDTAEN

SEQ ID NO: 155728 - protein, 132 aa, Glycine max
  Coding DNA Sequence Number=SeqID_38950
MYASVQQRGLGVEESFPSSERQQREVSPELRMVFRCKKGFLWRDPGAHRHGWQGATFTRELRRCQAVLRLGSGAIEEVTTWIPVLFNFSSQSFKRKEHGIEVPVLTLCFKLCPEFDKPKPFYSVHGMPQALN

SEQ ID NO: 155729 - protein, 67 aa, Glycine max
  Coding DNA Sequence Number=SeqID_38951
  Subcellular localization annotation: CTP_CleavageSite=29; ConfidenceScore=5.01e-01
MDEIVLKDILAGALLHVKCMHGPSKPPVRLASSLSVKESSLGMTISTCKGNCQFDWRVPLGFNFSAL

SEQ ID NO: 155730 - protein, 136 aa, Glycine max
  Coding DNA Sequence Number=SeqID_38952
  Gene Ontology: Mol. function=protein binding; Cellular component =spindle pole body; Biological process=protein modification process
  Homolog annotation: Hit_ID=Q9FLP6; Match level="QueryCoverage=82%, HitCoverage=87%, E-value=8e-40, Identity=77%"; Hit description =Ubiquitin-like protein SMT3-like
  Pfam annotation: Domain name=ubiquitin; Domain location=50-118; Score= 38.0; E_value=3.2e-08; Accession=PF00240.13; Description=Ubiquitin family
MSVSGGRGSQEEEKKPSDQGAHINLKVKGQNYYIFVLSPWFPLCSVLSNRVKDGNEVFFRIKRSTQLKKLMNAYCDRQSVDFNSIAFLFDGRRLRAEQTPDELEMEDGDEIDAMLHQTGGGHKFLQMYDDHLHQNA

SEQ ID NO: 155731 - protein, 78 aa, Glycine max
  Coding DNA Sequence Number=SeqID_38953
MGLRGWWLCVGEKHISNNNGFFKVVITVEGVITRVVIIAIEDEMRRPPMRRTDSLVVVGSWRKGRWVTARKGRESMYF

SEQ ID NO: 155732 - protein, 142 aa, Glycine max
  Coding DNA Sequence Number=SeqID_38954
MEELALYGNQVQAETTSTKKEVDKPIFYNAKEEGGRDQLPREPRYAHYTPLNVSRSHILDQALAIETLVMSKRANTPPKDFVHMQDQDKGRERDQDHNHHSLTKRSKEKEEKPLNHPRHIINTIARGFVRECATILACKRHL

SEQ ID NO: 155733 - protein, 80 aa, Glycine max
  Coding DNA Sequence Number=SeqID_38955
MNWRDCRSPHGVIVNKPDEYQAIIVDSQSNNKSNVLEAFIDYDFSHMATTSALRVKDMLEVNGGGYGYAEEEEEEQERQG

SEQ ID NO: 155734 - protein, 141 aa, Glycine max
  Coding DNA Sequence Number=SeqID_38956
MAPKKLATKSSRMDTTKEGSSAAQEFDAHRFRSVEHQQHFEAIKGWHWAPLATSMAKFDPDIVLEFYANTWPTEEGVRDMRSWVRFQWIPFDADALNQFLGHPLMLEEGQQCEKADADHVHQHDHSDPNMDDVAAQKHPTQ

SEQ ID NO: 155735 - protein, 51 aa, Glycine max
  Coding DNA Sequence Number=SeqID_38957
MSNLWKEAINEIVYMDLRLNGGTTKGLLNKWETIGVREDKGDEKVSIKKVE

SEQ ID NO: 155736 - protein, 560 aa, Glycine max
  Coding DNA Sequence Number=SeqID_38958
  Homolog annotation: Hit_ID=Q1ST43; Match level="QueryCoverage=24%, HitCoverage=9%, E-value=1e-59, Identity=80%"; Hit description =Integrase, catalytic region; Peptidase aspartic, catalytic
MKFELDALEKNGTWIIMDLPEDVRPIGNKWVYKVKYRVDGSIERYKARLVAKGYNQVEGLDFFDTFSPVAKLTTVRTLLALASIYSWHLHQLDVNNAFLHGDLHEDVYMVVPQGVKCSKPNQVCKLLKSLYGLKQYHGRLRQLATPLGLFILVNMGSNQTPRLKKRFYQVKIKSLEDASLLKLGQLMGQLQRQAFRKAYGALWEEGSHISSRGSTPSMARVAKVVKISAQELDRVKQNRNGVVGVPMRCLEEKAKALANQGEWASFIDILVLLIFGVVLFPNVKGLVDLAAIDIFLAFHHGKESPVVAILANMYDTPICLLQGHYLCIEKGKANWDQLLASMEGASINWFPRWKEGKIGNLCSCEGFPNVPLMGTRGCINYNLVLAIRQLGYPMRGAPSEESIAPFIARGFSDPNAGVLQGVHKAWDVVQRKDKELRGSSNGIISDYLKPKLQKRVRRYLKAELERARAVKKKFKSTAIKVQREYDELRDVNMATIEALEQETKRMSTPRYQRKGKHGKAFTFTLNGSQELSQLLAKAKAMADVYRPLKKFTGSSTIANT

SEQ ID NO: 155737 - protein, 106 aa, Glycine max
  Coding DNA Sequence Number=SeqID_38959
MPHKMYVCCIRWQKYLINLGDGPEKASIKDVQEGHLQRRLQRCPTETTNGHPHLCHLETTSPMTRRDKYGHLFFSSKTQCLSTETTLVSPCHPKTIESDDTWRQLI

SEQ ID NO: 155738 - protein, 211 aa, Glycine max
  Coding DNA Sequence Number=SeqID_38960
MTTPLSSTPPLELTPLRSTSKKTRKATRLKSLAIRPIEMERPVVHPNPTIGKADGPHRKKLRTHFGIVARDKHPGRVCAAGAGVTIRQYFGIASACSRTSTLISPKKLHQITKNIKEQLTQNIRDELEQSITEKGVVPPLELEVGPSAARVNTKGSHVNPSRVYEGVDNYPQRPFGHMPIEKVHKLFQGKPGNASMYGLLEPQSIQRFGQS

SEQ ID NO: 155739 - protein, 124 aa, Glycine max
  Coding DNA Sequence Number=SeqID_38961
MRHHRRLRCEEESAPFRESEWTNFYAESVSGECDFEGANKLLQGVGFFEELELRLDYPVIDLNGDALHSRNRNALKWEENLGIKNDCRGRTFLFLVGLFHFMAWVVNFGNVQDVLGNITASGFN

SEQ ID NO: 155740 - protein, 357 aa, Glycine max
  Coding DNA Sequence Number=SeqID_38962
  Gene Ontology: Mol. function=metal ion binding
  Homolog annotation: Hit_ID=Q9SFU2; Match level="QueryCoverage=94%, HitCoverage=98%, E-value=6e-44, Identity=34%"; Hit description =Putative RING zinc finger protein
  Pfam annotation: Domain name=zf-C3HC4; Domain location=309-346; Score= 25.5; E_value=0.00019; Accession=PF00097.15; Description=Zinc finger, C3HC4 type (RING finger)
MEGRRRITLHEQMSASDNSRARELAGLTLDDVLGNQKKFSSTPPSQQLPKSRTLLDIIKEDESNKKDRRSWKAFKDKLRLKRAGSAWTSSIHIPTSDVPIPNPNSRTFTQFGRRNSVRSPTQTQTHSDSDMSTPYNAHQVEDLDPADDDSGSPTTGPPAVRPQFSRHGSTRFAGDASGDNTAGTLRPQLSRRNSTNISSEPYKRGRVVTFRDSFDDEEADGEDGKKPGEGRALSAREAVAAQEAAEAAAQEAEAAEQAPVTMSLMDLLEETDREMGLEGSRYILSDDEDFDEDEDEDDDGGEGSMEHTCCVCMVKHKAAAFIPCGHTFCRMCSRELMVSRGNCPLCNNFILEILDIF

SEQ ID NO: 155741 - protein, 52 aa, Glycine max
  Coding DNA Sequence Number=SeqID_38963
MPPLDREDRDDVEGVANDVHDNFKAANAPWGLRSGLRGWKKGGVELEEKRRW

SEQ ID NO: 155742 - protein, 282 aa, Glycine max
  Coding DNA Sequence Number=SeqID_38964
  Gene Ontology: Mol. function=structural constituent of ribosome; Cellular component=ribonucleoprotein complex; Biological process =ribosome biogenesis and assembly
  Homolog annotation: Hit_ID=P50346; Match level="QueryCoverage=96%, HitCoverage=85%, E-value=1e-117, Identity=79%"; Hit description=60S acidic ribosomal protein P0
  Pfam annotation: Domain name=Ribosomal_L10; Domain location=6-110; Score=156.3; E_value=7.8e-44; Accession=PF00466.10; Description =Ribosomal protein L10
MARKLTKAQKKIAYDAKLCKLLDNYTQILVVAADNVGSNQLQNIRHGLRGDSVILMGKNTMMKRSIKIHAQNTGDTTILNLIPLLVGNVGLIFTKGDVKEVKEVVSKYKVAAPARVGLVAPIDVIVPPGNTGLDPSQTSFFQVLNIPTKINKGTVEIVTPVELIMKGDKVGSSEAVLLSKLAIRPFSYGLAVVSVYDNGSVFSPEVLDLTEDDLVVKFAEGVCMVSSLSLAISYPSIAAAPHMFVNSYKNILAVAVATEYSFPEADKVKEYLKVLSLMGIEH

SEQ ID NO: 155743 - protein, 122 aa, Glycine max
  Coding DNA Sequence Number=SeqID_38965
  Gene Ontology: Mol. function=structural constituent of ribosome; Cellular component=ribonucleoprotein complex; Biological process =ribosome biogenesis and assembly
  Homolog annotation: Hit_ID=Q307Z8; Match level="QueryCoverage=79%, HitCoverage=30%, E-value=1e-41, Identity=87%"; Hit description=P0 ribosomal protein-like
MGYEVGAPARVGLVAAIDVVVPPGNTGLDSSQTSFFQVFNIPTKINKGTVQIITHAELIKKGDKVGSSEAALLFKLGIRPFCYGLVVVSVYDNGSVFIPKNVQAVAVQQHIHSPRQTKLRST

SEQ ID NO: 155744 - protein, 74 aa, Glycine max
  Coding DNA Sequence Number=SeqID_38966
MRTSVDLLDPDGCQLYGNTVDERSTAKVRMQLSLTDKLGVAVHQILFQTTGFVKGCFLPNSTSMPMDPKAHVQS

SEQ ID NO: 155745 - protein, 103 aa, Glycine max
  Coding DNA Sequence Number=SeqID_38967
SCGFIIEKEELKGAANKGRFLVTPSKLKQRAYLVFLLKRGKKDKNSRIEPPYGAVLAALPLTQGVKCTRSLAEASSNLNACRLRKPSEQETVTVLCCLVYFKY

SEQ ID NO: 155746 - protein, 238 aa, Glycine max
  Coding DNA Sequence Number=SeqID_38968
  Gene Ontology: Mol. function=amino acid transporter activity; Cellular component=integral to membrane; Biological process=auxin mediated signaling pathway
  Homolog annotation: Hit_ID=Q9FEL8; Match level="QueryCoverage=94%, HitCoverage=46%, E-value=1e-108, Identity=83%"; Hit description =Auxin transporter-like protein 1
  Pfam annotation: Domain name=Aa_trans; Domain location=1-238; Score= -48.0; E_value=1e-05; Accession=PF01490.8; Description=Transmembrane amino acid transporter protein
MRISACTLLWSLLKQEKVAQVLLTLPYSFSQLGMVSGIIFQVFYGLLGSYTAYLISILYIEYRSRKEKENVSFKNHVIQWFEVLEGLLGPYWKAIGLAFNCTFLLFGSVIQLIACASNIYYINDHLDKRTWTYIFGACCATTVFIPSFHNYRIWSFLGLGMTTYTAWYLTIAAIAHGQVENVKHSAPNKMVLYFTGATNILYTFGGHAVTVTGIKDNWRISLHGPFPFFNCSFILHSF

SEQ ID NO: 155747 - protein, 168 aa, Glycine max
  Coding DNA Sequence Number=SeqID_38969
  Subcellular localization annotation: CTP_CleavageSite=45; ConfidenceScore=5.37e-01
DIRRTIPGNLRPLMTNIPASSLYSVRSGSHHGRTISVSGSPHATSSNASSELSVNQNGICLDSSEVDDDIGSERCGQSPASVRGSHSGFAYGANHACTNVKLLGSESSDVTSLAWIFYSKAPKRVFTVWCLLTNCCNNFRKLARTIAAFKLASNGPTSIGACYCWHRL

SEQ ID NO: 155748 - protein, 294 aa, Glycine max
  Coding DNA Sequence Number=SeqID_38970
  Gene Ontology: Mol. function=peptidase activity; Biological process =proteolysis
  Homolog annotation: Hit_ID=Q3R0K1; Match level="QueryCoverage=77%, HitCoverage=39%, E-value=2e-70, Identity=54%"; Hit description =Peptidase M28
MPRKLLLCLAAAAALSACKGEDTPAPAPATDTAAAKPAAHAFSPEINAGDFAEMVKTLASDEFEGRAPGSKGEELTVNYIRDQMQRIGLQPGNGDSWFQDVPMTETTADASTVLKITQGGKTTELKFGTDMVVGTRTGQAEVKVDASDLVFVGYGVDAPEQKWNDYAGQDWKGKTVVMFVNDPGFHVDDAKLFDGKRMTYYGRWTYKFEEAARKGAAAALIVHDTAGASYGWDVVKNSWAGPQYDLPAKDDPDARIPVQGWLSADAARRCLPVPAWTWRRLTRMRASAASSRCR

SEQ ID NO: 155749 - protein, 206 aa, Glycine max
  Coding DNA Sequence Number=SeqID_38971
  Homolog annotation: Hit_ID=Q2QV87; Match level="QueryCoverage=48%, HitCoverage=8%, E-value=3e-09, Identity=37%"; Hit description =Expressed protein
MSFCSSCERFETTVIGSVCEVNEKQTRLGFSVGVFEGFRVRVVWILGMNRSFRAQESQMHAALKQREQQFGGLRTSVMKEKEEELALFLEMKKREKERNDLLLNSSEEFDAALVSNGGANPIFNISSSTPAPVRKTGVDDFLNSENDKNDYDWLLTPPGTPLFPSLEMESRKTVMSRLGTPTTRPVALKSRKTSFVGNIIIVMQFA

SEQ ID NO: 155750 - protein, 64 aa, Glycine max
  Coding DNA Sequence Number=SeqID_38972
  Homolog annotation: Hit_ID=Q9ZT48; Match level="QueryCoverage=75%, HitCoverage=7%, E-value=2e-08, Identity=53%"; Hit description =Arginyl-tRNA--protein transferase 1
MASSSSNTPKESVVDDRGRRRTSCGYCRSSRDNSISHGMWAHSLTVDDYQGQCNLFFAYASHSA

SEQ ID NO: 155751 - protein, 174 aa, Glycine max
  Coding DNA Sequence Number=SeqID_38973
MNPRNVGPLCSVFNQEDLLLKTVTRSRSLEKLFIRMEEEEENRIAQGKFEYMSYYLLLSIMMQSYPARALDRKLQVDWARDAREGPRVLMSLRVDFGSIGACRPRIFFINGFLCFLEDEWQRNGERERERRRHFKEKMSLEEAHHHRRPWIRAWRKKEMNEGRGREEHEILCSK

SEQ ID NO: 155752 - protein, 384 aa, Glycine max
  Coding DNA Sequence Number=SeqID_38974
  Gene Ontology: Mol. function=nucleoside-triphosphatase activity; Cellular component=membrane; Biological process=regulation of transcription, DNA-dependent
  Homolog annotation: Hit_ID=Q26U09; Match level="QueryCoverage=66%, HitCoverage=50%, E-value=5e-58, Identity=48%"; Hit description=ATPas
RGNFVALGPALSRRPLPIVIGAVETSARSSSPKLMPLPDAPQDVEDLIFTPDPEEFTRPAVRRTPPAPRPTTDILAELSRSTPATVGPAPEQSPRAGQPEITPEERDEKISAVLVEILDDPQSAYRTDAVLYQDFLVRARMRRIPGTPMTLAEFRRQVAIARSGVDAAMAASEGWEKALELSMSVSDDLQGVFLLLVKAALGEEPCPSDARIARAYGTHSARRARRLLSYFEEKELVVVHADFSGKRIVAFPDLDAKTAPGDADAAEDDARLAAESCDATVDRDERRHQFVLERCGRVAPQSTRCVRIPAKRQIPQDAVAVSWKRATAPESVAEDIDRFPEALVPCARAEQHTPRFDEIVHLKQHFTIFLKERQIDFGMAEPSL

SEQ ID NO: 155753 - protein, 188 aa, Glycine max
  Coding DNA Sequence Number=SeqID_38975
MREAQEIPHHNLANFEPCLGYATEGQAVGVVPLPNTLEGPQFCPQPQPLHFAAGKVPPAMAKKGKLDHIEERLRAVEGGGDYIFADMEDLCLVPDVVIPLKFKVTDIDKYKGKTCPKNHLKVYYRKMGAYEKDEKLLMHFFQESLTGAAVTWYTNLEPSQVHSWKDLMVAFIRQYQYNSDMAPNRMQL

SEQ ID NO: 155754 - protein, 95 aa, Glycine max
  Coding DNA Sequence Number=SeqID_38976
MVIPQFKVPDFDKYKGTTCPKNHLKMYCRKMGAYVKDEKLLIHFIQESLTRAAVTWYTNLEPSQVHSWKDLIVAFVRQYRYNSNMAPDRMQLQSV

SEQ ID NO: 155755 - protein, 76 aa, Glycine max
  Coding DNA Sequence Number=SeqID_38977
MGETHEIPHHNLAEFELCLGYATKGQAVGDIPLQNTLEGSQYHPQPHLLHSTAGKIPLIMKEMGEVGSSRGKAQGR

SEQ ID NO: 155756 - protein, 67 aa, Glycine max
  Coding DNA Sequence Number=SeqID_38978
MDNQMDVDTRRHGAENPTNSAPIARGGGGAQHNERPTATTPHPNNHPKNNVKKRMTNANGPRKISIL

SEQ ID NO: 155757 - protein, 322 aa, Glycine max
  Coding DNA Sequence Number=SeqID_38979
NSQGLWNGVPQNEDLSNVFNDETTPVKACGDFAYNVNNSGIYLCTSIYPPQVPLGWSLMHWVTVNFYYYCYSCILLLYAMLSLIQIRWISELQKESDKCLKSSDQIKRRRMLQFNTQDGGHFLSNEHMSSAYLKGKEESNEDVFPELSHWVSGASGSASASNYEDLESAEGWLADCFKDAEMQLCPDDLNFSGADAVQIDVADLCNFPPACEQNVLQHHVTQTPKNIVFKGGKSFIETPTKLAASVAYPFTFIKPCGAHGDVTLKEINQRILSPPPPLKSQQSMEDPSAYPKSAFSGKPVVGKTKIHIEGGKGSITIMRTKG

SEQ ID NO: 155758 - protein, 74 aa, Glycine max
  Coding DNA Sequence Number=SeqID_38980
MGEVEEVQEKMKADMEAMKEQMATMMEAMMIMKKIMEASAVAVAATSTVAKVVLGIKWMNGMVKRRLSGGWTEI

SEQ ID NO: 155759 - protein, 150 aa, Glycine max
  Coding DNA Sequence Number=SeqID_38981
  Subcellular localization annotation: CTP_CleavageSite=34; ConfidenceScore=5.38e-01
MASFSQMQSQFQSQMQSQGLALPPEPKVGPSGARVNTKESCVNPSRNDPETGDSNKCGLYIEENSSRLVAQGILYEGSTAVHNIPLLHGQVKVGVKEVKDAEALVLVPTNEAAVSPAKPPKSPDHEVDDPLYLMTLTIPQLFLKPLQASD

SEQ ID NO: 155760 - protein, 131 aa, Glycine max
  Coding DNA Sequence Number=SeqID_38982
MTLAALANLRQADDESLRKFIGKFGRTVVQIRNLNPEIKLHSMLLALHPSKFVDSLCKKLPGSMDEPHERAKGYIQIEEMSKFWNEVYQVKQKCERCKANTKTYLHKSDKRHKLDKCQPLSKRPGMSVRYP

SEQ ID NO: 155761 - protein, 82 aa, Glycine max
  Coding DNA Sequence Number=SeqID_38983
MRPTGGVLHTESFDEGVEAIYGSWKASKCSSGSVVSSYRSRLSDFHPKGMSTSITRSIKGCQWTVCVVGRCMRETQIVCSVA

SEQ ID NO: 155762 - protein, 230 aa, Glycine max
  Coding DNA Sequence Number=SeqID_38984
  Gene Ontology: Mol. function=protein kinase activity; Cellular component=cell surface; Biological process=protein amino acid phosphorylation
  Homolog annotation: Hit_ID=Q1S8T9; Match level="QueryCoverage=70%, HitCoverage=24%, E-value=2e-64, Identity=71%"; Hit description =Protein kinase
  Pfam annotation: Domain name=Pkinase; Domain location=1-226; Score =50.4; E_value=6.1e-12; Accession=PF00069.15; Description=Protein kinase domain
  Pfam annotation: Domain name=Pkinase_Tyr; Domain location=1-194; Score=-14.6; E_value=1.4e-11; Accession=PF07714.7; Description =Protein tyrosine kinase
  Pfam module annotation: Pfam domain module=Pkinase::Pkinase_Tyr; Domain location=1-226::1-194
MLHKAKGNGQDFISEIATIGRIHHQNVVQPIGYCAEGSKRALVYEFMPNGSLDKFIFTKDGSTHLTYDEIFNIAIGVARGIAYLHHGCEMQILHFDIKPHNILLDETFTPKVSDFGLAKLYPIDNSIVTMTAARGTIGYMAPELFYKNIGGISHKVDVYSFGMLLIEMTMEMLEGDIESLKIPPKPSLYPHETMENDQSIYSSQTMSTDFIISSSYSKEIVTNPLVEDAI

SEQ ID NO: 155763 - protein, 406 aa, Glycine max
  Coding DNA Sequence Number=SeqID_38985
  Gene Ontology: Mol. function=protein prenyltransferase activity; Biological process=protein amino acid prenylation
  Homolog annotation: Hit_ID=Q8X6N8; Match level="QueryCoverage=52%, HitCoverage=89%, E-value=5e-63, Identity=59%"; Hit description=No significant matches
GIIRGALHSLNGTMQGLLPARPRSCAACHDRGRKEMMNKKATLALLVAAVLITGCASRTAPIQNVSQTVAQSYSDQQMQRAIVEAGAANHWVISPAGPGVMNGLLAERGHTANIRITYTANSYRIDYVSSTNLKAGSGQIHRNYNRWIQNLNQGIQTQLGDIRVRRMTGIESREGMPRSENLTIPEAEERMQRWAQHAPVLDACLAIAKPQFLPMMTARRLSPGSRAAVECGLALLARQSVDAVVFTSRHGELERNLRILRTLADGQPLSPTDFAMSVHNSAVGSLTIAARQPLVSSSISAGIDSFQQGLLEVSTLHQAGYRQVLLVDFDGLVPDYYRPWLPEIDTFNAPYAVALLLRAGEAWRCTATAARAQPDALPQSLQFLHAMLSETADFTLAGERHQWRWE

SEQ ID NO: 155764 - protein, 95 aa, Glycine max
  Coding DNA Sequence Number=SeqID_38986
  Gene Ontology: Mol. function=transferase activity; Cellular component= integral to membrane; Biological process=lipopolysaccharide core region biosynthetic process
  Homolog annotation: Hit_ID=Q6CYK8; Match level="QueryCoverage=98%, HitCoverage=16%, E-value=1e-34, Identity=70%"; Hit description =Putative glycosyl transferase
MGQPAPFPQGPFVLAAALRCPVLLMFALRQQGKLRVHCEAFADPLPLPRNGRQQALQAAVDRYAARLQHHALLAPLDWFNFYDFWALPEEEQRDA

SEQ ID NO: 155765 - protein, 186 aa, Glycine max
  Coding DNA Sequence Number=SeqID_38987
  Gene Ontology: Mol. function=catalytic activity
  Homolog annotation: Hit_ID=Q1LF27; Match level="QueryCoverage=54%, HitCoverage=73%, E-value=8e-27, Identity=57%"; Hit description =Thioesterase superfamily precursor
  Pfam annotation: Domain name=4HBT; Domain location=1-85; Score=42.7; E_value=1.3e-09; Accession=PF03061.12; Description=Thioesterase superfamily
MGVVWHGNYFRYFEVAREALLRSINYSYAEMSASGYVWPVVDTRVKYRLPLRCEEAIRVEASISEYENRLRIDYVIRNAAGQVTTKAHTLQVAVSASTQEIVWGCHHDSSGLPAADAAQRQRQRGDAGTATAALCQPAGDSRQLCSGAQHRWHGTAAGVARPAVDCSAAGAVVAPGDTVPDDADSG

SEQ ID NO: 155766 - protein, 109 aa, Glycine max
  Coding DNA Sequence Number=SeqID_38988
EIHRPEIPSNVYLITPFTDIISGLAPRHTLVDIVGVIADLIDVKTVNPPDRMTVRLRDNSNCDILITVWEDYAIQLHDAIDKNLLLQEPLVVMLTLGKIKDATGVSGVG

SEQ ID NO: 155767 - protein, 185 aa, Glycine max
  Coding DNA Sequence Number=SeqID_38989
MDRFTLTLNGSQELPRLLARAKAMADTHCHHQKVIIATKNNERALQHPYRTRARARIMSEVEEVQEQMKDDMESMKDQMAAMMEAMLSMKKIMESNAAAVSTTSATAEMDPTHPSSINQMNHPVPNMVGQGGEALRSIGGPHVVQSKNSFPLYGLPPNYAPPNVVHVSDENTDHFALVLFESQQP

SEQ ID NO: 155768 - protein, 120 aa, Glycine max
  Coding DNA Sequence Number=SeqID_38990
  Gene Ontology: Mol. function=ATPase activity, coupled to transmembrane movement of substances; Cellular component=membrane; Biological process=transport
  Homolog annotation: Hit_ID=Q1FRD8; Match level="QueryCoverage=64%, HitCoverage=28%, E-value=7e-17, Identity=42%"; Hit description=ABC-2
MGQVVSVIIALMLFMSPIFYPITAVPEQYRMLIYINPLTFIVEALRDVVLYGKLFSLEGYALYWGISIVLYVLAITWFKKRLGALLGYRGAKGREFVALDSVNFEIRKVKQSVLLVSMVP

SEQ ID NO: 155769 - protein, 95 aa, Glycine max
  Coding DNA Sequence Number=SeqID_38991
  Subcellular localization annotation: CTP_CleavageSite=70; ConfidenceScore=5.27e-01
MQVGSATFIIRVIKHSGICSGNSKILQVASRFQDVKTSHVTSAFCSPCLHALTAVKQFTAASSSLFQDVKTSHVTSAFCSPCLHALATASSISYS

SEQ ID NO: 155770 - protein, 72 aa, Glycine max
  Coding DNA Sequence Number=SeqID_38992
RTRGFDWLSKLKIINEENFEAPEEDEETSGKSVSGYEKKMQLPQEPLNKKPRGLARKSMARKNFVELCGAAT

SEQ ID NO: 155771 - protein, 49 aa, Glycine max
  Coding DNA Sequence Number=SeqID_38993
MTLFCTRLPIESKVKRGVGYRQSRTTLNGNLKGRNTKNGFCFAGSPLPC

SEQ ID NO: 155772 - protein, 102 aa, Glycine max
  Coding DNA Sequence Number=SeqID_38994
AIAYPTALHLKESIKFKFYPNRIYQRFPIINFHKRKGVEPEEVDMATKAKVEFQQYFELFKEMFSPPEPKILPSKENTSMIGVSSPQGEPPKTPPPPLEMSM

SEQ ID NO: 155773 - protein, 503 aa, Glycine max
  Coding DNA Sequence Number=SeqID_38995
  Gene Ontology: Mol. function=nucleic acid binding; Cellular component= chromatin; Biological process=chromatin assembly or disassembly
  Homolog annotation: Hit_ID=Q1RVR4; Match level="QueryCoverage=66%, HitCoverage=95%, E-value=2e-94, Identity=52%"; Hit description =Peptidase aspartic, active site; Aldehyde dehydrogenase
  Pfam annotation: Domain name=RVP_2; Domain location=184-298; Score= -27.6; E_value=0.00014; Accession=PF08284.2; Description=Retroviral aspartyl protease
MAKDVEEELKEEDDEGDRYYGKNRMGRSEPNGLLSKSQNGSNLIHKDFTRFNSGGYAPSQKTGSTGSNTIPTSSMNSTGRKGENDRRTLSSERWKGVRGVQSDEITERRAKGLCFKCGGKYHPTLHKCPERAMRVLILGEGEELNEEGEIVSLEATETEGEGEETDAECNLIGVMGSMGEYNTMKICGKIASIDVMVLIDSGASHNFISPEITTALGLSVTPMAAKNIKLGDGHKVLSKGICEGVQIDLGTQVFHVDALVLELGGLDVVLGVSWLSTLGKVVMDWKDLSMQFTHEGRMVNLQAQGRIQEKQSCLHSFLEDKHRRGGEGWWWTQQEERDIAQAVGQMELTKLLSQFSEVFQEKITLPPERSQVHQIKLIPEHGPVNVRPYRYPHHQKKEIEKQVTELLAAGVIRTSMSTFSSPVILVKKKDGSWRMCVDYRALNKATVPDKYPIPIVDELLDELYGATIFSKIDLKAGYHQIRVHKDDIHKTAFRTHNGHYEYL

SEQ ID NO: 155774 - protein, 91 aa, Glycine max
  Coding DNA Sequence Number=SeqID_38996
MASYGGELLLDSTSPGSERLLSTLLLLHSAAIKIQEAKDNIDEEDPRPTSSNGATSCGYCKGGLVPSLKEFESRNKGPTTLRAIRLRSTPN

SEQ ID NO: 155775 - protein, 140 aa, Glycine max
  Coding DNA Sequence Number=SeqID_38997
  Gene Ontology: Mol. function=transferase activity, transferring acyl groups, acyl groups converted into alkyl on transfer; Biological process=branched chain family amino acid biosynthetic process
  Homolog annotation: Hit_ID=Q39891; Match level="QueryCoverage=53%, HitCoverage=13%, E-value=1e-35, Identity=98%"; Hit description =Probable 2-isopropylmalate synthase
  Pfam annotation: Domain name=LeuA_dimer; Domain location=59-140; Score=0.7; E_value=3.8e-05; Accession=PF08502.1; Description=LeuA allosteric (dimerisation) domain
MIYNVIRIANKSHSDDFIKSIWNECALSKVVALLWELAQDQPPTLDNVESIDVILRKKVVTDVDLKALVSYKAFHAESIWKLGDLQVTCGTIGLSTATVKLVNIDGSTHVACSIGIGAVDSTYKAINLIVKSSNITYITI

SEQ ID NO: 155776 - protein, 85 aa, Glycine max
  Coding DNA Sequence Number=SeqID_38998
MYRPKQDTLIIYRSNSGWDILCFVKKQKWIGFFEVNEPIYPRLVRDFFEAIVVDRNNFTLKALISEKLLADLLGIPANSLRLYEY

SEQ ID NO: 155777 - protein, 226 aa, Glycine max
  Coding DNA Sequence Number=SeqID_38999
  Homolog annotation: Hit_ID=Q1S9I4; Match level="QueryCoverage=38%, HitCoverage=7%, E-value=1e-08, Identity=39%"; Hit description =Integrase, catalytic region; Zinc finger, CCHC-type
MAKRMNNSGRRMSCIKALSESQLAKRTVFTFRLSEVFGCGETERELSLKRKPSCGALDEILRDCEEASLLWRAKSSVGSSYGNGETISELETRFIHIVNHLLGLGKTFEDDELNIKILNCLTRTWESKITMIKESKDLASMWMEALFGKFLEYEHGLIRQSHVEDTKKKRKGIELKVSSTKEDHKESSSDDKDVENLSLMTMHQHPLILLVKKNLQDESLTIEETE

SEQ ID NO: 155778 - protein, 142 aa, Glycine max
  Coding DNA Sequence Number=SeqID_39000
  Gene Ontology: Mol. function=chitin binding; Cellular component =extracellular region; Biological process=chitin metabolic process
  Homolog annotation: Hit_ID=UPI0000612705; Match level="QueryCoverage =61%, HitCoverage=91%, E-value=5e-13, Identity=31%"; Hit description =UPI0000612705 related cluster
MTGPLHESISCFLIRVDPWVLVPITFRGLHVLASRGLHVLVFRGLHVLAIRGLHVLAFRGLHALTIRGLHVLAFVGLHALTFRGLHVLTFRGLHILAFRGQHILAFRGQHILSLCIQYPDEGVPYVLKTGLIHLLPKFHGLK

SEQ ID NO: 155779 - protein, 62 aa, Glycine max
  Coding DNA Sequence Number=SeqID_39001
KTNCSLLLCLPVTKQWTHRNISSPQRDTRPTWELAASRGGSRLAVWEWSRRGETLGRWRRGA

SEQ ID NO: 155780 - protein, 85 aa, Glycine max
  Coding DNA Sequence Number=SeqID_39002
MASSTCFQQISLQITIMKQKPNKTTHHISQNPIPTKIKDALHDSENAFLSRFGAEMATKGWSFVGASMVEEEEENGNVRERGKGF

SEQ ID NO: 155781 - protein, 173 aa, Glycine max
  Coding DNA Sequence Number=SeqID_39003
  Homolog annotation: Hit_ID=Q47522; Match level="QueryCoverage=29%, HitCoverage=64%, E-value=5e-24, Identity=100%"; Hit description=LacZ protein
MRRRGCEVHGSSSVGEGMMTQSWGQRKSVLGSFQQGVHEVGSGIEIITVFVVVVGAGGMISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 155782 - protein, 706 aa, Glycine max
  Coding DNA Sequence Number=SeqID_39004
  Homolog annotation: Hit_ID=Q69MD6; Match level="QueryCoverage=83%, HitCoverage=97%, E-value=6e-66, Identity=30%"; Hit description =Ternary complex factor MIP1-like protein
  Pfam annotation: Domain name=DUF547; Domain location=481-625; Score =236.1; E_value=7.6e-68; Accession=PF04784.5; Description=Protein of unknown function, DUF547
MSHSHQHPQPQQRRLLSQCLNQLREHPAESSFSSSQTHYKTKIPLCLIHSETTSTTSTPRHSFFGPKIVSSSPHQHYYFHEPHSPSSSFPCNCFNVSSRRWSAFKLGCTSMDPQVEFSSSLHSASEIIRKKKITGRQKREELEKEVAMLQKLLDQEEKFHEILEMVHSRPNGSSISIPNFLPPKMRELLGELVMVEGEIARLESQISELQADLKHEQEITKESKPKTWNQGNLSNSNNHLSTSPVPNPSPIRRNVQERMAFETKALHFISKAIKGDYNLNDFSYNDKTGFVKTSVEPKESKFQEDVKFHEKLPRKNGMVKPPSPMRDPRHPSPKFRERNPEMYLDLPTRSLLDPLLSEENDLKWQPNKLSESIMKCLNFIYVRLLRTSRAMELEKSGPISRSVHSSLSSRSFRVDIGSNPKPSLLLQKESRQQDPYGIFNTEESIPRDIGPYKNLVIFTSSSMDPKFISSPSSIPLLRKLRILMSNLQTVDLKSLTNQQKLAFWINVCNACIMHGFIQYGVPSTPEKLLALMNKATLNVGGNIINAQAIEHFILRKRDISNVKEVQRKGEWEEKESFVRELYGLEFNDPNVTFALCCGTRSSPAVRIYTADGVTAELEKSKLDYLQASILATSTKRIGFPELLLRNMLDFSVDTDSLVEWVCSQLPTSGTLRKSMVDCFRSHSNVKPSTIVEKIPYDYEFQYLLTI

SEQ ID NO: 155783 - protein, 34 aa, Glycine max
  Coding DNA Sequence Number=SeqID_39005
IVQSYNKSANLEEADYWNSHLITVDRRLERLVSQ

SEQ ID NO: 155784 - protein, 128 aa, Glycine max
  Coding DNA Sequence Number=SeqID_39006
  Pfam annotation: Domain name=HEAT; Domain location=53-89; Score=20.6; E_value=0.0058; Accession=PF02985.12; Description=HEAT repeat
MYPILGEFGPSLTHCPNLALSPLLFWYLHEPHPLAHVPPPRRRVVHVASAKFEVRHSLLLAVLLRFTKDPFSQVRASALEGLVGFYKCGRVERHHVLVGKTLVSRTQGTKVMLNSFTRELNLLIRKLS

SEQ ID NO: 155785 - protein, 330 aa, Glycine max
  Coding DNA Sequence Number=SeqID_39007
  Gene Ontology: Mol. function=transferase activity, transferring acyl groups, acyl groups converted into alkyl on transfer; Biological process=branched chain family amino acid biosynthetic process
  Homolog annotation: Hit_ID=Q39891; Match level="QueryCoverage=50%, HitCoverage=29%, E-value=3e-86, Identity=96%"; Hit description =Probable 2-isopropylmalate synthase
  Pfam annotation: Domain name=HMGL-like; Domain location=41-257; Score= 24.5; E_value=6.9e-09; Accession=PF00682.9; Description=HMGL-like
MATKTSTPSSQSPKLSRLRPQYIPNHIPDSSYVCILDTTLRDGEQSPGATMTAKEKLDIARQLVKLGVHILQPGFPSASNSDFMAVKMIAQEVGNAVGDDGYVPVIAGFCRCVEKDISTAWEAVKYAKRPRLCTSIATSPIHMEHKLRKSKDQVIQIARDMVEFARSLGCNDIQFGAEDATSSKTVVKNRLRVRSGGNFVIKEKTVVFNVVHSKAVIDDRLRMSFGGKLVIMRKKNTLTLLLTPCTLSSVFAVSSKQKPPNSTDKKNSNFGHCYRRHFFTKSQRKFLANQTAQTKSYRGHLSFSFCECYLKVRAVLERATGGVEKALLGV

SEQ ID NO: 155786 - protein, 552 aa, Glycine max
  Coding DNA Sequence Number=SeqID_39008
  Gene Ontology: Mol. function=RNA-directed DNA polymerase activity; Cellular component=chromatin; Biological process=chromatin assembly or disassembly
  Pfam annotation: Domain name=rve; Domain location=189-339; Score =70.9; E_value=4e-18; Accession=PF00665.16; Description=Integrase core domain
  Pfam annotation: Domain name=zf-H2C2; Domain location=128-165; Score =15.9; E_value=0.0028; Accession=PF09337.1; Description=His(2)-Cys(2) zinc finger
  Pfam module annotation: Pfam domain module=rve::zf-H2C2; Domain location=189-339::128-165
LKELMAQTIQTPEQQKYLTRLMGYDFIIQYRFGHSNVVTDALSCTFDHSKGMVLTFLMPYFIFIDELKGELADNPEFNALRQGLQENPTNRPTLTYSDGLVLQNGRIWLPNKLNFIRLLLHKFHSTPTGSHMGVTKALAKLHDKFTWNSIRQDVHDFVAQCLNCRYTKYVTRKPAGLYLHYLFLLSHRRTYHSIFIVELPIYKGNTTILVVVYRFSKGIHLGLLPSQYIAYQVATLFLDIVSKLRGMPRSLVFDREPLFISKFWQELFKLSGTKLHLSLTYHPQSNGQTEVMNRIIEQFMRAFVHHRPSPWGKFLPWVEWSYNTSKNTSTGTSPFEDSHIHLVFHCSLLKPFWHDARTEPSPLPLPGKDFDNYPLITPLTILNTRWVDTNNGPRLHVLVQRASLPVDDTSWEHWASLKEKYHLEDKVIFEGIRSDRPVNMHEAQHGRPQRKTLEEFPTKEQYEAHISAVVEPETPVEKHNNTGLWYLVYKHMVSNMDENNSESLIDGADKKESGFDGSRTRGASFSYESTPVTDQEMKFKDHVVADPEVARQ

SEQ ID NO: 155787 - protein, 61 aa, Glycine max
  Coding DNA Sequence Number=SeqID_39009
MEKVSFVLGALLKHENEQKKKIGHACKEKDLSLSKLSVEVAKERIQEGCGKELLAPSPIGD

SEQ ID NO: 155788 - protein, 164 aa, Glycine max
  Coding DNA Sequence Number=SeqID_39010
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=60%, HitCoverage=17%, E-value=9e-49, Identity=99%"; Hit description =Probable 2-isopropylmalate synthase
  Pfam annotation: Domain name=HMGL-like; Domain location=2-159; Score =15.3; E_value=2.2e-08; Accession=PF00682.9; Description=HMGL-like
MKLGETCKRIIELNGSRERREDLHEEAIIYTFIKRSDREFLYEILGVVIEVGATTVNIADTVGIVMPLELGKLIVDIKDNTPGIANVIISTHCHNDLGLATANTIEGARTGARQLEVTINGIGERAGNASLEEVYAIGHNLVLTGKTEFHHDFSKHSKTVLNRL

SEQ ID NO: 155789 - protein, 440 aa, Glycine max
  Coding DNA Sequence Number=SeqID_39011
  Homolog annotation: Hit_ID=Q7XA57; Match level="QueryCoverage=7%, HitCoverage=3%, E-value=2e-07, Identity=78%"; Hit description =Putative BEL1-like protein
  Pfam annotation: Domain name=POX; Domain location=303-434; Score= -27.6; E_value=0.00015; Accession=PF07526.2; Description=Associated with HOX
MSSLRPELHVAQQLRRDKLRIQNSSQQQHLQEFPNNLEQLSLQPGFNLDLLQVRSVRNGNMLDEALYSSEMITFPNPLSAPRNPLECQELMMVQYGSTSFPHSSSPKEQQCEPRNLGASWMLNCNNSSSSNNNNSNNSLYSSELNNNVSSEMANREIQKQFGEMQYPPSSSSSSPIYHNALQDMAYGVWGGNNHHGESVLHYGNNELRIGGANLWTHNNNNIPLGFKKINNDEQLHDRNHTHQGLSLSLSSNSQQQQSKPCFDEGSVVKSPSSTMKLNALSNNNNNTVYRNVGPLGPFTGYATILKSSRFLRPCQQLLDEWCCQSGSKFAKRGICDVPEWVSRDVSSASTCATALNVDESAAKGGGNSGASSSVLYCSIENNNNNNNNNNNNNNNNNNSADGGAASSFCLSSRPECQKNKAKLLYMQEECVFGIWLNVCQ

SEQ ID NO: 155790 - protein, 277 aa, Glycine max
  Coding DNA Sequence Number=SeqID_39012
  Gene Ontology: Mol. function=sequence-specific DNA binding; Cellular component=nucleus; Biological process=regulation of transcription, DNA-dependent
  Homolog annotation: Hit_ID=Q94KL5; Match level="QueryCoverage=88%, HitCoverage=44%, E-value=5e-31, Identity=33%"; Hit description=BEL1 -like homeobox 4
  Pfam annotation: Domain name=Homeobox; Domain location=70-107; Score=- 4.6; E_value=0.015; Accession=PF00046.19; Description=Homeobox domain
  Pfam annotation: Domain name=POX; Domain location=1-41; Score=-40.6; E_value=0.0021; Accession=PF07526.2; Description=Associated with HOX
  Pfam module annotation: Pfam domain module=Homeobox::POX; Domain location=70-107::1-41
MQMVVQSFESVAGLSLATPYVSLALKSVSKHFRCLKNAISDQLKLTCEVLGEDFSIPTTSTGSKFDNNMARLRYPTDTDKHMLATQTGLSRNQVSNWFINARVRVWKPMVEEIHMLETKGVTTEARQHHQTSSKNDQLASASEGSNNQPKSDNQPAHRFGGAHASHSHAIPEKQFQCLEMGSSSSACNEEQIGMEEDQWNQEKRSKLDCQITTTTPSMDGTVMGFMPYRRSGLEGLGSVSLTLGLRHGVEGVQQQQLQQEEELRRQFGGHMIYDFVG

SEQ ID NO: 155791 - protein, 193 aa, Glycine max
  Coding DNA Sequence Number=SeqID_39013
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=56%, E-value=2e-47, Identity=53%"; Hit description =Integrase, catalytic region
MARRKSSIGSLNNTCTHSFMIILINGSSFFPWQNGPMIHPCIMAQDFLPSKSFMHLTLQRRLLKSQNVMKTQADAHHWDVQLDVGDWVYVKLRPYHQTSLQPSYSKLSKRYNGPYLVEACVVPVAYQLHLPPGSKIHPIFHVSLLKPHQGPITSDTSPLPPLSTNNHPIVRPLQFLDWKIDTASTPPTQQVLV

SEQ ID NO: 155792 - protein, 94 aa, Glycine max
  Coding DNA Sequence Number=SeqID_39014
MQRYYSASARELARLVGRNKAHEHKPQVFPLDKNSKITSNTKKGFRDQDKLTFQILKPQASCPSSTSVRQGLVMMGHKLLVVGEEWVKSGKGCW

SEQ ID NO: 155793 - protein, 363 aa, Glycine max
  Coding DNA Sequence Number=SeqID_39015
AGNRYTDNVLGRNILPERKVELYHTELDDFKTELERRNFHKRLTNLVDGSIDLALVKEFYANLYSSEGPSPKQSRVRGHLVKIDADSLNTFLETPVVLAEGRGFILNTEGHPGKILRKDLTTLTRMTSIAQSNISRIGFPALITALCRARGVVSNSLTFERLSPVINWAYIRKNYWNPEDLTVSIRGARRARARPVELPSTSVIPTLASTSAASSVPTQTDSQRFEAMLQSIHQGQITLLQRSIPSVEQFREMVAWPRTQPSLHKEDEGPTAQVPQHVEDESSEATIPEPFVIGEEAEPPAPVVDLPSPQCTTDPSTPIVQTPEDPTTPDLAMDTSPPATPVLHLTNEKDVQTHDTQDQSQEF

SEQ ID NO: 155794 - protein, 181 aa, Glycine max
  Coding DNA Sequence Number=SeqID_39016
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=11%, E-value=1e-71, Identity=71%"; Hit description =Multidrug resistance-associated protein 3
  Pfam annotation: Domain name=ABC_tran; Domain location=77-181; Score=- 46.6; E_value=0.0023; Accession=PF00005.17; Description=ABC transporter
  Pfam annotation: Domain name=MMR_HSR1; Domain location=78-155; Score=- 16.6; E_value=0.033; Accession=PF01926.13; Description=GTPase of unknown function
  Pfam module annotation: Pfam domain module=ABC_tran::MMR_HSR1; Domain location=77-181::78-155
MPIYSLPDTISMIAQTKVSLERIASFLRLDEWKTDVVEKLPQGSSDKAIELVDGNFSWYLSSPYPTLKNVNLTVFHGMRVVVCGNVGSGKSSLLSCIIGEVPKISGTLKICGTKAYVYESPWIQSGKIEDNILFGKEMDREKYDEVLEACSLTKDLEVLPFGDQTTIGEKRINLSGGQKQR

SEQ ID NO: 155795 - protein, 88 aa, Glycine max
  Coding DNA Sequence Number=SeqID_39017
AEDDVSLCVLLGFSTYRQQKLYTDNHSGISARQRDSKVNMTDLVSAEDDAFCLTDSKKNVYTDDHSGISARQRDLNVSITDLVSAEDD

SEQ ID NO: 155796 - protein, 182 aa, Glycine max
  Coding DNA Sequence Number=SeqID_39018
  Gene Ontology: Mol. function=chitin binding; Cellular component =extracellular region; Biological process=chitin metabolic process
  Homolog annotation: Hit_ID=UPI000044A8F0; Match level="QueryCoverage =57%, HitCoverage=99%, E-value=2e-13, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFNVLCVLVFRGLHVLAFRGLHALAFRGLHILAFRGLHVLAFSGLHVLAFRGLHVLAFRGLHALTFRGLHVLIFRGLHAIAFRRLHTLGFKGRHVLNFGGMHAPSPLKGYAPTWAFQILPPKGYCFWRKQPCSPGRDELAWASWGRGSAFLALLILSKWLRKIVSVKKIQAEALPLQL

SEQ ID NO: 155797 - protein, 95 aa, Glycine max
  Coding DNA Sequence Number=SeqID_39019
MTFVCPLNEGRYATEGCHYHACSQKHCFVTYEKKYGGNILMGSDDPSPLELVGLGSFSSMYSFASGKMNGSRMEKEEREEMPLQGEDESRRSSPP

SEQ ID NO: 155798 - protein, 250 aa, Glycine max
  Coding DNA Sequence Number=SeqID_39020
  Homolog annotation: Hit_ID=A0BEB1; Match level="QueryCoverage=59%, HitCoverage=75%, E-value=6e-10, Identity=30%"; Hit description =Chromosome undetermined scaffold_101, whole genome shotgun sequence
MNVFDIQHIKTYSSYVSQCEGFYGYDYIHSDNLTRTVTAYKFRTDAQCSQSTHQGMNQINFNPQQTGTYTFKFWQGTNSWITKTIVIFGQKIIWKEDQKLTWDDFKSPVSRKSNKDVVAYTHCGWEYSVVTSSNPASPVKIEVLTIFNKDKSWKDVKRINDYVLLHEQKHFDIAELYARKLRKEVMENIKTAGDYQKKFKAIYDRVLHEYRDFQIAYDKETQNGMNKEKQAEYNASITEHLDQLNSYKKS

SEQ ID NO: 155799 - protein, 206 aa, Glycine max
  Coding DNA Sequence Number=SeqID_39021
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=8e-27, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LQVLAFRGQHALALRGLHPLAFRGLHVLTFKGLHVLTFRGLHALAFRGLDVLAYRGLHALAFIGLHALAFRGLHALAFRGLYVLAFRGLHVQTFRGLHALTFKGLHVLAFRGCTPSLLEGYIPSPSEDYTFSPSEDYTSSPSEGYASSPSEGYTPSPSEGYMSSPPEDYTTSPSEDYTSSPSEDYYDWSVAYIPWPASKRPSPKPR

SEQ ID NO: 155800 - protein, 165 aa, Glycine max
  Coding DNA Sequence Number=SeqID_39022
MEGSVDLAAIDAFLAFHHGKESPVVAILAHEGRIRILSSCEGCPNVPLMGTRGCINYNPVLTVRQLGYPMRGVSSDESITPFITRGFSDHNARDRELRGSSNGIIGGYHKWLRVWTQGLDWLPNLKTVRDNEVKASEESDEVQALKAKLERARVVKEKFKSIAIK

SEQ ID NO: 155801 - protein, 148 aa, Glycine max
  Coding DNA Sequence Number=SeqID_39023
  Gene Ontology: Mol. function=3-dehydroquinate dehydratase activity; Biological process=aromatic amino acid family biosynthetic process
  Homolog annotation: Hit_ID=Q26T71; Match level="QueryCoverage=97%, HitCoverage=96%, E-value=7e-52, Identity=68%"; Hit description=3 -dehydroquinate dehydratase
  Pfam annotation: Domain name=DHquinase_II; Domain location=2-145; Score=188.7; E_value=1.4e-53; Accession=PF01220.9; Description =Dehydroquinase class II
MPQIFFLNGPNANLYGMDRHGTYGSDSFASIGERCQQRADAHGLRLQFRQSNHEGVLVDWIQEARQQADGLIINAAGLSYRSVPILDALLMFDGPIIEAHMSNIWQRESFRHQSLVSKAATGVIAGLGALGYELAIDALATLLQEPSA

SEQ ID NO: 155802 - protein, 58 aa, Glycine max
  Coding DNA Sequence Number=SeqID_39024
MKKENEMKKETSRSGNNLHNLQQKNLKPTTMMTESDDDNNNNNKRLGLERFGHKRKTV

SEQ ID NO: 155803 - protein, 414 aa, Glycine max
  Coding DNA Sequence Number=SeqID_39025
  Homolog annotation: Hit_ID=Q1RTB4; Match level="QueryCoverage=45%, HitCoverage=41%, E-value=2e-08, Identity=25%"; Hit description=IMP dehydrogenase/GMP reductase
MGSDQAPSFEKRFYHVKVKKLELASMRELGQRMDQLASTIEEFEGIFGCPLGERKPYLFSGFYPSMARIAKVVTISEQELDRLKQNRNGVVGIPRKCLEKKTKALINQGEWTSFIDILALLVFGTILFPNVDGLVDLAVIGTFLAYHHSKEISVIAILGDAYDTFDLSVCPLQGHRMCTKKGKANWEELLADMAGLLCSGEGFPNIPLMGMRGIDEANAKILQRIHKAWNTVERKDKELKGSSNGVIDGYHKWLKSWTQGITWLLKLKGLSGKEAKVPEESEEVQALKEELEKMRVVKEKLKMTVTRVRKKCDELRDVNMTTVEALEWETKRAQKEEWSRNKFRGALWGSNNELKLRRAERDELRMESMVLKDKLKACQRAKRSLTEQLSKMEENMLTIIDQYKEKVNLAASHG

SEQ ID NO: 155804 - protein, 1502 aa, Glycine max
  Coding DNA Sequence Number=SeqID_39026
  Gene Ontology: Mol. function=RNA-directed DNA polymerase activity; Cellular component=chromatin; Biological process=chromatin assembly or disassembly
  Pfam annotation: Domain name=Chromo; Domain location=1406-1456; Score= 23.6; E_value=0.00068; Accession=PF00385.14; Description='chromo' (CHRromatin Organisation MOdifier
  Pfam annotation: Domain name=RVP; Domain location=346-450; Score= -11.4; E_value=0.051; Accession=PF00077.10; Description=Retroviral aspartyl protease
  Pfam annotation: Domain name=RVP_2; Domain location=336-464; Score= -33.6; E_value=0.00042; Accession=PF08284.2; Description=Retroviral aspartyl protease
  Pfam annotation: Domain name=RnaseH; Domain location=849-968; Score= -27.7; E_value=0.022; Accession=PF00075.14; Description=RNase H
  Pfam annotation: Domain name=rve; Domain location=1103-1259; Score =97.0; E_value=5.5e-26; Accession=PF00665.16; Description=Integrase core domain
  Pfam annotation: Domain name=zf-H2C2; Domain location=1044-1085; Score=6.3; E_value=0.053; Accession=PF09337.1; Description=His(2) -Cys(2) zinc finger
  Pfam module annotation: Pfam domain module=Chromo::RVP::RVP_2::RVT _1::Retrotrans_gag::RnaseH::rve::zf-H2C2; Domain location=1406 -1456::346-450::336-464::589-758::110-200::849-968::1103-1259::1044 -1085
MADHTTRKTTIDRLEDAITRLSNSHATLLDKHSDLVDKYSEISGKVDSILDHLHLRSPVRDHAGINTQVHQRNTIKLDIPRFDGRDPMGWIFKISQLFEYQHTPEEERIIVASFYLDGAALSWYQWMFRNGFITSWSGFLQALESRFTLAYYEDPKGALFKLTQRGTVNEYLTEFERLANRVIGLPPPFLLSCFVSGLAQDIRREVLALQPISLPQAMALAKLQEDKLRDRRQTPLRSHNTQPTPYLPPPRKPHSTYVQRTPDEMALRREKGLCYNCDEKWSSTHRCKGRVLLFIADNPPLTTEENLPNLPSPPSPDQEPENLLEYDPPLDLNPPHVSLHALSGLPSSETFRLEGIINHTPLTILIDSGSTHNFLQPRIAHFLHLKAQNTNPLRVLVGNGSVLDCNQVCPDTTLSLQGHKFTVTFHLLSISGADAVLGIEWLRQFGPVTTDYTAFSMKFTHLGRPIELKADISTGPKPITAPQVKRLIQTGSASALFHLNLIQNPQPDPNLLLPHPIPAIQCLLNRFHLLFQTSSSLPPPRNIVHHINLLPNINPINVRPYRYPQFQKSEIERQVSELLSVGLIQPSMSPYSSPVLLVKKKDGTWRMCVDFRALNSVTIRDQFPIPTIDELLDELGHAAWFSKLDLRQGFHQILMHGPNVEKTAFRTHQGHYEYRVMPFGLCNAPSTFQAAMNSLLASFLRKFATVFFDDILVYSPTLSSHLEHLEVIFHTLLQGQYHLKRSKCLLAQTQIEYLGHIVSGKGVEPESSKLQAIVQWPTPLSPKELRSFLGLTGFYRKFIQNYAKLAAPLTSLLAKDAFEWSLNAQSAFETLKKAMTNAPVLALPDFDEPFALETDASGTGMGAVLMQKGHPLAFFSKQFGPRMIHASTYVRELHAIVATVRKWRQYLLGQSFTIFTDHKSLRELMSQVVQTPEQHYYLSKLLGFDYTIQYKLGSSNAVADALSRSTPSSSGELLLLSVPNFDFMDDLRRTLHSSQAFRALLSKVQDHPQNHPDYRIHQGLLLFKNRIWLNDDNPSIPALLLEFHATPLGGHLGVAKTTHRLESSFFWASLPKDTERFIKECAVCQQTKADTQRPAGLLQPIPPPTGVWEDISMDFITQLPPSHGYTAILVVVDRYSKGTHLGALPTNHSAFKVASLFIDIVCKHHGFPKSIISDRDPLFLSSFWRELFRLSGMRLRMSTAYHPQTDEQTEVMNRILEQYLRAFVHAQPATWYRYLTLVEWCYNTSLHSSSGLTPFEVIYGKPPPALPQYLQGATANEAVDSILSSRQEIHQKLHKRLHKAQETMKRMADIKRRDVHFTIGQWVYIKLRPFRQRSVTGNIHPKLSKRYFGPFRVTERVGKVSYRLELPKEARIHPVFHCSLLREHHGPPPSPTDTSPLQFMAQKPVARPLCILDSKLDTSSQPPTRLVLVQWEGQPLEDTTWETWSEIRDLHHLEDKVHFTGEGIDSLHDSKANTANSVTLEHAEARPKRTNSKPSYLKDYVL

SEQ ID NO: 155805 - protein, 94 aa, Glycine max
  Coding DNA Sequence Number=SeqID_39027
MEREMITMIVDTLPVLYYKKMMGYMPSSFAYMVFAGERIEVSLRRGKLDYAASTSARNRRTIKGGAKKKERDAYAVTVAPTWPRSKQTPHNPTY

SEQ ID NO: 155806 - protein, 251 aa, Glycine max
  Coding DNA Sequence Number=SeqID_39028
  Gene Ontology: Mol. function=carbonate dehydratase activity; Cellular component=extracellular region; Biological process=one-carbon compound metabolic process
  Homolog annotation: Hit_ID=Q9SL34; Match level="QueryCoverage=98%, HitCoverage=99%, E-value=3e-79, Identity=57%"; Hit description =Putative carbonic anhydrase
  Pfam annotation: Domain name=Carb_anhydrase; Domain location=24-246; Score=44.0; E_value=4.1e-14; Accession=PF00194.11; Description =Eukaryotic-type carbonic anhydrase
MSHEVEDESEFNYDVKSEIGPFNWGHIKPEWSLCKIGSMQSPIDLLNERVQIVSHLGTLQMNYQPSNATLKNRGHDIKLGWLAGTSFLQINGTEYVLKQFHWHSPSEHTIDGRRLDLELHMVHETPSGQTAVIGILYKAGRRPDPFLSLLTNHLKAISNSTGAEREVGVMDPRLVKIGTSTTLYYRYIGSLTTPPCTENIAWTMLKKVKSVSKEQIRLLRDAVHDDFDANARPLQPINNRLVQLNKPKDHR

SEQ ID NO: 155807 - protein, 80 aa, Glycine max
  Coding DNA Sequence Number=SeqID_39029
DRARKTPVDPKKSNRVLGFPALITGLCQFYGVPVAPSKFIKPPINRAFIKKYCAPGKRRARHHSSLGMADSGQQTHCHHL

SEQ ID NO: 155808 - protein, 175 aa, Glycine max
  Coding DNA Sequence Number=SeqID_39030
  Gene Ontology: Mol. function=carbonate dehydratase activity; Cellular component=extracellular region; Biological process=one-carbon compound metabolic process
  Homolog annotation: Hit_ID=Q9SL34; Match level="QueryCoverage=84%, HitCoverage=60%, E-value=2e-44, Identity=54%"; Hit description =Putative carbonic anhydrase
  Pfam annotation: Domain name=Carb_anhydrase; Domain location=41-175; Score=-112.5; E_value=0.00028; Accession=PF00194.11; Description =Eukaryotic-type carbonic anhydrase
MEKLAKQVLFCSLLTALVLLPFPVIMSHLVEDESEFNYDVKSKRGPYNWGNIKPEWSICKNGSMQSPINLLNKRVQIAPHLGKLHINYQPSNATLRNRGHNIMLEWLAGTSYLQINETQYVLKQFHWHSPSEHTIDGRRFDLELHMVHEASSGEIAVIGMLYKAGRPDPLLSLVN

SEQ ID NO: 155809 - protein, 127 aa, Glycine max
  Coding DNA Sequence Number=SeqID_39031
MPEDIPIARLETKWTQDDFMELNTKARSTLTHTLTRNKYKKICRLKTSKEVWDSLCVSYEGIEDVILRKDATLMRHSRRLQIIYLARILLPLTMEKQAPKEKKRSAPPKLSKFKWLNLKHQKIALVD

SEQ ID NO: 155810 - protein, 103 aa, Glycine max
  Coding DNA Sequence Number=SeqID_39032
  Gene Ontology: Mol. function=isomerase activity; Biological process =carbohydrate metabolic process
  Homolog annotation: Hit_ID=Q9LVC5; Match level="QueryCoverage=56%, HitCoverage=18%, E-value=3e-16, Identity=66%"; Hit description =Apospory-associated protein C
MSNEKAPSSASSSSYELSKGINGLDKVILRDARGSSAEVYLYGAHVTSWKNDHAEELLFLSSKLADFPPLHVKMKGGREDLINFRSDLSEVVKYQFSLKTFIG

SEQ ID NO: 155811 - protein, 574 aa, Glycine max
  Coding DNA Sequence Number=SeqID_39033
  Gene Ontology: Mol. function=RNA binding
  Homolog annotation: Hit_ID=Q9SVZ7; Match level="QueryCoverage=97%, HitCoverage=72%, E-value=4e-55, Identity=32%"; Hit description =Pumilio-like protein
  Pfam annotation: Domain name=PUF; Domain location=506-537; Score =23.0; E_value=0.0011; Accession=PF00806.9; Description=Pumilio -family RNA binding repeat
  Pfam annotation: Domain name=PUF; Domain location=539-573; Score=8.4; E_value=0.55; Accession=PF00806.9; Description=Pumilio-family RNA binding repeat
  Pfam module annotation: Pfam domain module=PUF::PUF; Domain location =506-537::539-573
MATENPIRISEAGSKWPFHGRGKDVVPNSSGSAPPSMEGSFLAIESLLSQNTTWNASLGSLNRDMQKDDSGKGSLYLSRGTLATHKEESEDYSTQQMYDNELDKAIGKWHRQDVASTSSQHTHLVMEDFPHNMSPVYNKFLGVVDELIGIDTGSSSSHGPPVTTVDAVKPTIGADDIRLSSTVDSPAPVTSSSSLNSTGSMGFNDLHVTIVESQLRALSVSNLPNSESRSYEDKWENSFQNNLMQHQLQNYPCEVPSTNSQSEKCTYVGMEQFLHNPSKFSSDVQPASGIYSLQYVGAYPFSPTAVPPYIAAYPPHGSVPLVDGATGSSFTPQAPGVSSTAGNNSHGAEMMHAIKFFGQFGFPLQPSFGDPIFMQYHQQPFAEGYGVSGHLLAPRASVGGQIGGLIHPGYFGHPSNLGFVPQYPSSPLSRPVLSGYPESRNGVKIWQRRASPGAAVKLCLGDLLVMGSNPKTAFLHMQGTAQHGSCFIQQKLESCCVKEKELVFKEVLPHTSKLMTDVFGNYVIQKYGSPEQRKELANRLLCQIPPLGLQMYGCCVVQKGIDEAVSTWDLVIVV

SEQ ID NO: 155812 - protein, 906 aa, Glycine max
  Coding DNA Sequence Number=SeqID_39034
  Gene Ontology: Mol. function=actin binding; Cellular component =cytoskeleton; Biological process=cytoskeleton organization and biogenesis
  Homolog annotation: Hit_ID=Q1T1I1; Match level="QueryCoverage=99%, HitCoverage=96%, E-value=0.0, Identity=69%"; Hit description=Villin headpiece; Gelsolin region
  Pfam annotation: Domain name=Gelsolin; Domain location=11-94; Score =88.0; E_value=2.8e-23; Accession=PF00626.12; Description=Gelsolin repeat
  Pfam annotation: Domain name=Gelsolin; Domain location=214-289; Score= 36.7; E_value=8.1e-08; Accession=PF00626.12; Description=Gelsolin repeat
  Pfam annotation: Domain name=Gelsolin; Domain location=364-443; Score= 18.8; E_value=0.0094; Accession=PF00626.12; Description=Gelsolin repeat
  Pfam annotation: Domain name=Gelsolin; Domain location=596-676; Score= 46.4; E_value=9.5e-11; Accession=PF00626.12; Description=Gelsolin repeat
  Pfam annotation: Domain name=VHP; Domain location=871-906; Score =65.4; E_value=1.9e-16; Accession=PF02209.10; Description=Villin headpiece domain
  Pfam module annotation: Pfam domain module=Gelsolin::Gelsolin::Gelsoli n::Gelsolin::VHP; Domain location=11-94::214-289::364-443::596 -676::871-906
MSGLEIWRIENFNPVPIPQSSYGKFFTGDSYVILKTTASKSGALRHDIHYWLGKDTSQDEAGAAAIKTVELDASLGGRAVQYREVQGHETEKFLSYFKPCIIPQEGGAASGFKHVEAEEHKTRLFVCKGKHVVHVKEAKRAKALEVVQYVKDTYHDGKCEIASIEDGKLMADSESGEFWGCFGGFAPLPRRTVSDDDKPADSHPPKLLCVDKGKAEPIETDSLTKEFLDTNKCYILDCGLEVFAWMGRNTSLDERKSASVAADELIRGTGRPKSHIIRVIEGFETVMFKSKFDSWPQASDAPMSEEGRGKVAGCHYVPLILSLLGNFLALLKRQGLDVKGLVKSEPKQEEPQPHIDCTGHLQEKILLPATDQSKFYNGDCYIFQYSYPGEDKEEHLIGTWIGKTSVEEERASALSLASKMVESMKFLPSQARIYEGSEPIQFHAILQSCIVFKGGLSDGYKNYIAEKEIPDETYNEDGVALFRIQGTGPDNMQAIQVEPVASSLNSTYCYILHSGPTVFIWSGGLATSDDQELVERMLDLIKNIPVKRSRGMLKMILTYFLATSQKDLGHNLSAKWLWSSWRPLKTDSGRRMLTENWPVKEIHNFSQDDLMTEDIYILDCHSEVFVWVGQQVDSKNRMQALTIGEKFLEHDFLLEALSREAPIYIVKEGSEPPFFTRFFKWESAKSAVNARKLISKEACNREKWGSSGAPDKSQRSRSMSVSPDRVRVRGRSPAFNALAANFESSNARNLSTPPPMIRKLYPKSVAKDTAQLVPKSSAIAHLTSSFEPFSALENLIPQSQKANSVTPKSNPETSDKEGSMSSRIESLTIQEDVKEGEAEDDEGLPVYPYERVNTASTDPVEDIDVTKREAYLSSAEFQEKFGTAKNEFYKLPKWKQNKLKMAVQLF

SEQ ID NO: 155813 - protein, 239 aa, Glycine max
  Coding DNA Sequence Number=SeqID_39035
  Gene Ontology: Mol. function=transferase activity
  Homolog annotation: Hit_ID=Q1T1H8; Match level="QueryCoverage=80%, HitCoverage=62%, E-value=3e-73, Identity=71%"; Hit description =Glutathione S-transferase, C-terminal-like
MAELNTLVVRKPCFGLPTGCTQSLSAYIYLKFAQIPFQLDFHLNNPHSNQIPYFEVGDSVAYNNEKEGIIECLKKDVGVVDLDSGVSSLPEWISTKAILTTWLADALAYELWLGCEGSSAYSIYYSDLPWPLGKILSWKKAIWVKLKHGITNDNAEVKKEEIYERAKSAYEALSSCLGEQNYLFENRPSSLDAIFLAHGLVVLHALPLVAVVVFLTLMTSFDDAEVELDDDDGSYDYDE

SEQ ID NO: 155814 - protein, 455 aa, Glycine max
  Coding DNA Sequence Number=SeqID_39036
  Gene Ontology: Mol. function=transferase activity; Cellular component= nucleus; Biological process=flavonoid biosynthetic process
  Homolog annotation: Hit_ID=Q1T1I0; Match level="QueryCoverage=98%, HitCoverage=96%, E-value=1e-161, Identity=63%"; Hit description =Transferase
  Pfam annotation: Domain name=Transferase; Domain location=1-450; Score=490.1; E_value=2.7e-144; Accession=PF02458.6; Description =Transferase family
MPVTLKACYTVKPIETTWCGRVSLSEWDQTGNVTHVPIIYFYRTPSQESNNNSIASTLKDSLSRVLVPFYPLAGRLHWINNGRLELDCNAMGVQFIEAESSSSFEDLGDDFSPSSEYNYLVPTVDYTLPIHGLPLVLIQLTNFKCGGVSIGITLSHAVVDGPSASHFISEWARLARGEPLQTVPFHDRKVLHAGDPPSVPLARCHSHTEFDEPPLLLGKTDNTEERKKKTAMVILKLSKTQVETLKKTANYGGYGNDSYSRYEAIAGHIWRSACKARGHKEDQPTTLTVIVDSRSRMEPPLPKGYFGNATLDTVATSLAGDLVSKPLGYASSRIREAIERVSDEYVRSGIEFLKNQEDLRRFHQDLHAIESEKKEPFYGNPNLAVVSWLTLPIYGVDFGWGKELYMSPATHDFDGDFVLLPGPDGDGSLLVCLGLQVEHMDAFKKHFYEDIESKS

SEQ ID NO: 155815 - protein, 144 aa, Glycine max
  Coding DNA Sequence Number=SeqID_39037
MLQPYGINIGLKEHSNPVTPKAYTPKSPSGPLPLDSAYNKSNVTSSVNYTLIHNQNSFTISHLIVSQSTITCLHAHVSLDSDISISSGSLRFLQFFPLTAPIEFPNVRETEKGLKPPLVLSSCDSFFYLHEYYLANPNSEGVQN

SEQ ID NO: 155816 - protein, 136 aa, Glycine max
  Coding DNA Sequence Number=SeqID_39038
MTTLAQTWSVLSFSILIPTSHTSDVTFDRAKLIYGIIMKIDMNVGKARGKRSEAPSTLASEAPTPSSSTVPPSSSTQIPFIPLVAWPGDQPSSSRGGGASAAQEPDIEEPPEPAEEETDPDQTHPSTPIAEPEQPI

SEQ ID NO: 155817 - protein, 382 aa, Glycine max
  Coding DNA Sequence Number=SeqID_39039
  Gene Ontology: Mol. function=hydrolase activity; Biological process =nucleotide metabolic process
  Homolog annotation: Hit_ID=UPI0000699D51; Match level="QueryCoverage =55%, HitCoverage=68%, E-value=1e-34, Identity=35%"; Hit description =probable nucleotide pyrophosphatase-like protein
  Pfam annotation: Domain name=Metalloenzyme; Domain location=128-229; Score=-20.2; E_value=0.016; Accession=PF01676.8; Description =Metalloenzyme superfamily
  Pfam annotation: Domain name=Phosphodiest; Domain location=14-317; Score=-6.1; E_value=2.2e-08; Accession=PF01663.12; Description=Type I phosphodiesterase  nucleotide pyrophosphatase
  Pfam module annotation: Pfam domain module=Metalloenzyme::Phosphodiest ; Domain location=128-229::14-317
MAVIVSCFLSAQTKKVLFIGIDGCRADVMMSSDTPNIKSLITKSVYSLDGLCAATTWSGNGWSTMLTGVWHTKHNVQDNNFTNPNYVNYRDFLTRAEAYNSNLRTISLVHWSPINDIIIKNADVKTNFSTDLAVKNAAVDALQNDNPDILFVDFDDVDHAGHSYGFSSTVPQYVSSMQTTDTYIGEIVNAMKNRSTYNNEDWLVVLTTDHGAVNNGHGGGNLSERNIFTIYSNPNLTPQQISKTDIDSNITFNQLNFPAGTYAKPTNQVPFNFGANQDFTIEFWVKPNASFSSDPVMISNKNWNSGKNKGFVISGYSGQTYKVNIGDGTNRIDLVGGKMETNKWKHIAVSFDRDGLVTLYEDGVPVTFAKMIQSEILIQGFR

SEQ ID NO: 155818 - protein, 254 aa, Glycine max
  Coding DNA Sequence Number=SeqID_39040
  Gene Ontology: Mol. function=RNA-directed DNA polymerase activity; Biological process=RNA-dependent DNA replication
MPPNVVYTPNENVNNSTPILIKSQQPQSDHAHVSRPIGETHEMPHHNLANFEPCLGYATEGQAVGDIPLQNTLEDPQYHPQPHLFHSIAGKNPHAMTEMGNLDHLEKRLRVIEGGEDYAFANLEELFLVPNIITPPKFKVSDFDKYKGTTCPKNHLKMYCRKMGAYAKDEELLIHFFQEILTGVVVTWYTNLEPSRVHSWKDLMVALLGSISTILIWLRMQLQNVCKKGHESFKEYPQRWRDLAAQVAPPSGIL

SEQ ID NO: 155819 - protein, 231 aa, Glycine max
  Coding DNA Sequence Number=SeqID_39041
  Gene Ontology: Mol. function=transcription regulator activity; Biological process=regulation of transcription
MERLRSVQSKKHHCCPNSFLDQMEGQVAKRRRVYSVEPNQIVQSIFTRNYLNHLVPALVKIKEKSSVEEDRRHCDDINNAVKYEVDMAMVLSAQGFAWSNGLKDKLQSDDVHVNAAKSTSFLENDEAGEGSSSKNAYDKNEVVLPMEYFSSNPSSKSKCKDMSEMKRDLAREDDDKEDEDISNQWKKLRRLIPGGEEMCDDEQMVSELESYISCLQMQVNALQFLCHTRVS

SEQ ID NO: 155820 - protein, 150 aa, Glycine max
  Coding DNA Sequence Number=SeqID_39042
MARRDKLWSLCALLSSRGGEPDDMRRQIMVIPDTFSPFRHDRVRWHAKMVILRLLSSRGGEPDDMRRQIMVIPDTFSPFRHDRVRWHAETNYGHYAPFCHPEVVSPMTCGDKLWSFWTPFRHPDTIVSDGTQRQIMVILRPFVIQRRRAQ

SEQ ID NO: 155821 - protein, 192 aa, Glycine max
  Coding DNA Sequence Number=SeqID_39043
  Gene Ontology: Mol. function=isomerase activity; Cellular component =cytoplasm; Biological process=carbohydrate metabolic process
  Homolog annotation: Hit_ID=Q9LVC5; Match level="QueryCoverage=98%, HitCoverage=75%, E-value=2e-75, Identity=60%"; Hit description =Apospory-associated protein C
  Pfam annotation: Domain name=Aldose_epim; Domain location=2-172; Score=-2.5; E_value=7.2e-08; Accession=PF01263.10; Description =Aldose 1-epimerase
FSNLGPLDSHGFARNQFWTIDDSPPPFPTSTSNKAFVDLILKPSEDDIKIWPHSEVRVEGLETLDYLDNLQKRERFTEQGDALTFESEFDRIYLSTPTKIAILDHEKKRTIVLRKDGLPDAVVWNPWDKKAKAISDFGDDEYKYMLCVEAAAIEKPITLKPGEEWKGRLELSTVSSSYCSGQLDPKRVIQGS

SEQ ID NO: 155822 - protein, 474 aa, Glycine max
  Coding DNA Sequence Number=SeqID_39044
  Gene Ontology: Mol. function=transporter activity; Cellular component= integral to membrane; Biological process=cell division
  Homolog annotation: Hit_ID=Q7WCS7; Match level="QueryCoverage=72%, HitCoverage=33%, E-value=1e-127, Identity=67%"; Hit description =Integral membrane component of multidrug efflux system
MIDKGTRTLLVHATLGNSDNRLSPGVLVKGSISLPDPQKIVSVPETAINYNAYRDFIYVIDKNDENKLIARQVYVKTGGRDGSYVAIVEGIKAGVRVITSGQLRINNGAPVEIASVDTLATEDQSAHSVAHTLIFLMGLLALNNLPVRQYPLTESSTLTITTQYPGASPQLMQGFVTQTIAQAVATVEDVDYMTSTSTQGRSVIMVRMKLNADSNKAMTQIMAKVSEVKYRLPAEAYDPVIVKSSGDATAVAYVGFSSPTMSTAALSDYVSRIVQPQLSSIEGVGSLDLNGGQRMAMRVWLNAEQMAARGIAAGDVSRALLENNVQAAPGQAKGLYVVSDIQVNTDLVSVDEFRNMVVKRTINGVVYLRDIATVELGAASTNTSALMDGVNAVYFGLNAAPNANPLVIVKKLNEILPEIKKNLPPDVTVAVPFELARFISASIDEVVHTLIEAIVIVIFVIFLSLGSARAVIIP

SEQ ID NO: 155823 - protein, 135 aa, Glycine max
  Coding DNA Sequence Number=SeqID_39045
  Gene Ontology: Mol. function=solute:hydrogen antiporter activity; Cellular component=integral to membrane; Biological process =regulation of pH
  Homolog annotation: Hit_ID=Q476C2; Match level="QueryCoverage=95%, HitCoverage=63%, E-value=3e-22, Identity=62%"; Hit description =Na+/H+ antiporter
MDGAYFTAVASFRQHISGILLLAVGAVLFTTLCIGVVVHFLIPTLPWAACFVLGAIVSPPDAVSARAILNKCARGGSAKLGWDARYCNNGSSVYTTGRISWSRFNVDYGFLGHCGNRYAARCLARLDDPVVKTAR

SEQ ID NO: 155824 - protein, 322 aa, Glycine max
  Coding DNA Sequence Number=SeqID_39046
  Gene Ontology: Mol. function=sequence-specific DNA binding; Cellular component=intracellular; Biological process=regulation of transcription, DNA-dependent
  Homolog annotation: Hit_ID=Q1MJE5; Match level="QueryCoverage=95%, HitCoverage=98%, E-value=7e-76, Identity=49%"; Hit description =Utative AraC family transcriptional regulator
  Pfam annotation: Domain name=Cupin_2; Domain location=19-94; Score =5.2; E_value=0.08; Accession=PF07883.2; Description=Cupin domain
  Pfam annotation: Domain name=HTH_AraC; Domain location=204-250; Score= 37.8; E_value=3.8e-08; Accession=PF00165.13; Description=Bacterial regulatory helix-turn-helix proteins, araC family
  Pfam annotation: Domain name=HTH_AraC; Domain location=256-300; Score= 41.5; E_value=2.9e-09; Accession=PF00165.13; Description=Bacterial regulatory helix-turn-helix proteins, araC family
  Pfam module annotation: Pfam domain module=Cupin_2::HTH_AraC::HTH _AraC; Domain location=19-94::204-250::256-300
MDPLSALLGLLRVTNYHSATLSLGGNWAFDFPQRGGIKFTAVVKGSCLLKVDGESTLQRLHQGDCFLMTRGVPFQLYSDTSLPPMDSNDYIVHRGEREIALHYNGDDVQLVGGRFEFTGMPARVLLEMLPPVVHVHGESLQASALRWLLERLSQELHETKYGRSLIAEHYAHIMLVEVLRVHLASRSHHDIGWFSALADKQLGAAIAAVHNALSFPWTVDNMANRANMSRSAFAHRFKDVVGLSPMEYLTRWRMLQACDMLKNGELSISTIAFELGYQSESAFSNAFKRIMTLSPRHYQRLPATGMRILPPISLTASPDMHQ

SEQ ID NO: 155825 - protein, 76 aa, Glycine max
  Coding DNA Sequence Number=SeqID_39047
MQGSQRNREGRIGGFILYRILEISFEDSAPIKLFIFVRWSYDKQRRLVAVISACNTRLGEFGSPGRADPAPNFLLW

SEQ ID NO: 155826 - protein, 190 aa, Glycine max
  Coding DNA Sequence Number=SeqID_39048
  Homolog annotation: Hit_ID=Q1SKA8; Match level="QueryCoverage=59%, HitCoverage=44%, E-value=2e-07, Identity=31%"; Hit description=Zinc finger, CCHC-type
  Pfam annotation: Domain name=zf-CCHC; Domain location=97-114; Score =28.5; E_value=1.9e-05; Accession=PF00098.13; Description=Zinc knuckle
MSLATFFGKLEEHEMELMRLYQHEENDKKKKGIALKASSSSIHEENDKEDSNEKNLEEDDDFSLFVKRFNKFLRNKGNQRRPNFNPKKKGEDFSLVPKCYECNQPGHLRFDCPIFKRRMEKLDKKTFKDKKEKKAYITWEDNDMDSSSDSENEIINLSLMTCHTLILFGDYHSRILTSQTALFNTSYHTR

SEQ ID NO: 155827 - protein, 158 aa, Glycine max
  Coding DNA Sequence Number=SeqID_39049
MVPNALLTRKKVVLRASHVDLIIMKECALRCPYRTRAKARVMSEIEEVQEQMKADVEAMKEQMTTMMKAMMSMKRMMEVNVAIVIAASTATEVDPTHPSGSFKTRIPSHHMACLPTIHHPMLHTLPMRMSTTPHPCPLRANNPNLIMHMSLNPWGADT

SEQ ID NO: 155828 - protein, 150 aa, Glycine max
  Coding DNA Sequence Number=SeqID_39050
  Gene Ontology: Mol. function=tRNA binding; Cellular component =extracellular space; Biological process=translation
  Homolog annotation: Hit_ID=Q6CKI6; Match level="QueryCoverage=63%, HitCoverage=26%, E-value=1e-13, Identity=42%"; Hit description =Kluyveromyces lactis strain NRRL Y-1140 chromosome F of strain NRRL Y- 1140 of Kluyveromyces lactis
  Pfam annotation: Domain name=tRNA_bind; Domain location=94-150; Score= -3.7; E_value=0.0004; Accession=PF01588.10; Description=Putative tRNA binding domain
  Subcellular localization annotation: CTP_CleavageSite=60; ConfidenceScore=5.90e-01
MANALRVGSVISLCSLRNTRPHLPLLSNATRFRSKFPFFTLSSSPNPSGYPPFRTLSSSSASTDEAVTTEAITSNNASGEAENSIKDAAGLLDMRVGCILRAWKHDEADSLYVEEVDIGEPEPRIICSGLVKYIPLEHLQFRRNTNCMSN

SEQ ID NO: 155829 - protein, 176 aa, Glycine max
  Coding DNA Sequence Number=SeqID_39051
  Gene Ontology: Mol. function=RNA-directed DNA polymerase activity; Biological process=RNA-dependent DNA replication
MKNRMWIKGLVLGRWMVGGWGVAEGEVSKTVPYFSTTSTHPTNGDNIKYRLGMEVSMEERLTVHVQQQDIWRWEGDSSGKYTMGSAYELLNSNLSMESQDETFKALWKIKVPSKASIFTSRLIREKLPTKNNLRRRNVETNNVSCPFCRSHDEDEDETHLFFTCAKILSLWWESQS

SEQ ID NO: 155830 - protein, 67 aa, Glycine max
  Coding DNA Sequence Number=SeqID_39052
MEFDLVFACVKVPNKLLKVVRVSTSAQYVDILTKALSPSNFELLRFKLTMCDSSASLRPHPEFAREY

SEQ ID NO: 155831 - protein, 377 aa, Glycine max
  Coding DNA Sequence Number=SeqID_39053
  Homolog annotation: Hit_ID=Q1SD87; Match level="QueryCoverage=96%, HitCoverage=58%, E-value=3e-56, Identity=42%"; Hit description =Regulation of nuclear pre-mRNA protein
MTSVTGNQLGSTLVNDLQEQENELKQYMVQLENAEAARATLLSQLKDALQEQESRQELVHTQLLHPIISLKFVSPWSLNIIDLETPIPKILQHIFKPRFLDGQAAQGQIEQAASIRKRFTVAPEATRALEQNLPSVQPNNTPLQPSFTQPPISFAPPQTTEEDKKAAAAAVAAKLAASTSSALMLTSVLSSLVAEEAASMNGSLNSTGFTSGLPVFRPEKRQKLEKQMHASEFNSTDMGSSSFLGTLQQPSVANVPLTHSISLQPIPQPNQSQAAFASGPPPPHSPVNPPANQFVQSTGLMVGGIPYGYGSNNLPPPPPPPLPPHVAMGLSMAGMQPSQSQAQQQQPSATGGFYRPPDIGFYGQSHSSTQPAPVPRQ

SEQ ID NO: 155832 - protein, 87 aa, Glycine max
  Coding DNA Sequence Number=SeqID_39054
  Homolog annotation: Hit_ID=Q1SRN1; Match level="QueryCoverage=83%, HitCoverage=5%, E-value=4e-17, Identity=61%"; Hit description =Integrase, catalytic region
MKNKIMGQGNSAYIVTMNDKNHVLDSNFREKRLKPRDFSCDQSKASSLEQATTVCFFGHQETRLGPKNTQAPDVDLLSSGSEAQSAS

SEQ ID NO: 155833 - protein, 173 aa, Glycine max
  Coding DNA Sequence Number=SeqID_39055
MTRTHAKKTKEALNQIHKGVARCTQQHCKCTQHFYKMCRVLYFMFHAFFLSFWSGFCRSWWFFASVERGSGSVKVKVLFGGVLISTEDVTYIRSSFVRFLRKNFFRNCKKFLTEEGIIIKMDEDQWTYDSTMSQEVDMDFENKQQCGVNQPHVDCSDVFNTSQGCVVGLWYPR

SEQ ID NO: 155834 - protein, 480 aa, Glycine max
  Coding DNA Sequence Number=SeqID_39056
  Gene Ontology: Mol. function=RNA-directed DNA polymerase activity; Biological process=RNA-dependent DNA replication
MVGSDINGSDPKWKARWEVQPACNSARGLLCIWNEETFRLENKLIGDGFIYLEGTWHADGGKVLIDEGIMKEFNEWIADLGVEEVSSVGRRFTWYRPNGTAKSRLDRVLVSTKWFAKWKGSTQLIMDHNFSDHCPILLRSTCANWGPKPFRTLDYWFKDKSFRKIVRDSWTTNDFGDMPQKIRMEMEMNKLEIEGENRQFNDEKIKRVKEEIRHFFRKRFEETKWERPKLDGDCGSEKSPRPDGLNFKFIKEFWDVIKPDLMRFLDEFHVNGVFPKGTNASFLALIPKKVLPTIIDEQQTTFVEGRHLLHSMVIANEVIDEAKRCNKSCLAFKVDYAKAYNSVCWEFLLPTAEFIPQRGLKQGDPLAPFLFNIVVEGLTGLMREAQEKNLFEGYKVQEKYYANDTIFFGTATWENIRAIKVMLRSFELDVEESGGQTSGAVEAVFVGWKLRPEEDCLGELGYSLSTIEEREFGYKGFMDV

SEQ ID NO: 155835 - protein, 223 aa, Glycine max
  Coding DNA Sequence Number=SeqID_39057
MASPIDIGIDRIQSTMDDRIWNLVPKDRRGHAIGHRSYDQRCQNQVSKCLEWRGLGDKGYRITKLSHNSHRRDKLLGSSEPEEIKILSGRKSHQQVGHSLGRWPERVAGDRGRQLEGLSGWVMLEKKKADAAPIWRLDVKHRCCGGHKRAGDARKRERRHMAAYQAVVGGRSDGVGLAGEGHFYCGGSLEKKHHGGRKRGHAMRWVLFTHKELHYCRSQPKEL

SEQ ID NO: 155836 - protein, 37 aa, Glycine max
  Coding DNA Sequence Number=SeqID_39058
MWDIPFIPEPNQTLTYVMSSRSTSLEPKSQLTINLDP

SEQ ID NO: 155837 - protein, 199 aa, Glycine max
  Coding DNA Sequence Number=SeqID_39059
  Homolog annotation: Hit_ID=Q1SDS1; Match level="QueryCoverage=58%, HitCoverage=23%, E-value=5e-09, Identity=33%"; Hit description=IMP dehydrogenase/GMP reductase
MVEASVNWFPRWKEGRVGVLSSCEGFSNIPLMGTRGCINYNLVLAIRQLGYPMRGALSEESIMPFIARGFSDPKARIFQGVRKAWSVVKRKDKELRGSSNGIIGSYHKWLKARTQELVWLPKLKASSEEEAETPEESKEVQALKAELERAQAIKEKFKMIAIKVWKEYDELRDINVATAEALERETKRARKEEWGRNKF

SEQ ID NO: 155838 - protein, 244 aa, Glycine max
  Coding DNA Sequence Number=SeqID_39060
  Gene Ontology: Mol. function=sequence-specific DNA binding; Cellular component=intracellular; Biological process=regulation of transcription, DNA-dependent
  Homolog annotation: Hit_ID=Q12CS5; Match level="QueryCoverage=46%, HitCoverage=41%, E-value=2e-37, Identity=74%"; Hit description =Transcriptional regulator, AraC family
MGDDIAEGAVGQGGEQAAVGHAVHVAVGRADAHGQHVVGRAPVEAAQVRQVAHELAAGLPRREAGGDGVCHGMRKADGARQRRPVATGERTISAAAGAAVAPALHSAHAIVRFSAPRMNRIKTYGMAERADYFDFDIRAQQVREPLEQPHRHEYFQIQRHHAAVSARRAELRAAVPGAPGAASARRALRHHQFRAALPVAGAGGGRAGPGGRAGVAGAGAGAVPVPGIPGFSSWTRRGWPRPRR

SEQ ID NO: 155839 - protein, 78 aa, Glycine max
  Coding DNA Sequence Number=SeqID_39061
MRTVKRRKRRKESTLAEPRNVVGFGSKNPCAFFMVLPDLIWTRNEQDMAETRIGNEGAGTCCNRLQHLVIDYTLLNCL

SEQ ID NO: 155840 - protein, 51 aa, Glycine max
  Coding DNA Sequence Number=SeqID_39062
FSSEGRDYGKLGFWLKVCRTAGHDICQDVGLASGSGKKEMSHIISMIHMQH

SEQ ID NO: 155841 - protein, 127 aa, Glycine max
  Coding DNA Sequence Number=SeqID_39063
  Subcellular localization annotation: CTP_CleavageSite=47; ConfidenceScore=5.04e-01
MESGDMRGYHMVIRTFRQPGANEPVDAQRLTSSSTPFVILTHGVKRSSSMAWGSVVVPLGQLSYPNFIREPLFGGMQPLLEHLEGVQIATKPTCAFQEVPTEGGAFWWKQPSSPGQAGRQPPPSFLL

SEQ ID NO: 155842 - protein, 240 aa, Glycine max
  Coding DNA Sequence Number=SeqID_39064
  Homolog annotation: Hit_ID=Q47EW0; Match level="QueryCoverage=40%, HitCoverage=12%, E-value=7e-18, Identity=52%"; Hit description=Heavy metal efflux pump CzcA
PTAARADRWRAGGAADEPGHGGQPRQRTAVGGYWRSGPPVVAAGCTGEPGRTLEGGHAGARRAGQPRTRFQGGAVRARPGGVAGRGRCLAARCGRVVDRRQAGGVRGGGQGPLRASRGRPAAAAAGGQRACRRQQRHGARRPMIDRLIAYCLRQPLMVMLALLLFIGAGIAAFRVLPVEAFPDVSDTQVTVVSLHPGRAAEEVEREVTMPLEVALSGAGTPAGRGTAGRGNAGTGGDELG

SEQ ID NO: 155843 - protein, 121 aa, Glycine max
  Coding DNA Sequence Number=SeqID_39065
  Gene Ontology: Mol. function=isopentenyl-diphosphate delta-isomerase activity; Biological process=isoprenoid biosynthetic process
  Homolog annotation: Hit_ID=Q46822; Match level="QueryCoverage=96%, HitCoverage=65%, E-value=3e-43, Identity=65%"; Hit description =Isopentenyl-diphosphate Delta-isomerase
PGVWTNSVCGHPQSGEETVQAIIRRCRFEVGAELTDITAVAPEFRYRETDPSGIVENEICPVFAARITNDVTINEDEVMDYQWVELDALFRALDATPWAFSPWMVMEATTAREKLKAFAAQ

SEQ ID NO: 155844 - protein, 164 aa, Glycine max
  Coding DNA Sequence Number=SeqID_39066
  Homolog annotation: Hit_ID=Q6GWV0; Match level="QueryCoverage=51%, HitCoverage=42%, E-value=6e-07, Identity=47%"; Hit description=MADS -box protein
  Pfam annotation: Domain name=K-box; Domain location=70-159; Score =57.2; E_value=5.3e-14; Accession=PF01486.8; Description=K-box region
  Subcellular localization annotation: CTP_CleavageSite=35; ConfidenceScore=5.56e-01
MNHFSRLPSLGTDVWGANTFPVRKYNSRTFHLKVRRSRLFRFFRRFPQINVGGDSARIPFVEHASRESRVALPPKAFEARGSKHDEEDWPSLSCKTSLRKFLGEGLGACSIEELQWIQQQLERSLSNVRARKIQVFKEQIEQLKEKEKVLLDENAKLTENGTHI

SEQ ID NO: 155845 - protein, 213 aa, Glycine max
  Coding DNA Sequence Number=SeqID_39067
  Homolog annotation: Hit_ID=Q1RYJ7; Match level="QueryCoverage=87%, HitCoverage=20%, E-value=8e-30, Identity=56%"; Hit description =Timeless protein; Timeless C-terminal
MGKPVRINCQKAILMMKCSALFSRPLSTSPNQLDGDKITGATNHKSVNFEGSLLVQHLFKDHRRCSYMIANALDKDGKFTTAQVSRKLKQLGLYLPLPKDGKFTSAQGWECHYINAEYLLSELGHLKKESANWNNTLGDEEIGSSPAKVWTQDIKNKLDVIKGFAPTFGSNSDKDDHNGEQLMEDESQIALRRRKKLVLDGDLERQIKDLHEK

SEQ ID NO: 155846 - protein, 434 aa, Glycine max
  Coding DNA Sequence Number=SeqID_39068
  Gene Ontology: Mol. function=DNA binding; Cellular component=beta -galactosidase complex; Biological process=DNA integration
  Homolog annotation: Hit_ID=Q1SS72; Match level="QueryCoverage=89%, HitCoverage=51%, E-value=2e-40, Identity=48%"; Hit description =Integrase, catalytic region
MDILQTFQIIEEVEQALVALLAEGVLQAEAISIMVNKHDQVTWIFDSGAIDHVISSLKYFASYREIIPIVVKLPNGQQTTTTFSGTIQLTNSLFPYDVLYLPHFTFNLVSISKLASFLRCQLIFSVDKCLIQDIITKKMSGIVDAKDGLYKLKIPSSTITSNRKKLDPRALPCVFLGFKPHKKGYITFNLKTRAIEISRNVVFYEDYFPYFDDSSVTTDLHLLSHPPFIYHDNSPAPLQPPTSVHSESESSISHFASVESDVSTHDTSSSVENQPQLRRSDRPKSRPKRFFDFQTKFASTMTSHSSVAKITIVRILLAIAATQNWHLKQLDVNNAFLHGDLNEEVYMVLPPRMKASKPGQVCRLQRSLYDLKQASRQWYARLSTFLISQGYHQSVSDYSLFTMHQGSSITVLVVYVDGIVLSGNDLAEIKHITM

SEQ ID NO: 155847 - protein, 539 aa, Glycine max
  Coding DNA Sequence Number=SeqID_39069
  Gene Ontology: Mol. function=kinase activity; Cellular component =intracellular; Biological process=intracellular protein transport
  Homolog annotation: Hit_ID=Q2V732; Match level="QueryCoverage=60%, HitCoverage=45%, E-value=1e-85, Identity=51%"; Hit description=VHS and GAT domain protein
  Pfam annotation: Domain name=GAT; Domain location=202-301; Score =109.0; E_value=1.4e-29; Accession=PF03127.5; Description=GAT domain
  Pfam annotation: Domain name=VHS; Domain location=3-136; Score=107.6; E_value=3.8e-29; Accession=PF00790.9; Description=VHS domain
  Pfam module annotation: Pfam domain module=GAT::VHS; Domain location =202-301::3-136
MANNAAACAERATSDMLIGPDWAINIDLCDIINMDPGQAKDALKILKKRLGSKNPKIQLLALFVLETLSKNCGESVFQQIVERDILHEMVKIVKKKPDLNVREKILILIDTWQEAFGGYGVYPQYYAAYNELKSAGVEFPPRDENSVPFFTPAQTQPIIHSAAEYDDATIQASLQSDASDLSYPIPHTHTVNNDAVWPAVMLSMTAIPCLLEIQNAQGLADVLMEMLSALNPKDREGVKEEVIVDLVDQCRSYQKRVMLLVNNTTDEQLLGQGLALNDSLQRVLSRHDDIVKGTADSGAREAETSVLPLVNVNHEDDESEDDFAQLAHRSSRDTQAPNRKPAYDKAEPGRINPLIPPPPASKKPVYSGTGMVDYLSGDTYKTEGSPENSEPTSIAAPLHSSPNPTSSTIPSLSSSRPHAMSTSSPILSSQPVYDEQPSSVDKSSEGLPAAPWDAQSPGIIPPPPSKYNQRQQFFEQQGASHSSSGSNSSSDSLVGQTQNLSLNSSSPTKQQKPEDALFKDLVDFAKSKTSSSSKPNRSY

SEQ ID NO: 155848 - protein, 312 aa, Glycine max
  Coding DNA Sequence Number=SeqID_39070
MLDPRTHHPTNSFELYDAAPHKPHTWEATNSSGLWPSKPAFEEVEVDDSGICSPPMWTTSPARRKNNLRSLSPTSRTQAIVSGQRELMEMVKNMPESNYELSLKDLVEHHRVVDATRQEKNVVEERKNLSSVYMKREKSRKVDNNNKMAQVKRNGNIDRGGFYLKMGLPFPFGSKDKKKKMKKKNESLGNSSSSRVTPKPSDGSAKGGGVVDKEWWKKSPLACKESDSGESSINSESGKSSGSSSSNSSSSRSNSRRENSGKRCWPFIRRPKSRTQKKHDKANTSMPIEGVPSFDFVSIPSDEYEPAFGNFL

SEQ ID NO: 155849 - protein, 124 aa, Glycine max
  Coding DNA Sequence Number=SeqID_39071
  Gene Ontology: Mol. function=binding; Cellular component =intracellular; Biological process=mRNA editing
  Homolog annotation: Hit_ID=Q10AK3; Match level="QueryCoverage=97%, HitCoverage=59%, E-value=7e-22, Identity=34%"; Hit description =Pentatricopeptide, putative, expressed
MEFQTRLFFEGMSLKREWASRTCPDLANAETTMFHEKWVLRGMALNKWRALWVCPELRWAWTREFQEKEFVWGISSNKWDASWRWPQREYSWRSRFATATEEFRMPVIRNATWSCLPSRMEDQD

SEQ ID NO: 155850 - protein, 969 aa, Glycine max
  Coding DNA Sequence Number=SeqID_39072
  Gene Ontology: Mol. function=catalytic activity; Cellular component =intracellular; Biological process=metabolic process
  Homolog annotation: Hit_ID=Q60DD6; Match level="QueryCoverage=89%, HitCoverage=85%, E-value=1e-103, Identity=34%"; Hit description=PPR repeat containing protein
  Pfam annotation: Domain name=PPR; Domain location=113-147; Score =34.6; E_value=3.4e-07; Accession=PF01535.11; Description=PPR repeat
  Pfam annotation: Domain name=PPR; Domain location=166-200; Score=8.3; E_value=0.78; Accession=PF01535.11; Description=PPR repeat
  Pfam annotation: Domain name=PPR; Domain location=452-486; Score =45.7; E_value=1.6e-10; Accession=PF01535.11; Description=PPR repeat
  Pfam annotation: Domain name=PPR; Domain location=51-84; Score=0.1; E_ value=7.2; Accession=PF01535.11; Description=PPR repeat
  Pfam annotation: Domain name=PPR; Domain location=551-585; Score =26.6; E_value=8.6e-05; Accession=PF01535.11; Description=PPR repeat
  Pfam annotation: Domain name=PPR; Domain location=586-620; Score =12.8; E_value=0.23; Accession=PF01535.11; Description=PPR repeat
  Pfam annotation: Domain name=PPR; Domain location=652-686; Score =22.7; E_value=0.0013; Accession=PF01535.11; Description=PPR repeat
  Pfam annotation: Domain name=PPR; Domain location=722-756; Score =19.8; E_value=0.0096; Accession=PF01535.11; Description=PPR repeat
  Pfam annotation: Domain name=PPR; Domain location=825-858; Score=3.4; E_value=2.9; Accession=PF01535.11; Description=PPR repeat
  Pfam module annotation: Pfam domain module=PPR::PPR::PPR::PPR::PPR::PP R::PPR::PPR::PPR; Domain location=113-147::166-200::452-486::51 -84::551-585::586-620::652-686::722-756::825-858
MNSDPSQEVHRDAFVLATFLGACADLLALDCGKQVHAHVFVDGMGLELDRVLCSSLINLYGKYGDLDSAARVESFVRDVDEFSLSALISGYANAGRMREARRVFDSKVDPCSVLWNSIISGCVSNGEEMEAVNLFSAMLRDGVRGDASTVANILSVASAGVTHDIVVASALLDAYSKCQSPCEACKLFSELKDYDTILLNTMITMNKLDLKMDKFSFASVISACGSKSSLELGEQEWSKGRRCRTTKGGNDGYGDAVGSVGRGERREIKRAEKRGGTVMPPSVIISDDNARWAAAEDGREGVESTEKRKMGEVSVGRGILNTLSNVPVACSCGRGISICMYPLLKQAQGPYPSLSCCSLLLNHCLSQKSLNCVKIVHAHFLKLGLNTYTYLGNRCLDLYSEFGHINDALKVFDDISHKNSTSWNICLKGLLKSGQPGKACHMFDAMPVRDVVSWNSMISGYASCGYLSHALELFVEMQGTGVRPSGFTFSILMSLVSSSPHAKQIHCRMIRSGVDLDNVVLGNSLINIYGKLGLVEYAFGVIMIMKQFDVISWNSLIWACHSAGHHELALEQFYRMRGAELLPDQFTCSVLMSVCSNLRDLDKGKQVFAFCFKMGFIYNSIVSSAAIDLFSKCNRLEDSVRLFKKQDQWDSPLCNSMISSFARHDLGENALQLFVLTLRKNIRPTEYMVSSLLSSVSIFLPVEVGNQIHSLVPKLGFESDAVVANSLVDMYAKFGFIGDALNIFNEMKIKDLVSWNTIMMGLTYYGRVSLTMDLFRELLTREGILPDRITLTAVLLACNYGLLVDEGIKIFSSMEMEFGVKPGEEHYACVVEMLSKAGKLKEAIDIIETMPCRTTSDIWRSILSACAIYGDLQIIEGVAKKIMDRESQTSLPYLVLAQAYQMRGRWDSMVRMRKAVENRGTKEFIGHSWIGIRNNVYTFASNQLQHYGGKDLYLVLNLLVWEMETEGYV

SEQ ID NO: 155851 - protein, 608 aa, Glycine max
  Coding DNA Sequence Number=SeqID_39073
  Gene Ontology: Mol. function=DNA binding; Cellular component=nucleus; Biological process=regulation of transcription, DNA-dependent
  Homolog annotation: Hit_ID=Q8W475; Match level="QueryCoverage=92%, HitCoverage=99%, E-value=1e-108, Identity=41%"; Hit description =Putative SWI/SNF family transcription activator
  Pfam annotation: Domain name=C1_3; Domain location=185-213; Score =12.3; E_value=0.018; Accession=PF07649.3; Description=C1-like domain
  Pfam annotation: Domain name=Myb_DNA-binding; Domain location=240 -285; Score=36.5; E_value=9.4e-08; Accession=PF00249.21; Description =Myb-like DNA-binding domain
  Pfam annotation: Domain name=SWIRM; Domain location=16-104; Score =86.5; E_value=8.3e-23; Accession=PF04433.7; Description=SWIRM domain
  Pfam module annotation: Pfam domain module=C1_3::Myb_DNA -binding::SWIRM; Domain location=185-213::240-285::16-104
MEVTKDPNSDFELELYTIPSSSRWFAWEEIHETERTAFKEYFDGNSITRTPKIYKEYRDFIINKYREEPSRRLTFTEVRKSLVGDVTFLHKAFLLLEHWGLINYGTAQPSSGADAAEEEEEHRKVRLEEGAPGGIRVAATPNSLKPMLLPRNGKSGVNASGASLKLPPLASYSDVYGDLIRQKEGNCGLCGHKCGSGHYRCTQDNFIICINCFKSGNYGEKRSTEDFVLSESSENSGKHDTVWTEAETLLLLESVLKHGDDWELVAQSVQTKTKLDCISKLIELPFGELMLGPAHRNVNINDANGIVNNAKQVQSSSSDNQEISKTKDQSPEFTNENEQNGDAVKESPSKRQRVASLSDSSSSLMNQVGLISNVVDPHITAAAADAAVSALCDEDLCPREIFDVDGEEGLEMERSSLSGNHLMEGNDYSMVISCSLLNECLSQYLVIVHFRDFDWIDFLEEIPLTLRVRAATATALGAAAARAKLLADQEDREIEHLVATIIEAQIDKMLQKVKHFDDLELLMEKEHAEMENKKDSILTERIDVLRRTFRSGVTRWKDYSYNTLAGRVRETETLSGRWWFEWGPLMSSSTWVSKPMEELYEETDFGLD

SEQ ID NO: 155852 - protein, 530 aa, Glycine max
  Coding DNA Sequence Number=SeqID_39074
  Gene Ontology: Mol. function=oxidoreductase activity, acting on the aldehyde or oxo group of donors, disulfide as acceptor; Cellular component=mitochondrial alpha-ketoglutarate dehydrogenase complex; Biological process=metabolic process
  Homolog annotation: Hit_ID=Q84JL2; Match level="QueryCoverage=63%, HitCoverage=82%, E-value=1e-139, Identity=63%"; Hit description =Putative branched-chain alpha keto-acid dehydrogenase E1 alpha subunit
  Pfam annotation: Domain name=E1_dh; Domain location=149-399; Score =288.2; E_value=1.5e-83; Accession=PF00676.10; Description =Dehydrogenase E1 component
  Pfam annotation: Domain name=TPP_enzyme_C; Domain location=181-321; Score=-36.2; E_value=0.0046; Accession=PF02775.11; Description =Thiamine pyrophosphate enzyme, C-term
  Pfam module annotation: Pfam domain module=E1_dh::TPP_enzyme_C; Domain location=149-399::181-321
  Subcellular localization annotation: CTP_CleavageSite=74; ConfidenceScore=5.21e-01
MASWLLGRSSRILIHQHHHLHKKYLPFLLGPFLNHNNSSCSSFPSTEPFRCRDAFPGKNSSPTLFRFSRHESTKAEAQLELEQDVATEDEPNQVIDFPGGKVGFTSEMRFISESPEKRVPCYRVLDDNGEIVKYSNYVQVSKEMGVKMYSDMVTLQTMDNIFYEVQRQGRISFYLTQMGEEAVNIASAAALAPDDIILPQKFRTQLPQAVGAAYSLKMDGKSACAVTFCGDGATSEGDFHAAMNFAAVMEAPVVFICRNNGWAISTPVEDQFRSDGIVVKGKAYGIWSIRVDGNDALAVYSAVHTAREIAIKEKRPVLIEALTYRVGHHSTSDDSTKYRGTDEIEYWKMARNPVNRFKRWVERNGWWSDKDELELRSSVRKQLMHAIQVAEKAQKPPLQDLFNDVYDQIPSNLQEQERLIRKTIEKHPKDYPSDDHSPPASASYVVVACDATRDRTEHEIKLVVDHVRARRVFLSSGDKLLVLCVLHKTLACPESFAGTNFRAMEDEVKKKVDAYATELLSSYEDFESEG

SEQ ID NO: 155853 - protein, 97 aa, Glycine max
  Coding DNA Sequence Number=SeqID_39075
MNENGMTYKSCERREGHLRNKGVVGWCGIGDGQEKGTLWLVKMKRHCKKHNDMPLNMHNTVPLFMFRKPPLSSSQASEKVKWCGKIGVLGSVRLCGL

SEQ ID NO: 155854 - protein, 835 aa, Glycine max
  Coding DNA Sequence Number=SeqID_39076
  Gene Ontology: Mol. function=methyltransferase activity; Cellular component=cellulose and pectin-containing cell wall
  Homolog annotation: Hit_ID=Q9FMJ2; Match level="QueryCoverage=98%, HitCoverage=98%, E-value=0.0, Identity=57%"; Hit description=Ankyrin- like protein
  Pfam annotation: Domain name=DUF248; Domain location=313-819; Score =1125.2; E_value=0; Accession=PF03141.7; Description=Putative methyltransferase
  Pfam annotation: Domain name=Methyltransf_11; Domain location=432 -527; Score=26.5; E_value=9.5e-05; Accession=PF08241.2; Description =Methyltransferase domain
  Pfam module annotation: Pfam domain module=DUF248::Methyltransf_11; Domain location=313-819::432-527
MALGKNSQGKGRKLSNYCSTVSVAVFVAFCLVGVWIVLSSIVPIQNSVIQVSETETINDDVKNVASDSKQFEDRSGDISEDSTRGSSQTKKSQSGDSHPENQDDQKGIEKVSDNTAEENQEVVGDNSDEKNDLEKGLENTIEENDQMRNVKPSTDETEKESDRSLNSESEETETSNDQIHDDELRGSMETLDEKESDKSTNDNKLGTEKSMDEATQQDEMVGETAEDKKHLHSEATQSTGGSNTESHENNPASKEILVTGTSSEILIETSTENGTWSTQAAESQHEKESQKSLVSIDSRTYDWKLCNTTTGSEYIPCLDNWKAIRKLQSISHYEHRERHCPDEATTCLVSLPEGYRSPIRWPKSREMIWYKNAPHTKLVVDKGHQNWVKVTGEYLTFPGGGTQFKHGALNYIEFIQKSLPKIAWGKRSRVILDVGCGVASFGGYLFEKDVLTMSFAPKDVHEAQVQFALERGIPATLGVMGTVRLPYPGSVFDLLHCARCRVPWHVEGGKLLLELNRVLRPGGYFVWSATPVYQKDPEDVEIWKAMGEITKSMCWDLVVIAKDKLNGVAAAIYRKPTDNECYNNRIKNEPSMCSESDDPNTAWNVSLQACMHKVPVDASERGSIWPEQWPLRLEKPPYWIDSQAGVYGRAASVEFTADYKHWKNVISHLYLNGMGINWSSVRNVMDMKAVYGGFAAALRALKLNVWVMNVVPIDSPDTLPIIYERGLFGIYHDWCESFNTYPRSYDLLHADSIFSTLKEKCNKVAVIAEVDRILRPEGYLVIRDNVETIGEIESLAKSLQWDIRLTYSKNGEGLLCIQKTFWRPTKVETVASAIA

SEQ ID NO: 155855 - protein, 497 aa, Glycine max
  Coding DNA Sequence Number=SeqID_39077
  Gene Ontology: Mol. function=oxidoreductase activity; Cellular component=membrane; Biological process=electron transport
  Homolog annotation: Hit_ID=Q9M4G8; Match level="QueryCoverage=95%, HitCoverage=95%, E-value=1e-147, Identity=54%"; Hit description =Putative ripening-related P-450 enzyme
  Pfam annotation: Domain name=p450; Domain location=33-489; Score =408.1; E_value=1.3e-119; Accession=PF00067.12; Description =Cytochrome P450
MEFVTCALFLLLACATIGSFLAKTTRKPNHNLPPGPSRLPIIGNLLELGQNPHQSMAKLAKIHGPVMSLKLGTVTTIVISSADMAKEVLVTHDESLSNRPIPQSVSVLNHEHYSLAFLPVSPLWREMRKICNGQLFAHKTLDESQDVRRKIVQQLLSDVHKSCQIGEAVDVGRQAFKTTLNLLSNTIFSEDLVLSKGTAGEFKDLVTNITKLVGSPNMADYFPVLKRIDPQGAKRQQTKNVAKVLDIFDGLIRKRLKLRESKGSNTHNDMLDALLDISKENEMMDKTIIEHLAHDLFVAGTDTTSSTIEWAMTEVVLNPEIMSRAKKELEEVIGKGKPVEESDIGKLPYLQAIIKETFRLHPPVPFLLPRKAERDVDLCGFTIPKDAQVLINVWTIGRDPTLWENPTLFSPERFLGSNVDIKGRNFELAPFGAGRRICPGMMLAIRMLLLMLGSLINSFQWKLEDEIKPQDVDMGEKFGITLQKAQSLRVVPINISN

SEQ ID NO: 155856 - protein, 340 aa, Glycine max
  Coding DNA Sequence Number=SeqID_39078
  Gene Ontology: Mol. function=hydrolase activity, acting on ester bonds; Cellular component=cellular_component; Biological process =lipid metabolic process
  Homolog annotation: Hit_ID=Q7XAW7; Match level="QueryCoverage=43%, HitCoverage=96%, E-value=1e-32, Identity=46%"; Hit description =Putative lipase
  Pfam annotation: Domain name=Lipase_GDSL; Domain location=33-333; Score=44.3; E_value=4.1e-10; Accession=PF00657.12; Description=GDSL -like LipaseAcylhydrolase
MVKQTVSSVITLLLLLFILREVEGDKRSHEVKLFVFGDSYVDTGNSVNSASYKPPSGDTFPGKPAGRFSDGCVLTDYIASYLKIKSPTPYIFRNSSELQYGMNFAHGGSGIFNTSVDGPNMTVQIDSFENLIKEKVYTKADLESSVALVNAAGNDYATFLLRQHGSIQDMPVFTTILIRQMSLNLRRIHSLGINKIAVGLLEPIGCMPLLTVASSYEKCLEPFNLISQNHSQMLLQIVQELNKELGKPVFVTLDLYNSFLSVISTMQKRHSENPTLMNPLQPCCEGVSMEYSCGSVDEKGEKKYCLCKKPELSFFWEGVHLSQNGWYAVYMMLYSSLSKL

SEQ ID NO: 155857 - protein, 437 aa, Glycine max
  Coding DNA Sequence Number=SeqID_39079
  Gene Ontology: Mol. function=nucleic acid binding
  Homolog annotation: Hit_ID=Q1SM16; Match level="QueryCoverage=80%, HitCoverage=72%, E-value=1e-113, Identity=60%"; Hit description =Single-stranded nucleic acid binding R3H
  Pfam annotation: Domain name=R3H; Domain location=200-261; Score =10.7; E_value=0.027; Accession=PF01424.13; Description=R3H domain
MEKKSRSIRCGGHVGESVRKEVASIHPSSSSNQLTKPYLASSHSHSLCPQPKAPFHNPNPKSESSHETSHATLHRFRISFSMEGSAEDLGAPESWEVADLDESMNRLNLMVFSNNDSKQPHQRLADYNDDDAPLPPPPSSSCDEVSDDAINQVDQFLREAIQNPRERLSSRSNKLYVLRMIYLAQLIKASNLMNSVLRMEQDVENFIRDPTQQQLEFKQLPTSYLRLAAHRVAQHYSLQSMVLLDNSLPDGSGSRIIVRKTSECKLPVIRLADIPVKLSPENSAVMKVAIKQRPQKWTQILSNANSNSMKNNSSKSVEERKEEYNRARARIFNSSNNDGTVGGKPECESRQQDNSLHSSLVVPRVEDKSASVSDVTSGRGLVESSTNTNRARSRIEKEPVGRYRQNNRVAIFRDREVDRKDPDYDRNYDRYVHLLPC

SEQ ID NO: 155858 - protein, 740 aa, Glycine max
  Coding DNA Sequence Number=SeqID_39080
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=96%, HitCoverage=93%, E-value=0.0, Identity=47%"; Hit description=Protein kinase; Type I EGF
  Pfam annotation: Domain name=EGF_CA; Domain location=278-321; Score =24.4; E_value=0.0004; Accession=PF07645.6; Description=Calcium binding EGF domain
  Pfam annotation: Domain name=Pkinase; Domain location=404-677; Score =166.9; E_value=5e-47; Accession=PF00069.15; Description=Protein kinase domain
  Pfam annotation: Domain name=Pkinase_Tyr; Domain location=404-671; Score=121.2; E_value=3e-33; Accession=PF07714.7; Description=Protein tyrosine kinase
  Pfam module annotation: Pfam domain module=EGF_CA::Pkinase::Pkinase _Tyr; Domain location=278-321::404-677::404-671
VNIPYPFGTAEDCYLNSNFYVACNTSHNPPKPFLWNVTKSIEILEVSLNGHLRIKSPVAYVCYDEKGVLVDSGNSSMTLQAFPFSYTQNKFIGIGCDTLSSINATIGKNYSAGGCFSLCSSVESSANGSWFGVGFCQTSIPKNILAYQARVLSLNLMHRDMNIPCSYSLLVEEDSFKFSTDDFIKLQKRKTAPTVLDWAVGNQTCQEAKKNLTSFACQENSKCIDSDNGPGYLCRCLEGYVGNAYLHGGCQGMGEGCCTQPYPCICKEAVSGFPQSYIDECANLSLNDCSDLCINLPGSYNCSCPKSKGYQGDGRKGGSGCVSNLQHVVNQIVIGTGIGLMLLLIGSGWLYHVFRKRKRVRLTTRYFKQNGGLMLQQQISNMEGSSERAKIFTARELKKATENFHESRIIGRGGYGTVYRGILPDDHVVAIKKSKLVDHSQTEQFINEVVVLSQINHRNVVKLLGCCLETEMPLLVYEFVNNGTLFDHIHNKNTTLPWEARLRIAAETAGVLAYLHSAASIPIIHRDFKSTNILLDDKYTAKVSDFGTSRLVPRDKCQLTTLVQGTLGYLDPEYFQSSQLTEKSDVYSFGVVLAELLTGRRALSFDMPEEERNLALYFLSAVKDDCLFEIVEDCVSEGNSEQVKEVANIAQWCLRLRGEERPTMKEVAMELDSLRMMTTTTTTWINATSNSTEYVIGERSGLSLTETTDYANCHYTCNTCAGHEDETICNDVMSPIWDGR

SEQ ID NO: 155859 - protein, 682 aa, Glycine max
  Coding DNA Sequence Number=SeqID_39081
  Gene Ontology: Mol. function=protein kinase activity; Cellular component=integral to membrane; Biological process=protein amino acid phosphorylation
  Homolog annotation: Hit_ID=Q5F1Y5; Match level="QueryCoverage=89%, HitCoverage=87%, E-value=1e-131, Identity=39%"; Hit description =Putative wall-associated kinase 4
  Pfam annotation: Domain name=EGF_CA; Domain location=290-333; Score =40.0; E_value=7.9e-09; Accession=PF07645.6; Description=Calcium binding EGF domain
  Pfam annotation: Domain name=Pkinase; Domain location=357-621; Score =111.8; E_value=1.9e-30; Accession=PF00069.15; Description=Protein kinase domain
  Pfam annotation: Domain name=Pkinase_Tyr; Domain location=363-621; Score=110.6; E_value=4.6e-30; Accession=PF07714.7; Description =Protein tyrosine kinase
  Pfam module annotation: Pfam domain module=EGF_CA::Pkinase::Pkinase _Tyr; Domain location=290-333::357-621::363-621
  Subcellular localization annotation: CTP_CleavageSite=58; ConfidenceScore=5.42e-01
MAVCSIMLLLLLFTLLIAATKTQPMSKPNCPTNCGSVTVPFPFGMTEDCSLDASFLVSCNRTSSSSHVLFLPQTNISVLNISLNGELQISWPVASDCYAERGKLLSQTIQDLSITSFQLSSNRNMFTVLGCDTLGLVVGTDSDGRNYTTGCVSLCNRLQDIETNGSCSGTGCCETSIPRGLSGFSYGSSSVYNHTSVIDFNPCGHAFLVERGAYNFSSTDLFKFEKTTFPAGVDWVVKNQTCQEAKKEVSSYACKSENSECYHSFEGSGYLCSCSNGFEGNPYLLGGCQDVNECMGSTADCFDGAICNNLPGGYNCSCPEGFEGDGKNDGSRCSPKSSTNSRKAIIILIIALRQDPRSKEGQGTVYKGVLLDNRIVAIKKSKISDPNQIEQFINEVIVLSQINHRNVVKLLGCCLETEVPMLVYEFIPNGTIYEHLHDFNCSLKLTWKTRLRIATETAGALAYLHSATSTPIIHRDVKTTNILLDHNLIAKVSDFGASRIFPLDQTQLTTLVQGTLGYLDPEYFHTSQLTEKSDVYSFGVVLAELLTGKKALSFDRPEANRNLAAYFVSSMKTGQLLDIVDNYISHEANVEQLTEVANIAKLCLKVKGEDRPTMKEVAMELEGLQIVGKHRWGSVSSSSEETENLLQKASSVLAGEEGISGSGINSGFDSLNRFSVSLGGGR

SEQ ID NO: 155860 - protein, 417 aa, Glycine max
  Coding DNA Sequence Number=SeqID_39082
  Gene Ontology: Mol. function=transporter activity; Cellular component= integral to membrane; Biological process=transport
  Homolog annotation: Hit_ID=Q1SM15; Match level="QueryCoverage=93%, HitCoverage=85%, E-value=1e-158, Identity=76%"; Hit description =Major facilitator superfamily MFS_1
  Pfam annotation: Domain name=MFS_1; Domain location=5-361; Score =48.8; E_value=1.8e-11; Accession=PF07690.6; Description=Major Facilitator Superfamily
MADSLFYQYMMSFFGIFGMCVEYNEEIVGIFKMVVLPLLGQLSDEYGRKPLLLITISTAIFPFVLLVWHQSEEYVYAYYVLRTISNIISQGSIFCISVAYAADVVNESKRAAVFGWITGLLSASHVLGDVLAWSLPEKYIFAVSIVLLTSCPVYMKFFLVETVIPAPKNDRESGCWAKIVDVPRQRYISMRRAAEIVIFSPTLRGMALVSFFYELGMSGISSVLLFFDSLTIPVQYYLKAVFGFNKNQFSELLMMVGIGSIFSQMLLLPILNPLVGEKVILCSALLASIAYAWLYGLAWAPWVPYLSASFGIIYVLVKPATYAIISNASSSTNQGKAQTFIAGTQSISDLLSPIAMSPLTSWFLSSNAPFECKGFSIICASICMIISLCFACLLKPADTSSSNDIEGSQETPLLTDN

SEQ ID NO: 155861 - protein, 113 aa, Glycine max
  Coding DNA Sequence Number=SeqID_39083
  Subcellular localization annotation: CTP_CleavageSite=60; ConfidenceScore=5.48e-01
MAPPHVPTSLVASSLPMTKSPPHQKIPFHHKMDQVTNRHTNQSSTNQIINYSFIPFNCVSFGTGGSRIEDGIAVSCKMELLPLLVLVLGLFALGIENEYLWICDKSRGECKAI

SEQ ID NO: 155862 - protein, 220 aa, Glycine max
  Coding DNA Sequence Number=SeqID_39084
  Homolog annotation: Hit_ID=Q1S0F5; Match level="QueryCoverage=64%, HitCoverage=30%, E-value=1e-10, Identity=28%"; Hit description=IMP dehydrogenase/GMP reductase
MGSNQTPLLKKRFYQVKIKSLEVTSLQELGQLMGQLQQQAFRKAYGKIWDLATIEVSVEVIASLTQYYDQPLRCFTFEDFQLVPTMEEFEEILGCPLGGRKPYLFSGFYPSIARATKVVKISAQELDRVKQNRNGVVKVPRRCLEEKAKALENQVEWTSFIDILALLIFGFILFPNVEGLVDLALLTLSSPFTIARKARSSPFWPTWMTRLTGGVKRAAQ

SEQ ID NO: 155863 - protein, 89 aa, Glycine max
  Coding DNA Sequence Number=SeqID_39085
MESMGSDKGLSFLRHNTRMMLINLDHWLQQILAVWQSLSDQVWQQDAFMLLVCLVTCLLLFLSGTVLGLFVQSLWGIFMSGRHADEEHK

SEQ ID NO: 155864 - protein, 154 aa, Glycine max
  Coding DNA Sequence Number=SeqID_39086
  Gene Ontology: Mol. function=lactoylglutathione lyase activity; Cellular component=cytoplasm; Biological process=carbohydrate metabolic process
  Homolog annotation: Hit_ID=Q63X74; Match level="QueryCoverage=77%, HitCoverage=93%, E-value=3e-49, Identity=74%"; Hit description =Lactoylglutathione lyase
  Pfam annotation: Domain name=Glyoxalase; Domain location=1-117; Score= 117.0; E_value=5.5e-32; Accession=PF00903.15; Description =GlyoxalaseBleomycin resistance proteinDioxygenase superfamily
MLRVGDLQRSIDFYTGVLGMKLIRSQDYPDGEFTLAFVGYGNEYDNTVLELTYNYGKTTYDMGTAYGHMAIEVEDAYQACELVKAKGGKVVREAGPMKHGTIVIAFIEDPDGYKIEFIQKGTIESGGHQYEDHGPDVAGELAALYQQLSTATTK

SEQ ID NO: 155865 - protein, 350 aa, Glycine max
  Coding DNA Sequence Number=SeqID_39087
  Gene Ontology: Mol. function=aminopeptidase I activity; Cellular component=vacuole; Biological process=proteolysis
  Homolog annotation: Hit_ID=Q1SM19; Match level="QueryCoverage=87%, HitCoverage=58%, E-value=1e-139, Identity=80%"; Hit description =Peptidase M18, aminopeptidase I
  Pfam annotation: Domain name=Peptidase_M18; Domain location=65-347; Score=132.9; E_value=8.7e-37; Accession=PF02127.6; Description =Aminopeptidase I zinc metalloprotease (M18)
  Subcellular localization annotation: CTP_CleavageSite=47; ConfidenceScore=5.70e-01
MASIGGPQILLHSPSPSLKLKLKLKPSSSSFLLFPKRIPRRTFCSINSNSAPHGSSSIVPNLLHYLNHSCTQFHATAEAKQQLLAAGFHMLNENKDWHLKPGGRYFFTRNMSCLIAFAIGDKYNVGDGFHVIAAHTDSPCLKLKPKTASCKCNYSMVNVQTYGAGLWYTWFDRDLSVAGRVILRTGHNSFVHKLVKVDRPILRIPTLAIHLDRTVNLDGFKPNLETHLLPLLSMKPEDTSLESNSKEKNSALSSKAHHHRLLMQVLSDELNCDVDDIVNIELNVCDTQPSCLGGGNNEFIFSGRLDNLASSYCALRALIDSCESPGDLASENAIRMVALFDNEEVFLYLA

SEQ ID NO: 155866 - protein, 320 aa, Glycine max
  Coding DNA Sequence Number=SeqID_39088
  Gene Ontology: Mol. function=nucleic acid binding; Cellular component= intracellular; Biological process=chromatin modification
  Homolog annotation: Hit_ID=Q1SHX5; Match level="QueryCoverage=61%, HitCoverage=66%, E-value=3e-79, Identity=60%"; Hit description=Zinc finger, C2H2-type
  Pfam annotation: Domain name=zf-C2H2; Domain location=109-131; Score =21.3; E_value=0.0035; Accession=PF00096.16; Description=Zinc finger, C2H2 type
  Pfam annotation: Domain name=zf-C2H2; Domain location=194-216; Score =20.4; E_value=0.0065; Accession=PF00096.16; Description=Zinc finger, C2H2 type
  Pfam annotation: Domain name=zf-C2H2; Domain location=220-245; Score =3.8; E_value=4.1; Accession=PF00096.16; Description=Zinc finger, C2H2 type
  Pfam module annotation: Pfam domain module=zf-C2H2::zf-C2H2::zf-C2H2; Domain location=109-131::194-216::220-245
MQKTYSFSFISSSGSDSACYLEADEVDNEDSISLSLAPPSQHQFKSKVSNPKHSSTMPDHHQQNPDLISGVTVALHIGLPTTKPSSPTPIHCRYWIPTPQQILIGPTQFSCTVCNKTFNRFNNMQMHMWGHGSQYRKGAESLRGSKAGSSMLRLPCYCCEEGCKNNINYPRSKPLKDFRTLQTHYKRKHGGKPFECRKCHKPFAVRGDWRTHEKNCGKLWFCVCGSDFKHKRSLKDHVRAFGNGHAPHNLLSEERENEGGDDDDNEVVYVRLFFFVVTRTWIDPLKDCTLSVVEEKECKTNSEMKAKVLALKLEVAVLST

SEQ ID NO: 155867 - protein, 107 aa, Glycine max
  Coding DNA Sequence Number=SeqID_39089
  Subcellular localization annotation: CTP_CleavageSite=67; ConfidenceScore=5.33e-01
MDVKRKKKRRGVSGLSLKKGRDSQGMSFAFSVALSLFRVFYLNLSTGDGFRWELVMVGSTSLCVLCNATTFWANSSTTSISLTKGVLSGSKKDAGSNSLGSCVAQQR

SEQ ID NO: 155868 - protein, 332 aa, Glycine max
  Coding DNA Sequence Number=SeqID_39090
MGCCVSKCRPEYKPSQEEQQQHNQHHFNFNHVQHKLPISSQTPPPLPPTLYSSTKISPSPPSPTSSTSSISSFTCTTSNTISSASSLSTASSSLSSKDRSFSNEFLWSCYKDNPHIITRINSLRDATSLSFLPPTKPNRKLVNINPSPPKPNLASLNKRSPPPQSFSMPQKRVRSNSPTNLTRQKSFRKDTERSITINHASNVQSRSLIRSPSPSRRFNGDKCESANLATTMNSSKVNGVISGVHSNSHHSVLSSRRKESVKAASPNNNCSRRVFHSGLRNTRETSCTLGLGVSPKVDETVVKDVVSDYDMDLTLMEDIDNPLISLDCFIFL

SEQ ID NO: 155869 - protein, 237 aa, Glycine max
  Coding DNA Sequence Number=SeqID_39091
  Gene Ontology: Mol. function=transferase activity; Biological process= flavonoid biosynthetic process
  Homolog annotation: Hit_ID=Q2HVN0; Match level="QueryCoverage=94%, HitCoverage=52%, E-value=7e-70, Identity=57%"; Hit description =Transferase
  Pfam annotation: Domain name=Transferase; Domain location=2-231; Score=-187.6; E_value=0.072; Accession=PF02458.6; Description =Transferase family
MLNSYKVDDSGLRQHYHSEFRSPPIWLGSLGGRDTKVVVAVVKLTNENSRRPYSTFEVIAGYLWRCVSKARYEKGKSDQPTRLSALVNCRNRMRPPLPDGYAGSAVLPTVTPTCSFAEIMQNPSSYAVGNVGEAIERVTGEFVESALDHIAKEKDINLVKYNIYYPAPPVHKGHYKGNPNLFVVSWMNFSFKNADFGWGKPVYFGPGYMNSEGKVIVMNRANGCGHCFGGISHGWFQ

SEQ ID NO: 155870 - protein, 91 aa, Glycine max
  Coding DNA Sequence Number=SeqID_39092
  Gene Ontology: Mol. function=Rab GTPase activator activity; Cellular component=intracellular; Biological process=regulation of Rab GTPase activity
  Homolog annotation: Hit_ID=Q1RZW2; Match level="QueryCoverage=93%, HitCoverage=17%, E-value=1e-27, Identity=73%"; Hit description =RabGAP/TBC
MSLHLSNGKACLPRMGGVDPSIRAEVWPFLLGVYDLDSTKEERDAITTQNRKEYEKLRRQCRQLLKHSNGSFKLNEIGEINYEGDSASFIM

SEQ ID NO: 155871 - protein, 102 aa, Glycine max
  Coding DNA Sequence Number=SeqID_39093
MSLSDDHSHGLMKGHEYLSSMSSLMFLISISRLYLPFLVQCIDRVVELKIPVILQSFVGMPLLHVIQLALPNMVLQIQYAICASLQYNAFTVVSLVIAMFSG

SEQ ID NO: 155872 - protein, 235 aa, Glycine max
  Coding DNA Sequence Number=SeqID_39094
  Homolog annotation: Hit_ID=O65809; Match level="QueryCoverage=18%, HitCoverage=32%, E-value=5e-12, Identity=79%"; Hit description =Profilin-1
MPFRLHSGQRYFTDFSVGVPLPNVSLTQKSYEIHAEGSHSYTLHTCRLCAFRVCFNHSSNTDKITAIMNDFNKPGCLVPIGLYLSGTKYMVIQGESGVVIRGKKIYLLFTTPATKTVQNRRRKCFRTDVKSSFCSSVSVSSKRLVKKESHFEIKKNIKETSPLRQLPHLLICKKTLVSTATPLGLEAISQVKELLDEGLVRVEGRSPEYEEPRDLRSNPFQGGGDDAILPPKGIG

SEQ ID NO: 155873 - protein, 83 aa, Glycine max
  Coding DNA Sequence Number=SeqID_39095
  Gene Ontology: Biological process=response to biotic stimulus
  Homolog annotation: Hit_ID=Q53HY7; Match level="QueryCoverage=96%, HitCoverage=39%, E-value=1e-19, Identity=56%"; Hit description =Hypothetical protein c17
MLALSADGGEEAGDHVDVAKGPEDGMAAPDEVVVGPWVVVAPHDRPHGGDRGVDLLHHSGAPLVRGHDAGVVAASHHVGNNRG

SEQ ID NO: 155874 - protein, 220 aa, Glycine max
  Coding DNA Sequence Number=SeqID_39096
RALRHPYQTRAKARIISEIEKVQEQMKADMEAMKEKMTMMMEEMMSTRKMMEDNTTTIVVASTTTKMDPIHPIASSENIDNFAPALIENQQPQSHHAHVSQPMRETHEVPQDHTLVGFGVYPGYNTEGKKFSSIPVLNALGISQCCPGLPQYLRKKGLSHMEERLRAIEGGGNYAFADMAELCLVLNVVIPPKFKVPDFDKYKGITCPKNHPKMYCRKMG

SEQ ID NO: 155875 - protein, 61 aa, Glycine max
  Coding DNA Sequence Number=SeqID_39097
MALWVMAAHPGKRAGYFTPKLFGGPGKPEASLGEPGFIKELKMTLLPSLLGIFHILYRNME

SEQ ID NO: 155876 - protein, 67 aa, Glycine max
  Coding DNA Sequence Number=SeqID_39098
METMKEQMTTMMEAMMSMRKMMEVNMATVVAASTATEVREAKHWEVWAAPILYSCSLSKHSIGSLTS

SEQ ID NO: 155877 - protein, 157 aa, Glycine max
  Coding DNA Sequence Number=SeqID_39099
MINRCCLCTDNHLGISAYHLTCESESTDVVFVWIITWVYLPATSLKDVVRPKESRSEEADISGKGADDYIGLRLSIRLGDGVVDKNGAFAPMYPQFEMRNSDLSSSCERCETKIVPGEDGHSHPRSRFMVSWDFGSRLVEWMDMIYVRALVWPTVQG

SEQ ID NO: 155878 - protein, 97 aa, Glycine max
  Coding DNA Sequence Number=SeqID_39100
  Gene Ontology: Mol. function=transferase activity, transferring groups other than amino-acyl groups; Cellular component=cellular _component; Biological process=flavonoid biosynthetic process
  Homolog annotation: Hit_ID=Q8SAS8; Match level="QueryCoverage=52%, HitCoverage=12%, E-value=1e-14, Identity=72%"; Hit description =Trihydroxybenzophenone synthase
MTEKAKRITNWAWAIKLGVGVGMERAEQIGGGKAVATVLAIGTANPPNFILQEDYPDFYFRVTNSDHLHRLKQKFKRICMFLIFASHSLAYIFLITL

SEQ ID NO: 155879 - protein, 523 aa, Glycine max
  Coding DNA Sequence Number=SeqID_39101
  Gene Ontology: Mol. function=zinc ion binding; Cellular component =nucleus; Biological process=regulation of transcription, DNA -dependent
  Homolog annotation: Hit_ID=Q5N7H9; Match level="QueryCoverage=29%, HitCoverage=82%, E-value=3e-27, Identity=42%"; Hit description=PHD finger protein-like
  Pfam annotation: Domain name=C1_3; Domain location=240-269; Score =7.3; E_value=0.072; Accession=PF07649.3; Description=C1-like domain
  Pfam annotation: Domain name=PHD; Domain location=241-290; Score =39.4; E_value=1.2e-08; Accession=PF00628.19; Description=PHD-finger
  Pfam annotation: Domain name=PHD; Domain location=352-403; Score =13.8; E_value=0.0024; Accession=PF00628.19; Description=PHD-finger
  Pfam annotation: Domain name=PHD; Domain location=404-449; Score =52.3; E_value=1.6e-12; Accession=PF00628.19; Description=PHD-finger
  Pfam annotation: Domain name=zf-C3HC4; Domain location=353-400; Score= 1.9; E_value=0.1; Accession=PF00097.15; Description=Zinc finger, C3HC4 type (RING finger)
  Pfam annotation: Domain name=zf-C3HC4; Domain location=402-446; Score= 16.8; E_value=0.0029; Accession=PF00097.15; Description=Zinc finger, C3HC4 type (RING finger)
  Pfam module annotation: Pfam domain module=C1_3::PHD::PHD::PHD::zf -C3HC4::zf-C3HC4; Domain location=240-269::241-290::352-403::404 -449::353-400::402-446
MQDVTKPCDVALCNTSDDCSHGQWGNIVLKHLYQSLGDGNGGIEGCIREALIHYPKHNHTTTVMETFKIDKDGQECSLQFEPLSHRTEKEANGHADVMCNGGSSESPDHGVTEMCQRVLCNVLTSEKFSSLCKALLENFQGMKPESVLDFTVMNSRMKEQAYEQSPTLFLSDIQQVWRKLQDAGNEIVALAKSLSNMSRTSYSELVGIPAQSTFQDEKQVEFDCCMKPEQTQACAMYKICSCKCCGEKADDTDCLVCDSCEEIYHVSCIEPAVKEIIPHKSWYCANCTANVIESLHENCVLCERLNDAKTLDDVIGDGSFPTIEETQNEFEENSNCTSDGIQVSIGEEKTPNCKICENEVDGGKIKICGHRFCSNKYYHVRCLTINQLKSYGHCWYCPSCLCRVCLTDQDDDRIVLCDGCDHAYHIYCMKPPRTSIPRGNWFCRKCDAGIQAIHQAKKAYEFNKPRRNGEDAAKPNANLEKKHNNKRARELESGGAMDMLLTAANTLNFEEKEAASHIKLQRT

SEQ ID NO: 155880 - protein, 260 aa, Glycine max
  Coding DNA Sequence Number=SeqID_39102
MKCAVCLGEFEECDMIRKTVKKQPQSKHVQCRTLQRPPPQAPIIAINDATLCLEGNQEVIDKCPCPCLLDGEGECGSGGCDDALIDNLVVSAKQEGTKDDNSDGTQGGGRCGVGHMDTRQKQPQSQHVQCLTPQCPPPQVPVAAISDTCLCLKSDQEVINKCPDFVYSTVKENVAVECAVCLSEFEECDMMRHLSVPSFLVISAKEEGLTDDNSDGHPRRRMLGSWTLNRFTLKLIESWEYSSIIAPFNPMLMHFGAKLK

SEQ ID NO: 155881 - protein, 272 aa, Glycine max
  Coding DNA Sequence Number=SeqID_39103
  Gene Ontology: Mol. function=protein binding; Cellular component =nucleus; Biological process=ubiquitin cycle
  Homolog annotation: Hit_ID=Q7F241; Match level="QueryCoverage=87%, HitCoverage=95%, E-value=1e-58, Identity=49%"; Hit description =Speckle-type POZ protein-like protein
  Pfam annotation: Domain name=BTB; Domain location=84-202; Score=47.4; E_value=4.8e-11; Accession=PF00651.21; Description=BTBPOZ domain
MVRNRRRMPPRRCTASMGSSNGSESDASDLVMRCLSCEEEYDMDDSGTCRECYQEANEAEEELRREIEELKSKVSFLTLPYPNLNASTADIILVPVDDSDAVPIPAHKHLLVFRSHFEIHAREVSRSPVFKAMLENDMAERRSGTIKISDISYDTLSAFVNYLYTAEASLDNELACNLLVLGEKYQVKHLKTYCEKYLIAKMNWNKAISNYAFAYQYNCKQLRSASLAVILDNMDLLTQNECYAELVDTNPRLVVEIYETYIGKQLNTAGAF

SEQ ID NO: 155882 - protein, 85 aa, Glycine max
  Coding DNA Sequence Number=SeqID_39104
MESLKKRVEVEGGGGGGTGHAQLVNGTHTLRHVIPPRVATVAAASAIAVGCTTRFQTSTVASETHGVTLEGFILHFVAVNICYQL

SEQ ID NO: 155883 - protein, 53 aa, Glycine max
  Coding DNA Sequence Number=SeqID_39105
MSFCVVADRELERVSSTKEEMNHDFGLVWFGSTRGWFGLTVVCSFGIITHLPF

SEQ ID NO: 155884 - protein, 187 aa, Glycine max
  Coding DNA Sequence Number=SeqID_39106
  Gene Ontology: Mol. function=nucleotidyltransferase activity; Biological process=metabolic process
  Homolog annotation: Hit_ID=Q09WE7; Match level="QueryCoverage=73%, HitCoverage=23%, E-value=1e-70, Identity=94%"; Hit description=UDP -sugar pyrophosphorylase
MGSSLGDNFNLLSPQQQELVKVLLDNGQEHLFRDWPAPGVDDNHKKAFFDQLTRLDSSYPGGLESYIKNAKRLLADSKAGRNPFDGFTPSVPTGETLAFGDESYIKFEEAGVLEARKAAFVLVAGGLGERLGYSGIKIYTQIEEAEPPPILVPSGMLGLHSLPKRLLYMPRQQAVLLLPSHSYSISP

SEQ ID NO: 155885 - protein, 93 aa, Glycine max
  Coding DNA Sequence Number=SeqID_39107
  Gene Ontology: Mol. function=transferase activity, transferring glycosyl groups; Cellular component=endoplasmic reticulum membrane; Biological process=GPI anchor biosynthetic process
  Homolog annotation: Hit_ID=Q656F1; Match level="QueryCoverage=75%, HitCoverage=12%, E-value=2e-26, Identity=72%"; Hit description =Dolichyl-phosphate-mannose-glycolipid alpha-mannosyltransferase-like
MQTKKNPKLHQLHPNQIHKNESCFSAWHYILVQTYFNPDEHWQGPEVAHRIAFGYGHLTWEWKQGIPSYLHPFIFVPLYSLLALLHLDTPWLM

SEQ ID NO: 155886 - protein, 155 aa, Glycine max
  Coding DNA Sequence Number=SeqID_39108
PLEENEHVIRSMTENVSQFVRLIVKECINCIPMRAMFDCDGYLAKKLTMCLNELSLVPTSSTGSVVQSKFVPNLGEALGKNGSGQTSMRSFNGDFPPWRCSRRQRRIGEGRHHPLGNKPWKKELHHQKCALDKKLEEDALMEEKKERRGSTKLKE

SEQ ID NO: 155887 - protein, 114 aa, Glycine max
  Coding DNA Sequence Number=SeqID_39109
  Subcellular localization annotation: CTP_CleavageSite=40; ConfidenceScore=5.27e-01
MQSKDGPLRMYRMNSKLKNRKLTGRRTTKNGRRTITKSITEMLRKHYGSASTLIFLLLSLLSDVGSIGACRPRILFINGFLCFLEDKWQRNGEGREREETPLQGEDESRRSSPP

SEQ ID NO: 155888 - protein, 96 aa, Glycine max
  Coding DNA Sequence Number=SeqID_39110
  Gene Ontology: Mol. function=RNA-directed DNA polymerase activity; Biological process=RNA-dependent DNA replication
MVTSRNLNAPGAFGIGLNMSIPHMMKGQGELKLWRLSGRGVDPECQPIVADTHHFGCKGTSPDMEVVDPLMKLSHDIVHLLVVQEFKQWYCRTSFE

SEQ ID NO: 155889 - protein, 260 aa, Glycine max
  Coding DNA Sequence Number=SeqID_39111
MDLARSLSYHVNVSPLRDVGKRDMGLHHCWCRDLPGTFISGVSRVLIALGASYTSLQLVVISLKLSEFLLMASLNLCNTGLELLESVLVCHGCWKKGMFYRGPIVSAKCTYQNLKLTNIKGRHSLGVSRVLIALGASYTSLQLVVISLQLSEFLLMALEMSRSGLHLRPDYVLTISEESYWKVSLSVMVVGRRLEMSRSGLHLRPDYVLTISEERSWGIFYRGPTVSAKCTYQNLKLTDVKGRHSLKSFESLFVRAITEV

SEQ ID NO: 155890 - protein, 140 aa, Glycine max
  Coding DNA Sequence Number=SeqID_39112
  Homolog annotation: Hit_ID=Q9LHL7; Match level="QueryCoverage=60%, HitCoverage=24%, E-value=4e-15, Identity=47%"; Hit description =Arabidopsis thaliana genomic DNA, chromosome 3, P1 clone: MEC18
MEKKNTKRGMFNGTYGRYDENTKRGRSLIVNPNIVILVCVLVADARNLDGVIDFKKRGSLGIFSYALPIKREADLIAEDDFPLAEVDVCLAIEKAKRCRFEEEVTLIMKKASWTTPRVMRMLAGCALLSQLSSWEKTRRM

SEQ ID NO: 155891 - protein, 67 aa, Glycine max
  Coding DNA Sequence Number=SeqID_39113
MVMVVVVVMAKGMEKQGNNTKIGKLSGNGILHREPELLIFLPLSLSEEGQPHQLRLHWIPLEFRPWN

SEQ ID NO: 155892 - protein, 724 aa, Glycine max
  Coding DNA Sequence Number=SeqID_39114
  Gene Ontology: Mol. function=RNA-directed DNA polymerase activity; Cellular component=chromatin; Biological process=RNA-dependent DNA replication
  Pfam annotation: Domain name=RnaseH; Domain location=540-667; Score= -4.8; E_value=0.00016; Accession=PF00075.14; Description=RNase H
MEEMSRFRNEVRQKRDEREGSTRTDSHKGPKYERYTPLIANCTTILEESFNMEVPIKLPPPLPPRPGPDNHLVGARPEDIKRTNTETTMPIEEGTKQKIEGDRGITSKDMNDNLKKNRKTNLPNKLELGINPINQDDPMVVSIVIANFMVSKVLIDQDTSYLVLMGRKTLNELRAIVSMPHLKMKFPTLMGEITTIKADQKQARQWYAKNLKVTPYPSTRELGKPYPKVMSLDEGSPIQTLIVYKGILGDQDGVFDVDPHDDTINKGPKPIEEFVKLQLGLNPGQSNDKWRMCTDYTDLNKACPKDAYPLPNIDRLVDDTSVFQVLSFQDAYSGYNQIRMHIPDEEKTTFITEDANFCYWVYVDDMVVKSYSIAQNMANMEEVLREIRRYNMYLNLEKCTFGMHSPTNVEEVQRMNGRLVSLSKFLPKLAEKVKPFYKLLKKTESFLWNEAYKKTFLAFNKTIVTSPVLSRPKPRVLLLLYLSVVDEVVSSTLVQQDKRHRLPINFSSHILHDVERRYQMIEKVALTLITSARCLRPYFQDWWNLYVDRASNVKGSRATIILEGPDNVTLEQALKLNFKVSNNQAEYEALIVGLKPIKEVGAKKLRCYTDSQLVQGKVANRYQTKETVLLRYYHTAKTLIDNFNYFEMYHIPWESNTRADMLSKLANTKKTWHVKTIIKETLQAPTIDTKEVMEGEEEEPGRITPYKNFLIWGCCHQTKMKHNA

SEQ ID NO: 155893 - protein, 183 aa, Glycine max
  Coding DNA Sequence Number=SeqID_39115
MEQNLKEAPQVDMDAINRKKQKRLARAIIDEDKGLNSFGIAKKIQKIMNGKQKKTRKNSQRGEEDEELIAREHITKKRHDVKTRAIKANPKIGEKEWSISFTGNKESVVSSSFGNESIENTHVSRLCKQYSASSKRPPPPPIHLEKECVTVQSPNWMRHDYVHTPSKAFMALPSDTIVHLQPP

SEQ ID NO: 155894 - protein, 96 aa, Glycine max
  Coding DNA Sequence Number=SeqID_39116
  Gene Ontology: Mol. function=RNA-directed DNA polymerase activity; Biological process=DNA integration
  Homolog annotation: Hit_ID=Q1SJY5; Match level="QueryCoverage=80%, HitCoverage=7%, E-value=8e-21, Identity=56%"; Hit description =Integrase, catalytic region
MGAKHLTRTKEWSHVVEQRYLIGTHNLSLLFKKREDFRLTSLCDVDYAGDKVERKSTSGSCHFIGSNLVTWICKKQVSTTLSIVEAEYILATSYCA

SEQ ID NO: 155895 - protein, 134 aa, Glycine max
  Coding DNA Sequence Number=SeqID_39117
  Gene Ontology: Mol. function=RNA-directed DNA polymerase activity; Biological process=RNA-dependent DNA replication
MIKEFWRNFKLHESMMCQKSRIKWVREGDANTNVFHGVVNWRKRSNCIKGLEVDRVWCGDPVKSIAKRNSKRRDDHSMLTCVFSEEDIKEAIWEYGGDKSPILLPNGFNFTFHEGCKCEESTWDNYVRISNVRK

SEQ ID NO: 155896 - protein, 116 aa, Glycine max
  Coding DNA Sequence Number=SeqID_39118
MDCFENEGSEEDKGRWWCSASANSLIGGGGGQPINSPMPKLQKEEAFKEVGGGLDWGKRKKNQPQLAEGKHIHIRECKDGLLNLNFFGSRYTLEKTRSVGRLGGKEAAEGSIEEFV

SEQ ID NO: 155897 - protein, 119 aa, Glycine max
  Coding DNA Sequence Number=SeqID_39119
MEKYLNSICIGEMGMIDASMIAIREVFFLNGFFSIHVRPMGNNLALLSGNKEDDLKELLQNDKEGLVMRILKLAKYRLKAQVEKDKGPSGEGQSPRVEKDEGPKAETLSRLLIVAEGPN

SEQ ID NO: 155898 - protein, 563 aa, Glycine max
  Coding DNA Sequence Number=SeqID_39120
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q3KF49; Match level="QueryCoverage=94%, HitCoverage=50%, E-value=9e-65, Identity=32%"; Hit description=Hpt Sensor Hybrid Histidine Kinase precursor
  Pfam annotation: Domain name=HisKA; Domain location=484-546; Score =58.0; E_value=3.1e-14; Accession=PF00512.15; Description=His Kinase A (phosphoacceptor) domain
  Pfam annotation: Domain name=SBP_bac_3; Domain location=206-421; Score=37.0; E_value=1.7e-10; Accession=PF00497.10; Description =Bacterial extracellular solute-binding proteins, family 3
  Pfam module annotation: Pfam domain module=HisKA::SBP_bac_3; Domain location=484-546::206-421
MLRYTDRDAALAAIAADQADMLFSKAGNTVPANAQLDASQNLLINRPVVVTQRDRAMQPVPYAAPVRLAVDQHYLSDSVIRAQFPQAHIMRYASSRVALSALATGEADYVLDNLTSASFLIERNYLNQLALADILAPRAQDASRLLVSQRRPVLLRAINRVIAAIPAEQHRAISRQWTQRPDIWRLQQPLALTAAEQRWLQQHGSVRVGFNPFFAPLALLDGRNQFQGISAELLHQIHLRTGINFVAVPEYHEDTLLMQLQQHKIDMVAALSYNAQWPGRFTQPWLHTPFVLITAANAGAPAALHSGLRISVMKGSPVIGWLQQHYPEVQLQLVDNASLGMQQVVEGKADGMVHNQLGAAYLIKRYFSGRMRIVQRVGTQPAHISFAVHAGDPELLSIMNKALNEILPSEISQLTSRWQGTPEVTASSWPLYRAPFYALAGVAAVVSLACLLWVYQRGREIRRRRRAQRQLQIARDRADRENQAKSRWVATVSHEIRNPVNAIIGLLALEARKAGASEALLTAWQSAQALSGLVGDILDMAKIERGQLTLAPQWHSIATLCQP

SEQ ID NO: 155899 - protein, 89 aa, Glycine max
  Coding DNA Sequence Number=SeqID_39121
EESSEEIYPQEEGQPLMVKEECKETLVSIATSLRLEFIPQVKELLDEGVPMNPKRIKVIPEWPTPPSNRFFQSWARDPIPQGYWVEDSK

SEQ ID NO: 155900 - protein, 99 aa, Glycine max
  Coding DNA Sequence Number=SeqID_39122
IQETNRLIILCLNTLEGTSFVVQVERTSTWIVILRTREGTSLVDQFKWRVIHLVVQREQGRVHPLWIFACKGFYKVIGNLKNPWLLGDWTLARVEAEPV

SEQ ID NO: 155901 - protein, 75 aa, Glycine max
  Coding DNA Sequence Number=SeqID_39123
MASCLEKNDNVFEEEAITEEDVAVDDVAIEGGKYREGFGKGVRGGGIWGFGGEITLKFLRLRSFESKRRHTLLAR

SEQ ID NO: 155902 - protein, 73 aa, Glycine max
  Coding DNA Sequence Number=SeqID_39124
MADIAHAIEIMPIALQQQSATVLEKIFMAMTCPKDRKVTYATYTLVDEAEFHNIELNRLWKIMENPSLGKFII

SEQ ID NO: 155903 - protein, 85 aa, Glycine max
  Coding DNA Sequence Number=SeqID_39125
MGVKYLEVVKRGSHPNNGWSPDEIRTQNGHNLSLRFVGNDRAWAARYRMTIICLYMPPNTIARFLNNKGCRICLCAFITRFAAPE

SEQ ID NO: 155904 - protein, 83 aa, Glycine max
  Coding DNA Sequence Number=SeqID_39126
SFFHGLFLSGWRLLSPLLLCLPLHLHGGKSPLKELIEAQRSSLRRSPTSKLPSPPPEDEGWSSGQATCASNSFMLIMEGNPKP

SEQ ID NO: 155905 - protein, 295 aa, Glycine max
  Coding DNA Sequence Number=SeqID_39127
  Subcellular localization annotation: CTP_CleavageSite=49; ConfidenceScore=5.03e-01
MAFPVSSIALGWGRDSNGNYHAKSAKLRHARHTSKRERGNVMRMCDHLRCWIRSKPNCRGLVVGNTNLTDPLVVVPPSHSSVHGNGHHQANYQENPRGLVVGGDAFDSMEDVGFVDSLGRATIAPSAHFPINRHAREAEKGSKVKKLRELREERKKKKKEEEAKSRHYRITTMIIVRLLGCAPDRTKRKVPLATLSFQGYALYWWTSLVRERRIHGDPLVEYRNDLKSALRKRHIPSYYERELMDKLQRIRQGSMSVEEYRQQMELLLLIAGLREEERTSIARFLSGLNMEVRDK

SEQ ID NO: 155906 - protein, 127 aa, Glycine max
  Coding DNA Sequence Number=SeqID_39128
MQPLIDRFEILSTLCCTICEVPRRAGNQKNAWLRDPWNSVMWRKPKRDIVMQSALWPSGFFLQKAVASGGSNLAHLGELGGKLLPYFAINRGRNEEGKGSTFLALRIFLKLLRKIVSVKKIQAEALP

SEQ ID NO: 155907 - protein, 165 aa, Glycine max
  Coding DNA Sequence Number=SeqID_39129
  Homolog annotation: Hit_ID=Q2AA34; Match level="QueryCoverage=99%, HitCoverage=36%, E-value=1e-12, Identity=30%"; Hit description =F7F22.15, related
  Subcellular localization annotation: CTP_CleavageSite=28; ConfidenceScore=5.36e-01
MATQLNQAQSQNSDKLPSQTVQNPKNVSAITLRSGKQIEVPPLVAAPALEPVKLHSTPAQRRKLPDREGANKKFHVGGPSSSSSDLQQPLIPLPFPPRAIPNKKMEEVDKEILETFRKVEVNIPLLDAIKQILGYAKFLKELCTHKRRLKGNERISMDRNVSALI

SEQ ID NO: 155908 - protein, 108 aa, Glycine max
  Coding DNA Sequence Number=SeqID_39130
MPSTICWDRAHKTPSGPGGVQQGPGVSNSCYGPLSVLPGAHPPPARSCHCDIGIVPARHPVDPEKSNRVLGFPALITGLCQFYGVPVAPNKVIRPPINRTFIKMYCAP

SEQ ID NO: 155909 - protein, 135 aa, Glycine max
  Coding DNA Sequence Number=SeqID_39131
GFPVIFNYLVRAYRIDVRQGYHVGGLIIHLNSLERGHYLEGTSVTTLSVEFLLECIAHSKFDLMKHRAVKVLSFQSFLQSELIEMDKGLQGVLTSGHTNPFNSEMDFSINIEKGLPPLEAILRITDLSNRRECWS

SEQ ID NO: 155910 - protein, 347 aa, Glycine max
  Coding DNA Sequence Number=SeqID_39132
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-51, Identity=32%"; Hit description= UPI00006A17C9 related cluster
GLHILTFRGLQVLAFKGLHALTFRGLQVLAIRGLHVLTFRGLQVLAFRGLQVLAFRGLHVLAIRGLHVLTFIGLHALTFRGLHILPFIRLYVLAIRGLHVLVFRGLLALAFRGLHVLAIRGLHALVFKGLHVLAFRGLHVLAFRGLHVLTIRGLHVLVFRGLLAFAFKGLHVLAIGRLHALTFRGLHVLAIRGLHALTFKGLHVLVFRGMFALAFKGLHLLTIRGLHVLAFRGLHVFIFRGLFALTFKGLHILAIRGLHALTFRGLHVLTFRGLQILTFRGLHVLVFRGLLALAFKGLQVLAIRGLHALTIRGLHVLAFRGLHVLTLRGLHVLVFRGLLALAFKGLH

SEQ ID NO: 155911 - protein, 120 aa, Glycine max
  Coding DNA Sequence Number=SeqID_39133
MPKAQVIDSRLQDQASTIQSKIQDSREEIKKQQVKTSYRIRYILCGTSRAYIYLGCKRGYISCGSVQVECTSTWLFEENKGGYIPCGSLLVQNFTRLSEISRTGSCLGTGCRHGLLPKPV

SEQ ID NO: 155912 - protein, 204 aa, Glycine max
  Coding DNA Sequence Number=SeqID_39134
WLKAQTQGITWLPKLKSPSGEEAKVPKESEEVQALKAELERTRVVKEKLKTTVTRVRKECDELRDVNMTTIEANNKLKLQRAKKDESRVESMILEDKLKACQRSKISLTEQLSRTKENMLSIIDQFKEKLNLAASHGQRLEDEHAMVSALQVEREARERVIESLHGEAMKWMDRFTLILNGSQELPRLLVRAKAMADVYSAPEE

SEQ ID NO: 155913 - protein, 75 aa, Glycine max
  Coding DNA Sequence Number=SeqID_39135
EPVQAIEVSSSEEDLEEDPEELPLEPAMDALDLPVDDEDPLPNVDSPEDIMSASEADSTEESGPRGTANSDDSSS

SEQ ID NO: 155914 - protein, 127 aa, Glycine max
  Coding DNA Sequence Number=SeqID_39136
  Gene Ontology: Mol. function=structural constituent of ribosome; Cellular component=ribonucleoprotein complex; Biological process =translation
  Homolog annotation: Hit_ID=Q2QD65; Match level="QueryCoverage=71%, HitCoverage=73%, E-value=2e-37, Identity=86%"; Hit description =Ribosomal protein S12
  Pfam annotation: Domain name=Ribosomal_S12; Domain location=9-127; Score=149.3; E_value=1e-41; Accession=PF00164.15; Description =Ribosomal protein S12
MDPIRRVHNRMDKLTLTRQFGIQFGSLGGIGKEFWNSGSKGDLSVNFSTITPKKPNSALRKVARVRLTSGFEITAYIPGIGHNLQEHSVVLVRGGRVKDLPGVRYHIVRGTLDAVGVKDRQQGRTSA

SEQ ID NO: 155915 - protein, 55 aa, Glycine max
  Coding DNA Sequence Number=SeqID_39137
MPTNEDATNLAMEDPPLMIVLWFHPSKVVAKAVTLSIRQQFGQPWPTWGVIPKDH

SEQ ID NO: 155916 - protein, 238 aa, Glycine max
  Coding DNA Sequence Number=SeqID_39138
  Gene Ontology: Mol. function=potassium-transporting ATPase activity; Cellular component=integral to membrane; Biological process =potassium ion transport
  Homolog annotation: Hit_ID=P03959; Match level="QueryCoverage=99%, HitCoverage=49%, E-value=3e-78, Identity=57%"; Hit description =Potassium-transporting ATPase A chain
MALTAIAQLLTKGKAQRGRDQEDAQHLHKVGQCRRVFERMRRVGVEETATVGAEHFDRFLRGYRPERQRLLRAFQRGEGMIGFKVLNAALADKKQRHQQANRQQHVDGDTRQVAPGVTERFQRTRALACVRLPVGVGDKADRRIERQIPAQARQMLRIERQRALPHQHRQQQHKAERVKQQDGQQIVRPAHRRAVNAGQTPQHAFAARQQGFIRHHQRQQAAQRLRQHHQHQQIARNQ

SEQ ID NO: 155917 - protein, 132 aa, Glycine max
  Coding DNA Sequence Number=SeqID_39139
  Gene Ontology: Mol. function=catalytic activity
  Homolog annotation: Hit_ID=UPI00003CD24C; Match level="QueryCoverage =99%, HitCoverage=32%, E-value=2e-36, Identity=51%"; Hit description =COG2206: HD-GYP domain
MAAVCDVYDAVTSDRPYRKGWTPSEAMHNMLSWRGHFDSALLHTFVRTIGIYPVGSLVRLASGRVALVVQAGEKSLLKPKVHVFWSLHSQREVKPEALDLGDSFCTDTITGAEDSGLWHNVDLNRIWALESA

SEQ ID NO: 155918 - protein, 71 aa, Glycine max
  Coding DNA Sequence Number=SeqID_39140
MAATRFNKRIITGETIMSAMSQSSAMPAEKLPAPLVFTLAAGAGLSVASIYYSQPMLISSASSSMWASAAL

SEQ ID NO: 155919 - protein, 312 aa, Glycine max
  Coding DNA Sequence Number=SeqID_39141
  Gene Ontology: Mol. function=transcription factor activity; Biological process=regulation of transcription, DNA-dependent
  Homolog annotation: Hit_ID=UPI00005FA169; Match level="QueryCoverage =97%, HitCoverage=95%, E-value=8e-98, Identity=58%"; Hit description =COG0583: Transcriptional regulator
  Pfam annotation: Domain name=HTH_1; Domain location=13-72; Score =86.4; E_value=8.8e-23; Accession=PF00126.17; Description=Bacterial regulatory helix-turn-helix protein, lysR family
  Pfam annotation: Domain name=LysR_substrate; Domain location=96-303; Score=136.9; E_value=5.7e-38; Accession=PF03466.10; Description=LysR substrate binding domain
  Pfam module annotation: Pfam domain module=HTH_1::LysR_substrate; Domain location=13-72::96-303
MGRMSTLTSVDRIELMQTFIRIVESGSLSAAAAQLGTTQPTVSRRLQALEQRLGLKLILRTTHALKLTDDGERCYAQARQLVATWHALEDELTGANDDPIGTLRVRAPHAFGQDQLIAPLMDYLQRYPRLAVEWMLNDRTPDFVSENVDCAIQVGAPTDPSVVAVLLAEVPRFVVAAPALLAAHAPVKEVTQLTQLPWLALTSFYRNEIALQRLSDGQPINLAIAPRLASDSLYAVRKAALAGMGAAIVSSWVVQEDLASGALVQLVPDWQAPPLPVWLTYPWASYYPARLQHFFAMIRDVMPQLTGTQPVR

SEQ ID NO: 155920 - protein, 94 aa, Glycine max
  Coding DNA Sequence Number=SeqID_39142
MQGYSKEFTRHGMRHEERTESLGEATVRDNEVKASEESDEVQALKAKLERARVVKEKFKSIAIKAAIVSSNSEEVKGIITGQRHDLEGRAKGLP

SEQ ID NO: 155921 - protein, 87 aa, Glycine max
  Coding DNA Sequence Number=SeqID_39143
  Gene Ontology: Mol. function=nucleic acid binding
MSTRMTLQLADRSITRPYEVIKDVLVKVKHLIFLADFIVIDIEEDADIPLILGRPFMSTASCMDKDPPSQNACLKVHVMEERTPEKK

SEQ ID NO: 155922 - protein, 327 aa, Glycine max
  Coding DNA Sequence Number=SeqID_39144
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-40, Identity=33%"; Hit description= UPI00006A17C9 related cluster
MLARPSLSEDYTSSPSEVCTPSPSVEYTSSPSEACTTSPSEDYTSSSAEGYTPSPIEEYTSSASKGNKSKPLEDYMSSPSKGCTPSPSEGCTPSPSEDYTSSPSNCYMPSPSEDYMSSPSKGCTPSPSEDYTSSPLECYKCSPSEDYTSSPSEGNTLSPTEDYTSSPLEGCTPSPLEDYTSSPSHGCTPSPSRNYTSSPSKGCTPSLLEDYIGLHALTFRGLHLLAFRMLQVLTFRGLHVLAIRGLHVLAIRGQHALAFRGLHVLAIRGLQALTFRGLHVLAISGFQVLAIKGLHALTFKELHVLAFRGLHALTFRGLHILVFRGLH

SEQ ID NO: 155923 - protein, 139 aa, Glycine max
  Coding DNA Sequence Number=SeqID_39145
MKAMKEQMATMMEAMMSMKKIMEANVVAIAATNAIAKVNPMPPSDLNQMNHPTSDMVGKDLGSMDNPHLVRKTSMPSHCHTVISSGSTCGRPTWAFLRVPKEYGAFWWKQPSSPERAELAWGKEGRANGFSPPGIEKSL

SEQ ID NO: 155924 - protein, 98 aa, Glycine max
  Coding DNA Sequence Number=SeqID_39146
MCAVKKVIWTFQLPVTKDETNIQRMCDSMMQMRKRATGGCAACGGHAATEELIVKVMMGLPRECKMWVFEGDFEEGLGCEVEIGECGIWSFERKRVCG

SEQ ID NO: 155925 - protein, 209 aa, Glycine max
  Coding DNA Sequence Number=SeqID_39147
  Gene Ontology: Mol. function=RNA-directed DNA polymerase activity; Cellular component=chromatin; Biological process=chromatin assembly or disassembly
MFPISRRVSGATWPAKELREIWAGGSWFMLLGGSETGIREGAGKDPSPSEKQSLPGKGASMPEVGFGVVTAEVIKGEERLGISREVGVAWGMKEAGEVGRVKGWLWVAGRGSEELVRVGDGSEFACPRTSPPVILRVQQPVRGWPVGAPEPPAESPAPMVRLAKSSKSAKYWATVPLCVSLHKAPEGSSNWDGANRVRKASKNAGHDGN

SEQ ID NO: 155926 - protein, 41 aa, Glycine max
  Coding DNA Sequence Number=SeqID_39148
MSPCRVHLIDYVVGLIKVAADNLDFEGQEPPKQEYKEGRAG

SEQ ID NO: 155927 - protein, 1157 aa, Glycine max
  Coding DNA Sequence Number=SeqID_39149
  Gene Ontology: Mol. function=RNA-directed DNA polymerase activity; Cellular component=chromatin; Biological process=chromatin assembly or disassembly
  Pfam annotation: Domain name=Chromo; Domain location=1058-1107; Score= 35.4; E_value=2e-07; Accession=PF00385.14; Description='chromo' (CHRromatin Organisation MOdifier
  Pfam annotation: Domain name=RVP_2; Domain location=2-111; Score= -46.0; E_value=0.0039; Accession=PF08284.2; Description=Retroviral aspartyl protease
  Pfam annotation: Domain name=RnaseH; Domain location=494-612; Score= -28.3; E_value=0.025; Accession=PF00075.14; Description=RNase H
  Pfam annotation: Domain name=rve; Domain location=752-908; Score =105.4; E_value=1.6e-28; Accession=PF00665.16; Description=Integrase core domain
  Pfam annotation: Domain name=zf-H2C2; Domain location=697-734; Score =21.2; E_value=0.00055; Accession=PF09337.1; Description=His(2) -Cys(2) zinc finger
  Pfam module annotation: Pfam domain module=Chromo::RVP_2::RVT _1::RnaseH::rve::zf-H2C2; Domain location=1058-1107::2-111::233 -402::494-612::752-908::697-734
MGNISGHPLLLLVDGGSTHNFVQQQLVTHLGLPCRATTPLRVMVGNGQYLECTSICDAIDIQIQDHTFTIDLHVLPVSGANVVLGVQWLKTLGPVLTDYSSLTMQFFYKGTLVTLRGDPDATLSPISSSQFRRLCRTQTSGLCFHITVLSEDSHASSDPLLPPIQALLTKYQVLFRPPQTLPPERPTDHHIHLLPQSNPVNVRPYRYPHFQKREIELQVESMLQRGLIQPSNSPFSSPVLLVRKHDGTWRFCVDYRALNSLTVKDRFPIPTIDELLDELGGAQCFSKLDLLQGYHQIRMHSTDIPKTAFRTHHGHYEFRVMPFGLCNAPSSFQATMNSIFRPFLRRFVIVFFDDILIYSGTFEDHLRHLDMTFKVLLDNQFVLKMSKCFFAKAQVEYLGHLVSGKGVEPMADKVAAIVNWPRPQSTRVVRSFLGLAGFYRRFIRGYAMIAEPLVRITAMDTFQWPSQAQQAFENLKGALASAPVLALPDFQIPFTVETDASGRGMGAVLSQKGHPIAYFSKPFSPKLLTASTYVRELFAITSAVKKWRQYLLGHQFTILTDHRSLKELLTQVIQTPEQHQYLARLMGFDYQIQYRSGAHNQAADALSRSPGNDPPEYSASQLMILSIPCLTFLDELKQQVATNQQYSQQRQAIIDFPDSHSDFTIHHDLILQKGRLWLPRDLPIIQSLLREYHLTPMGGHAGVTKTIARLSENFTWPGLRADVVTYIANCVECQVTKYETKRVAGLLCPLPVPFRPWEDLSLDFVVGLPPFQGKTVLLVIVDRFSKGIHLGILPQAHTAHMVAQLFIDIVVKLHGIPRSLVSDRDPLFISGFWQELFKLSGTHLRMSSAYHPQSDGQTEVMNRVIEGYLRAFVHRRPTSWGKFLPWVELSHNTSWNTSTGSTPYEITYGRKPFSFPDYIAGSSRIDAVNDLLLSRDEVFDSIRRKLLKAQASMKKSADTKRREVNYEPGTWVLLKLRPYRQKSLKEAQTVHGKLAKRFYGPFQIIDRVGKVAYRLKLPDGTRIHPVFHCALLKPFHGDPTLSSPNPLPTQFFNGQPLITPLAILDYRRHKEKNTYEVLVQWHGLSPDESSWEDWEQLKQDHHLEDKVILQGPKEVDRSVTTETTAEGQFGESINKGGVQLVKTKRKITRPAYLRDYA

SEQ ID NO: 155928 - protein, 218 aa, Glycine max
  Coding DNA Sequence Number=SeqID_39150
  Gene Ontology: Mol. function=calcium ion binding; Cellular component =membrane; Biological process=induction of apoptosis by extracellular signals
  Homolog annotation: Hit_ID=Q6YZJ1; Match level="QueryCoverage=79%, HitCoverage=69%, E-value=2e-62, Identity=65%"; Hit description =Putative fiber protein Fb1
  Pfam annotation: Domain name=efhand; Domain location=115-143; Score =27.0; E_value=6.6e-05; Accession=PF00036.22; Description=EF hand
  Pfam annotation: Domain name=efhand; Domain location=48-76; Score =26.3; E_value=0.00011; Accession=PF00036.22; Description=EF hand
  Pfam module annotation: Pfam domain module=efhand::efhand; Domain location=115-143::48-76
  Subcellular localization annotation: CTP_CleavageSite=42; ConfidenceScore=5.66e-01
MSSSYGGYHSQSYAPSAPEQPPYSNYNHTSSSTSNSSSSSFPAGTPQDVIRSFQMVDRDRSGFIDERELHQALSSGFHHFNFRTIRLLLFLFKNPHQPLTIGPKEFAALWSCLGHWRGIFERYDRDRSGKIDPLELRDALYGIGYAVPGSVLQLLLSKYGDGSGRRVELGFDSFVECGMIIKGLTDKFKEKDTRYTGSATLSYDAFMTMVLPFLVSYD

SEQ ID NO: 155929 - protein, 302 aa, Glycine max
  Coding DNA Sequence Number=SeqID_39151
  Homolog annotation: Hit_ID=Q2QXI9; Match level="QueryCoverage=63%, HitCoverage=83%, E-value=4e-22, Identity=35%"; Hit description =Expressed protein
MFWKKIPSHQVISMTVCKGNFQIGSPFSKGDREYLDNFKNTCYLGLLYGQQQILAKLLLHKAPTLASKKGMATCGSLHHIFDTLLPEKPTLLESLSWNQIKPLKPTDQTHSFTEIFGELHFKESPISSSFTPHVSTSSSSSTEITNNTNRHKSSDSFSSLSSESLHLCTEGLGFESSDDVEDFKDEMSESCGVYKEKEGVKKYATSRVSEYPPPISCIGRSGKPWVCFRSYRSEGRFVLEEIRIPTHEFLHACREDGRLKLHFVHPEEEPIEEEEEDDDHVGVETMDEEEEEENMGEENDDV

SEQ ID NO: 155930 - protein, 263 aa, Glycine max
  Coding DNA Sequence Number=SeqID_39152
  Gene Ontology: Mol. function=hydrolase activity, acting on carbon -nitrogen (but not peptide) bonds; Cellular component=cytosol; Biological process=nitrogen compound metabolic process
  Homolog annotation: Hit_ID=Q8VYF5-2; Match level="QueryCoverage=79%, HitCoverage=70%, E-value=1e-109, Identity=90%"; Hit description =Isoform 2 of Q8VYF5
  Pfam annotation: Domain name=CN_hydrolase; Domain location=2-105; Score=54.0; E_value=5.1e-13; Accession=PF00795.12; Description =Carbon-nitrogen hydrolase
MQKLAKELGVVIPVSFFEEANNAHYNSTAIIDADGTDLGIYRKSHIPDGPGYEEKFYFNPGDTGFKVFQTKFAKVGVAICWDQWFPEAARAMVLQGAEILFYPTAIGSEPHDGSIDSRDHWKRVMQGHAGANLVPLVASNRIGKEIIETEHGKSEITFYGNSFIAGPTGEIVSIADDKEEAVLIAQFDLDNIKSMRHCWGVFRDRRPDLYKNYTWNGLSLYKLPERLSLTKKARTRILVRFNLTSKVSSPVHEMRITYQDYDM

SEQ ID NO: 155931 - protein, 470 aa, Glycine max
  Coding DNA Sequence Number=SeqID_39153
  Gene Ontology: Mol. function=GTPase activator activity; Cellular component=intracellular; Biological process=signal transduction
  Homolog annotation: Hit_ID=Q9FMR1; Match level="QueryCoverage=67%, HitCoverage=69%, E-value=1e-98, Identity=60%"; Hit description=Rac GTPase activating protein
  Pfam annotation: Domain name=PBD; Domain location=152-198; Score =48.8; E_value=1.9e-11; Accession=PF00786.18; Description=P21-Rho -binding domain
  Pfam annotation: Domain name=RhoGAP; Domain location=215-352; Score =109.1; E_value=1.3e-29; Accession=PF00620.17; Description=RhoGAP domain
  Pfam module annotation: Pfam domain module=PBD::RhoGAP; Domain location=152-198::215-352
LNESTKLIKVAADNLDFEGQEPPKQEYKEGRAGNICITELVMDASLQGTFESSKSFIVPAWLLSVWTAISSIVSEICRPAMTEVLHSSSPPHFVASSSPPTKTRTTTTTTTTSSFSSHNNAFLLRPLLALLLTLLRKSFQLSRRNICSIIMNIGSPTNVRHVAHVTFDRFNGFLGLPVEFEPEVPRRPPSASASVFGVSTESMQLSHDSRGNSVPTILLLMQKHLYVQGGLQVEGIFRINADNGQEEHARDQLNLGVVPEGIDVHCLAGLIKAWFRELPTGILDSLSPEQVMQCQTEDECAELVRHLPHTEASLLDWAINLMADVVQHENVNKMNAHNVAMVFAPNMTQMADPISALMYAVQVMNFLKTLILRTVRERKDSVQDTPAENKEAQENFVLEKTALDRSPESLQNNSTRAEPGSLTNSSENLVSNEDLYCEFPPVGNMGKSKTGQSSKSNARKESKKTRGSNL

SEQ ID NO: 155932 - protein, 49 aa, Glycine max
  Coding DNA Sequence Number=SeqID_39154
  Gene Ontology: Mol. function=hydrolase activity, acting on carbon -nitrogen (but not peptide) bonds; Biological process=nitrogen compound metabolic process
  Homolog annotation: Hit_ID=Q9XGI9; Match level="QueryCoverage=88%, HitCoverage=14%, E-value=3e-13, Identity=86%"; Hit description=N -carbamoylputrescine amidase
MEKGRTVVVSALQFACTDDVSTNVATAERLVRAAHKQGANIILIQVNVK

SEQ ID NO: 155933 - protein, 90 aa, Glycine max
  Coding DNA Sequence Number=SeqID_39155
MRAAASCSNQGRRGEEIAPRNAKNGGDFQNPVTRGAAAGGENRDKGIWGFVLRESLRERLMNSAKLGPGCQTGRVIGFKRVCLGYTGLTS

SEQ ID NO: 155934 - protein, 309 aa, Glycine max
  Coding DNA Sequence Number=SeqID_39156
  Homolog annotation: Hit_ID=Q5N7G7; Match level="QueryCoverage=24%, HitCoverage=36%, E-value=2e-14, Identity=58%"; Hit description =Prolyl 4-hydroxylase alpha subunit-like
  Pfam annotation: Domain name=DUF584; Domain location=118-243; Score =92.7; E_value=1.1e-24; Accession=PF04520.4; Description=Protein of unknown function, DUF584
MDLHDPNRFRNRKQTLSSRERFLGVPSSHAPRIENSSSSATDDDVVVFSNNDDLIEDDVVFSNNDDSTEPSSSSQIPNRHHNHNNHHKAFAFGPSDASFGILAALPENDHASSNGSHFFHHKPSVSVSVSVSLSSSSSSSAAARLIPAIPKPPPERTPSSSSSLKFHQSAPVNVPLMPMRRHHRRDFDDDDDATEEMLPPHEIVARNSAQSPMLAYSVLEGVGRTLKGRDLRQVRNAVWRQTDIGTGQSRLLSLGCLAIQAERFAAMAPPWQNGVVDCLPPSINTVWDLGIHFVHVRNGKLAKDGTEDE

SEQ ID NO: 155935 - protein, 218 aa, Glycine max
  Coding DNA Sequence Number=SeqID_39157
MAVLLNQLEEPHQLLSSIPLNSKYYAAPDFINRSIVLSAQNNALGPPKSITEGLVDEVDDNDVVRVGGCGGGCGGGEGVRGSEVGSEIMKGERSKCADDDEIKFDGINGRVGEDNNDESLPTPYVKATCSPSPASVIFSPNNTVSDFKVLKATKAEFSALDGQSVSYATLEFPVPVLVLCQFLTLFNTTIDDNDLALAFKTDVATIQTLKKGFAAYKA

SEQ ID NO: 155936 - protein, 58 aa, Glycine max
  Coding DNA Sequence Number=SeqID_39158
MERTEELKKRRYLPSEMRKVIETSTRLQEKENVFVGIFFCCYYGFVPMMSPEKYPGVL

SEQ ID NO: 155937 - protein, 218 aa, Glycine max
  Coding DNA Sequence Number=SeqID_39159
  Homolog annotation: Hit_ID=Q67X40; Match level="QueryCoverage=79%, HitCoverage=94%, E-value=1e-19, Identity=35%"; Hit description =Integral membrane family protein-like
  Pfam annotation: Domain name=DUF588; Domain location=54-203; Score =176.9; E_value=5.2e-50; Accession=PF04535.3; Description=Domain of unknown function (DUF588)
MDSGKEGEAPAATTSPESRRTRSNGKGKGIADAAPPSATVVSTKATPLPRAGWKKGVAILDFILRLGAIGSALGAAAIMGNSEQILPFFTQFFQFHAQWDDFPMFQFFVFANGAAGGFLILSLPFSIVCIVRPFAVGPRLLLVILDILMMALVMAAASAAAAVVYLAHNGSQDANWIAICQQFTDFCQVTSEAMVASFVAAFFLICLIVVSSVALKRD

SEQ ID NO: 155938 - protein, 280 aa, Glycine max
  Coding DNA Sequence Number=SeqID_39160
  Gene Ontology: Mol. function=hydrolase activity
  Homolog annotation: Hit_ID=Q53QH1; Match level="QueryCoverage=98%, HitCoverage=65%, E-value=2e-25, Identity=37%"; Hit description=Dcp1 -like decapping family, putative
MVSGSIMHVNVKRLPIFLAAVKLCLGDLLVMGSNPETASLHMQGILNAYAKVPPKSKVSSTKSEFEELEAVPTMAVMDGPLEPSSSTTSNVADVPDDPSFVNFFSAAMAIGNTSNTPITGQPYQSSAAISSSSVPTHTATPTVPTLQIPSLSQSTPLIPPLDAVESICSSNRTAKLVKPSFFVPPPSSAMMIPPVSSSTPTAPPLHPAVNVHRPYGAPLLQPFPPPNPPLSLAPAASPSSSPNYGSVISREKVRDALMVLVQDNQFIDMVYRALLNAHQS

SEQ ID NO: 155939 - protein, 405 aa, Glycine max
  Coding DNA Sequence Number=SeqID_39161
  Homolog annotation: Hit_ID=Q9FMR7; Match level="QueryCoverage=87%, HitCoverage=86%, E-value=1e-122, Identity=55%"; Hit description =Arabidopsis thaliana genomic DNA, chromosome 5, P1 clone:MWD9
  Pfam annotation: Domain name=DUF1022; Domain location=50-405; Score =519.3; E_value=4.1e-153; Accession=PF06258.2; Description=Protein of unknown function (DUF1022)
MEKSLPSSKFEAMRIKPILLPEPPSPTAARGTPDIFESGVHTLVRRAVVIGNGFPSSENHSIGLLRALGLSHDHLLFRVTRPRGGIDDWLHWFPLSLHRKFHYLISMFRAFSSKSNYLPLTSHPNGLSSILQADANHIVNLARETYEKEGPLLVVASGRDTISVASSIKRLAPDLVFVVQIQHPRSHLNRFDMVITPHHDYYPLTPEGQKQVPKFLRRWITPREPPDSHVVLTLGALHRIDFASLRSAAIAWQDVFANVPRPLLVVNIGGPTKNCQYGVDLAKQLATSLISVLGSCGSVRISFSDRTPQKVSNIIVKELGNNRKVYIWDGQEPNPHMGHLAWADAFVVTADSVSMISEACSTGNKTFIDSTSCAKLQGEQQIPHSQNLYNLMTQSTFRVSMSASS

SEQ ID NO: 155940 - protein, 172 aa, Glycine max
  Coding DNA Sequence Number=SeqID_39162
MVDRYKKSRKLKERETSSFIAVLGLHFLPLLAGIMSRPMLLVFLLIILIITSQFEWKQQLVADVDSNPNLPQKQHQISKAEETVKEKVLLHFDYKRVKKISQNTERGVDEDYNKDGFSLYACCHGQMQKGSSIEKERDNRILSMSTLSLPSIYLAPLASLKIPVVGVSCFPL

SEQ ID NO: 155941 - protein, 297 aa, Glycine max
  Coding DNA Sequence Number=SeqID_39163
  Homolog annotation: Hit_ID=UPI00004DBF97; Match level="QueryCoverage =69%, HitCoverage=50%, E-value=2e-28, Identity=31%"; Hit description =UPI00004DBF97 related cluster
MTHPVPSQAASTITRSAPLAMPAPSLSLDIKVLIGLLLFSVVWLLQIDSSSLTAPKDNLEQLTWVHSLEWGYYKHPPLPTWMFSVPVNVFGLSARTSYVTGALFTLAGLLVFWKLMQTLRGSRHATLALLAALCITYYNERLHFFNHEVVLMPFFVASALLVWRAMILAAVAVFLFWLASGAWRERVHMIGLVLAAAISLAIISPHLYWLFLNDFGPIRYATESSLGASLGGGARLLNTLHWLADQLLNRALLAWVLLGLVMALHRRSRLAPQDTPQRPGTADASRALILCFGLTPI

SEQ ID NO: 155942 - protein, 145 aa, Glycine max
  Coding DNA Sequence Number=SeqID_39164
  Homolog annotation: Hit_ID=Q2PMM5; Match level="QueryCoverage=99%, HitCoverage=6%, E-value=3e-69, Identity=91%"; Hit description =Protein ycf2
MVKRKSPYLTRLLTIPMNSIGPKNDTLEESSESSNINRLIVPLLYLPKGKKIFESYFLDPKESTRVLPITKMYIMPESNWVRGGGGIEILVVRYLMKPLLELRSHSKRKVSNIWNSFLYIIWMIRSVRIMIGNFLIVFLQERGET

SEQ ID NO: 155943 - protein, 134 aa, Glycine max
  Coding DNA Sequence Number=SeqID_39165
  Gene Ontology: Mol. function=RNA-directed DNA polymerase activity; Cellular component=nucleus; Biological process=RNA-dependent DNA replication
MAVRRDQGLCYHCDEKWSHGHRCKPRLHILIADEDLEPSSGPSALDSHTGSAIDTLLTPQISLNAMEGTPAPQIFCLLGSLSHHQVVILVDGGSTHNFIQSRVAKFLTLPSTPTSALRVMVGNDHTLDCDTLSF

SEQ ID NO: 155944 - protein, 44 aa, Glycine max
  Coding DNA Sequence Number=SeqID_39166
MKGFKSFKAHPIPLKLLRPQGPTASCGGRELVQVADRGMRMETV

SEQ ID NO: 155945 - protein, 42 aa, Glycine max
  Coding DNA Sequence Number=SeqID_39167
MWIPIGANVDWGGLGKKMNMARTVFIRGGMGVINEGDEGGED

SEQ ID NO: 155946 - protein, 85 aa, Glycine max
  Coding DNA Sequence Number=SeqID_39168
MTLLFRNILPNDHITDLALWKYQLFCAGSCPQDTQWTRRSPTGSGGSSHRPQQVHQAPINRAFIEKYWAPRQAQGGVNGGGPGIK

SEQ ID NO: 155947 - protein, 208 aa, Glycine max
  Coding DNA Sequence Number=SeqID_39169
  Gene Ontology: Mol. function=DNA binding
  Homolog annotation: Hit_ID=Q1S0F5; Match level="QueryCoverage=90%, HitCoverage=36%, E-value=3e-17, Identity=33%"; Hit description=IMP dehydrogenase/GMP reductase
KHLEEKAKALAVQGEWASFIDILVLLVFGVVLFPNTDGLVDLVAIDAFLAYHYSKESPVVAVLADAYDIFDRRCEKRGARIVCCTTVPYIWLVSHLFHHESRPVCPLQGHRMCVEKGEANWEQLLAGMVEASINWFPRWKEGKAIVLSSCERFSNVPLMGTRGCINYNLVLAIRQLDYPMRGASSEESIMPFIARGFSGPNVRMFQRV

SEQ ID NO: 155948 - protein, 87 aa, Glycine max
  Coding DNA Sequence Number=SeqID_39170
  Homolog annotation: Hit_ID=Q09JM0; Match level="QueryCoverage=65%, HitCoverage=98%, E-value=1e-10, Identity=63%"; Hit description=10 kDa putative secreted protein
MNRKLGYGAQLRANLDPTKGVGRLRQQDGGHGSRNPLRRRGGRCKTQGASPGGAVVGADLGGSSKYSNENFEGRRGERFHVNGTCTW

SEQ ID NO: 155949 - protein, 77 aa, Glycine max
  Coding DNA Sequence Number=SeqID_39171
MSDKGNACALLVMGKLEGVDGDPVLRGRRIRATWGYVSSVEGGQLGMVGSCVICGCGRVDLHHRPITYDGYPIILQA

SEQ ID NO: 155950 - protein, 97 aa, Glycine max
  Coding DNA Sequence Number=SeqID_39172
MKESLFNNFMEKYRFKTSYDCNTARTIWNKICVDRFSDALARAREKAKQVTVSENVADYKGHGPRGMRTEIWDGLVGIWNTPGWKNKSIKAKMNRVA

SEQ ID NO: 155951 - protein, 55 aa, Glycine max
  Coding DNA Sequence Number=SeqID_39173
MCFREENPSRGASVTLLRRFHEQFHEDFPSFFVVLHTFFGLQPQNLINCSRCNLG

SEQ ID NO: 155952 - protein, 150 aa, Glycine max
  Coding DNA Sequence Number=SeqID_39174
MHSIGVRDPLEQPPSPIYRRKGEEVAAQLAQASRSLPLEVSYAPPKLIMEKAYPGLREFYGSITEALEARFQKKEERCLPPSSPRRVGFLARKEETIQKPLDGPRFENFYLHPHLDKFNPPPFLCFLAVFFPKPHGTLRIPWRWVLSLPK

SEQ ID NO: 155953 - protein, 116 aa, Glycine max
  Coding DNA Sequence Number=SeqID_39175
  Homolog annotation: Hit_ID=Q9ARH4; Match level="QueryCoverage=71%, HitCoverage=42%, E-value=2e-09, Identity=33%"; Hit description =Plastid-targeted protein 2
MVVYASITPGDPIDPSEKVETTIDEAQRVVDIVEDVAEGVDKVAEEAVKHLPDGKLRDAVEFVEKVAEDIDKHAERAEDELEKVENMENEFESFIESTTHHQENSVTTTAEAKEQK

SEQ ID NO: 155954 - protein, 100 aa, Glycine max
  Coding DNA Sequence Number=SeqID_39176
MVDLMVANVLGIEKAIGLEFLSKHDIIKIFKISAKHRLHQLDLIAGHEQEHDVAQAKMVASMVEDTGKGSCGKTKTLSITTNSFHMEIGHNKLKYMLIKN

SEQ ID NO: 155955 - protein, 73 aa, Glycine max
  Coding DNA Sequence Number=SeqID_39177
MVTADPWTWRSLVSKVFLTGESMHRGQATSLASVATIQVGLAIVKLYGSPLDTSGLKMTFVRRERYHVEETHT

SEQ ID NO: 155956 - protein, 81 aa, Glycine max
  Coding DNA Sequence Number=SeqID_39178
MDKVDIFVPHPLTNACLLIQLSPECGCKPLVCLLKQPALLSVDFQDRSIRDYSSCTLVGRSELSRIGCWTNGLSYLKKKGG

SEQ ID NO: 155957 - protein, 152 aa, Glycine max
  Coding DNA Sequence Number=SeqID_39179
  Gene Ontology: Mol. function=transcription regulator activity; Cellular component=nucleus; Biological process=regulation of transcription
  Homolog annotation: Hit_ID=Q2HTN6; Match level="QueryCoverage=100%, HitCoverage=40%, E-value=9e-23, Identity=39%"; Hit description=Helix- loop-helix DNA-binding
  Pfam annotation: Domain name=HLH; Domain location=119-151; Score =13.5; E_value=0.0053; Accession=PF00010.16; Description=Helix-loop -helix DNA-binding domain
MALEAVVFPQDPFTYGCNNKDFLYSLVGGGGGSQTHVGIINNNNIDHTLHANWDSSSPSVLQNVKDQWDSHSSPEACTVDQSLPAVFPPPSSSAEAAAMGRRKRRRTKSAKNKEEIENQRMTHIAVERNRRKQMNEYLAVLRSLMPPSYVQR

SEQ ID NO: 155958 - protein, 73 aa, Glycine max
  Coding DNA Sequence Number=SeqID_39180
MPLLLGNTGSESTSQVKKWNMNSTRWEDTKNEVTLSKKGNINEEKKIVLKQAQPNTRAKRASGAKRAKKTGAK

SEQ ID NO: 155959 - protein, 256 aa, Glycine max
  Coding DNA Sequence Number=SeqID_39181
QVVRFDADTINDFLDTPVILEDGEKYPAYTRYLSTHPDPDTIAATLCTPGGRFVLNADGLPWKLLKKDMTTLAQTWSVLSYYDIAPTSHTSNVNLDRAHLIYGVVSDTLIFESLSPAINLAYMKKNCWNPADPSITFPRTHRTRTRASTSEAPLPTQPSSQPSSQRQRPPPASTSASLDKHGQILRSLHIRQQLIMENMHKLSLHLQMDPPLITLEAYRQQVAWPGDQPSIDRGAEPSGAAEDPATDEDLIADLAS

SEQ ID NO: 155960 - protein, 81 aa, Glycine max
  Coding DNA Sequence Number=SeqID_39182
MKLSEIHYDNMHAKFRKLHLCILSLKKFAHFASALSFCIFNFEASTIHHPKLAKRAYRAKRVHLLRMNTHPLAKLPVAKQG

SEQ ID NO: 155961 - protein, 184 aa, Glycine max
  Coding DNA Sequence Number=SeqID_39183
  Subcellular localization annotation: CTP_CleavageSite=52; ConfidenceScore=5.10e-01
MSCLAIITPISLCRSVSWCMPPTRHPLDPNKSNRALGFPALITSLCQSFGVPVAPSKVIRPPITRAFIKKYCMPRQAQGEAHQATDAQPLPHQADPAGSLGMERYLQHLVRQQAANHRGQVQIHECLYRFSLSQQGQGSAPFACPTPEAQEGEEPAGSPNEAEEARMDEDMTDLLSFLGGSGAT

SEQ ID NO: 155962 - protein, 116 aa, Glycine max
  Coding DNA Sequence Number=SeqID_39184
  Gene Ontology: Mol. function=zinc ion binding; Cellular component =nucleus; Biological process=proteolysis
  Homolog annotation: Hit_ID=Q1S6A6; Match level="QueryCoverage=95%, HitCoverage=22%, E-value=3e-25, Identity=45%"; Hit description=FAR1
MGGHEGLGFHKKYLFNHIERQRRAKIKDEDVLVSLSYLEGKADNDPMFYGRYVLSKFFGEVVACDNTYKKNKYNKPLVLFSGKDDHCQTVIFGCALVFDETTETYKWVLESFLATI

SEQ ID NO: 155963 - protein, 392 aa, Glycine max
  Coding DNA Sequence Number=SeqID_39185
  Gene Ontology: Mol. function=metal ion binding; Cellular component =integral to membrane; Biological process=ubiquitin cycle
  Homolog annotation: Hit_ID=Q84W40; Match level="QueryCoverage=83%, HitCoverage=79%, E-value=7e-47, Identity=37%"; Hit description=RING -H2 finger protein ATL1N precursor
  Pfam annotation: Domain name=zf-C3HC4; Domain location=135-176; Score= 26.2; E_value=0.00012; Accession=PF00097.15; Description=Zinc finger, C3HC4 type (RING finger)
MSMQKESPLIRLHSFDQGHAWLALLHLLIHISPAVTGQPVTPPVQPDSNKSVIAIMAIVVIMFLISAFLSLYSRKCSDRPVQTRGILDLAGPTGAAGNPLQAESNGLNQATIETFPTFLYADVKGLKIGKDTLACAVCLNEFEDNDTLRMIPKCCHVYHPDCIGAWLASHSTCPVCRANLVPQPEDMNTNTNTNMPSILSIQIPNEEEREHEHEHEYEAVIVGEQHKRDVDVESPKVDLLRRIRTLHHDHQSRPSRSKSTGFLSSLLFPRSNSMGQLAQHAGENYERFTLRLPEEVLRSQMVLKRANSCVCFTRMSSGTWGYRTRSVGRGCVQYERFGGENEQWGFTLTPPSLVRNSWNNNRSTRKSPVQRSGVALDNNNAGERSTEFLRLG

SEQ ID NO: 155964 - protein, 99 aa, Glycine max
  Coding DNA Sequence Number=SeqID_39186
  Gene Ontology: Mol. function=zinc ion binding
  Homolog annotation: Hit_ID=Q1SYI4; Match level="QueryCoverage=91%, HitCoverage=40%, E-value=4e-15, Identity=40%"; Hit description=Zinc finger, SWIM-type
  Pfam annotation: Domain name=SWIM; Domain location=38-74; Score=14.2; E_value=0.014; Accession=PF04434.8; Description=SWIM zinc finger
MKVFSRGFYNLVKDQILVAGSLNAIKKIGNHDKRGRQREVVYHKAEAKFSCACRLYESKGIPCSHIIRAMRFDHVEAFLATLICKRWLKDAKKSFIKII

SEQ ID NO: 155965 - protein, 171 aa, Glycine max
  Coding DNA Sequence Number=SeqID_39187
  Gene Ontology: Mol. function=DNA binding; Biological process=DNA integration
  Homolog annotation: Hit_ID=Q1RWP6; Match level="QueryCoverage=48%, HitCoverage=6%, E-value=4e-13, Identity=47%"; Hit description=Zinc finger, CCHC-type; Polynucleotidyl transferase, Ribonuclease H fold
  Subcellular localization annotation: CTP_CleavageSite=32; ConfidenceScore=5.41e-01
LGPVHGQSDSPRINVSFVSATSSLSSKPRDRVASKENSVDGGFDVSKKPFKVLEGSGRWFGFCHAKMFKDVSYELMLGELNAKDHRLLMKFESMIMVLRVFEARRLGHAYYFFMEGSLKEHIVDIKLMHMPAIAKGYGGESLPGEDNGNKGFAGVIVEMGTIMGKAWWELL

SEQ ID NO: 155966 - protein, 59 aa, Glycine max
  Coding DNA Sequence Number=SeqID_39188
  Subcellular localization annotation: CTP_CleavageSite=46; ConfidenceScore=5.01e-01
MAVVTSLHSFSRPLRVWMMTSSSSMGVVTMGRLVDPVESINKSHPVVAYKESIYLDSPG

SEQ ID NO: 155967 - protein, 99 aa, Glycine max
  Coding DNA Sequence Number=SeqID_39189
  Homolog annotation: Hit_ID=Q6Z7S5; Match level="QueryCoverage=93%, HitCoverage=29%, E-value=1e-09, Identity=45%"; Hit description =Transducin family protein / WD-40 repeat family protein-like
  Subcellular localization annotation: CTP_CleavageSite=75; ConfidenceScore=5.75e-01
MPFFPHSHRHISPSQPPENNPPPPPSNASAFTVDFCLPMLLTNFAVAVNSNGINRVLVRLNGLQTPVTQQVPHLKASIPRNRIHKPLVNRQTRNGCQNV

SEQ ID NO: 155968 - protein, 70 aa, Glycine max
  Coding DNA Sequence Number=SeqID_39190
  Gene Ontology: Mol. function=L-ascorbate peroxidase activity; Cellular component=chloroplast; Biological process=hydrogen peroxide catabolic process
  Homolog annotation: Hit_ID=Q9THX6; Match level="QueryCoverage=91%, HitCoverage=18%, E-value=1e-24, Identity=84%"; Hit description =Putative L-ascorbate peroxidase, chloroplast precursor
MANAADLIQRRQRSEFQSKVKETLFTAIKGNPDLIPSLLTLALNDALTYDKATKSGGPNGSIRFSLHRKK

SEQ ID NO: 155969 - protein, 576 aa, Glycine max
  Coding DNA Sequence Number=SeqID_39191
  Gene Ontology: Mol. function=nucleotide binding
  Homolog annotation: Hit_ID=Q67X84; Match level="QueryCoverage=72%, HitCoverage=76%, E-value=1e-166, Identity=68%"; Hit description =Putative auxin-independent growth promoter
  Pfam annotation: Domain name=DUF246; Domain location=118-462; Score =713.1; E_value=1.9e-211; Accession=PF03138.5; Description=Plant protein family
MKKRKWIPLVVLRKLLIAAICSIAFVALFSARVHIVPSSKDHRFNDKISTTQDPQSWMRELAPPHLSKAPLPTPKLSGSKGNLDYQKLWKPPSNRGFLPCTNPTPNYNTPAESQGYLLVHTNGGLNQMRSGICDMVAVARIINATLVIPELDKRSFWQDTSNFSDIFDEEYFMNSLANDVKIIKKLPKELVNATRVVKQFISWSGMDYYENEIASLWEDYQVIRASKSDSRLANNNLPPDIQKLRCRACYEALRFSPRIEQMGKLLVERMRSFGPYIALHLRYEKDMLAFSGCTHDLSPVEAEELRSIRENISYWKIKEIDPIEQRSKGLCPLTPKEVGIFLTALGYPSTTPIYIAAGEIYGGESHMAELRFRYPLLMSKEKLASIEELEPFSNHASQMAALDYIVSIESDVFIPSYSGNMAKAVEGHRRFLGRGRTISPDKKALVHLFDKLEQGIITEGKKLSNRIIDLHRRRGEHQSDSGQECSIRPKQNIAISGLYPTVKHPRLEKTVPCFTVAEVASYIEADIEGNEECSCDGGVIGEAVIRLHAVADEDVDGELVGVVAVGVGEDSVDKED

SEQ ID NO: 155970 - protein, 106 aa, Glycine max
  Coding DNA Sequence Number=SeqID_39192
MCMISLRLSAFNEYGFRVINILTGSVCHIGWCIVGRQAIWPYGGVKSTSAMVLVAAIATALTSIISFMLIMASIIVAICSFKASVLAFICSCTSSTSPITLALAPV

SEQ ID NO: 155971 - protein, 481 aa, Glycine max
  Coding DNA Sequence Number=SeqID_39193
  Gene Ontology: Mol. function=amino acid transporter activity; Cellular component=membrane; Biological process=amino acid transport
  Homolog annotation: Hit_ID=Q9LHN7; Match level="QueryCoverage=87%, HitCoverage=88%, E-value=1e-165, Identity=66%"; Hit description =Similarity to amino acid transporter
  Pfam annotation: Domain name=AA_permease; Domain location=44-459; Score=-44.2; E_value=0.00015; Accession=PF00324.11; Description =Amino acid permease
  Pfam annotation: Domain name=Aa_trans; Domain location=28-424; Score=- 163.9; E_value=0.1; Accession=PF01490.8; Description=Transmembrane amino acid transporter protein
  Pfam module annotation: Pfam domain module=AA_permease::Aa_trans; Domain location=44-459::28-424
MGEKENPSAESAPTTTVPTVSRTTKKPKKLTLIPLIFLIYFEVAGGPYGEEPAVQAAGPLLALLGFLVFPFIWSVPEALITAELTTAYPGNGGFVLWASRAFGPFWGSLMGTWKFLSGVINIAAFPVLCIDYVQKIFPVFHSGWARHVAVLSSTLTLSFLNYTGLTIVGYVAVLLAVISLTPFIVMSLIAIPKIKPHRWISLGQKGVKKDWNLFFNTLFWNLNFWDNVSTLAGEVDEPQKTFPLALFVAVIFTCVSYLIPLFAVTGAVLVDQTQWENGFHAQAAEIIAGKWLKIWIDFGAVLSAIGLFEAQLSSSAYQILGMAEIGILPKLFGVRSKWFHTPWLGILVSTIITIGVSYMDFTDIISSANFLYSLGMLLEFASFLWLRWKSPSIKRPYRVPLKLPLLVVMCLVPSGFLVLIMVIATKTVYLVSGVMSVAGIGFFLFIKLCKRKKWVGFEQEEDDGFERDNVSSLCISVVVLD

SEQ ID NO: 155972 - protein, 123 aa, Glycine max
  Coding DNA Sequence Number=SeqID_39194
  Homolog annotation: Hit_ID=Q6R074; Match level="QueryCoverage=33%, HitCoverage=15%, E-value=3e-13, Identity=78%"; Hit description=MYB transcription factor
  Pfam annotation: Domain name=Myb_DNA-binding; Domain location=17-58; Score=20.2; E_value=0.0075; Accession=PF00249.21; Description=Myb -like DNA-binding domain
MAGHMGRGVIEEQVWRKGPWTAEEDRLLVEYVRLHGEGRWNSVARLATNKNSEYFDILTLTVARSRHHSKEHDFGYGGGGNNRIFLVVFLLPTKMQEYELATETNFDLRFPMKSLAIMEMKNS

SEQ ID NO: 155973 - protein, 66 aa, Glycine max
  Coding DNA Sequence Number=SeqID_39195
MAEECTMVDVHNDIVMVERSCPHGASKVEIMHGWRSRTRRVESQGFGEKKVGVWGVGVMMEEGGAK

SEQ ID NO: 155974 - protein, 51 aa, Glycine max
  Coding DNA Sequence Number=SeqID_39196
MFDWLHAVILFGIQRPANVDRNTTAVEFPRNTPGDLDGKPITERNQKGKFA

SEQ ID NO: 155975 - protein, 111 aa, Glycine max
  Coding DNA Sequence Number=SeqID_39197
  Gene Ontology: Mol. function=nucleoside-triphosphatase activity; Cellular component=membrane; Biological process=defense response
  Homolog annotation: Hit_ID=Q8UE54; Match level="QueryCoverage=88%, HitCoverage=31%, E-value=1e-47, Identity=96%"; Hit description=ABC transporter, nucleotide binding/ATPase protein
MAFILLGFSKEFAMNAIVSIRNLTKSYANGFQALKGVSLDIREGEILALLGPNGAGKTTLISIVCGLVNPGEGSVLVGGHDVVKDFRQTRALIGLVPQELTTDQFETVWNT

SEQ ID NO: 155976 - protein, 69 aa, Glycine max
  Coding DNA Sequence Number=SeqID_39198
MQSADKREYHMVIRTFHQPGANEPVDAQRLTSSSAPSVILTHEVYFSRPKIFKPNDARDSSLLGGDDQV

SEQ ID NO: 155977 - protein, 211 aa, Glycine max
  Coding DNA Sequence Number=SeqID_39199
  Pfam annotation: Domain name=Transposase_23; Domain location=37-106; Score=-0.5; E_value=0.0013; Accession=PF03017.5; Description =TNP1ENSPM transposase
MQSQGLALPPEPEVAPSGPRVGTKESCVDPSGNDPKMGDSNKCGLYIEANPPHLVALGRLYEGSTVHNIPLLPGQVKVGVEEVKDAQAPVLVPTDEVTLVGQTLNTFLAWPTHLMKALSVQRNYLTMFDQQAVVSPAKPPQRPDPEVDDPLYLMTLTIPELFLQPFQVNWDATMFGVCHPNFPLYIKYEDLSKIAHGSQCLNISVIQLWIL

SEQ ID NO: 155978 - protein, 34 aa, Glycine max
  Coding DNA Sequence Number=SeqID_39200
MKVWRFRDEGGTRRSFGYAARLDVVIDYRLPVLV

SEQ ID NO: 155979 - protein, 83 aa, Glycine max
  Coding DNA Sequence Number=SeqID_39201
MCHKISKSSNTLQSNHHCYSTHDFFQAAHHNYCWYQEMVYPSGTRQESLKHVVKGLNPDECIYGENLVEREIPLMSANRSLGG

SEQ ID NO: 155980 - protein, 119 aa, Glycine max
  Coding DNA Sequence Number=SeqID_39202
  Gene Ontology: Mol. function=transporter activity; Cellular component= outer membrane-bounded periplasmic space; Biological process=transport
DFINSQGRRMKFNVKYYASLENMFSDPSIPFTKGKIGPASALAADIVGIGDSWLKFAINKGIIEPIRDVEDQEWFKSLDDKWKIFLSSLYIRDSSYIPYFKRETVRPGTAEIESGLEIE

SEQ ID NO: 155981 - protein, 125 aa, Glycine max
  Coding DNA Sequence Number=SeqID_39203
  Gene Ontology: Mol. function=2-oxoglutarate decarboxylase activity; Cellular component=chloroplast; Biological process=menaquinone biosynthetic process
  Homolog annotation: Hit_ID=Q15KI9; Match level="QueryCoverage=87%, HitCoverage=6%, E-value=1e-34, Identity=63%"; Hit description =Chloroplast Phyllo
MITWHRVRCISDLICDPSRCYARVLLDHANELSNSLKESANINTVWASLIVEECTRLGLMYLCIAPGSRPSPVAVAAESHKLITCISCFDERSLAYHAVGYGRGSHIPAVAITSSGTAVSNLLPA

SEQ ID NO: 155982 - protein, 109 aa, Glycine max
  Coding DNA Sequence Number=SeqID_39204
MSPSTRDESGGMSSSTTFNYALGEQKKTINIYVLSQHALLRASEVRFTGALSKGGKMRGVATNVYLWETSEKTDGKPIKTKILSSGVVFTFEEGISASHICLKGQQPIF

SEQ ID NO: 155983 - protein, 357 aa, Glycine max
  Coding DNA Sequence Number=SeqID_39205
  Gene Ontology: Cellular component=integral to membrane; Biological process=electron transport
  Homolog annotation: Hit_ID=Q8P410; Match level="QueryCoverage=47%, HitCoverage=95%, E-value=1e-56, Identity=66%"; Hit description =Cytochrome B561
  Subcellular localization annotation: CTP_CleavageSite=48; ConfidenceScore=5.03e-01
DDPDPGRPLGGVFAVLQPPRNASAPPATSSNRRRPHDEHRQRPLQPARAGAALVHGADDHRHAVHRRDHGRLAAPAADADRPAPPTGHRHRRTGAAAPVQPAAPSPAAAAFRPARLAGAGSEGLALDVVRADAGDAADRLGNAVGGRLPDRAVGWPAPAADRAAHPGAVCRVAQCAQPAGVCVVRHGADACRGCAVPPVGAARWGVPGDGAREGLIGFAGATPDATSVSAHAATTTPSAAPAGTPRSGWPHPACRCTRTGNCAPCRATAPAARRSRWRYGLRRPAAARGARGRSVGRPATRHRVPVAGRSHGYPASPCAVHRPGSPPVRPSTGTPARPLPARGAGNRRGRRWSRSPP

SEQ ID NO: 155984 - protein, 57 aa, Glycine max
  Coding DNA Sequence Number=SeqID_39206
MHDNWPSVSRSQIELDELESVSILSMTLAWDEFSFSTFQEAHYSLQDSLDQVPDMPF

SEQ ID NO: 155985 - protein, 154 aa, Glycine max
  Coding DNA Sequence Number=SeqID_39207
MKKDNNWYLKALHWGNERPHAETSNEPRGRLEVLTPIGSQLQGHDERQQLPYTGAMRGIVHEPQVNIGADQKFSPVDVFKQEKRGGGDKPWNFNRWIKRQTAPLPSLQNGQVTKSNRTYTLREFPERFAKDRMRLHELSPFSKKDSQSVFSKKD

SEQ ID NO: 155986 - protein, 134 aa, Glycine max
  Coding DNA Sequence Number=SeqID_39208
  Gene Ontology: Mol. function=transporter activity; Cellular component= integral to membrane; Biological process=transport
  Homolog annotation: Hit_ID=Q47HB0; Match level="QueryCoverage=95%, HitCoverage=30%, E-value=5e-35, Identity=59%"; Hit description=Major facilitator superfamily MFS_1
  Subcellular localization annotation: CTP_CleavageSite=56; ConfidenceScore=5.16e-01
MAFSATDAGLLLLPSGIALVLTIPLAGRMADRFSPRRITLAGLAIFGASFLVFVFVAMRVQYWEIVAATVLCPAVGRGCRGDHDGGVYGVAGAGMGLSGARRVSGLCTRLLIAVCGVCAGDTGGDGNEGCKAPR

SEQ ID NO: 155987 - protein, 157 aa, Glycine max
  Coding DNA Sequence Number=SeqID_39209
  Homolog annotation: Hit_ID=UPI000044A741; Match level="QueryCoverage =27%, HitCoverage=11%, E-value=1e-08, Identity=70%"; Hit description =PREDICTED: similar to Ac1147, partial
IDRLRALSDSMGGGAWPFLVGGAIVWSVMPLDIIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGD

SEQ ID NO: 155988 - protein, 423 aa, Glycine max
  Coding DNA Sequence Number=SeqID_39210
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-56, Identity=31%"; Hit description= UPI00006A17C9 related cluster
RALSVFAFRGLHVLPFRGLHALTFRRLHSLAFRGLHILAFRGLHVLTFRGLHFFPSRGLHALAFRGLHVLLFRGLHALTFRGLHRTTHPPFQRATRPRLQKATRPHLKRTKRPCLRGLHILAFRELHAFAFRGLHVPTFKGLHALAFKGRHTLDFRGLHVLTFRKLDTLAFRGLHVLPFRGLPAREFNGLHVFLFRRLHACAFRVLHVLTFRGLNVLTFRGLHALAIRGLHILVFRGLHVLSCGGQHVHLFKRLHSLAFRGQHILAFTGLHVLLFRGLHALTFRWLQALIFEGLHVLAYRGLQALTFRGLHTLSFSGLHILAFRGVHALAIRGLHVLAFRGLHALAFRGLHVLPFRGLHALTFRWLHALTFRWLHALTFRGLHFLAYRGLHALAIRGLHVLAFRGLEVLTFRGLHVLTFRGLH

SEQ ID NO: 155989 - protein, 78 aa, Glycine max
  Coding DNA Sequence Number=SeqID_39211
MYIVVVKQEQDHLGLPSGVETRHERQKPIKVLKDERKWGWGHDRPIVALLCAKQAENVAARQPRILCILQLSFTFCLF

SEQ ID NO: 155990 - protein, 125 aa, Glycine max
  Coding DNA Sequence Number=SeqID_39212
  Subcellular localization annotation: CTP_CleavageSite=39; ConfidenceScore=5.12e-01
MTHQDFQVQAIGQFAQATCAPEFGPPRLFNQRLLVLHVGGVAVKQRQKINSNKRSLKEERNANLIYTGSATSRAYVQSSSNPLEIFHSLCKTPFTKSEPHRDNPSLVFRNPLQQEIHDLLIPFQK

SEQ ID NO: 155991 - protein, 130 aa, Glycine max
  Coding DNA Sequence Number=SeqID_39213
  Subcellular localization annotation: CTP_CleavageSite=31; ConfidenceScore=5.20e-01
MPISPCESISLDRTHKTPSGPGGAQQGPRVSSSGIAPTRHSVDPEKSNKFYGVPVAPSKVIRPLTNRAFIKKYCAPRQAQGETPQQPGDGRQRATDAPPTPPKAPQLIYKSWSIAYEPWSTSRRPSPKPK

SEQ ID NO: 155992 - protein, 109 aa, Glycine max
  Coding DNA Sequence Number=SeqID_39214
ITPARHLVDPEKSNRVLGFLALIMGLCQFYGVPITPSKVIKPPTNRAFIKKYCAPRQAQGETPQQPGDGRQQATDAPPPPPKPLSSSIKAGALPTTCGRLAGDQVQSQR

SEQ ID NO: 155993 - protein, 243 aa, Glycine max
  Coding DNA Sequence Number=SeqID_39215
MKVYMEAMKEQMTTMMEAMMSMRKMMEVNTTTVVAASTATEVNLTNPSGHAQVPQPMGETHEVPRSHTLADFEPHHEYATEGQTFGGIPLPNTLGGPQYRPQPLHFAVGRLPPAMVEREKFDHIEETLWAIEGGGNYAFADMVELCLVPDVIIPPKFKVPNFNKYKGTTCPENHLKMYNKKMGAYSKNEKLLMHFFQESLTVAAVTWYTNLEPSWVHSWKDLMVAFIRQYQYNFDMALDRMQL

SEQ ID NO: 155994 - protein, 159 aa, Glycine max
  Coding DNA Sequence Number=SeqID_39216
  Gene Ontology: Mol. function=transferase activity, transferring glycosyl groups; Cellular component=endoplasmic reticulum membrane; Biological process=GPI anchor biosynthetic process
  Homolog annotation: Hit_ID=Q9LEQ5; Match level="QueryCoverage=96%, HitCoverage=40%, E-value=3e-33, Identity=64%"; Hit description =Dolichyl-phosphate-mannose--glycolipid alpha-mannosyltransferase -like protein
MEVSWPSCMGFGFLQFIRPQGIQVCLASSSDSSDVFCLFFGHDRRSRLCTRGPEDVMNHLAREALHGKVKSILFLMPCHATPYYSMLHHNLPMQFLDCTPSEEKGVPDESDRFLMDPVTFVSEYAKNKSLPSHVVLFDSEEQKLRNLLISFDYREEILQ

SEQ ID NO: 155995 - protein, 302 aa, Glycine max
  Coding DNA Sequence Number=SeqID_39217
  Gene Ontology: Mol. function=zinc ion binding; Cellular component =integral to membrane; Biological process=defense response to bacterium
  Homolog annotation: Hit_ID=Q6KAE5; Match level="QueryCoverage=99%, HitCoverage=57%, E-value=1e-133, Identity=73%"; Hit description =Putative receptor-like kinase Xa21-binding protein 3
  Pfam annotation: Domain name=Ank; Domain location=117-151; Score =19.1; E_value=0.016; Accession=PF00023.20; Description=Ankyrin repeat
  Pfam annotation: Domain name=Ank; Domain location=178-210; Score =38.4; E_value=2.5e-08; Accession=PF00023.20; Description=Ankyrin repeat
  Pfam annotation: Domain name=Ank; Domain location=221-253; Score =41.3; E_value=3.3e-09; Accession=PF00023.20; Description=Ankyrin repeat
  Pfam annotation: Domain name=Ank; Domain location=50-82; Score=33.7; E_value=6.5e-07; Accession=PF00023.20; Description=Ankyrin repeat
  Pfam annotation: Domain name=Ank; Domain location=83-115; Score=33.0; E_value=1.1e-06; Accession=PF00023.20; Description=Ankyrin repeat
  Pfam module annotation: Pfam domain module=Ank::Ank::Ank::Ank::Ank; Domain location=117-151::178-210::221-253::50-82::83-115
MKFLSIVGNSFGCSASGERLVSAARDGDIQEAKALLEYNPRLARYSTFGVRNSPLHYSAAHGHHEIVNLLLESGVDINLRNYRGQTALMQACQHGHWEVVQTLIIFNANIHKADYLNGGTVLHLAALNGHTRCIRLILADYIPSVPNFWNALQTGDHKSISEFDQSGLCEVINRTADGGITALHMAVLNGHAESVQLLLDLGASVSEVTVEDGTTIDLIGSGSTPLHYAACGGNQQCCQLLIAKGANLTAENANGWTPLMVARSWRRDWLEDILKTPPEDPLQVLPSPYISLPLMSIVRIAR

SEQ ID NO: 155996 - protein, 61 aa, Glycine max
  Coding DNA Sequence Number=SeqID_39218
MHAKEVRKNGRGTDRGAEGREVLEFLEAGKILTYEHINGGPPCRGMERSENFKSYPSPLIY

SEQ ID NO: 155997 - protein, 49 aa, Glycine max
  Coding DNA Sequence Number=SeqID_39219
MTLFRTRLPIESKIKRGVGYRQSRTTLNGNLKGKDTKNGFSFAGSPLPC

SEQ ID NO: 155998 - protein, 808 aa, Glycine max
  Coding DNA Sequence Number=SeqID_39220
  Gene Ontology: Mol. function=histone-lysine N-methyltransferase activity; Cellular component=nucleus; Biological process=chromatin modification
  Homolog annotation: Hit_ID=Q69SU4; Match level="QueryCoverage=14%, HitCoverage=17%, E-value=1e-26, Identity=51%"; Hit description=SET domain-containing protein-like
  Pfam annotation: Domain name=zf-CW; Domain location=690-739; Score =43.9; E_value=5.4e-10; Accession=PF07496.5; Description=CW-type Zinc Finger
MEVPSGAFWTDTEVESTSDQPCDPKDGEDQNSTCEEIININSCVKISSSPGCNETVGSSPVVGFPCEPALLDPEYEMKNGMLQIEDDACKLKDCSSEETTNSTFRKPFSPESGLPSVALITNCSAKDVPDQQSKGDDVSIDNNNAVNNQGQMDNDGTEAVEVDGITEGIPLPSQRNSRRTKFGRKTQTKKASRKCKNKTKVTHPNGGMKLNLEAARKKRSCFSKPARSSIWGLIGNIEQFFEQDNELGDGEAVCQELGKARSKPQSGKAVKNGASTTSLGSVQKHSVSTTRVRLKIKFGKEVDLSCSNVLIPESVDGLASASYLGSGSGSQKVAGNADDKISEVVALGHSESFNNDLDKDGFVLNEQVANNPLETTEITEKSYGDAEEPCLAVPPEKVVEALIEPINNKGMDPGTSPDSEVINSIPEVQAGEKHQEDAHHAVLGSSKELNSKLDVTISKRGKNKEKVICSSNCITEDGSQGPHKNSRAKHSKNHRRKKNCRDVVSSLELPTDISKSLSSKELSPESLPLSVETELGGSTEALKVKNHTDVKTSDKPSVDHGFSDSLVAENMLSSARPLERKLPKSLRASKVSKTKSKASDSTGRKKTTAGIRKEKQIKAINKSKVKGKGVSLKVTCEVEDCLHPEENAGNHKLDAVGKIIADDNRVSVNLSNLDMLSGVGYGEQLLSPRNAWVRCDDCHKWRRIPAVLADRIDETNCTWTCKDSSDKAFADCAIPQEKSNAEINAELGLSDASGEEDAYEGSKNFKELEYRPPLVSQESTFTHILTNEFLHRSHKTQTIDEVLDCSSL

SEQ ID NO: 155999 - protein, 528 aa, Glycine max
  Coding DNA Sequence Number=SeqID_39221
  Gene Ontology: Mol. function=histone-lysine N-methyltransferase activity; Cellular component=nucleus; Biological process=chromatin modification
  Homolog annotation: Hit_ID=Q2LAE1; Match level="QueryCoverage=98%, HitCoverage=26%, E-value=1e-125, Identity=49%"; Hit description =Histone-lysine N-methyltransferase ASHH2
  Pfam annotation: Domain name=SET; Domain location=44-204; Score =127.7; E_value=3.2e-35; Accession=PF00856.18; Description=SET domain
MVCHCKPSQEGKLGCGDECLNRILNIECVQGTCPCGDRCSNQQFQKHKYASLKWFKCGKKGYGLKAIENVAQGQFLIEYVGEVLDMQAYEARQREYALKGHRHFYFMTLNGSEVIDASAKGNLGRFINHSCDPNCRTEKWMVNGEICIGLFALRDIKKVCLQPSLATFIKCKCYSVPKAEFVYHHPPQDEELTFDYNYVRVFGAAAKKCYCGSPNCRGYIGGGDPLNAELIVQSDSEEEFPEPVMLTKDGEIEDSVPTPEYFNNVDTQSAKHMLKDRDILDNSTTAIDSDGSLEKERSMNPASAVSLLHSSAEMEDSKGKLQSSVQVEEISQQMEDVTSKPMPAVHQGYEKESEFADKTSSIQRLDTTSPLTTVSKMLPNSAGSNRESKSEIIGGRKTPKLKGSVKKGKVHANPPNGLKTEVTANRLQVPSIKHKKVEGSSNGRFEAVQEKLNELLDGDGGISKRKDATKGYLKLLFLTVASGDRINGEAIQSNRDLSMILDALLKTKSRAVLNDIINKNGNTYLLSM

SEQ ID NO: 156000 - protein, 167 aa, Glycine max
  Coding DNA Sequence Number=SeqID_39222
MELLLQPPPRPPSDDSGEQHQLVPPQVHPLTVSFLHAKNPDETSPQTTATDTKLRGKGAPQEEFSVDHVLTKRHRREKLNHKQVGHALFWGPGGCEERKKVYLCYAAEPRNTELAVKLLHKASVCGNLCAQYQLGLCLHRGGGRGVPSASMNEGVPSARPNRKSTKP

SEQ ID NO: 156001 - protein, 293 aa, Glycine max
  Coding DNA Sequence Number=SeqID_39223
  Gene Ontology: Cellular component=plastid chromosome; Biological process=positive regulation of transcription, DNA-dependent
  Homolog annotation: Hit_ID=Q2RBI6; Match level="QueryCoverage=62%, HitCoverage=55%, E-value=2e-66, Identity=63%"; Hit description =Expressed protein
  Subcellular localization annotation: CTP_CleavageSite=76; ConfidenceScore=5.70e-01
MECKRKSLTSSPGAKRQQSSETMMTSSSLFFSSPPLFLNPHPPRSFLPFRPLKPLFNPSLLLRPPSKSRHNPFLTRADDDDGDGGGPDHYEMDEDEMEELDNKKDFDIEYDPLVPAAAAAASAAGDDDIAVVESKSFVSTQGWHSDTVVDYKINEDEFHKICLVDCDFFIRKPPDPDNDVYDFREMYVTPPDTDVYSVPKVLAPMPQKYIRCAQSDYGSYNVTEPPIDAPRDPLYKTEREILKVYLTKHYKNRRKGDSEFVLDFEEIYVIDSKSKSITRAKVLTLYSWKCTFA

SEQ ID NO: 156002 - protein, 158 aa, Glycine max
  Coding DNA Sequence Number=SeqID_39224
  Gene Ontology: Mol. function=sequence-specific DNA binding; Cellular component=nucleus; Biological process=regulation of transcription, DNA-dependent
  Homolog annotation: Hit_ID=Q533S4; Match level="QueryCoverage=89%, HitCoverage=78%, E-value=5e-67, Identity=90%"; Hit description=MADS box protein PIb
  Pfam annotation: Domain name=K-box; Domain location=71-157; Score =75.0; E_value=2.3e-19; Accession=PF01486.8; Description=K-box region
  Pfam annotation: Domain name=SRF-TF; Domain location=9-59; Score =114.9; E_value=2.4e-31; Accession=PF00319.9; Description=SRF-type transcription factor (DNA-binding and dimerisation domain)
  Pfam module annotation: Pfam domain module=K-box::SRF-TF; Domain location=71-157::9-59
MGRGKIEIKRIENSSNRQVTYSKRKNGILKKAKEISVLCDAQVSLIIFGVSGKMHEYISPYTTLIDVLDRYQRASGKTLWDAKHENLSNEIDRLKKENDSMQIELRHLKGEDITSLNYKELMALEDALENGLSGVHGSAQDVQEKSTAFGSRRNWKHA

SEQ ID NO: 156003 - protein, 904 aa, Glycine max
  Coding DNA Sequence Number=SeqID_39225
  Gene Ontology: Mol. function=transferase activity; Cellular component= chloroplast; Biological process=metabolic process
  Homolog annotation: Hit_ID=Q9C5W3; Match level="QueryCoverage=97%, HitCoverage=86%, E-value=0.0, Identity=53%"; Hit description=NAD kinase 2, chloroplast precursor
  Pfam annotation: Domain name=NAD_kinase; Domain location=677-904; Score=14.3; E_value=2.4e-06; Accession=PF01513.11; Description=ATP -NAD kinase
  Subcellular localization annotation: CTP_CleavageSite=37; ConfidenceScore=5.57e-01
MVFSVDRITPTFVSVFSAKARVLAFRFQLRRNTDLVTAQLSNSFAFNFGLDSQSLNSIESHAAPQLPWTGPVPGDIAEVEAYCRIFRNSERLHSALMHALCNPLTGECSVSYEVPYDEKPLLEDKIVSVLGCIVALVNGGRQYVLSGRSSIGTPFCSAEVSVMEDTLPPLALFRSEMKKCCESLHVALENYFIPGNGRSLDVWRKLQRLKNLCYDSGFPRGEDYPSPELFVNWTPVYLFTSKEDMESKESEAAFCTGGQVTEEGLKWLLDKGYKTIIDLREEDVKDNFYQAAVCGAISSGSIELVRIPVKVRTAPTMKQVERFASYASDCSKRPIFLHSKEGVWRTSAMVSRWRQYMTRPASKFFSNQAVISNDMSSYYTNGSGKLQDSMIAEGSSLQKDTNLLQEGLGATHGSAGTFDSCSSSKKNNEKTKSNGALSELTPDDIASSQATAATGEGSFPSFSSETSPLEAQVPPFDIFSKKEMSKFLGSRKISKPSHFSYHGKRLEGLPDSRNLEPKIVDPAKSSNGSAHVDCPSGESQNTVGSNWKLVNLNNSSSVRTTVNGFSEGEMYYRSDANFSTTVNNDIDNVNTNSQRIGVNNDKAGLALCDEDLGLIEGDMCASSTGVVRVQSRKKAEMFLVRTDGFSCARERVSESSLAFTHPSTQQQMLMWKTTPKTVLLLKKPGEHLMEEAREVASFLYYQEKMNVFVEPDVHDIFARIPGFGFVQTFYTQDTCDLHEKVDFVACLGGDGVILHASNLFRDAIPPIVSFNLGSLGFLTSHNFEDFKQDLQQVIHGNSTRDGVYITLRMRLRCEIFRKGKAVPGKVFDILNEVVVDRGSNPYLSKIECYEHAFTISKHLLEAVSFLLYDDCHVFQVQGDGVIVATPTGSTAYSTAAGGSMVSLS

SEQ ID NO: 156004 - protein, 753 aa, Glycine max
  Coding DNA Sequence Number=SeqID_39226
  Homolog annotation: Hit_ID=Q60EP7; Match level="QueryCoverage=86%, HitCoverage=82%, E-value=8e-67, Identity=31%"; Hit description =Unknow protein
MNSVFPMAEEKRASSFVKKGDRQMFTVELRPGETTIVSWKKLLKDANKPNGSTSVPQYVAIAPIRLDYHDLVESLIFENHGQPVEVEETDPSQPNRFSAVIEKIERLYMGKDSSDDEDLLDVPDDDQYDTEDSFIDDAELDEYFEVDNSAIKHDGFFVNRGKLERINEPPVLPNQQPKKRRRKDILKNAGESNDGHGSNKNVKVGRPASAKTASLQAKNMLNSSENLVTPGEHIEDLKLPNQPDVSGIISKRKTADTKPILNPSVSLKTSSDDVPAVTDAKDADKQKIGAFQSKNISDKYKDDSGSFDASHHKYNEKSAYAHSKSQAGRPLSNIDDLENINRTKEKNGMRELPDLNLSEGKSATQATKSENMHKKEGSSVRPKTSMLEKALCELEKMVAESRPPAVDNQEADATSQAVKRRLPREIKLKLAKVARLAATHGKVSKELINRLMSILGHLIQLRTLKRNLKIMINMGLSAKQEEDNRFQQIKKEVVDLIKMQAPTLESKQQQKGEASGDFQEFGPDGKPITKRKFTMDAALEDKICDLYDLFVDGLDENAGPQIRKLYAEVLAQLWPSGYMDNHGIKRGICRAKERRRALYNKHKDQEKIKRKKLLVPKQEENVRFDINSIASQQNPRERSAPESSSHAYTSGNKQASNTSTTGRVPCPMNGLKQEKTKGSSSSSVDDVRAADGVLTKKVKRKPELELEGGHLGAEKVASLQGEERPRSLKQSIGSLPTKSNLQPTSLPDLEQSS

SEQ ID NO: 156005 - protein, 218 aa, Glycine max
  Coding DNA Sequence Number=SeqID_39227
  Gene Ontology: Mol. function=DNA binding
  Homolog annotation: Hit_ID=Q1SFS3; Match level="QueryCoverage=86%, HitCoverage=37%, E-value=6e-70, Identity=68%"; Hit description =Lambda repressor-like, DNA-binding
MDIPLRSTRKYLFKKTDLLRLRELASLLVPTLEEYSYLVGLPVPDKIPFHGFEPTPKPSDIAAALHLKTSIIQANLTSKGGLQGLPTHFLYQQASIFAEAASILAFHSILALLIYGLLFFPNVDNFIDINAIKIFLTKNPVPTLLADTYHSIHDRTQAGRGTISCCAPLLYQWFTFHLPQSRAFKTNDDKLSWPRRIMTLDPSDIAWYQAASDVGEII

SEQ ID NO: 156006 - protein, 123 aa, Glycine max
  Coding DNA Sequence Number=SeqID_39228
MLMCNDQFSCVGPIELLCTIGRTPDGVINLLQRTMPRTHDVIMYYNGKWNMPPQNKFVGCAFTGKNPKKFQIPSTCTIDELKDLIKQVAPKGIPPLGIHEFKRCYLMEPGNGINFFRFFDVQT

SEQ ID NO: 156007 - protein, 70 aa, Glycine max
  Coding DNA Sequence Number=SeqID_39229
MACSLLVSLLMAKMHIPFGSSGFYSLFFDNDNILRLLYDGLEVSAFTGHIHGWHLGKLIRTQCMLDGVVK

SEQ ID NO: 156008 - protein, 887 aa, Glycine max
  Coding DNA Sequence Number=SeqID_39230
  Gene Ontology: Mol. function=transporter activity; Cellular component= membrane; Biological process=transport
  Homolog annotation: Hit_ID=Q8D1A4; Match level="QueryCoverage=69%, HitCoverage=96%, E-value=6e-90, Identity=53%"; Hit description=Inner membrane permease of ABC transporter
  Pfam annotation: Domain name=FecCD; Domain location=579-785; Score= -201.2; E_value=0.031; Accession=PF01032.9; Description=FecCD transport family
  Pfam annotation: Domain name=Peripla_BP_2; Domain location=23-261; Score=32.2; E_value=1.3e-06; Accession=PF01497.9; Description =Periplasmic binding protein
  Pfam module annotation: Pfam domain module=FecCD::Peripla_BP_2; Domain location=579-785::23-261
MALALSPLLGSLPGRAADAPPDIARVAALEWLPIELLLALGVTPLAVADVHNYNLWVAEPKLPATVVDVGQRTEPNLELLQQLQPSLVLLSQGYGPTPQKIQPIAPTMSFGFNDGSGKPLTVARQSLLALGQRLGIESRAVQHLAQFDRFMQDARQRLQSYTRQPLLLFSLIDTRHALIIGQKSLFQEAMDQLGIRNAWQEETNFWGTAVVGIERLATVRNARVIYLDHGNQAMMDKVSATPLWQSLPFVRQNQLRQVPAVWFYGATLSTMRLRRVRHEFGHPEIAADADPTVAGGGRWPDDIQSGAAAAAGAMGAGAQRAGHRRRAANAVPLQPVAAVDGVAVGRRRSGVGRRAVPAGVAQSVGGAVDARRRRRRAAWPDHRHAVVGRYGGRDCGGRAGVRRRLGQTDVAGHADSGRAGAGAVLRRGHVPVGHRRVEPTGLERRAVPPAAFAGGWPVSGAVAAPADAAGAGRRCGAQPGVRAVDGALLCFGVGHHLQRHVGERGGRYRLYRPVCTADGEDAGGSPPGAPHDVGAAAGGAVAVADRSGDARGNAGVARDPDRRGHRAVRRAAAAVAAAAFAQRRHAAADEPRRQGACRTRESAWLDPGGRPRAADRPGAGADAGLGAELDALLPWRWPRVLSALAAGMMLAVAGTLIQKLTGNPMASPEVLGISSGAAFGVVMMLFMPGGGRYVADHHDRRRPRRFLDRTHAAGRYRAQHRLYHRHLPAVGQRRSAYGGLADLALRFDLFGGAGAGAAHRADRRRIAGIGTAVPPLADHPAARRRHRPFGGHCADADAVDHSVAGCHPDRHGDPDRRAAELCRADGAAYGAHAGLPPRAAANGDRRAAGRLADGVCRLVRTDAAVPVSDPRRVIGDLYRCTVLRVSV

SEQ ID NO: 156009 - protein, 77 aa, Glycine max
  Coding DNA Sequence Number=SeqID_39231
MDDGDKKRHDKKTRTRRYPSESLSTLTGNTQVDRVWVRVWVFPDNQKSDIEILGSRGRGLRRQYQSPPRLIAMSNRE

SEQ ID NO: 156010 - protein, 90 aa, Glycine max
  Coding DNA Sequence Number=SeqID_39232
MENPPTSRDYFNSSNLFMPPREHLEGAEVAVSLRRDRALSEYHLLSEAAVGLTSKRNLEGNLPCKSVLSVSSARLASHLSPSGTKRACRN

SEQ ID NO: 156011 - protein, 299 aa, Glycine max
  Coding DNA Sequence Number=SeqID_39233
MVRTRGLGWALGRVIRRALGREPEEVVVDDVVTIVEGFSGGPHDTSALIDYVHHVAMTVWNGDVTIILDDVASLLHLPITGAFHSFEALHMDEVVLLLVELLEVNLEEARAETIQCHGWKLSMESARKLVEYITLLQHFPSIAFCIAAEDYHERKPRAYHWKSRKAFLCFPDISDGVHLLSDTDQRGLCDSLVDQICVVSGQCAADYVEWFYRISHPFISPTQTEAPPRHPHVVQNDTFIEPDIPQHLVAATTMVETPADALAHVEHPRHAMVGTIAKPKDRDIRYISIHYRQRLPKDR

SEQ ID NO: 156012 - protein, 319 aa, Glycine max
  Coding DNA Sequence Number=SeqID_39234
  Gene Ontology: Mol. function=DNA binding; Cellular component=nucleus; Biological process=regulation of transcription
  Homolog annotation: Hit_ID=Q0PJL5; Match level="QueryCoverage=97%, HitCoverage=96%, E-value=1e-107, Identity=65%"; Hit description=MYB transcription factor MYB57
  Pfam annotation: Domain name=Myb_DNA-binding; Domain location=134 -181; Score=48.9; E_value=1.7e-11; Accession=PF00249.21; Description =Myb-like DNA-binding domain
  Pfam annotation: Domain name=Myb_DNA-binding; Domain location=26-75; Score=37.3; E_value=5.4e-08; Accession=PF00249.21; Description=Myb -like DNA-binding domain
  Pfam module annotation: Pfam domain module=Myb_DNA-binding::Myb_DNA -binding; Domain location=134-181::26-75
MEILPPASPYTYNSNWLLDDNRTNNNTKWTPAENKLFENALAVYDKDTPDRWHKVAEMIPGKTVMDVVKQYKELEADVCDIEAGLISIPGYRSTTTTSPFTLDWVNPAYGDGFKGLTAKRSSSGRPPEQERKKGVPWTEEEHKLFLLGLKKYGKGDWRNISRNYVITRTPTQVASHAQKYFIRQLSGGKDKRRASIHDITTVNLTETTRTSSDESKRSTSPQHSTILSHQQQQQQQPNSSVASSGLNLQWSNQPNAGVAMPLNPAHEQVFMSPYGLNSYGFKMHGQNLHRSSVHESSYLGPQTPNMVFQMLPSQHYSHA

SEQ ID NO: 156013 - protein, 102 aa, Glycine max
  Coding DNA Sequence Number=SeqID_39235
MRQAPESRQLGTIDLDEGSNRTVWIQSVHTHLTSSFSNVLPQGRCLPWICQFGIVKLLQRPKPFFDTNNMLQLLFHWCPNSMFCSILAAKCTATALQVIFNN

SEQ ID NO: 156014 - protein, 1126 aa, Glycine max
  Coding DNA Sequence Number=SeqID_39236
  Gene Ontology: Mol. function=zinc ion binding; Biological process =protein amino acid phosphorylation
  Homolog annotation: Hit_ID=UPI00000482A1; Match level="QueryCoverage =99%, HitCoverage=63%, E-value=1e-129, Identity=50%"; Hit description= ATP binding / ubiquitin-protein ligase/ zinc ion binding
  Pfam annotation: Domain name=Pkinase; Domain location=131-452; Score=- 67.2; E_value=0.00015; Accession=PF00069.15; Description=Protein kinase domain
  Pfam annotation: Domain name=SecA_DEAD; Domain location=859-1083; Score=379.7; E_value=4.4e-111; Accession=PF07517.4; Description=SecA DEAD-like domain
  Pfam annotation: Domain name=SecA_PP_bind; Domain location=1065-1125; Score=-13.8; E_value=1.8e-08; Accession=PF01043.10; Description=SecA preprotein cross-linking domain
  Pfam annotation: Domain name=WD40; Domain location=535-574; Score =10.8; E_value=2; Accession=PF00400.22; Description=WD domain, G-beta repeat
  Pfam annotation: Domain name=WD40; Domain location=585-622; Score =11.3; E_value=1.8; Accession=PF00400.22; Description=WD domain, G -beta repeat
  Pfam annotation: Domain name=WD40; Domain location=626-662; Score =36.5; E_value=9.4e-08; Accession=PF00400.22; Description=WD domain, G-beta repeat
  Pfam annotation: Domain name=WD40; Domain location=670-706; Score =3.8; E_value=13; Accession=PF00400.22; Description=WD domain, G-beta repeat
  Pfam annotation: Domain name=WD40; Domain location=708-744; Score =3.4; E_value=14; Accession=PF00400.22; Description=WD domain, G-beta repeat
  Pfam module annotation: Pfam domain module=Pkinase::SecA_DEAD::SecA _PP_bind::WD40::WD40::WD40::WD40::WD40; Domain location=131-452::859 -1083::1065-1125::535-574::585-622::626-662::670-706::708-744
  Subcellular localization annotation: CTP_CleavageSite=45; ConfidenceScore=5.68e-01
ARYFFNPSTSATQFLVSYHVDTPSAKLASRSFRSGTRTLFGAPPAAQLVKYPSQQGPSSLPKNIDLLRLSLQHSPSPSSSSSSDHSQIPNQRSTTNSCYYHPPFSSHELYVTWKDWILPHDAVLTDDHCIGWFSSTKGRGCFGVNRSVSLAPIVCFPPRDRSKFRFSYVAWVIKCLEGMNEGAKEELALILEASVRQGRMCRVYGLWSEGVEGPLYMVCERQRCNLLDKFGELGNGFLAVSEGGLELDKGGIFSFLMIGKGICEAVLALHLEGLVAGCLGLSCFSFDELGGICVDLNEALMLARKFVNAVSVEHKEEAMCKGCLENEVFASPEVLYELLHKRGTAPDSGHSRYPIGYGSDVWSLACVLLRLLIGNVLAWNTLEMKEENDGDSSASYACWVEKVSSVLEDKLGSEYLSLRQILCKCLDVNPGNRPDVVDVRKCIQNMLVKPQFDFLGNLEVTISRDYTGICLVLGELCLLPKQSSNELIEHELWEKEIGGQPNVVQDGKGKSDEDFAAGLPKGMTELKDLQGHLDCISGLAVGGHENKVMALVYVDEEEPLCISGDSGGGIFIWGIAAPLRQDPLRKWYEKKDWRFSGIHSLVVSKNHSLYTGSGDRTIKAWSLKDETLICTMTGHRSVVSTLAVCDEVLYSGSWDGTVRLWSLNDHSPLTVLGEDPPAEMKSILAITVDRHLLVAAHENGCIKVWRNDVFMNSKTLHKGAIFAMSMQGKCLYTGGWDKNVNIQELSGDEFELDVKAYGSIPCSAVATAILCSQGKLYVGYADKSIKLEAQTHTFMAALSYSPFFALHRITSTSTSACANANAFFIRPRPSVPPRPRLRRRRCAPVLVAAASVKENLGRVQKSLADFTSLNYWVVRDYYRLVNSVNAFEPQIQTLSDEQLAAKTAEFRRRLARGATIADIQAEAFAVVREAAWRKLGMRHFDVQIIGGAVLHDGSIAEMKTGEGKTLVSTLAAYLNALTSEGVHVVTVNDYLAQRDAEWMGRVHRFLGLSVGLIQELGFDYLRDNLAGNSEQLVMRWPKPFHFAIVDEVDSVLIDEGRNPLLISGEASKDAARFPVAAKVAELLIQGIHYKVELKDNSVELTEEGIDLAEMALETNDLWDENDPWAR

SEQ ID NO: 156015 - protein, 170 aa, Glycine max
  Coding DNA Sequence Number=SeqID_39237
MTSITNLYERMTKLEETLAQFMQVSMSNHKSIESSIKSLEIQLVIELAHEPVEPLCELEEEEEEDDDQLRETPIIVTEKEIHVEEKEGKEKEKQKEKEKNEINKKEEKREEKKKSKSELARDKKKESAPAEGKEVPYPLVPSRKDKKRHLARFLDIFKKLEITMPFREAL

SEQ ID NO: 156016 - protein, 626 aa, Glycine max
  Coding DNA Sequence Number=SeqID_39238
  Gene Ontology: Mol. function=nucleotide binding; Cellular component =membrane; Biological process=intracellular protein transport
  Homolog annotation: Hit_ID=UPI00000482A1; Match level="QueryCoverage =93%, HitCoverage=34%, E-value=0.0, Identity=65%"; Hit description =ATP binding / ubiquitin-protein ligase/ zinc ion binding
  Pfam annotation: Domain name=SecA_DEAD; Domain location=1-73; Score= -170.3; E_value=2.3e-05; Accession=PF07517.4; Description=SecA DEAD -like domain
MNKILKISQLTGRVEEKRRWSEGIHQAVEAKEGLKIQADSVVVAQITYQSLFKLYPKLSGMTGTAKTEEKEFLKMFQMPVIEVPTNLPNIRKDLPIQAFATARGKWEQVRREVEYMFRQGRPVLVGTTRQLKLHPCFKPNRAFTRGGKPERDAFIVENSELLSGLLREWNIPHNVLNARPKYAAKEAEIVAQAGRKHAITLSTNMAGRGTDIILGGNPKMLAREIIEDSLLSFLTREDPNVELADEAISQKVLPKVKVGSSSMALLAKTTLMGLCLCAKYVSKSEGKSWTYQKAKSFILEAVEMSLSYSLEGLEKLANEESEIYPLGPTVALAYLSVLKDCEEHCLHEGSEVKRLGGLHVIGTSLHESRRIDNQDEMFQKFNFDTEWAVRLISKITNDEDLPIEGDAIVKQLLALQINAEKFFFGIRKNLVEFDEVLEALAFGGALQFQIGISKANIYLVGERLRNWKFVCTAYRYMQAVVDEIVFSNIDPLKHPRSWGLSKLLKEFVTVGGKLLRGMLVCYDYGGISDDTLLNSLGLVNDLSSVDIVNFSLPNLPAPPNAFRGIRRKSSSLRRWLAICTDDLIGNGKYQTTSNLLRKYLGDFLIASYLNVVEESGYDERHAKEIE

SEQ ID NO: 156017 - protein, 285 aa, Glycine max
  Coding DNA Sequence Number=SeqID_39239
MCANPLLCFIKVELSAPCCAKLDHLAMASKKRKSTASSSSQVRFDRSRFHSQEAWDRYNDFVITRKILPERNEVVYHTKFDEFKEELMRKKWDEKLTTFIEGSIDVAIVREFYANLYDPEDKSPKQGTKAKRSEASTSSIPPTSTAPDIPAPSSASLPDSSAPSTSAPQIPQLPTSVLDPSATDFSFTPQMLHSMMQSLHRGQEPEAAEEEPIVEEDELIPSEPTADIAQEEAHASETIPESSPPLIFEDALPSTIVMEPEQPQDAPATPVLDLNEEQPYDDQDF

SEQ ID NO: 156018 - protein, 458 aa, Glycine max
  Coding DNA Sequence Number=SeqID_39240
  Gene Ontology: Mol. function=heat shock protein binding; Cellular component=integral to membrane; Biological process=protein folding
  Homolog annotation: Hit_ID=Q2R031; Match level="QueryCoverage=95%, HitCoverage=91%, E-value=4e-36, Identity=35%"; Hit description =Expressed protein
  Subcellular localization annotation: CTP_CleavageSite=78; ConfidenceScore=5.17e-01
MDEFGVLTEKFGLKPQGKSAPMARAKRPPNVADSQTRPNPKFPLNGSPSHQNSTFDFDYGVFSNSNTDNKTQRFDDIFGGNAKSNGASFDYDSIFAGSNTPVSTSSYVDDIFGGIHGKSVGVDDLLDKIGGLNTNAKSPNAKSPAFDDLIPGFGVSNNGVGMNNPSVTPNKPAAAAAASHDDPFLIFETASSSPSSESFLDALEQISKLNNSKGTKGGSPSLKSPPKPMSKVNSLSVSTIDELEDFAMGGTQTNASSRKANVKAAETKQNLAARMNNGKRVPAAKVNQANGVDDLESFFSMGSRSSSVPKSRTPTMDRMYDNQMKNKGKPEVSPRVPSRSSANVNKSPVMTSLDDLSLMFGGSPSSEFQEVEGETEERRKARLGRHQRAQERALKAVNDMNQRDLQTKMEQEERRKIADTADVQIKRWAAGKEGNMRALLSTLQYWHGVADSKNAMAG

SEQ ID NO: 156019 - protein, 199 aa, Glycine max
  Coding DNA Sequence Number=SeqID_39241
  Gene Ontology: Mol. function=transmembrane receptor activity; Cellular component=membrane; Biological process=defense response
  Homolog annotation: Hit_ID=Q1SI46; Match level="QueryCoverage=92%, HitCoverage=16%, E-value=2e-51, Identity=56%"; Hit description =Leucine Rich Repeat, putative
  Pfam annotation: Domain name=TIR; Domain location=46-176; Score =154.6; E_value=2.6e-43; Accession=PF01582.10; Description=TIR domain
MAYSSSGAYKIKYVFLLLCDLLLISGLTGEISVQISDNIPQIKYDVFVSFRGEDIRQGFLGYLTEAFHQKKIHAFIDDKLEKGDEIWPSLVGAIQGSLISLTIFSENYSSSRWCLEELVKIIECRETYGQTVIPVFYHVNPTDVQHQKGSYEKALAEHEKKYNLTTVQNWRHALNKAADLSEISALFCFSLLMFTSSQI

SEQ ID NO: 156020 - protein, 49 aa, Glycine max
  Coding DNA Sequence Number=SeqID_39242
  Subcellular localization annotation: CTP_CleavageSite=13; ConfidenceScore=5.29e-01
MTLHAQTRMATPSPMMTPSRRVSVFTSLRFAGLRLQKSTFRVGLIVIHT

SEQ ID NO: 156021 - protein, 108 aa, Glycine max
  Coding DNA Sequence Number=SeqID_39243
MENNDSLWWLMVDVGDGETTPKQRLKCLNKRCSREWKLLAHYRHLLTDPNGQIMDKCLVKLQTKFREDPTVKEGWESFLPRQLHVVFSRSFIKRLLAHSRHLLKDPNG

SEQ ID NO: 156022 - protein, 47 aa, Glycine max
  Coding DNA Sequence Number=SeqID_39244
MKNAKIEPGTAVYKENRKWNEYKQKTIKNIEASFMVFKRVSGPTRQL

SEQ ID NO: 156023 - protein, 354 aa, Glycine max
  Coding DNA Sequence Number=SeqID_39245
  Gene Ontology: Mol. function=methyltransferase activity; Cellular component=chloroplast; Biological process=metabolic process
  Homolog annotation: Hit_ID=Q2XV86; Match level="QueryCoverage=68%, HitCoverage=71%, E-value=1e-115, Identity=81%"; Hit description =MPBQ/MSBQ methyltransferase 2
  Pfam annotation: Domain name=Methyltransf_11; Domain location=113 -210; Score=79.2; E_value=1.2e-20; Accession=PF08241.2; Description =Methyltransferase domain
  Pfam annotation: Domain name=Methyltransf_12; Domain location=113 -208; Score=29.8; E_value=9.7e-06; Accession=PF08242.2; Description =Methyltransferase domain
  Pfam annotation: Domain name=Ubie_methyltran; Domain location=64-257; Score=-84.1; E_value=3.9e-06; Accession=PF01209.9; Description =ubiECOQ5 methyltransferase family
  Pfam module annotation: Pfam domain module=Methyltransf _11::Methyltransf_12::Ubie_methyltran; Domain location=113-210::113 -208::64-257
  Subcellular localization annotation: CTP_CleavageSite=53; ConfidenceScore=5.30e-01
MAYLMLSGAESTKLTSGSGLAPSGLGSIGLNFHKRCFFKKSVVSYGIKCVVPRCSISSLSPASQPGFKEGFWFYRFLATIVYDHVINPCHWTEDMRDEALEPVDIYDRKMRVVDVEGGTAFTTLGIVKHVDAKNVTIIDQSPHQLAKATKNKKEPLKECKIIEGDAEDLPFPTDCADRYISAGSIEYWPDPQRGIKEAYRVLKIGGKACIIGPVYPTFWLSRFFADMWMVFPKEEEYIEWFKKAGFKDIKLKRIGPKWYRGVTRHGLIMGCSVTGIKPLSGDSPLKRRGRGEDEGARKGGEGEKPGGPRWRGRGEEGAHGGEEEEGASRKERKRRRRVGKTKGWVRREEKKWGK

SEQ ID NO: 156024 - protein, 94 aa, Glycine max
  Coding DNA Sequence Number=SeqID_39246
MNVEEWSRIFASASARTFFTETIFLSKFKRIRSTKKAEPLLPSLLPLFIAKQGKSLPPSSPRRARLLPPEATAFWRKNLEGPSGSDCYLYPLFY

SEQ ID NO: 156025 - protein, 95 aa, Glycine max
  Coding DNA Sequence Number=SeqID_39247
  Homolog annotation: Hit_ID=Q9C7B9; Match level="QueryCoverage=65%, HitCoverage=6%, E-value=6e-10, Identity=53%"; Hit description =Kinesin heavy chain, putative; 55116-47986
  Subcellular localization annotation: CTP_CleavageSite=63; ConfidenceScore=5.98e-01
MASKRSAKSKGLGLSGSKAANSPSSSTTSSSKLFLETSVDGMSSPASSSARSKTPCSFSESVPLDAKENVAVTVRFRPLNPREIRQGEEIAWYAD

SEQ ID NO: 156026 - protein, 766 aa, Glycine max
  Coding DNA Sequence Number=SeqID_39248
  Gene Ontology: Mol. function=microtubule motor activity; Cellular component=microtubule associated complex; Biological process =microtubule-based movement
  Homolog annotation: Hit_ID=Q9C7B9; Match level="QueryCoverage=99%, HitCoverage=73%, E-value=0.0, Identity=59%"; Hit description=Kinesin heavy chain, putative; 55116-47986
  Pfam annotation: Domain name=Fez1; Domain location=595-748; Score= -95.4; E_value=0.099; Accession=PF06818.5; Description=Fez1
  Pfam annotation: Domain name=Kinesin; Domain location=1-142; Score =20.2; E_value=2.2e-15; Accession=PF00225.13; Description=Kinesin motor domain
  Pfam module annotation: Pfam domain module=Fez1::Kinesin; Domain location=595-748::1-142
HRHVGSTNFNLLSSRSHTIFSLTIESSPCGENNEGEAITLSQLNLIDLAGSESSRAETTGMRRREGSYINKSLLTLGTVISKLTEGKASHIPYRDSKLTRLLQSSLSGHGRISLICTVTPSSSNAEETHNTLKFAHRAKHIEIQAAQNTIIDEKSLIKKYQHEIQFLKEELEQMRQGIVSVQSKETVEVDFVLLKQKLEDGQVKLQSRLEEEEEAKAALLGRIQRLTKLILVSTKAPHTTRFSNRPGPRRRHSFGEEELAYLPYKRRDLISDDENTDLHVNLEGNAETADDSFKEEKKRKKHGLLNWLKIWKRDTRLSALSGTSEKSCGAKSVSTPSTPQAETGNNAESRHFHSLPAQSSPSADLVSVAREVKEIYEDSLLGQETPLVSVKSIDEIDLLREQQEILSGEVALHSSALKRLSQEAARNPQKDQIHYDYFDYHGSISESLHILWLTHTKVEMERLKDEIKAKKEQIDLLERKIADSFIVKNKLDESGVSLSLTELMTQLNEKSFELEVKTADNHIIQQQLSQKIHECESLQETIGSLKHQLADALELRNLSPQPFSVTKDYHGEPHHDKESAMITNTNEKILLQEQAGEIEGMNQKLAELTESKEQLELLNQKLAEESSYAKGLASAAAVELKALSEEVSKLMNQNERLSAELAASKNSPAQCRNSGPGTVRNGRRESHVRRNDQGGSNSDIKRELALSKERELSYESALLDWDHREAELQRKIEESKQRETYLENELANMWVLVAKLKKSQGADTDV

SEQ ID NO: 156027 - protein, 188 aa, Glycine max
  Coding DNA Sequence Number=SeqID_39249
MGCKGLVNAFHEMDVRIEHRFYVRHMYAKKIGEGALLRDLVMVASKATYLERCKKYGHNTRTCKERLVAVGGSEAQAIGYEIPTARNNVANAESKVGGLGSAIPTGNNVATTIEYEISMQESQVGTSIPSGSMFRKKQPKPKQKAKEKACSTLSMKDINKEKDFLANCTLAQLVTKIVNQNMVNQNKI

SEQ ID NO: 156028 - protein, 239 aa, Glycine max
  Coding DNA Sequence Number=SeqID_39250
  Homolog annotation: Hit_ID=Q1SP02; Match level="QueryCoverage=89%, HitCoverage=64%, E-value=9e-07, Identity=23%"; Hit description=IMP dehydrogenase/GMP reductase
MLDDVASLLHLPIIGAFHNFEPLHVDEAVIMLVELLEVSHEEARAETAQCHGAYTRLSWLWDIYQRRCEARHWIVATHLAQSGSYAWGVATLVHMYDQLNDASQSISRHLADVTTCLPVAYYQTHIDALTIPDVCWMPYGDHRGVRAFDLISCFQGEFKWGPVVDMDDRWMHYSDHLVAAGQICLVPGQCATNYIDWFFGISHPFITPTQATDPPRHPLVPQHEKYMEPDIPEVPMAPE

SEQ ID NO: 156029 - protein, 181 aa, Glycine max
  Coding DNA Sequence Number=SeqID_39251
  Pfam annotation: Domain name=SAM_1; Domain location=86-148; Score =25.5; E_value=0.00018; Accession=PF00536.20; Description=SAM domain (Sterile alpha motif)
  Pfam annotation: Domain name=SAM_2; Domain location=85-150; Score =19.3; E_value=0.014; Accession=PF07647.7; Description=SAM domain (Sterile alpha motif)
  Pfam module annotation: Pfam domain module=SAM_1::SAM_2; Domain location=86-148::85-150
MVQVVEPIRQQRRGVAANGNDGHEISHDKWCYSCNSTGSVMASRTAGRVCCGALCYCWSVGLVMNASARDELSGLEKLMGDEQVQVQQSHQTVDGLLHALGLQKYAILFKAEEVDMTALKQMGENDLKELGIPMKTLFHLFSSLIAILLEYMNFSHACTFSPWGPRKKILLAVLPRTKRQQ

SEQ ID NO: 156030 - protein, 368 aa, Glycine max
  Coding DNA Sequence Number=SeqID_39252
  Subcellular localization annotation: CTP_CleavageSite=92; ConfidenceScore=5.43e-01
MCCNLKDSTKLNTKRSPQDYPSWTFKQGCLQSVHLNPNSNRGGDVFFSASASSRGNGIRVTVTVRVSVIVMSDPSRGRVTITLGRSGHVVKRDASAVDVSSFSSIHSAGTKRSVRDRIGSNADSSGWHGNGHSGNKRHRGDVSMQNGLDGNDLRLKLMRKSALGQADSNGSKRHMDLREKLSKASHPLANTYNSKQHGPDSRETSLRQIPSARSSDKLLRMESMRSSYSPWTLDHIRRRSPDGFPSTSRGISPQRDVQDLHRRPVSRTYDGVRSVSYVGRDVLETSRPPISTPQSFMSRSTMSTLPPVTVKPVASHPGQLPPSGSVAQRPSYVVSITYLLASRYPFSQPFLLVYLEKIFLRPSVGYPS

SEQ ID NO: 156031 - protein, 75 aa, Glycine max
  Coding DNA Sequence Number=SeqID_39253
MEATSFEFVSGATDSKSNILIKTCICLAKLLGLPLLSPVKDSDKNRDLLGAYWDKLSVEEAKEVVSFKNVMLELV

SEQ ID NO: 156032 - protein, 723 aa, Glycine max
  Coding DNA Sequence Number=SeqID_39254
  Gene Ontology: Mol. function=two-component response regulator activity; Cellular component=periplasmic space; Biological process =protein transport
  Homolog annotation: Hit_ID=Q10MC3; Match level="QueryCoverage=67%, HitCoverage=73%, E-value=5e-88, Identity=36%"; Hit description=WD40 -like Beta Propeller Repeat family protein, expressed
  Pfam annotation: Domain name=PD40; Domain location=164-205; Score =5.9; E_value=3.1; Accession=PF07676.3; Description=WD40-like Beta Propeller Repeat
  Pfam annotation: Domain name=PD40; Domain location=218-262; Score =8.2; E_value=1.6; Accession=PF07676.3; Description=WD40-like Beta Propeller Repeat
  Pfam annotation: Domain name=PD40; Domain location=265-304; Score =11.1; E_value=0.7; Accession=PF07676.3; Description=WD40-like Beta Propeller Repeat
  Pfam annotation: Domain name=PD40; Domain location=419-450; Score =4.4; E_value=4.7; Accession=PF07676.3; Description=WD40-like Beta Propeller Repeat
  Pfam annotation: Domain name=PD40; Domain location=508-543; Score =26.0; E_value=0.00013; Accession=PF07676.3; Description=WD40-like Beta Propeller Repeat
  Pfam annotation: Domain name=PD40; Domain location=555-594; Score =41.9; E_value=2.2e-09; Accession=PF07676.3; Description=WD40-like Beta Propeller Repeat
  Pfam annotation: Domain name=PD40; Domain location=603-654; Score =6.7; E_value=2.4; Accession=PF07676.3; Description=WD40-like Beta Propeller Repeat
  Pfam module annotation: Pfam domain module=PD40::PD40::PD40::PD40::PD4 0::PD40::PD40; Domain location=164-205::218-262::265-304::419 -450::508-543::555-594::603-654
MPWLSNNHSADDALLLAIFPDSCRETLAHSAPARMKTRHLLNDLCLVVLVLALGCAAEEDSTSTASIIFTTLGRASYAFDIYSLPVPVQQQQQQPLSPSQELLLTDGHSVNFNGHFLSNSSAIQLPKHSPPLQLVYVTERNGYPTIFYDAIYSSSMVSNRIQIPLLSNHLSDASIKDKPSVTPDGQYLLYVSSHENPGVPRASWTAVYSTQLESGLTQRLTPYGVADFSPSLSPSGLWTAVASYGPHGWAGEVEDLTTDIYVFLTHDGTHRFKIVEHGGWPTWVDDRTLYFHRRGQDHWWSIYRAILPSNAPFSVDSVFVERVTPPGLHAFTPATSPGNNNFIAVATRRPGSNFRHIELFDLASNEFTELTRLVSPNSHHLNPFISPDSTRVGYHKCRGEPNAHSTPQFFLENVRSPVPGLTLFRFVGSFPVFSPSGDRIAYVEMPGVYVVNRDGSNLRKVSNAMAFSTAWDRVRPGVIYTAIGETFAPESSQVDIVSIDVDHENSVKRLTLDGKNNAFPSPSPDGKWIVFRSGRSGHKNLYIMDAVDGEKKELRRLTEGPWTDTMCNWSPDGEWIAFASDRHDPGSGSFEIYLIHPNGTGLRKLIQSGSGGRTNHPYFSPDGKSLTFTSDYAGISAEPISNPHHYQPYGEIFTVRLDGSGIKRLTHNSYEDGTPAWSPKYMPPVNVPKGGPYCSFDDCHWLNNMPISTAFGVSKAKPQCAAL

SEQ ID NO: 156033 - protein, 372 aa, Glycine max
  Coding DNA Sequence Number=SeqID_39255
  Homolog annotation: Hit_ID=Q1SHI2; Match level="QueryCoverage=25%, HitCoverage=18%, E-value=5e-21, Identity=61%"; Hit description=AAA ATPase
MAKSVILVEDLDQFMEPESGATTTVTALGIQSFMDGIISACCREERVMVFTMNNKECVNPNLLQPSRVAVHIHFSVCDFSTIKTLDNNLLDNHEKDHVARYLVQKCAPHAMTIGYHVMHDSWINAFPATGMPHLYPLPFLPSLWLTSKQYEDTRPLTFSVGSNSSNVTVTLRCSAAEEKEASTSTTSIIFNTVGRAHYAFDIYSLPIQQPPTPDRELRLTDGHFVNFNGHFLSNFPPHTPLLSNSFTSPREMTSFILPPPQGEKDRFWNPLPQTESKSLSSATLLVLVNSPQLLLESVKSLVPGLSLFRFVVRPEVIYTAMGESFATGASQVGIVYINVDDEENSVKRLTAERRHVQLVTGCILDCFFVEPA

SEQ ID NO: 156034 - protein, 203 aa, Glycine max
  Coding DNA Sequence Number=SeqID_39256
  Gene Ontology: Mol. function=serine-type peptidase activity; Cellular component=integral to membrane; Biological process=proteolysis
  Homolog annotation: Hit_ID=Q9LV44; Match level="QueryCoverage=47%, HitCoverage=31%, E-value=1e-23, Identity=58%"; Hit description =Similarity to signal peptidase
  Pfam annotation: Domain name=Peptidase_S24; Domain location=56-131; Score=69.9; E_value=8.1e-18; Accession=PF00717.13; Description =Peptidase family S24
MSFLRPSALYNFLISYPALRWLPCQSWGFLRWPGLDGFFRLFVVVLLWSTLSELRFIPSSSMYPTLRVGDRIIVEKASYYIRSPAIHDIVTFKDPTQSSGENTDAVFIKRIVAKAGDTVEVNHGALYINGVAQQEDFIAEPPAYAMQLTLELQVFGLSEFVYCPSCQDKWLCLIANCAPFPLCTIPIDNVVYTVVSMKAFQFN

SEQ ID NO: 156035 - protein, 173 aa, Glycine max
  Coding DNA Sequence Number=SeqID_39257
MGAVSVVRVDDDDGDSFKKAGAVPFKWEVKPGLPIVQQKLHHQKLESPSLKLRPPPPVGAYLLSPAEPRSRSFRSTPRDRSDRWRFKRPLLAQAESVSSGCFFSPFLRRLQRRKKVPKRVFEEDYRPELETLGRWSLSSTKSLSPFRASTTSSSVASSPRPVSDAEWAGFGLF

SEQ ID NO: 156036 - protein, 544 aa, Glycine max
  Coding DNA Sequence Number=SeqID_39258
  Gene Ontology: Mol. function=transporter activity; Cellular component= membrane; Biological process=transport
  Homolog annotation: Hit_ID=Q1SJX6; Match level="QueryCoverage=97%, HitCoverage=97%, E-value=0.0, Identity=80%"; Hit description=Natural resistance-associated macrophage protein
  Pfam annotation: Domain name=Nramp; Domain location=70-433; Score =668.7; E_value=4.6e-198; Accession=PF01566.9; Description=Natural resistance-associated macrophage protein
  Subcellular localization annotation: CTP_CleavageSite=61; ConfidenceScore=5.28e-01
MASLTQHQPKGVNGGSSRIAAVNVTPSNNLSTPSHHDASSNHQKPGWKKFLSYVGPGFLVSLAYLDPGNMETDLQAGADHKYELLWVILIGLVFALIIQSLAANLGVTTGKHLSELCKAEYPLLVKYCLWLLAELAVIAADIPEVIGTAFALNILFHIPVWAGVLITGCSTLLFLGLQRFGVRKLELLISILVFVMAGCFFGEMSYVKPPASGVLKGMFVPKLSGQGATGDAIALLGALVMPHNLFLHSALVLSRKVPSSVRGINDACRYFLMESGFALFVAFLINVAMISVAGTVCSADNLSAENADQCSDLTLNSASFLLKNVLGRSSSTIYAIALLASGQSSAITGTYAGQYIMQGFLDMRMKRWIRNFVTRCIAIAPSLIVSIIGGSQGAGRLIIIASMILSFELPFALIPLLKFSSSSTKMGPHKNSIIIIVISWILGLGIIGINVYYLSTAFVGWLIHSSLPKVANVFIGIIVFPLMALYVAAVIYLTFRKDTVKTYIETKNEPAMQTHMEKGFMANGQLELSQVPYREDLADIPLPQ

SEQ ID NO: 156037 - protein, 84 aa, Glycine max
  Coding DNA Sequence Number=SeqID_39259
  Gene Ontology: Mol. function=DNA binding; Cellular component=nucleus
  Homolog annotation: Hit_ID=UPI00000529F6; Match level="QueryCoverage =92%, HitCoverage=6%, E-value=1e-25, Identity=66%"; Hit description =transcription factor
MEEIEGEYWRIIEQPTDEVEVYYGADLETGSFGSGFPKTSSLTKNESDRYALSGWNLNNFPRLPGSALCFEGSHISGVVARNKV

SEQ ID NO: 156038 - protein, 209 aa, Glycine max
  Coding DNA Sequence Number=SeqID_39260
  Gene Ontology: Mol. function=nucleoside-triphosphatase activity; Cellular component=membrane; Biological process=DNA replication
  Homolog annotation: Hit_ID=Q1SJW8; Match level="QueryCoverage=98%, HitCoverage=59%, E-value=5e-87, Identity=81%"; Hit description =Chaperonin clpA/B; Checkpoint protein Rad24; DEAD/DEAH box helicase, N-terminal
  Pfam annotation: Domain name=Rep_fac_C; Domain location=105-194; Score=113.5; E_value=6e-31; Accession=PF08542.1; Description =Replication factor C
METYSKVTRFFFICNYVSRIIEPLASRCAKFRFKPLSEEIMSSRILYISQEEGLCLDAEVGTLVALSTLSFISHGDLRRAITYLQSAARLFGSSISSENLISVSGVVPAKVVEALLKACKSGNFDLANKEVNNFIAEGYPASQMLTQLFEAIVEENDLSDEQKARISKKLGEADKCLVDGADEYLQLLDVVSNTIKAFNSLPEAFAYEC

SEQ ID NO: 156039 - protein, 97 aa, Glycine max
  Coding DNA Sequence Number=SeqID_39261
  Gene Ontology: Mol. function=nucleotide binding; Cellular component =intracellular
  Homolog annotation: Hit_ID=O82626; Match level="QueryCoverage=87%, HitCoverage=20%, E-value=1e-26, Identity=68%"; Hit description=GTP -binding protein ERG
MCFLRHRMKLPLPHLAVRRAWEEDPFTMSEEVMKMIALEVVRERLLDLHQEILYDVEHQLIDWKKLQDGFLRIEQHFISSKLSKCKILVGKNGSKIG

SEQ ID NO: 156040 - protein, 152 aa, Glycine max
  Coding DNA Sequence Number=SeqID_39262
MKVKGPVFIVAVVGSTSVTNKLTRKVYTDQVDPYKPYGSTSSMNEDQCMYDTIMFEEVDTDDQNEQECGVNEPQVDYSDAFNTSQVFDSRDDVLQWAQSVAYENGLVAVIIRSDTNTGSRGRTSFVLIGCERSDEYRCRKKEFFTRDTGTRK

SEQ ID NO: 156041 - protein, 82 aa, Glycine max
  Coding DNA Sequence Number=SeqID_39263
  Homolog annotation: Hit_ID=Q1SJY2; Match level="QueryCoverage=66%, HitCoverage=7%, E-value=1e-11, Identity=66%"; Hit description =Galactose-binding like
MVMKVWWCFSFAFISTVFIGTTVYGGNVTYDGRSLIIDGQHKILFSGSIHYPRSTPQQCRYQFTWGLIRETLDSLRDRSFSL

SEQ ID NO: 156042 - protein, 299 aa, Glycine max
  Coding DNA Sequence Number=SeqID_39264
  Gene Ontology: Mol. function=protein binding; Cellular component =mitochondrion; Biological process=ubiquitin cycle
  Homolog annotation: Hit_ID=Q1SJZ0; Match level="QueryCoverage=96%, HitCoverage=72%, E-value=1e-96, Identity=64%"; Hit description =Cyclin-like F-box
  Pfam annotation: Domain name=F-box; Domain location=83-151; Score =25.9; E_value=0.00015; Accession=PF00646.23; Description=F-box domain
MASASDFALAVSSELESVLRLKTVNYFVTRRPWLVLNHLFCVPGWHSLVVVAMRFVSDLYGVNVRPVAPVGSASRRPYVDPALIHRSLPDELLFEVFHIINILCGSDNGTSYYVLMVFARMTPYDLGKASCVCRKWKYTIRNPVFWRNACLKAWQKTIRYFNQNMMAHGGKCGCYDQGCGLMLGLFVLQCSHISGLYVSRNTYIRAGVAEWKITNPVHVVCYFRYLRFFPSGRFLYKNSSQKIKDVAKCMNFRSSKIDCVFGGHYTLSDDKVEAAVLYPGMRPTVLRIRLSKANIKNQK

SEQ ID NO: 156043 - protein, 97 aa, Glycine max
  Coding DNA Sequence Number=SeqID_39265
MVMFLVFENYYVWLINCTNYTIRVADATVGAHITHPSLLEMKIGEENKKEEGDTSVPHWCDAIANNSSPIAVEDSGIERVYPREMRGVCLLTVTGII

SEQ ID NO: 156044 - protein, 309 aa, Glycine max
  Coding DNA Sequence Number=SeqID_39266
MTRLGILIEEEATTVASTSAKVKLTWLVDLYHRYIESGSCVWSAMTYLLHLIDSMIFANKSLTHVHVAYLLYRNNLDICHKYARGVIALVYLYDHLSYASQYNIKQVGIMGICAFAHLLNVGYLELTSYDVDDPIATRWKPLRGTMCVLPIKEKLDELQMEFFAWCPFDLHRGVRPFAQQALFFSFIKCKNDVWPYRLERAWTKWEQHIIPLGKVVPLTICLGFIRFPTTVILLEEEQPSSGPIRLSPILIQPLADYVPSEDYSCLSAEICQQFLGLNVKSSEGESHLSYKHLEHSANIAIAIPWLAIV

SEQ ID NO: 156045 - protein, 126 aa, Glycine max
  Coding DNA Sequence Number=SeqID_39267
  Gene Ontology: Mol. function=3'-5'-exoribonuclease activity; Cellular component=Arp2/3 protein complex; Biological process=regulation of actin filament polymerization
  Homolog annotation: Hit_ID=Q01CA0; Match level="QueryCoverage=94%, HitCoverage=37%, E-value=6e-30, Identity=51%"; Hit description=[Z] KOG2826 Actin-related protein Arp2/3 complex
  Pfam annotation: Domain name=P34-Arc; Domain location=1-125; Score= -49.4; E_value=4.7e-07; Accession=PF04045.5; Description=Arp23 complex, 34 kD subunit p34-Arc
ADKVTVVYPMRFNDSIDIVLATSFLQEFVEARRTAGLNNTPPCSWSLTPPLELKEVPADALSANAGFVTFVIFPRHVEGQKLDRTVWNLSTFHAYVSYHVKCSEGFMHTRMRRRVESLIQLNVFHY

SEQ ID NO: 156046 - protein, 76 aa, Glycine max
  Coding DNA Sequence Number=SeqID_39268
MDKFDARFVALETSVEALKKAMSEQGTRFPYCRNQEKCGRVPEVLIKNRYKTPKVPPSKNKGKTQQNPTTKGNNPN

SEQ ID NO: 156047 - protein, 164 aa, Glycine max
  Coding DNA Sequence Number=SeqID_39269
  Gene Ontology: Mol. function=lysine decarboxylase activity; Cellular component=cytoplasm; Biological process=amino acid metabolic process
  Homolog annotation: Hit_ID=UPI0000E4524B; Match level="QueryCoverage =100%, HitCoverage=22%, E-value=6e-79, Identity=85%"; Hit description= lysine decarboxylase 1
  Pfam annotation: Domain name=OKR_DC_1_N; Domain location=16-126; Score=148.0; E_value=2.4e-41; Accession=PF03709.5; Description =OrnLysArg decarboxylase, N-terminal domain
MHMNVIAIMNHMGVYFKEEPIRELHQALESLDFRIVYPNDREDLLKLIENNARLCGVIFDWDIYNLELCEKISQLNEYMPLYAFANTYSTLDVSLNDLRMQVRFFEYALGAATDIAAQIKQNTDDYIDTILPPLTNALFKYVREGKYTFCTPGHMGGTAFHKSP

SEQ ID NO: 156048 - protein, 189 aa, Glycine max
  Coding DNA Sequence Number=SeqID_39270
LISGQITSIAQSNSSRLGFPALITVLCKDRGVTSDSLVFERLSPVINLAYIKKNNWNPDDLTVSIRGARQARMRPAEPPSTSTTPIPAPMLQSIHQGQIILLQSLQVVAPPGSIPSVKQFTELVAWPGTLSSLCKEDEGPTAQVPQHVEDDSSEATILEPFVRGMVAEETQEVAATLERSLEAASEPPA

SEQ ID NO: 156049 - protein, 161 aa, Glycine max
  Coding DNA Sequence Number=SeqID_39271
  Subcellular localization annotation: CTP_CleavageSite=27; ConfidenceScore=5.47e-01
MAEPSKKRKGTSSRSQRHSRSQKMPIPSSTPSGSLFSSEEQRIRYTNIFSSRSIIDPKFIDMDFFSKINEGTLMSEVYGIKMVIDQSLFYDLTKLPSEGVPFEGTLIDDWKFDFSVHDARQLVYNSRLGSSAALIGLQLSLSGPWADLANKMLPDAVVGLA

SEQ ID NO: 156050 - protein, 69 aa, Glycine max
  Coding DNA Sequence Number=SeqID_39272
MIQNTETYIHKETHFRCQSLEEIKNYEKYGSLPRCHRVKIQDKEESNDKTRSETEFTDNYKLMNTTESD

SEQ ID NO: 156051 - protein, 56 aa, Glycine max
  Coding DNA Sequence Number=SeqID_39273
MVEVVVTIIMVVQLLWTMCSVGEGIGVERCGGHWQHTRYAEGGAAVGKEQIRYRST

SEQ ID NO: 156052 - protein, 78 aa, Glycine max
  Coding DNA Sequence Number=SeqID_39274
MAMVATTIVMVVMTIATRRMVMIAKVAAVDNDMVVMMVTVTTTKVMTTEVMAVVVAVDGDNDNSGSYSGGHDRSPIKN

SEQ ID NO: 156053 - protein, 130 aa, Glycine max
  Coding DNA Sequence Number=SeqID_39275
  Pfam annotation: Domain name=GRP; Domain location=1-68; Score=-20.5; E_value=0.0093; Accession=PF07172.2; Description=Glycine rich protein family
MATVATLIVMVVMTVATTMMVMIAKVAAVDNDSDDNNNHGDGYSGGHDGDSNNDKGHGDRGDGRGGGEPQWQHCDSGATNIVQQFKERHHPFEGANDNAYVALNNSHTGATPDKSIPVLGGSNWVRDLWD

SEQ ID NO: 156054 - protein, 69 aa, Glycine max
  Coding DNA Sequence Number=SeqID_39276
MINRIEHAIQESYAWHLYLSFLLKQPKDGRFVLRQRRMMALVRLVGGKRCGGDDESEGLIMRGRREERT

SEQ ID NO: 156055 - protein, 58 aa, Glycine max
  Coding DNA Sequence Number=SeqID_39277
MTNEEVLFLSLTFFTASTPAGWTSTAPPSCPRDSCGIPRPLPPYKPPPLYRSTSKGKP

SEQ ID NO: 156056 - protein, 55 aa, Glycine max
  Coding DNA Sequence Number=SeqID_39278
MAAVEKDYDNTEMDDTEPYCMSTDENGKEIKKGKGLNIDWWFNSSPLLSHSMPGR

SEQ ID NO: 156057 - protein, 83 aa, Glycine max
  Coding DNA Sequence Number=SeqID_39279
MPSLMLVLGYYHQIFKPEVVKYIKHTIGVWHNDIVKIASDLIGNNEFFMQPDVGTLESTKEGKRERSDTKERVARLNDLEYRC

SEQ ID NO: 156058 - protein, 260 aa, Glycine max
  Coding DNA Sequence Number=SeqID_39280
  Gene Ontology: Mol. function=nucleic acid binding; Biological process= DNA integration
  Homolog annotation: Hit_ID=Q1S1X7; Match level="QueryCoverage=87%, HitCoverage=19%, E-value=6e-21, Identity=35%"; Hit description =Integrase, catalytic region; Zinc finger, CCHC-type; Peptidase aspartic, catalytic
  Pfam annotation: Domain name=zf-CCHC; Domain location=201-218; Score =13.9; E_value=0.0051; Accession=PF00098.13; Description=Zinc knuckle
MAQPPEKRCIISYSHSNSWKAHQDVFLVDKFALEQQEEKVHSLILLSLSDEVLYEVSEEKITYVLWLKLEKLFMTKSISNKLLLKQCLFMKEGMPHLVELNSALLELYDIDVKLEDIDLAMILLASPRPLSYESFVNFLSVGKDCITLEEVNSSLYSRELRHKASTNGDEASASRLSLTNFAKGQKKKKAKDSRREKLIQRISNYCKEPDHWKKDCPNKIKKDFVAVVVQSDKMIWYSQLLINNNIMLNNGYWTQVVLLI

SEQ ID NO: 156059 - protein, 77 aa, Glycine max
  Coding DNA Sequence Number=SeqID_39281
MAKNVVKVVVVEGRNSKAYSSGHNFGNNLVYWQRRHHMPREQFPPITGGHSTSALKPMLKVMMLNVSSLTSVFKNRC

SEQ ID NO: 156060 - protein, 94 aa, Glycine max
  Coding DNA Sequence Number=SeqID_39282
MMVMIAKVMAVDDDSDDNNNHDGGYSGDHDSDNGNDKAPCGTCRPWIFFINGVLCFLKFNGSGMEKEKDDWRRHFKEKKSLEEAHHHKKPWVIA

SEQ ID NO: 156061 - protein, 86 aa, Glycine max
  Coding DNA Sequence Number=SeqID_39283
MLTDHLIRKQPSNFPTAFSAIAGKNQNANDKLTLKKKQKREEEAEMRRRSTNAKTHTFLLNAATMAAMAAKKKKKNEEATREEEEN

SEQ ID NO: 156062 - protein, 47 aa, Glycine max
  Coding DNA Sequence Number=SeqID_39284
MDLLAFADLYAKEHLGFDTHPFGFVIILVARLFGGALSTSLTGFLGH

SEQ ID NO: 156063 - protein, 105 aa, Glycine max
  Coding DNA Sequence Number=SeqID_39285
  Pfam annotation: Domain name=B3; Domain location=7-98; Score=0.7; E _value=0.064; Accession=PF02362.12; Description=B3 DNA binding domain
MVDSIKIMQATAKASFIDNDQLKSLPKDIVDVLKVWKLHSLILFFNNNNKNGIHCKLNIHYTHRKTVKIAKGWKEFCTTNNILKNITLWFDFKRANNNRVYVTKV

SEQ ID NO: 156064 - protein, 91 aa, Glycine max
  Coding DNA Sequence Number=SeqID_39286
RCGISIACSYFAAGGGAIEGLAVEGEGEDWGQKGGLVVKRGRMKLMTRNEGDDGIVVVVCGNTRDVEEVPFLFEFCCVLAFGSCLCGSFEV

SEQ ID NO: 156065 - protein, 91 aa, Glycine max
  Coding DNA Sequence Number=SeqID_39287
  Subcellular localization annotation: CTP_CleavageSite=38; ConfidenceScore=5.19e-01
MAFGVVAIAFLSSVSLYHMVASPSRSLTMVALTYLVIVANMLYYLALSHSPPFHDHRTRCLISTYGFTSSLSIPSTSRGGPVPAFVPFSEG

SEQ ID NO: 156066 - protein, 298 aa, Glycine max
  Coding DNA Sequence Number=SeqID_39288
  Homolog annotation: Hit_ID=Q5XM22; Match level="QueryCoverage=34%, HitCoverage=57%, E-value=2e-16, Identity=44%"; Hit description =Resistance-like protein HAAS-2
  Pfam annotation: Domain name=DUF1723; Domain location=1-44; Score =29.0; E_value=1.7e-05; Accession=PF08330.1; Description=Protein of unknown function (DUF1723)
MSIFVERWHKETSGFHLLVGEVTITLDDVASLRHLSIVSVAKARAETIQCHGSYVRLSWLCYVYQTKIKTCHWIIAAHAYLLHLLGCTLFANKSATHVHVLFLDALRDLTQSGTYAWGAAALVHIYDNLNEASKSTTRQLPGYITLLQETAFMLMDLWQGTARVDVISLFFGYLSWGPLTVIHQSERVVPSVSIEEINAIWMQFGDYIGPPRDPSRVSPVQQYDTFVEPNVHQQSMAAVTLDEANVDVHRLGHAVDGYVAIVDKLERLLNLRILNEGTEAYIVVEECLSTPEATLANQ

SEQ ID NO: 156067 - protein, 90 aa, Glycine max
  Coding DNA Sequence Number=SeqID_39289
MISMPRDPISVAKRRRISAQKREERRKNDEEPPERTALLIATKTGIVEIVEKFLDVNPEAIFHVTENNQNILTIKTTCTKVLSSIYIQKN

SEQ ID NO: 156068 - protein, 90 aa, Glycine max
  Coding DNA Sequence Number=SeqID_39290
MDGEELPSPVNSDVVKRILVLYNFSSQSFKRKEHGIKDQNRLRQWSNAGPDPKVVRDGSKQRLGSRSIDHRPMPSSGQAESATGRQPSIL

SEQ ID NO: 156069 - protein, 143 aa, Glycine max
  Coding DNA Sequence Number=SeqID_39291
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-18, Identity=32%"; Hit description= UPI00006A17C9 related cluster
GYTPSASGDYSSSPSDGYTPSPSEDYTSFTSEDYTSFPSEDYTSSPSEGYTSSPSEDYTSSPSGGYSPSPSKVYTSSSSEGYMPSPSEDYTSSPLKGYTPSPLEDYTSSPSEDYTFSPLEGYTPSPSKDYTSSPSKDCTPSPS

SEQ ID NO: 156070 - protein, 147 aa, Glycine max
  Coding DNA Sequence Number=SeqID_39292
MTTLTQIWMTLLLSNILPNYHNTDLPLRKDRAHKTPSGPGEVQQGLRVSSSGVSLCQSYRVTVPPARSCHRDIGITPTRHLMDPEKSNGVLGFPALITSLSQFYGVPVTPARSSGPLLTELSSRSTAPSGRRRARHHSSLGMADIVQ

SEQ ID NO: 156071 - protein, 377 aa, Glycine max
  Coding DNA Sequence Number=SeqID_39293
  Gene Ontology: Mol. function=ammonium transporter activity; Cellular component=membrane; Biological process=transport
  Homolog annotation: Hit_ID=Q93X02; Match level="QueryCoverage=91%, HitCoverage=70%, E-value=1e-176, Identity=86%"; Hit description =Putative ammonium transporter AMT2
  Pfam annotation: Domain name=Ammonium_transp; Domain location=24-371; Score=71.8; E_value=2.1e-18; Accession=PF00909.11; Description =Ammonium Transporter Family
MATPTAYQEHLPASPHWLNKGDNAWQLTAATLVGLQSMPGLVILYASMVKKKWAVNSAFMALYAFAAVLICWVLVCHRMAFGDKLLPFWGKGAPALGQKFLTHRAKVPESTHYYNNGTVESATSEPLFATASLVYFQFTFAAITLILLAGSVLGRMNIKAWMAFVPLWLIFSYTVGAFSLWGGGFLYHWGVIDYSGGYVIHLSSGIAGFTAAYWVGPRLKSDRERFPPNNVLLMLAGAGLLWMGWSGFNGGAPYAANIDSSIAVLNTNICAATSLLVWTSLDVIFFGKPSVIGAVQGMMTGLVCITPGAGLVQSWAAIVMGILSGSIPWVTMMILHKKSSLLQKENTKHSIHFRWIGVERKDTKKKEKNKENSKSDK

SEQ ID NO: 156072 - protein, 149 aa, Glycine max
  Coding DNA Sequence Number=SeqID_39294
  Homolog annotation: Hit_ID=Q5ND71; Match level="QueryCoverage=34%, HitCoverage=20%, E-value=7e-11, Identity=67%"; Hit description=BCL-2 binding anthanogene-1
MSKHYGVNDYLNVDNCICMLYIKSETLCSYDIIRLKGDRYVLIEDKLQRKMSCRIFSIFLISNNLLHQGLIFISIIPVTHAPSPAVLDVTSIEVAINGGNKASEKEFLVLTELLMSQLLKLDGIEAEGEAKLQRKAEVTRNGKGAGVVI

SEQ ID NO: 156073 - protein, 162 aa, Glycine max
  Coding DNA Sequence Number=SeqID_39295
  Gene Ontology: Mol. function=ammonium transporter activity; Cellular component=membrane; Biological process=transport
  Homolog annotation: Hit_ID=Q93X02; Match level="QueryCoverage=89%, HitCoverage=29%, E-value=2e-44, Identity=61%"; Hit description =Putative ammonium transporter AMT2
MDKFTCNLLIYTLSPREKVDDTLGVFHTHAVAGLLGGLLTGLLAEPQLCRLILPVTNSRGAFYGGSGGIQLFKQLVAACFIAGWNLVSTTLILLTIQLFIPLRMPTEQLEIGDDAIHGEEAYALWGDGEKYDPTRHGSSRVEKTSASPRVNVTGARGVTIDL

SEQ ID NO: 156074 - protein, 100 aa, Glycine max
  Coding DNA Sequence Number=SeqID_39296
MRETINKLNVELLAKANKEKTLEEKMLQMMENHDHQSQEMRQQMQQQIHQQNEQMQRILQHLHIQPIIPAPSLSHTIGDGTDHHVNDAQVDRSHDMENDH

SEQ ID NO: 156075 - protein, 120 aa, Glycine max
  Coding DNA Sequence Number=SeqID_39297
ELTSVNNTWKGSKLFINDSLLKIESFTERTSVRLPIGVLVLNSSTKDQSLSQSSGSSRHGKKIRTRGYPHEPVPTLTGNTRVDRVWVRVRVFPDNQKSGTGTGMGFLYPPRPRPRPRPRP

SEQ ID NO: 156076 - protein, 92 aa, Glycine max
  Coding DNA Sequence Number=SeqID_39298
MGTGRGVGVGNWGNNTRPRPAPLPCLFVKGGDKNVNIFSNPLDNVLGHTLAFKVRVQPKYKNSSVQKISDDPTVMRAILDFLSNEEVSKGSI

SEQ ID NO: 156077 - protein, 59 aa, Glycine max
  Coding DNA Sequence Number=SeqID_39299
NKNSEYFRHPYLDSSKVATPLQRARLRLWRWWDQQVARVGTTKVREQRCEGGHKRDRVG

SEQ ID NO: 156078 - protein, 291 aa, Glycine max
  Coding DNA Sequence Number=SeqID_39300
  Gene Ontology: Mol. function=protein binding; Biological process =defense response to fungus
  Homolog annotation: Hit_ID=Q2QU42; Match level="QueryCoverage=73%, HitCoverage=21%, E-value=1e-24, Identity=35%"; Hit description =Leucine Rich Repeat family protein, expressed
  Pfam annotation: Domain name=LRRNT_2; Domain location=29-67; Score =39.5; E_value=1.1e-08; Accession=PF08263.3; Description=Leucine rich repeat N-terminal domain
  Pfam annotation: Domain name=LRR_1; Domain location=115-137; Score =11.2; E_value=2.3; Accession=PF00560.23; Description=Leucine Rich Repeat
  Pfam annotation: Domain name=LRR_1; Domain location=139-161; Score =15.8; E_value=0.16; Accession=PF00560.23; Description=Leucine Rich Repeat
  Pfam annotation: Domain name=LRR_1; Domain location=188-209; Score =3.5; E_value=65; Accession=PF00560.23; Description=Leucine Rich Repeat
  Pfam annotation: Domain name=LRR_1; Domain location=214-236; Score =5.1; E_value=32; Accession=PF00560.23; Description=Leucine Rich Repeat
  Pfam module annotation: Pfam domain module=LRRNT_2::LRR_1::LRR_1::LRR_ 1::LRR_1; Domain location=29-67::115-137::139-161::188-209::214-236
MLGLAFAVVFLLTAFVVLSSCGHSPLGCNEEERHGLQWIKGSFKDPSSWLSSWEEEDCCQWKGVVCSNITGYIVKLDLRNPCFPRRNQGGQPNCDFNKYVLKAKHAHPSILQLKYLTYLDLSGNKFNSSIPMFIQTMEHLQFLSLSDCHFSGRIPYNLGNLTKLLLLDFSFNPLLYADDFYWISQLPSLQYLYMRDVHLGKTRNLLQALSMLPSLIEIELRNCGLNKLHTYQLVRATNCGSNAFKGYFDDAKEFKNEEKDSREVSSFQESRIKNNQDSRFKISRIMIKIQD

SEQ ID NO: 156079 - protein, 679 aa, Glycine max
  Coding DNA Sequence Number=SeqID_39301
  Gene Ontology: Mol. function=protein binding; Cellular component =integral to membrane; Biological process=defense response to fungus
  Homolog annotation: Hit_ID=Q5VPF0; Match level="QueryCoverage=92%, HitCoverage=85%, E-value=4e-79, Identity=30%"; Hit description =Putative HcrVf3 protein
  Pfam annotation: Domain name=LRR_1; Domain location=100-128; Score =6.6; E_value=17; Accession=PF00560.23; Description=Leucine Rich Repeat
  Pfam annotation: Domain name=LRR_1; Domain location=133-155; Score =17.1; E_value=0.064; Accession=PF00560.23; Description=Leucine Rich Repeat
  Pfam annotation: Domain name=LRR_1; Domain location=157-179; Score =12.1; E_value=1.5; Accession=PF00560.23; Description=Leucine Rich Repeat
  Pfam annotation: Domain name=LRR_1; Domain location=204-227; Score =15.4; E_value=0.21; Accession=PF00560.23; Description=Leucine Rich Repeat
  Pfam annotation: Domain name=LRR_1; Domain location=229-251; Score =7.4; E_value=12; Accession=PF00560.23; Description=Leucine Rich Repeat
  Pfam annotation: Domain name=LRR_1; Domain location=253-274; Score =11.3; E_value=2.2; Accession=PF00560.23; Description=Leucine Rich Repeat
  Pfam annotation: Domain name=LRR_1; Domain location=26-48; Score =12.3; E_value=1.4; Accession=PF00560.23; Description=Leucine Rich Repeat
  Pfam annotation: Domain name=LRR_1; Domain location=277-299; Score =11.2; E_value=2.3; Accession=PF00560.23; Description=Leucine Rich Repeat
  Pfam annotation: Domain name=LRR_1; Domain location=3-24; Score=4.8; E_value=37; Accession=PF00560.23; Description=Leucine Rich Repeat
  Pfam annotation: Domain name=LRR_1; Domain location=301-323; Score =2.2; E_value=1.1e+02; Accession=PF00560.23; Description=Leucine Rich Repeat
  Pfam annotation: Domain name=LRR_1; Domain location=325-347; Score =9.6; E_value=4.5; Accession=PF00560.23; Description=Leucine Rich Repeat
  Pfam annotation: Domain name=LRR_1; Domain location=350-372; Score =9.4; E_value=5; Accession=PF00560.23; Description=Leucine Rich Repeat
  Pfam annotation: Domain name=LRR_1; Domain location=374-396; Score =14.9; E_value=0.29; Accession=PF00560.23; Description=Leucine Rich Repeat
  Pfam annotation: Domain name=LRR_1; Domain location=441-463; Score =6.8; E_value=15; Accession=PF00560.23; Description=Leucine Rich Repeat
  Pfam annotation: Domain name=LRR_1; Domain location=465-487; Score =14.3; E_value=0.45; Accession=PF00560.23; Description=Leucine Rich Repeat
  Pfam annotation: Domain name=LRR_1; Domain location=489-511; Score =13.2; E_value=0.98; Accession=PF00560.23; Description=Leucine Rich Repeat
  Pfam annotation: Domain name=LRR_1; Domain location=50-71; Score =15.6; E_value=0.18; Accession=PF00560.23; Description=Leucine Rich Repeat
  Pfam annotation: Domain name=LRR_1; Domain location=513-534; Score =14.8; E_value=0.31; Accession=PF00560.23; Description=Leucine Rich Repeat
  Pfam annotation: Domain name=LRR_1; Domain location=73-94; Score =13.7; E_value=0.68; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=100 -128::133-155::157-179::...
  Pfam module annotation: Domain location=204-227::229-251::253-274::26- 48::277-299::3-24::301-323::325-347::350-372::374-396::441-463::465 -487::489-511::50-71::513-534::73-94
MSSIAEIEFSFNNLSSTPFWLGTYSNLVYLSVENNALYGSLPSTLQNLTSLIYLDLSENNFDSVPSWLGELKGLQYLYLSGNDLKHIEGSLASFLGNCCHLHSLDMSSNNLKGDALGVYIQYGCIRSLEQLVSLKSLDLSRNSLNGTIPQNIGQLKNLITLYLFYNNLHGSIPYSLGQLLNLQNFDMSLNHLESSVSDIRWPKQLVYLNLTNNNITGSLPQDIADRLPNVSHLLFGNNLINGSIPNSLCKIDSLYNLDLSSNLLSGEIPDCWSATQGLNVLNLVSNKLSGVIPSCLGNLPMLAWFHLNNKSLQGGIPSSLRNLQQLLILDLGENHLSGIIPLWMGNIFYSMQILRLRQNMLIGKIPSQLCQLSALQILDLSNNNLMGSIPHCIGNLTAMILGKKSSVIQPSEEPRDVEWYEQEVRQVIKGRELDYTRNLKLVANMDFSNNNLSGTIPEGIALLSALQGLNLSHNHLSGHIPKRIGDMKSLESLDISHDQLSGTISDSISSLTSLSHLNLSYNNLSGPIPKGTQLSTLDDPLIYTGNQFLCGPPLPNECSADDSQHDNVDEDEDGKKDKVAKLWFYFIIALGYALGFWAVIGSLLIKTSWRRSYFQYIDDSTQRINVSWAIHLSNFKARFTGSPVAESHIIGVFMLSVFVLCIYRISCLLCLISDYFTFV

SEQ ID NO: 156080 - protein, 171 aa, Glycine max
  Coding DNA Sequence Number=SeqID_39302
  Gene Ontology: Mol. function=protein serine/threonine kinase activity; Biological process=protein amino acid phosphorylation
  Homolog annotation: Hit_ID=Q53KU9; Match level="QueryCoverage=68%, HitCoverage=14%, E-value=9e-21, Identity=45%"; Hit description =Probable protein kinase [imported]-Arabidopsis thaliana
MEVEAEIKQRDYKEEDPASKIGATGLIVGLESALTGELELEFESVVGSTEVGLATELLESSIGVVVLKIVSGLKAVNFRQPEVLLVKKVHEFEVRKRPLEALAYMGLNGEYNLKELMRLVSLGAACTRSDPKLRPSTTQIVSILDGNDKLIMGENMDSREDWRERNACFSY

SEQ ID NO: 156081 - protein, 88 aa, Glycine max
  Coding DNA Sequence Number=SeqID_39303
MMNKTRPCNAYFYLEAKSINIFVPLEIEESTPVKNLDGCIGCGTLKITFQRPTHFDIASNSFKVQTFSMYKLSELKGWIWTRRISQDH

SEQ ID NO: 156082 - protein, 158 aa, Glycine max
  Coding DNA Sequence Number=SeqID_39304
  Homolog annotation: Hit_ID=Q8LGU6; Match level="QueryCoverage=22%, HitCoverage=4%, E-value=2e-07, Identity=69%"; Hit description=HOBBIT protein
MEKAILEDKKNPVPMYQKAKILISLERIDEALDVLDELKEKSKEEEWKCFRGNLTEKCGRKRIEEELEELENSLSVQSNLVCNSRSTCVLAHRAGLSVQMHAQCEVSMKSKLPQAYKRSRKLKEKIHRVSELSSAEIQSPSLSLRENPFLSHSPFSYY

SEQ ID NO: 156083 - protein, 67 aa, Glycine max
  Coding DNA Sequence Number=SeqID_39305
METTLLDLETSGNHFGRMDKKALRKERKCLASERIGGREVIEDQGVDAGGIGGLKLGDEGGFRGTRS

SEQ ID NO: 156084 - protein, 94 aa, Glycine max
  Coding DNA Sequence Number=SeqID_39306
  Subcellular localization annotation: CTP_CleavageSite=17; ConfidenceScore=5.16e-01
MIVTTTSTMMPMTTTIMAMVATIIIMVVMTIATRMMVMIAKVATVDNDMVVVIVTVTTTKVMATEVMTVVVAVDGDVDNSVSCSGGHDRSPIKN

SEQ ID NO: 156085 - protein, 60 aa, Glycine max
  Coding DNA Sequence Number=SeqID_39307
SDNESCEGNDTEELDVDFEQLVNQAEDGEDEDWGFPSELKRMVEQEDKEVDAILPRKGIG

SEQ ID NO: 156086 - protein, 650 aa, Glycine max
  Coding DNA Sequence Number=SeqID_39308
  Gene Ontology: Mol. function=triacylglycerol lipase activity; Biological process=lipid metabolic process
  Homolog annotation: Hit_ID=Q6K832; Match level="QueryCoverage=50%, HitCoverage=50%, E-value=1e-127, Identity=70%"; Hit description =Lipase class 3 protein-like
  Pfam annotation: Domain name=DUF1336; Domain location=71-227; Score= -3.7; E_value=9.3e-11; Accession=PF07059.3; Description=Protein of unknown function (DUF1336)
  Pfam annotation: Domain name=Lipase3_N; Domain location=356-437; Score=87.0; E_value=5.8e-23; Accession=PF03893.7; Description=Lipase 3 N-terminal region
  Pfam annotation: Domain name=Lipase_3; Domain location=490-631; Score= 118.0; E_value=2.8e-32; Accession=PF01764.16; Description=Lipase (class 3)
  Pfam annotation: Domain name=Zim; Domain location=280-316; Score =48.0; E_value=3.2e-11; Accession=PF06200.4; Description=ZIM motif
  Pfam module annotation: Pfam domain module=DUF1336::Lipase3_N::Lipase_ 3::Zim; Domain location=71-227::356-437::490-631::280-316
NLQGKDNAPPPPPQWIEAKSHVQQGAYECGYYVMHWMWCIVSGGLKNELHNYFSDGTALDTGTMTTLRKKWAAYFLEVGKWMSAFDMFLLGSFSPSQPSHTLVQEIIGKAPQTIPYCRAFWMEMMLIGTQDLSSYHIFVRYISTKNVTWIMVFLMQSVGKKACLVGQALEMLYIRGKNYLEIDIDVGSSTVASGVPSLVLGYLNNLVVEMAFLVQYLVLTERLYSSSMKLAEKFIQIGPQSSVSEKGPPDTSCHSAATMQSVYPRHLEIPTFINPRSMEKEAKAAQLTIFYDGQVVVFDDFPADKVQETKMATAAGAVALLYYTLNRKLQTHDVIDEDGEENGSDSPADTPLGIGCVSHRLIQAPATWLETISTLLETLRFTYSETLGKWPIRDLAFGINFLLKRQGNYHVGSEFCGKDSVQLKGSEITAELKYLLNLLTLCWHFSKKPFPLFLEETGYTEENVLLREAKAGILKPTFTIIADHKMGCLLLLIRGTHNIKDTLTTVTGNVVPFHHIVVNLGGVSDLVLGYAHCGMVAAARWIAKLATPCLLEALGHYPDYKVKIVGHSLGGGTAAILTYVLRERKDLPVTTCITFAPAACMTWELAESGDSFITSIINGADLVPTFSVAFVDDLCSEVVILRIAYWKMLL

SEQ ID NO: 156087 - protein, 73 aa, Glycine max
  Coding DNA Sequence Number=SeqID_39309
QTDTKAQDKKRNLPRRWNTTAVVWMASTNLTKTDYGDYGGSTTRNTRTRRKTKKRVAAKGNCFVQHVSFLCTQ

SEQ ID NO: 156088 - protein, 144 aa, Glycine max
  Coding DNA Sequence Number=SeqID_39310
  Homolog annotation: Hit_ID=Q1RV57; Match level="QueryCoverage=55%, HitCoverage=17%, E-value=2e-20, Identity=58%"; Hit description =ENSANGP00000004406, related
MDEESKRMEEGINSALNGGGNKDDLKRRVTIKTSNGGSVIEHDKGTMAKPYGAESESVQKIAEQEQPVVKQKTKRIATLDAFRGLTIVLMILVDDAGEAYPRIDHSPWNGCTLADFVMPFFLFIVGIAIALALKHYDSEYNIVS

SEQ ID NO: 156089 - protein, 571 aa, Glycine max
  Coding DNA Sequence Number=SeqID_39311
  Homolog annotation: Hit_ID=O80960; Match level="QueryCoverage=97%, HitCoverage=94%, E-value=1e-173, Identity=56%"; Hit description =Nodulin-like protein
  Pfam annotation: Domain name=MFS_1; Domain location=17-475; Score =10.7; E_value=0.0001; Accession=PF07690.6; Description=Major Facilitator Superfamily
  Pfam annotation: Domain name=Nodulin-like; Domain location=12-258; Score=432.1; E_value=7.5e-127; Accession=PF06813.4; Description =Nodulin-like
  Pfam module annotation: Pfam domain module=MFS_1::Nodulin-like; Domain location=17-475::12-258
MKTLIYHVLTGRWFMLFASLLIMAAAGAAYMFGMYSNEVKTSLGYDQTTLNLFSFFKDVGATVGIISGLVNEITPPWVVLSIGVIMNFFGYFMIFLAVTGRIAKPQVWQMCLYICIGSNSQTFANTGGTVTCVKNFPGSRGNVLGLLKGYVGLSGAIIAQLYHAFYGDHNPQALILLIAWLPAAVSFLFLPTIRIFNTVHHPNENKVFYHLLYISLVLAGFLMVLIIMQNKLRFTRPEYIADGVVVFFFLLLPLVVVFREEINQLKAKTQGLTDSVKVVTEVIPPPNVVEQEVPSTTTSSHEKSSCFGNILKPPKRGEDYTILQALFSIDMLILFIATTFGAGGALTAIDNLGQIGRSLGYPRKSITTCVSLLSIWNYLGRVVAGYASEIFLTKYKLPRPYMLTLVLLLSCVGHILIAIGAPNSLYLASVIIGFCLGAQWPLMFAIISEIFGLKYYSTLFNFGAVASPVGSYILNVKVAGVLYDKEALKQLKAKGLTREEGKDLTCVGVQCYKMAFIIITASTLFACIVSFVLVVRTRKFYKGDIYRKFRVEHETGENEMGITKTRNSPSG

SEQ ID NO: 156090 - protein, 60 aa, Glycine max
  Coding DNA Sequence Number=SeqID_39312
MAKINNATKMNGLAKRTLELELVRANVPSPSSLTSHKKIYSVDHNGVIGLCLMREGKGNI

SEQ ID NO: 156091 - protein, 93 aa, Glycine max
  Coding DNA Sequence Number=SeqID_39313
VESAHWSLNKLLQNFIGDICSVWEAMNNMMTLQHTQIKASFETKTIHIFWRRLSFSDQGLCEAEVTMTEEMETISKQFEQLDICGKVHLKTKL

SEQ ID NO: 156092 - protein, 257 aa, Glycine max
  Coding DNA Sequence Number=SeqID_39314
  Gene Ontology: Mol. function=transferase activity; Biological process= lipopolysaccharide biosynthetic process
  Homolog annotation: Hit_ID=Q84HE1; Match level="QueryCoverage=95%, HitCoverage=96%, E-value=8e-57, Identity=45%"; Hit description =Rhamnosyl transferase
  Pfam annotation: Domain name=Glycos_transf_2; Domain location=12-191; Score=-9.0; E_value=0.009; Accession=PF00535.16; Description=Glycosyl transferase
MPESLVEPCRCFISVISHGHGNMIIDEGCLKLLASNNYIVVLKDNKPQRELQEYCQESGIHYLVDQPMGFGANNNYIFTWCQQELGMRDGDRFLVLNPDVFIEPSVLAALLLHAEQNTYSLVAINLFNDKNFTIYDKGIRHFPTISSFAVSFLLQKNKSIYDKDKITQDTEVEWAAGSFLLFTAKCYRELGGFDTRYYMYCEDLDICWRARRELGINVVYLPQFKALHLAQMRSRSLFSKHFIWHVTSALRFCLKQA

SEQ ID NO: 156093 - protein, 388 aa, Glycine max
  Coding DNA Sequence Number=SeqID_39315
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=82%, HitCoverage=64%, E-value=1e-146, Identity=77%"; Hit description =Serine/threonine protein phosphatase 2A 57 kDa regulatory subunit B' beta isoform
  Pfam annotation: Domain name=B56; Domain location=48-388; Score =732.2; E_value=3.4e-217; Accession=PF01603.10; Description=Protein phosphatase 2A regulatory B subunit (B56 family)
  Subcellular localization annotation: CTP_CleavageSite=26; ConfidenceScore=5.06e-01
MFKRIMKGGQKKPSKTDPSDPSPLAPAAAGAAAAPALVVPPPSGTIEPLPLFRDVAVSERQNLFIRKLQICCHVLDFSDTLKSVREKEIKRQTLMELVDFIQSGSGKITETCQEEMIKMVSANVFRCLPPASHENTGQEATDPEEEEPCLEPAWPHLQLVYELLLRYVVSSDTDTKVAKRYIDHSFVLKLLDLFDSEDPREREYLKTILHRVYGKFMVHRPFIRKAINNIFFRFIYETERHSGIGELLEILGSIINGFALPMKEEHKLFLARALLPLHKPKPVGVYHQQLSYCIAQFVEKDYKLSDTVIRGLLKYWPVTNCQKEVLFLGELEEVLEATQTAEFQRCMVPLFRQVARCLNSSHFQMSNPGCEGSVLRSLIMATPGLVKL

SEQ ID NO: 156094 - protein, 153 aa, Glycine max
  Coding DNA Sequence Number=SeqID_39316
  Gene Ontology: Mol. function=protein phosphatase type 2A regulator activity; Cellular component=protein phosphatase type 2A complex; Biological process=signal transduction
  Homolog annotation: Hit_ID=O04376; Match level="QueryCoverage=64%, HitCoverage=19%, E-value=3e-31, Identity=65%"; Hit description =Serine/threonine protein phosphatase 2A 57 kDa regulatory subunit B' beta isoform
  Pfam annotation: Domain name=B56; Domain location=2-99; Score=-229.8; E_value=0.00043; Accession=PF01603.10; Description=Protein phosphatase 2A regulatory B subunit (B56 family)
MQVAERALFLWNNEHIVSLIAQNRTVVLPIIFEALEKNIKSHWNQAVHGLTVNVRKMFVEMDAELFEECQRQFEEREAKAKELEVQRELNWKRLAEAASQNGVDMVLLGTKFCKELVLCRRPDKRATLASSKSGQRCPAAGNHAANMFDVTHH

SEQ ID NO: 156095 - protein, 82 aa, Glycine max
  Coding DNA Sequence Number=SeqID_39317
  Homolog annotation: Hit_ID=Q9SD67; Match level="QueryCoverage=53%, HitCoverage=5%, E-value=7e-12, Identity=77%"; Hit description=FtsH metalloprotease-like protein
MTRPCLKGIEEKTAKLKGSEKALVARHEASHAVVGTAVANLLAGQPHVEVWTLEYLILEFIDLVLWWEIKEKYKSVMCDIQR

SEQ ID NO: 156096 - protein, 98 aa, Glycine max
  Coding DNA Sequence Number=SeqID_39318
MKVDLSALYKVIACAPKREIQIGKKSWQARTQGITWLPKLKGPSGKEVEVPEEREEVQALKAELGRTRVVKEKLKTTVTRVRKECDELRDVNMTTVIP

SEQ ID NO: 156097 - protein, 422 aa, Glycine max
  Coding DNA Sequence Number=SeqID_39319
  Homolog annotation: Hit_ID=Q1S0F5; Match level="QueryCoverage=61%, HitCoverage=59%, E-value=2e-18, Identity=30%"; Hit description=IMP dehydrogenase/GMP reductase
MASCLSSQLAWAICGHVGSPTRLIIVKPYLVFSSFDDALSLGVEVLVIKISILANMGSDQASSFKKMFYHVKVKNLEVASLRKLGQWMNQVQRQAFRKMFHIWGLSVSTTIKEFEGILGCPIGGRKPYLFSGYYPSMARIAGVAETLASQGEWVSFINVLALLVFGTVLFPNIDELMDLVVIDAFLAYYHSKESSIIVVLAYAYDTFGLRCEKSSHSMCSRKDKANWEELLAGMMGASISWFPWCKEGGARVLCSCEGFPNVPLIRTRGCINYNPVLAIRQLGYPMKGAPSEETIVPSFNEANTKILQRIRKAWDKVGRKDKELRGRSNGVIGGYHKWFKPRTQGITWLQKLKGLNREESEEVQALKAELKKTRVENEKLKVAVTRVRKECDKLKDINMTVAEALEWETKKDRKEEWSKNKF

SEQ ID NO: 156098 - protein, 373 aa, Glycine max
  Coding DNA Sequence Number=SeqID_39320
  Gene Ontology: Mol. function=RNA-directed DNA polymerase activity; Biological process=RNA-dependent DNA replication
  Subcellular localization annotation: CTP_CleavageSite=27; ConfidenceScore=5.16e-01
MKKDSLWVQGSSSYAQIFIAQYIFNVKSSPDASFIRRGILRGKNTLLGGFKFRRGNSSDDWAVSNRRHRSPYGERPTGAPRDPCIWTTMLTILKKDRSNNAVSCHDVNLCLRDIMIDENWCANHLYTNTILLDSFMQNLASIDCVLAPGFEDCWVWKHSANGTHTAASTNSWLLSVHNEAHLSPLASFRWLWKLEIPEKICMFLWLILHKSLPTNSVRRHRNLVNSPACQVCSHVMEDTLHYIRDCPHARDIWSRLNFTSRVGEEVRTSFAFDGYGDVMKVELLALLHVLELAWNKDFRNVCCEVDNLEVEKIINSREEANEVAHFLASVGVHQTQPFGIWDNPSLALETILLKDSLGNEANDASDRMRGDTE

SEQ ID NO: 156099 - protein, 306 aa, Glycine max
  Coding DNA Sequence Number=SeqID_39321
  Gene Ontology: Mol. function=protein serine/threonine kinase activity; Biological process=protein amino acid phosphorylation
  Homolog annotation: Hit_ID=Q8W559; Match level="QueryCoverage=53%, HitCoverage=41%, E-value=2e-51, Identity=55%"; Hit description =Calcium/calmodulin-dependent protein kinase CaMK3
  Pfam annotation: Domain name=Pkinase; Domain location=23-214; Score= -72.5; E_value=0.0003; Accession=PF00069.15; Description=Protein kinase domain
MKEKERPKMLHNEGQRFEVEAVQCHNGLLPNGVLGVVKKLDDTRKHGGDGLLIDEPADGVKSGANDEVVIGGEVFLDCVDDEDDEVVVVAEEEREGEVVRALQEEGVVTRSSFTSPYLVVGSSILCLMSLTMFLLLVSHLTDERLNDIVGSAYYVAPEVLHRSYGTEVDVWSIANPSFDKTLWPSLSLEAKDFVKRILNKDPQNRISAAQALTNNIGEALSKTLTADELYYLREQFALLEPRKNGSISLENVNKALMKYATDAMKESHILDFLSLLFIVGNNMPAVHMNSLIKTKIGLLSLKSLLQ

SEQ ID NO: 156100 - protein, 480 aa, Glycine max
  Coding DNA Sequence Number=SeqID_39322
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=94%, HitCoverage=59%, E-value=1e-124, Identity=52%"; Hit description =Putative CRK1 protein
  Pfam annotation: Domain name=Pkinase; Domain location=1-185; Score =62.4; E_value=1.5e-15; Accession=PF00069.15; Description=Protein kinase domain
  Pfam annotation: Domain name=Pkinase_Tyr; Domain location=1-184; Score=-164.5; E_value=0.022; Accession=PF07714.7; Description =Protein tyrosine kinase
  Pfam module annotation: Pfam domain module=Pkinase::Pkinase_Tyr; Domain location=1-185::1-184
MVKCYMQQLLQGLDHCHNCGVLHRDIKGSNLLIDNNGILKIADFGLASVFDPNQTQPLTSRVVTLWYRPPELLLGATYYGTAVDLWSTGCILAELYAGKPIMPGRTEVEQLHKIFKLCGSPSEDYWRKSKLPHATIFKPRQPYWRCVADTFKDFPAPALALMETLLSIDPADRGTAASALKSDFFTTKPLPCDPSSLPKYPPSKEFDAKLRDEQARRQGATGSRGQRHDLERRGAKESRAVPAPDANAELPLSMQKRQSQAQSKSRSEKFNPHPEEASGFPIDPPRSSQAVEVGIETQVPQHKRASHSGPLAHRTAWAKSGKNQDDAPKISVGGDLSTISGLVAARSMLSDDRRERSGSSQTEASKLTNRFPGSFKDFSESSIKQDQRHHVQGQVGTSQKEEGRSSNKDLVLVGYGSEGHKIHYSGPLTSSNMDQVLKDHDRQIQEAVRRARLDKAKIRRLQAEGNQLQVSDQMYAEEES

SEQ ID NO: 156101 - protein, 54 aa, Glycine max
  Coding DNA Sequence Number=SeqID_39323
MSERQCIFVLFCNIKVWPIHVDLKFLEPVGRELKMLGKFMDDAVELMNKSFIER

SEQ ID NO: 156102 - protein, 277 aa, Glycine max
  Coding DNA Sequence Number=SeqID_39324
  Gene Ontology: Mol. function=carbonate dehydratase activity; Cellular component=extracellular region; Biological process=one-carbon compound metabolic process
  Homolog annotation: Hit_ID=Q6Z9S4; Match level="QueryCoverage=87%, HitCoverage=86%, E-value=1e-62, Identity=48%"; Hit description =Putative dioscorin class A
  Pfam annotation: Domain name=Carb_anhydrase; Domain location=31-268; Score=73.7; E_value=5.8e-19; Accession=PF00194.11; Description =Eukaryotic-type carbonic anhydrase
MQRQSHISVAISLICILFCSTLTSALDEPEYGYNEKSANGPQHWGDLKEEWAACKIGQIQSPIDLSTNGVEVIPKLGGLKYWNYKPQHATVSNRGHDVAVIWEGDAGSIEINGTPFFLQQAHWHWPAEHTINGRRYDLELHMVHVSPQPDGTNKTAVVGVLYKYGSPDPLLSKLGKYIMDTPEEDDEKSVGVVDPSEIMKGSKMYYRYMGSLTAPPCTEDIIWTVDKKVRTVSRGQVKLLKDTVLKYYAKWNARPLQPLNQRAIQLYVPKTKNKPVY

SEQ ID NO: 156103 - protein, 206 aa, Glycine max
  Coding DNA Sequence Number=SeqID_39325
  Gene Ontology: Mol. function=RNA-directed DNA polymerase activity; Cellular component=extracellular region; Biological process=RNA -dependent DNA replication
  Homolog annotation: Hit_ID=Q1S4Z4; Match level="QueryCoverage=93%, HitCoverage=28%, E-value=5e-34, Identity=38%"; Hit description=RNA -directed DNA polymerase
MDHLHANRILPKGCNSSFITFIPKRENPQSLGDFHPISLEGCMHKILDKIFTRRLKSVLPSVLDDRQIAFLGGRNILNGVLVTNEVIDEARRKKNKCILFKVDYEKACDLMSWNFLLYMLTGLGFGINGLSGLVSVSCQLIFQCLLKWDDESAVDKEFFAGYSIGTEEVKVDLLQYADDTTFIGEAMVENVVMIKSVLRRRRRRIV

SEQ ID NO: 156104 - protein, 127 aa, Glycine max
  Coding DNA Sequence Number=SeqID_39326
MARLQVQRRKMDGKRYGAVKEILIAVKRNRWGRQYGFLRFVDVKNPKRLDTREMGSSKHNRNSGMEDENQTKPKSGRKGKATRHKFAGINMRCIGDDMILISGIGEKDAREMIDKGRDNLLSVFQAS

SEQ ID NO: 156105 - protein, 75 aa, Glycine max
  Coding DNA Sequence Number=SeqID_39327
  Gene Ontology: Mol. function=triose-phosphate isomerase activity; Cellular component=chloroplast; Biological process=reductive pentose- phosphate cycle
  Homolog annotation: Hit_ID=Q9M4S8; Match level="QueryCoverage=90%, HitCoverage=23%, E-value=3e-10, Identity=51%"; Hit description =Triosephosphate isomerase, chloroplast precursor
  Subcellular localization annotation: CTP_CleavageSite=52; ConfidenceScore=5.46e-01
MAATSTSLASQLYIGLRRPCLKLDSFNSQSFSVFDPNLRLSLSPPRPSRAIVAMAGTGKFFVGGNWKCNLIVAHR

SEQ ID NO: 156106 - protein, 76 aa, Glycine max
  Coding DNA Sequence Number=SeqID_39328
MWKSGSYYVTGTSNIINILILIDVVLDPRCKVKYVNQFVNYLFNEDQRDELKLKLSSSFKSLYEQYQGVEEGSQIN

SEQ ID NO: 156107 - protein, 450 aa, Glycine max
  Coding DNA Sequence Number=SeqID_39329
  Gene Ontology: Mol. function=GTP binding; Cellular component =intracellular; Biological process=RNA-dependent DNA replication
  Homolog annotation: Hit_ID=Q94JX6; Match level="QueryCoverage=41%, HitCoverage=100%, E-value=1e-75, Identity=70%"; Hit description =Hypothetical protein unannotated coding sequence from BAC F20L16
  Pfam annotation: Domain name=PPR; Domain location=175-209; Score =33.0; E_value=1e-06; Accession=PF01535.11; Description=PPR repeat
  Pfam annotation: Domain name=PPR; Domain location=210-244; Score =36.0; E_value=1.3e-07; Accession=PF01535.11; Description=PPR repeat
  Pfam annotation: Domain name=PPR; Domain location=245-279; Score =10.5; E_value=0.42; Accession=PF01535.11; Description=PPR repeat
  Pfam annotation: Domain name=PPR; Domain location=280-313; Score=2.9; E_value=3.3; Accession=PF01535.11; Description=PPR repeat
  Pfam annotation: Domain name=PPR; Domain location=314-348; Score =18.8; E_value=0.02; Accession=PF01535.11; Description=PPR repeat
  Pfam annotation: Domain name=PPR; Domain location=349-383; Score =27.9; E_value=3.7e-05; Accession=PF01535.11; Description=PPR repeat
  Pfam annotation: Domain name=PPR; Domain location=384-418; Score =25.4; E_value=0.00021; Accession=PF01535.11; Description=PPR repeat
  Pfam module annotation: Pfam domain module=PPR::PPR::PPR::PPR::PPR::PP R::PPR; Domain location=175-209::210-244::245-279::280-313::314 -348::349-383::384-418
MLQTCSKLILRHSKPRLLLNLHSITKTLTTASSSRDEYFAVIHHVSNIVRRDFYLERTLNKLRITVTPELVFRVLRACSNNPTESLRFFNWARTHPSYSPTSLEFEQIVTTLARANTYQSMWALIRQVTLHHRLSLSPSAVASVIEAYGDNRHVDQSVQVFNKSPLLLNCPQTLPLYNALLRSLCHNKLFHGAYALVRRMLRKGLRPDKTTYAVLVNAWCSNGKLREAKLFLEEMSEKGFNPPVRGRDLLVEGLLNAGYVESAKGMVRNMIKQGSVPDVGTFNAVVETVSKEDVQFCVGLYHEVCALGMAPDVNTYKILVPAVSKSGMVDEAFRLLNNFIEDGHKPFPSLYAPVIKALCRRGQFDDAFCFFGDMKAKAHPPNRPLYTMLITMCGRAGKFVEAANYIFEMTEMGLVPISRCFDMVTDGLKNCGKHDLARRVQELEVSIRGV

SEQ ID NO: 156108 - protein, 91 aa, Glycine max
  Coding DNA Sequence Number=SeqID_39330
  Gene Ontology: Mol. function=metal ion binding; Biological process =metal ion transport
  Homolog annotation: Hit_ID=Q9C9A3; Match level="QueryCoverage=70%, HitCoverage=43%, E-value=6e-08, Identity=40%"; Hit description =Putative isoprenylated protein; 28702-28078
  Pfam annotation: Domain name=HMA; Domain location=5-64; Score=19.1; E_ value=0.013; Accession=PF00403.16; Description=Heavy-metal-associated domain
MEVVELKVEMVCIHEKRLRKCLSKLKGIEKVEVDTNCQKVVVTGYTHKNKILKAVRRGGLKADFWSAQNEFLNAYVSSNYANFRFNPFNFF

SEQ ID NO: 156109 - protein, 144 aa, Glycine max
  Coding DNA Sequence Number=SeqID_39331
  Pfam annotation: Domain name=UIM; Domain location=31-48; Score=16.7; E_value=0.086; Accession=PF02809.10; Description=Ubiquitin interaction motif
MVKARSKLALGRVPPRLKQNFGALVESDENKEEDEEVQRALAASMESMKESTVMTGRDNIDTDVAVYGQQTTLAKRPIYPALPEEPKVERNLLCRVGVRLPDGHRIQRNFLRTDPIQSVIDSAEFMNFLHHPAGNRVDGNRRDI

SEQ ID NO: 156110 - protein, 305 aa, Glycine max
  Coding DNA Sequence Number=SeqID_39332
MGKEILENVKDDGGLEELEMLLNEIPQATSHNLYHGKSHDVVVHHGDDDDHRHGSFVVSHGMCDDDHPFTQVQYPCVSSPVSGFSLQSDGSSSSLFSSSGHALSDTGSPTPPPLEDLKSTTMPSSGGSSSHPNNRFITPDSTLIRNANGGLVNELGGLCANFSQMYISNQQESPCDFKDASMAMHRPPFPECVSFTGNGPSNVHKHGDSYSFRRGSFDCVGVQSPLPWSPRNQDTDMNSALMANLFGSRQCAKRSEPMLSQLNDFSGSMESPCHHHSRQLMDNYYFGRSRNQPPECTASLSRNPM

SEQ ID NO: 156111 - protein, 199 aa, Glycine max
  Coding DNA Sequence Number=SeqID_39333
  Gene Ontology: Mol. function=RNA binding; Cellular component=cytosol; Biological process=loss of chromatin silencing during replicative cell aging
  Homolog annotation: Hit_ID=Q2QQH7; Match level="QueryCoverage=98%, HitCoverage=64%, E-value=2e-52, Identity=40%"; Hit description =Pumilio-family RNA binding repeat containing protein, expressed
  Pfam annotation: Domain name=PUF; Domain location=100-134; Score =26.5; E_value=9.4e-05; Accession=PF00806.9; Description=Pumilio -family RNA binding repeat
  Pfam annotation: Domain name=PUF; Domain location=138-171; Score =17.1; E_value=0.037; Accession=PF00806.9; Description=Pumilio-family RNA binding repeat
  Pfam annotation: Domain name=PUF; Domain location=28-62; Score=35.8; E_value=1.5e-07; Accession=PF00806.9; Description=Pumilio-family RNA binding repeat
  Pfam annotation: Domain name=PUF; Domain location=64-98; Score=17.9; E_value=0.029; Accession=PF00806.9; Description=Pumilio-family RNA binding repeat
  Pfam module annotation: Pfam domain module=PUF::PUF::PUF::PUF; Domain location=100-134::138-171::28-62::64-98
MMYKTNTTLTANAQFSRNIAGEGFIFVAAAKYCVDIATHQHGCCVLQRCIGHSSGEYREKLIAEICANALLLAQDQFGNYVVQFILDLKISSVTTCIRLQFEGNYVHLSRQKFGSHVVEKCLAAFNDENRSRVILELLSTPHFEHLLQDPHANYVVQSALRHSEGHLHNLLVEAIESHKAVSRNSPYSKKIFSQKLLKK

SEQ ID NO: 156112 - protein, 99 aa, Glycine max
  Coding DNA Sequence Number=SeqID_39334
  Homolog annotation: Hit_ID=Q53NL0; Match level="QueryCoverage=65%, HitCoverage=4%, E-value=8e-10, Identity=52%"; Hit description =Integrase core domain, putative
MDVKTTFLNGDLEEQVYMKQSKGFSSSSANDQVLLHKVKQFLSKNFDVKDMGDASYVIGIKIHRDCRSKLHDDESSSFDDDKKPKRMMSRLSQQVQDQD

SEQ ID NO: 156113 - protein, 187 aa, Glycine max
  Coding DNA Sequence Number=SeqID_39335
MTASYDYCRKISFRGYKCSNRIRLSLIEYDPKWINLSISTYRRRKIRMSNELSSSHNRKSTYALSFYRSSFHLTSPKAKLGKEEKEHDGGGNDGDNAAGERAVVKIFIDFWVSVQIAELVEDFIHHGRSPKPLGEYEAVNGVPSSTVAGEWRVGEGMGWLKNEERPKQTRDHMNDPFFKVKSVQHAV

SEQ ID NO: 156114 - protein, 73 aa, Glycine max
  Coding DNA Sequence Number=SeqID_39336
  Homolog annotation: Hit_ID=Q10M68; Match level="QueryCoverage=87%, HitCoverage=16%, E-value=8e-26, Identity=80%"; Hit description =Serologically defined breast cancer antigen NY-BR-84, putative, expressed
MDISGEQHLDIRHNIVKKRIDANGNVIEERKDGIGAPKIERPLQKHGGRLGHDEKYCGSCFGAEEVPLTIYYT

SEQ ID NO: 156115 - protein, 103 aa, Glycine max
  Coding DNA Sequence Number=SeqID_39337
  Gene Ontology: Mol. function=protein binding; Cellular component=ER -Golgi intermediate compartment; Biological process=ER to Golgi vesicle-mediated transport
  Homolog annotation: Hit_ID=Q10M68; Match level="QueryCoverage=87%, HitCoverage=23%, E-value=6e-32, Identity=67%"; Hit description =Serologically defined breast cancer antigen NY-BR-84, putative, expressed
  Pfam annotation: Domain name=DUF1692; Domain location=36-103; Score= -99.7; E_value=0.093; Accession=PF07970.2; Description=Protein of unknown function (DUF1692)
MSMLSLSLVLMQSDEHCCNSCEEVREAYRKKGWAMTNMDLIDQCQREGYVQRVKDEEGEGCNLQGSLEVNKVAGNFHFATGKSFLQSAIFLADLLALQDNHYN

SEQ ID NO: 156116 - protein, 66 aa, Glycine max
  Coding DNA Sequence Number=SeqID_39338
AWKLCAFVCESIRILIGIWNATGRLGKVGATKCGNKTAMKEGLGRGCEKEEGLGMMDEFGNYCKIS

SEQ ID NO: 156117 - protein, 146 aa, Glycine max
  Coding DNA Sequence Number=SeqID_39339
  Gene Ontology: Mol. function=protein binding; Cellular component =endoplasmic reticulum; Biological process=ER to Golgi vesicle -mediated transport
  Homolog annotation: Hit_ID=Q10M68; Match level="QueryCoverage=78%, HitCoverage=30%, E-value=4e-39, Identity=65%"; Hit description =Serologically defined breast cancer antigen NY-BR-84, putative, expressed
  Pfam annotation: Domain name=DUF1692; Domain location=5-142; Score =122.6; E_value=1.1e-33; Accession=PF07970.2; Description=Protein of unknown function (DUF1692)
MSGCQDEPLTQLLQMNVFFTFSQHIGLKQGVKWVQGPAHGMYQYFIKVVPTIYTDIRGRVIHSNQYSVTEHFKSSELGVAVPGVFFFYDISPIKVNFKEEHIPFLHFLTNICAIIGGVFTVAGIIDSSIYYGQRTIKRKMELGKFT

SEQ ID NO: 156118 - protein, 305 aa, Glycine max
  Coding DNA Sequence Number=SeqID_39340
GEVNEANKANEANEANEANEANEANEANEANEANEANEANEANEANEANEANEANEAVLSQSALKSIDKGKKRRYINAIDSVLIALLLIGCIIALVKQQQNLAINVQPADIEPLFRIKKCNIFTIEDYDIYPKEKTIKLALNEIEKKKINCNNISYDLYFAKMLLNKENSLFSFLAVRCQVDTVVTDMLNGRDMLSYEMRMNYIFNAQKESVVNMTGYVIHNNNRYRYLRTLHFMLDLSDSKDIYNIRYTLEQIHPSDNTPKDISYLLMSSQFDGSNSYIRINKIKGNTYLINGISQPIALCYRY

SEQ ID NO: 156119 - protein, 123 aa, Glycine max
  Coding DNA Sequence Number=SeqID_39341
MSSIQKWLQHRRNSNKIIQSLEAKSTALESKVLRTMIGARKKPNGTREKLHCIFKLRSLHRSHDAGIPSLSIDAFNETLGRAEHMSFDQRIAMMKKLSVAFCRVWSGVVSMKLKKMLEQLSLE

SEQ ID NO: 156120 - protein, 150 aa, Glycine max
  Coding DNA Sequence Number=SeqID_39342
  Gene Ontology: Mol. function=metal ion binding
MANITSAAIANPFTYPILPPPLVHSLALEMLLDMRSRQSMFNFELQFTLNQTSGRFSDFKKKSLDRKRLILNGAAHVFDMDISNQILLIAQKREAVGGMPLLTKMSLMSPFEMQGMLLPSGTSGVKDLYISPSHSSLALFASLGKKLSVL

SEQ ID NO: 156121 - protein, 155 aa, Glycine max
  Coding DNA Sequence Number=SeqID_39343
  Gene Ontology: Mol. function=protein serine/threonine kinase activity; Biological process=protein amino acid phosphorylation
  Homolog annotation: Hit_ID=Q9LDC1; Match level="QueryCoverage=48%, HitCoverage=11%, E-value=1e-16, Identity=56%"; Hit description=CRK1 protein
MGCMCCKPSAIEDSKESPRERLSSKAVSDLRVSRGASSRREEAFRVKDRYDNNDGRTALIDKQGNGSVRVQGESFERKREKMEYAVAQHPGIGSVPKAMEGEQVAAGWPSWLAAVAGEAIKGWLPRRADSFEKLDKILCFIYLACLLFLQLSVEY

SEQ ID NO: 156122 - protein, 208 aa, Glycine max
  Coding DNA Sequence Number=SeqID_39344
  Homolog annotation: Hit_ID=Q1RV57; Match level="QueryCoverage=98%, HitCoverage=42%, E-value=2e-41, Identity=39%"; Hit description =ENSANGP00000004406, related
MACTFSSPASGPFRDDAPSWCRSPFEPEGLLSSISAILSGTIGIHYGHILIHFKGHSERLKQWVLMGFVLLIIAIILHFTDALPINKQLYSFSYVCFTAGAAGIVFSGLYILIDVWGLRTPFLFLEWIGMNAMLVFVMAAEGIFAAFVNGWYCENPRNSLVHWIKKHVFVNVWHSERVGTILYVIFAEITFWSVVAGVLHKLGIYWKL

SEQ ID NO: 156123 - protein, 88 aa, Glycine max
  Coding DNA Sequence Number=SeqID_39345
MDRCPEANVVGLSLVISTVLPGDPFLHLKQNEQSVLSMEASRKWNIIWNRQRPFNVDGILQDVIFVAWVWQKFDGSASMDDMFTCNNT

SEQ ID NO: 156124 - protein, 100 aa, Glycine max
  Coding DNA Sequence Number=SeqID_39346
MVRYCDIARAPARARRRYFLAGTELSTSISCLIISFFRPASLARIWASAFSTKDSSCCRFGRISMASTAVQHHRRAAPRAELPVQRQQRSEAHCPQQQPG

SEQ ID NO: 156125 - protein, 106 aa, Glycine max
  Coding DNA Sequence Number=SeqID_39347
MIDSRLQDQASRIQSKIQDSREEIKKPQVKTSYGIRIQGTNRLRILCLNTLEHTYFVVQVEHTSTWVVILRTREDTSLVDQFKWSVHPLGCSKRTREGTSLLDLCL

SEQ ID NO: 156126 - protein, 174 aa, Glycine max
  Coding DNA Sequence Number=SeqID_39348
  Gene Ontology: Mol. function=mannonate dehydratase activity; Biological process=glucuronate catabolic process
  Homolog annotation: Hit_ID=Q8A7U2; Match level="QueryCoverage=100%, HitCoverage=44%, E-value=4e-33, Identity=40%"; Hit description =Mannonate dehydratase
  Pfam annotation: Domain name=UxuA; Domain location=1-173; Score= -162.2; E_value=1.9e-09; Accession=PF03786.4; Description=D-mannonate dehydratase (UxuA)
MEDGSKALYFDWIDLAYFDIHLLQREGAINDYSDPILKAVDKKKKSITAEERKVLSENILMGIPGEKNITLESLRKSIDVYKNIGTEGLRANLKHFLESIASVCRKEKIKMTIHPDDPPYPILGLPRILSHKEDFEYLLNTINDEFNGVCFCTGSLGAGIHNNIPEIFDLVKDR

SEQ ID NO: 156127 - protein, 153 aa, Glycine max
  Coding DNA Sequence Number=SeqID_39349
  Homolog annotation: Hit_ID=Q9FMI8; Match level="QueryCoverage=80%, HitCoverage=34%, E-value=8e-34, Identity=50%"; Hit description =Arabidopsis thaliana genomic DNA, chromosome 5, P1 clone:MHJ24
MPAWSKLHFCQFAAAWAGGASHCPCRNELDRDGEIVGEINDFANTFEIRDDTEGKGERIPLPWEILQPSLRILGHCLLGPLNSQDVKDAASFAVRCLYARASHDLVPQAILATRSLIQLDVRTREAAKTNAATNSNANTPTKAKKPEILLVSK

SEQ ID NO: 156128 - protein, 100 aa, Glycine max
  Coding DNA Sequence Number=SeqID_39350
MRHVKHEGHAQTVGSKHKEHLNSTGDLARTYKCKNDNFMQHTQGSSCRTEDAAEINRPREELHQSKKDMHVFLSVVLQLLPPEAHNIIHQQQQPHQQHQD

SEQ ID NO: 156129 - protein, 142 aa, Glycine max
  Coding DNA Sequence Number=SeqID_39351
  Gene Ontology: Mol. function=hydro-lyase activity; Cellular component= cytoplasm; Biological process=fatty acid biosynthetic process
  Homolog annotation: Hit_ID=Q2Q9T4; Match level="QueryCoverage=98%, HitCoverage=58%, E-value=3e-70, Identity=88%"; Hit description=Beta -hydroxyacyl-ACP dehydratase
  Pfam annotation: Domain name=FabA; Domain location=17-141; Score =173.8; E_value=4.3e-49; Accession=PF07977.3; Description=FabA-like domain
YPAFPTSLDINKIRDILPHRFPFLLVDRVIEHNPGVSAVAIKNVTINDNFFPGHFPERPIMPGVLMAIAQVGGLVMLQPEVGGSRENFFFAGIDKVRFRKPVIAGDTLVMRMTLIKLQKRYGIAKMEGKAYVGGEVVCDGEF

SEQ ID NO: 156130 - protein, 214 aa, Glycine max
  Coding DNA Sequence Number=SeqID_39352
MAPRNLPVKRSRKDTAREGSNAAPQADVDYDRHRRVQLRDEEYVEFQKEIARRHWAQLVSPMAKFDPEIVRDFYAIAWPTEEGVRDMRSWVRGQWIPFDGDAINQFLGHPLILEEGQQDFAWTATGRRVSVHVAQLISNAIYQFAGITPPRHPVDPKKSNRALGFPALIIGDVSSIGACRPRIFFINGFLCFLEDEWQWNGEGRERGDATSRRR

SEQ ID NO: 156131 - protein, 143 aa, Glycine max
  Coding DNA Sequence Number=SeqID_39353
MVNLGAFFSPWAHLGPLGNFKEVFPKIREKKDKVEEKSRPRRFRNVSVINFVTILHRSSIFDRGPSFLCMSSVEAKLHGESKVIQRTIQEFKIRIKKNSRLKKKVKSQESRFKVQDLNNQDQDSRLKIQESRVHDFSQKLSST

SEQ ID NO: 156132 - protein, 78 aa, Glycine max
  Coding DNA Sequence Number=SeqID_39354
MSFERDYCRLPLPSRDKQVQWHAGTNHGLPPFVIFKLIAVPFAIQRQASFADWASGQSGGEITRTKLVSLSLLPFYLQ

SEQ ID NO: 156133 - protein, 80 aa, Glycine max
  Coding DNA Sequence Number=SeqID_39355
  Subcellular localization annotation: CTP_CleavageSite=47; ConfidenceScore=5.26e-01
MALYFPTFFLHFPIFFNIPKDLHTPPFLFCNLCSSPQLASSSVYPLRAEEFVEEEVISTNTGVSVNLCSVPVKVGGVGLR

SEQ ID NO: 156134 - protein, 102 aa, Glycine max
  Coding DNA Sequence Number=SeqID_39356
MATMAEEEKDERIVDGDKQQLVTKLASEPEDNFCELEEIENEEDDQENENTISKNENEINDGKKKEKEKEEEKEKENHEKNEKKKDEKKKSKSKQSREKKKE

SEQ ID NO: 156135 - protein, 88 aa, Glycine max
  Coding DNA Sequence Number=SeqID_39357
MEAAKEGPHYSGADLERTRKARARGSEGPFFVAPQTSTTPAPIPSAPVPATSGPSVLPRAFTRWPDQESSLLLMEEVSDAILPPKGIG

SEQ ID NO: 156136 - protein, 63 aa, Glycine max
  Coding DNA Sequence Number=SeqID_39358
  Subcellular localization annotation: CTP_CleavageSite=46; ConfidenceScore=5.13e-01
GARSPRQGHIIIGIAPARHPVVPKKSNRFYGVPVTSSKGIRPPTNRAFIKKYCVSRQAQGETP

SEQ ID NO: 156137 - protein, 38 aa, Glycine max
  Coding DNA Sequence Number=SeqID_39359
MCGQSWRVNCNSVLIVSFGWARILDGSSVPQEIVKDQE

SEQ ID NO: 156138 - protein, 79 aa, Glycine max
  Coding DNA Sequence Number=SeqID_39360
MMKYYMIEEDRSGVKHSQWNIVEPLLCRMIKEAFQNSSTIGELNETLITVILENLRPINPCNVSSYKAITKQGVDGSSC

SEQ ID NO: 156139 - protein, 85 aa, Glycine max
  Coding DNA Sequence Number=SeqID_39361
MRDPMVRLPRKEKCAESPPTFIRGKHQKNQNGKGRRSAYFENEGSRVVYAWGRRESLRRWTLKRPLIFGRRESLRRWTFERSLEF

SEQ ID NO: 156140 - protein, 100 aa, Glycine max
  Coding DNA Sequence Number=SeqID_39362
MRGVTTNVYSRKTSEKPERCGLRTLSVKGSGVVFMHGEDRAAQCARQDKMSNEEVKLQDPRCRIQCPDILPENTGVAVQCKIKVKCRSEAAGSTMSDTMS

SEQ ID NO: 156141 - protein, 167 aa, Glycine max
  Coding DNA Sequence Number=SeqID_39363
TGPWRRPATTFHRRIDENIAPESGCKAVRYASVGSGGRHGRPGLGAEAQGGGHRCGGVRTWWGDGGQPGGLWNPDRWQWTTRVAALFAGRGARCVRTDRGPCGNRGVFPGPDGASADGFQMQRAGAGGAPFHRAPGLAAHPVYRPGCSWRSRYSEGPRSPITRGWGT

SEQ ID NO: 156142 - protein, 142 aa, Glycine max
  Coding DNA Sequence Number=SeqID_39364
  Subcellular localization annotation: CTP_CleavageSite=21; ConfidenceScore=5.22e-01
VLPSTSVAPTPSSTSAAPSVPAQSDSQHFEAMLQSIHQGQIILLQSLQVVAPLGSIPSVEQFLDRDASSEATILEPFMVEEEVGETQVGQEAAATPERSREITSDPPTPVDPTTPILNLNTFPPATPVLHLTDEEGGQTQDT

SEQ ID NO: 156143 - protein, 245 aa, Glycine max
  Coding DNA Sequence Number=SeqID_39365
YYQEKIDKLVSDKQLPKPPYNDNLYLTTPFSSPDPGMTYPLPLIGIKSSSPASADVQPGNQLASKLKYCNYDSKNGEVTDVRDGKKYAYKRYGNTDWFMENLNWNGYDGNNAATNNTVGVAVPGDSEGKVYGRYYPTNAFNASKSWCPNGWDVANTQDWKNLFTSIKQEYNTTDDQLAPMMKCGEDRDRVSDGLWAKGPMTIQNANANTVGFNALPAGVYNNDQQSYDGGDQMGMKASFIDESST

SEQ ID NO: 156144 - protein, 507 aa, Glycine max
  Coding DNA Sequence Number=SeqID_39366
  Gene Ontology: Mol. function=calcium ion binding; Cellular component =extracellular region; Biological process=pathogenesis
  Homolog annotation: Hit_ID=Q8XQP2; Match level="QueryCoverage=94%, HitCoverage=88%, E-value=1e-105, Identity=40%"; Hit description =Probable hemagglutinin/hemolysin-related protein
MLLGLGLLSAIGAAAGIIYHNHKKDHGKSGEGEGGNLPDPVFTRGATIDAVTDNVGAIQGPLASGDYTDDATPTLSGTGTNPGNTVEIWDNGTKIGEAIVDQDGNWTFTPGTALAEGDHSFTVIERDGKGNTSQPSEPFELIIDLKAPAQATLDSVFDDHGSLTGLIGNGEATDDNTPTLSGKAEPYSTVSIYDNGEKIGEALTDANGNWTFTPATALADGEHAFTVVAADRAGNIGLPSAPHIITIDTQAPVNPGIGEVTDNVGSIVGPVDNGGSTDDRTPTIGGGGTPGDVVTIIDDGKPIGSTVVGDDGKWEFTPEQPLEDGEHNIGIIITDPVGNESAPSDDYTIIVDTQAPDKPRIVAVIDNQGEQQGELQPGDTTDDALPTIKGEAEAGSIVNLYDNGVLIGSARADAAGNWEFTPNKPFSNGGHSLTAEATDAAGNVSETSDSFDFTLITGGVPSAPAIIGVLDDVGDIQGNVAKNGVTDDTRPTVHGTAQPGYTVSVYD

SEQ ID NO: 156145 - protein, 143 aa, Glycine max
  Coding DNA Sequence Number=SeqID_39367
MSGCWSGSGIKGNVPHYFHDTNATMMIRKFYAKLVMHAPMWTLKCRNFFGRADEGAHYLLTSNHKVNEKHTKMRCSGRQRRRGERRRHPLGNKPWKKELHHQDEPWIRSLERRLQWRKRKRERKREGGARNLRKKKGEKLNFE

SEQ ID NO: 156146 - protein, 64 aa, Glycine max
  Coding DNA Sequence Number=SeqID_39368
  Homolog annotation: Hit_ID=Q1SSA9; Match level="QueryCoverage=85%, HitCoverage=9%, E-value=3e-17, Identity=73%"; Hit description=Amidase
HEFRLKHDDWMNTVKPNLHPGVSAQLHEKFEVFDVEIENSKSVRSEMRAVINSLLKAHAQEISE

SEQ ID NO: 156147 - protein, 383 aa, Glycine max
  Coding DNA Sequence Number=SeqID_39369
  Gene Ontology: Mol. function=nucleic acid binding
  Homolog annotation: Hit_ID=UPI0000E4A6CC; Match level="QueryCoverage =66%, HitCoverage=22%, E-value=6e-10, Identity=25%"; Hit description =PREDICTED: similar to WD repeat domain 60
MVGGGCWRQKRHSRIVARQVMEDDTAVERVYSSRHGHSSSPNPVRENSARVSHHSRKYDDREHDQQYGRNHYGRSSDSLRHSDRQSFKSSFGHSRYDKYANEDRYRERLLSRSGHESRDDHVREESDSRPKNYQCSVDKYSHDKYDRSDHRSKEKRRDTYSEHQKYKDMDSSYEKSASSKRHALYDEVEREGHSRDWDGQNERRDSRRSSGDYRSDQRDESGPQRDSGKFSLKEAYKSEQKESNDQNLPWEEKRKHDDTEIRKGKDWKTRKAGEQCAIEDKESSGKKLKLFDPDKDDNYRKDGIAYIFFVLMVDMICTIIGDYCITSFSCTEADESKTSSSNLSHKSKEDLWAVKSSGFDGDNDLDAAKIAAMRAAELGIHLS

SEQ ID NO: 156148 - protein, 71 aa, Glycine max
  Coding DNA Sequence Number=SeqID_39370
VQEVTVRLPGPEGTAPDAGTAAREQHAPEIARRKGGACGRVRRPTAARVPGVDRAFRGDPNPGLAGENRRS

SEQ ID NO: 156149 - protein, 77 aa, Glycine max
  Coding DNA Sequence Number=SeqID_39371
  Subcellular localization annotation: CTP_CleavageSite=52; ConfidenceScore=5.31e-01
MGDANSFWAISCLRLKQPSSPGPSRIAISKFWIGPSRMFFWSWVAPGSNPARLGEQGGNLLPLFPINRLKGAVLRIP

SEQ ID NO: 156150 - protein, 60 aa, Glycine max
  Coding DNA Sequence Number=SeqID_39372
MQAQRPAKNKRQHLKQAQRRTTKLPEQVGRASDVGTAARLGRAFQGGSNPRFAGENDGQK

SEQ ID NO: 156151 - protein, 71 aa, Glycine max
  Coding DNA Sequence Number=SeqID_39373
MTLSSVSNSNATFPVGSHFYWPRSAFYAAYLCSSCRDARKKMAVVVGGDGSDDDDDDDDGDGVIELANERM

SEQ ID NO: 156152 - protein, 214 aa, Glycine max
  Coding DNA Sequence Number=SeqID_39374
  Gene Ontology: Mol. function=nucleic acid binding; Cellular component= endoplasmic reticulum membrane; Biological process=DNA integration
  Homolog annotation: Hit_ID=Q1SPP8; Match level="QueryCoverage=98%, HitCoverage=13%, E-value=3e-64, Identity=62%"; Hit description =Integrase, catalytic region; Zinc finger, CCHC-type; Peptidase aspartic, catalytic
MRLYQIDVKSAFLNGAIQEVVHVEQPHGFEGNTFPHHVFKLNKALYGLKQALRAWYECISSFLLSNGFERGKRDTTLFYKNYDSQFILVQIYVDDIIFGATNELCEDFSKLMQAEFKISMMGELKFFLGLHIKQTNNAIYIHQTMYVKELLKKFKLEDAREMKTHMHPTACLGLDEESNKVDNSQYTAMRNPDLTYCSVLDYLPDSNKTQGKFT

SEQ ID NO: 156153 - protein, 182 aa, Glycine max
  Coding DNA Sequence Number=SeqID_39375
MASNRLFIRDHFKLAVNPSSCSIREWCGAPHYEATWLVCLTVHLVMFERAQGSRHTKSLTKERNTDDYEGISQSLPMRETNNGDGGNISAMVEAFFSSDMDQFRKYNSKLCCWFCPRLIQLIMVLFNLYHGWWVVEAMRRKFFDMYNVRRGPGCIVLMTCYLIIQIYMYNVIRTVELVKPTN

SEQ ID NO: 156154 - protein, 116 aa, Glycine max
  Coding DNA Sequence Number=SeqID_39376
  Subcellular localization annotation: CTP_CleavageSite=30; ConfidenceScore=5.04e-01
MVVGTQSSNGAGTNGGQNAEQQWCRNSGRRAARAFAQQWSPKSFKTKEVLIGLYAKEDPERRSIGIQSVFDSGELRGEFEKNGIDPKFIQITWKDLVSADSKQQKEDEDWEKCELD

SEQ ID NO: 156155 - protein, 312 aa, Glycine max
  Coding DNA Sequence Number=SeqID_39377
MATSTYLELDEKDKSVDESRYQANPKKTHLTTVKRIIKYLKGTTNVGLWYPKDHISKGDCCIEFIDSEHQLADIFTKPLARDRFFFIRNELGFDFPNLLEAQGLSKLVHMKGTFYPKLVKIIYTCARVDLEVRKFDETNDGYNKMKTYRGMLLDPARNLRNHSGVDGLTVEDRMLVYLITYILTPRFIDYFNVDVSNEIVDFTKASSEIIKRHLKKLGISFVDHEWIMARVPTIGNLEQMDEDAEAEGPQELAHQWSPFESLMIQKMDAMLHLHQEHLTEVHSSLENITTQLENIETRLTLSNLLNPDEDEA

SEQ ID NO: 156156 - protein, 129 aa, Glycine max
  Coding DNA Sequence Number=SeqID_39378
MDTKTTTKTRKCDCPFRLRGRPLKNSEGWVVRVLCGSYNHDVTETLVEHPYVGRLTTNEKTMFVDMTKSKVKTKGSQKDHFIHMKGTSSPTTSVQEKDFHVRPIPFEALLGMGEDSWPLVCNDLHKELG

SEQ ID NO: 156157 - protein, 204 aa, Glycine max
  Coding DNA Sequence Number=SeqID_39379
  Gene Ontology: Mol. function=nucleic acid binding
  Homolog annotation: Hit_ID=Q1RXW3; Match level="QueryCoverage=52%, HitCoverage=25%, E-value=4e-11, Identity=30%"; Hit description=Zinc finger, CCHC-type
  Pfam annotation: Domain name=zf-CCHC; Domain location=138-155; Score =22.9; E_value=0.00016; Accession=PF00098.13; Description=Zinc knuckle
MDKSLKVGEDEWREKEIRSTKFYASNELKKYTHKASIYSLNVKQWVTISKLQTRFTHIVNHLLGLGKMFEDDELNIKILNCLTRTWEPKITAIKKSNDLASMSMEALFGKLLAYEHESKDRKFSKHSKKIESNNNNTFTCFECGKQGHIKSECLIYLRKQLAEKKGKKDKKQKAREDNASTPSNSSSEEEVANVCLMADSMVKF

SEQ ID NO: 156158 - protein, 83 aa, Glycine max
  Coding DNA Sequence Number=SeqID_39380
MAPSTTIEGAKRDENYSLPRGLKSVNFREHRAEQGAKFSSFREISEFLSDCESPRGGGDIATPLDFSIGKCTVSLELDRAGTK

SEQ ID NO: 156159 - protein, 143 aa, Glycine max
  Coding DNA Sequence Number=SeqID_39381
  Gene Ontology: Mol. function=protein serine/threonine kinase activity; Cellular component=integral to membrane; Biological process=protein amino acid phosphorylation
  Homolog annotation: Hit_ID=Q93W70; Match level="QueryCoverage=99%, HitCoverage=27%, E-value=1e-41, Identity=57%"; Hit description=SERK1 protein precursor
MDYKNTHVTAAVRGTLGHIAPEYLATGKSSEKTVVFGYGVMLLELITGQRAFNLTRLAINDEVMFLEWVGENTSERQEVEDTGSSPLERPTMSEVVRMLEGDGLAEKWDQWGKKEDMIQQNFSPFNLYTPCDSTSNIQLSGPR

SEQ ID NO: 156160 - protein, 630 aa, Glycine max
  Coding DNA Sequence Number=SeqID_39382
  Gene Ontology: Mol. function=protein serine/threonine kinase activity; Cellular component=integral to membrane; Biological process=protein amino acid phosphorylation
  Homolog annotation: Hit_ID=Q94F62; Match level="QueryCoverage=97%, HitCoverage=98%, E-value=0.0, Identity=70%"; Hit description =BRASSINOSTEROID INSENSITIVE 1-associated receptor kinase 1 precursor
  Pfam annotation: Domain name=LRRNT_2; Domain location=31-71; Score =56.2; E_value=1.1e-13; Accession=PF08263.3; Description=Leucine rich repeat N-terminal domain
  Pfam annotation: Domain name=LRR_1; Domain location=180-204; Score =16.7; E_value=0.085; Accession=PF00560.23; Description=Leucine Rich Repeat
  Pfam annotation: Domain name=LRR_1; Domain location=75-97; Score=5.5; E_value=27; Accession=PF00560.23; Description=Leucine Rich Repeat
  Pfam annotation: Domain name=Pkinase; Domain location=304-578; Score =148.4; E_value=1.9e-41; Accession=PF00069.15; Description=Protein kinase domain
  Pfam annotation: Domain name=Pkinase_Tyr; Domain location=304-578; Score=132.3; E_value=1.3e-36; Accession=PF07714.7; Description =Protein tyrosine kinase
  Pfam module annotation: Pfam domain module=LRRNT_2::LRR_1::LRR _1::Pkinase::Pkinase_Tyr; Domain location=31-71::180-204::75-97::304 -578::304-578
MANMERVISDFMSWFPLWAILVLDLLLKVSGNTEGDALTALKNSVSDPNNVLQSWDSTLVDPCTWFHVTCNNENSVTRVDLGNANLSGQLVPQLGQLPNLQYFCAISWKATHRSIAVLSRTKVELIAATEVQEIHMFDNPAYCLELFIICKLNGSSPRTRRLNNNSLSGKIPVRLTTVDSLQVLDLSNNNLTGDIPINGSFSSFTPISFRNNPSLNNTLVPPPAVTPPQSSSGNGNRAIVIIAGGVAVGAALLFAAPVIVLVYWKRRKPRDFFFDVAAEEDPEVHLGQLKRFSLRELQVATDTFNNKNILGKGGFGKVYKGRLTNGDLVAVKRLKEERTQGGEMQFQTEVEMISMAVHRNLLRLRGFCMTPTERLLVYPFMSNGSVASCLRDRPESQPPLEWPKRKNIALGAARGLAYLHDHCDPKIIHRDVKAANILLDDDFEAVVGDFGLAKLMDYKDTHVTTAVRGTIGHIAPEYLSTGKSSEKTDVFGYGVMLLELITGQRAFDLARLANDDDVMLLDWVKALLKDKRLETLVDTDLEGKYEEAEVEELIQVALLCTQSSPMERPKMSEVVRMLDGEGLAEKWDKWWQKEDMIQPNFDPSNLHNGYWRPLLDSTSNIAPDELSGPR

SEQ ID NO: 156161 - protein, 323 aa, Glycine max
  Coding DNA Sequence Number=SeqID_39383
  Gene Ontology: Mol. function=protein binding; Cellular component =nuclear pore; Biological process=DNA integration
  Homolog annotation: Hit_ID=Q1S326; Match level="QueryCoverage=94%, HitCoverage=95%, E-value=3e-52, Identity=38%"; Hit description =Putative receptor kinase-related
MADHNWQWEMLEEMTALDASNTWEFVLLPPNKSIIGCHWVDTVKITPDGLIDRYKGRLVAKSYTQIFGLDYGDTFSIVAKITSIHLLLWPPFDIGLFTSWTSKMPSYMQSPRAWFGRFNSTLIEFGMTRCETDHLVFSLHSLSGLRIYLVVYVDDIVINSDDSDGILRLNQFLKEPCGCRWNVVICILRYLKSAPSCRLIYEDKGNAKIACYSDADWAGSPLDRRSTSGYCVLIGGNLISWKNKKQKAVARSSVEAEYRAMAVAAFFHERTKHIEIDCHFVREKVLLEKSSPTLSALVTNLQTCSLNPSKSGGSLPATQQGAC

SEQ ID NO: 156162 - protein, 216 aa, Glycine max
  Coding DNA Sequence Number=SeqID_39384
MVEEVGNDVGGLVGSVAGGVCVHRWYTRGRGGVGATNGARTTDGTSRGTSSTVEGKKGVVSKNSEIMHKTHTSKDTKRNRMEALMRIQDGIKNLIVENQRRHADLTLEKLGTNRCNLSRLGSPRHRCVRAGDADETQAIGGKDQEYGMGLSDAPDFNLKAIYESNRRQGVQKSQGREKRLVTSHMIKGVRIKNPRSKGAGLRNKGYRITRLSHSGN

SEQ ID NO: 156163 - protein, 160 aa, Glycine max
  Coding DNA Sequence Number=SeqID_39385
  Homolog annotation: Hit_ID=Q1SSZ2; Match level="QueryCoverage=99%, HitCoverage=45%, E-value=2e-36, Identity=45%"; Hit description=C2 calcium/lipid-binding region, CaLB
MSNILACYQLLELNVISAQDLAQMDRSMQTYAVAWIDPDHKLSTRVDSQDIHVDTVHMLSGDLFPPSTQPQKKYIQIHGYAVYGAPSPKRPSSCPKGILNIGAAIIDSSMKSKPLGYNHDNLIKPSHPVMLELHHTKSDYSSMLSSEAIARKHQAKAKKG

SEQ ID NO: 156164 - protein, 293 aa, Glycine max
  Coding DNA Sequence Number=SeqID_39386
  Gene Ontology: Mol. function=calpain activity; Cellular component =intracellular; Biological process=proteolysis
  Homolog annotation: Hit_ID=Q1T2S5; Match level="QueryCoverage=94%, HitCoverage=75%, E-value=1e-34, Identity=36%"; Hit description =Cyclin-like F-box; F-box protein interaction domain; Galactose oxidase, central
MKITLPDDQIVEILLRLPVRTLLRFKCVRKSWLFLISDPQFTKSHFDLAAAPTHRFLLTTFSAQVNSVDTEAPLHDDTVNVIFNIPPPSGFHEFQPWGFVLVGSCRGFLLLKYTFLRRLPTFAIWNPSTGLFKRIKDLPTYPHLCGIGYDSSTDDYVIVNVTIWNYNTMIQCFSWRTNTWSTSSWSSYESTVPYPCYHEIRHGLFINGALHWLVRSCYYNKPRVIIAYDTMKRILSEIPLPDDAAETTFYSLGVMRGCLCIYSKSRWPTMLEIEVPEFYKVPEVPSSFPATNP

SEQ ID NO: 156165 - protein, 93 aa, Glycine max
  Coding DNA Sequence Number=SeqID_39387
MRSDCLVEFSILNLFGAPRIAFLFMCPPPSSLELFVSPINCVFVHVSSTFEFGAMRSDCIVQFSILNLFGARRIAFSFLCPPPSSLELCVVIA

SEQ ID NO: 156166 - protein, 418 aa, Glycine max
  Coding DNA Sequence Number=SeqID_39388
  Gene Ontology: Mol. function=protein serine/threonine kinase activity; Cellular component=integral to membrane; Biological process=protein amino acid phosphorylation
  Homolog annotation: Hit_ID=Q94F62; Match level="QueryCoverage=88%, HitCoverage=61%, E-value=1e-150, Identity=70%"; Hit description =BRASSINOSTEROID INSENSITIVE 1-associated receptor kinase 1 precursor
  Pfam annotation: Domain name=Pkinase; Domain location=99-373; Score =147.1; E_value=4.6e-41; Accession=PF00069.15; Description=Protein kinase domain
  Pfam annotation: Domain name=Pkinase_Tyr; Domain location=99-373; Score=123.5; E_value=6.1e-34; Accession=PF07714.7; Description =Protein tyrosine kinase
  Pfam module annotation: Pfam domain module=Pkinase::Pkinase_Tyr; Domain location=99-373::99-373
MREKTRVGRGIYSRKKKSGTGEELVGLGNGITAIGVIAGGVAVGAALLFASPVIAIVYWNRRKPPDDYFDVAAEEDPEVSFGQLKKFSLPELRIATDNFSNNNILGKGGYGKVYIGRLTNGGNVAVKRLNPERIRGEDKQFKREVEMISMAVHRNLLRLIGFCMTSSERLLVYPLMVNGSLESCLREPSESKPPLEWPMRKRIALGAARGLAYLHDHCDPKIIHRDVKAANILLDDEFEAVVGDFGLARIMDYQNTHVTTAVCGTHGHIAPEYLTTGRSSEKTDVFGYGMMLLEIITGQRAFDLARFARDEDIMLLEWVKVLVKDKKLETLVDANLRGNCDIEEVEELIRVALICTQRSPYERPKMSEVVRMLEGEGLAEKWDEWLNMQEDIQNFTFNLCTPYDSNPNIQPDVLSGPR

SEQ ID NO: 156167 - protein, 105 aa, Glycine max
  Coding DNA Sequence Number=SeqID_39389
  Gene Ontology: Mol. function=RNA-directed DNA polymerase activity; Cellular component=chromatin; Biological process=chromatin assembly or disassembly
MKPKSKPCYNRELLDPARALFPPLFCLLRNAMVHGMQRMLVLEVRLVAREHLSHLEQAFQILLAGKFFLKLSKCTFAQKQVEYLGHLVSQSGVQPVSTKVEAVQQ

SEQ ID NO: 156168 - protein, 143 aa, Glycine max
  Coding DNA Sequence Number=SeqID_39390
  Gene Ontology: Mol. function=nucleic acid binding; Biological process= DNA integration
  Homolog annotation: Hit_ID=Q1S0A6; Match level="QueryCoverage=61%, HitCoverage=6%, E-value=3e-27, Identity=67%"; Hit description=Zinc finger, CCHC-type; Peptidase aspartic, catalytic; Polynucleotidyl transferase, Ribonuclease H fold
MVVAYYEKLKTLWDELANYDQILACRCGGNNWDIASKLQKRKEEERVHQFLMGLDDATYGTVRSNLLATGSLPTLNRVYSTMIQERDMKQETVFNSLVILTGGGTNQKIVDEASQCNECELDEEKEEQCVQMLCTVVEQVQTT

SEQ ID NO: 156169 - protein, 313 aa, Glycine max
  Coding DNA Sequence Number=SeqID_39391
  Gene Ontology: Mol. function=protein serine/threonine kinase activity; Cellular component=integral to membrane; Biological process=protein amino acid phosphorylation
  Homolog annotation: Hit_ID=Q0R4K1; Match level="QueryCoverage=31%, HitCoverage=43%, E-value=9e-27, Identity=64%"; Hit description =Leucine rich repeat protein 1
  Pfam annotation: Domain name=LRRNT_2; Domain location=32-72; Score =50.6; E_value=5.3e-12; Accession=PF08263.3; Description=Leucine rich repeat N-terminal domain
  Pfam annotation: Domain name=LRR_1; Domain location=213-235; Score =17.1; E_value=0.065; Accession=PF00560.23; Description=Leucine Rich Repeat
  Pfam annotation: Domain name=LRR_1; Domain location=237-259; Score =15.3; E_value=0.22; Accession=PF00560.23; Description=Leucine Rich Repeat
  Pfam annotation: Domain name=LRR_1; Domain location=261-282; Score =14.8; E_value=0.32; Accession=PF00560.23; Description=Leucine Rich Repeat
  Pfam module annotation: Pfam domain module=LRRNT_2::LRR_1::LRR_1::LRR_ 1; Domain location=32-72::213-235::237-259::261-282
MTNMQRVVSSFMSLFLILWMFVVLDLVIKVSGNAEGDALMALKNNMIDPSDALRSWDATLVHPCTWLHVFCNSENSVTRVNKSSIKKLKTQPSAAKKILGMEIHMDCQAGRIMVVIFIKDLFLAISFTLCNCAISWKATHKSVAVLSITKVEPIAATEGVKEVKFEFKRVIFGNPADMLSYFQMLSFKITWSWELYSNNITGEIPVELGSLTNLVSLDLYLNKITGPIPDGLANLKKLKSLRLNNNSLSGNIPVGLTTINSLQVLDLANNNLTGNVPVYGSFSIFTPISFKNNPFLYQTTPVTPAATPQQNPS

SEQ ID NO: 156170 - protein, 104 aa, Glycine max
  Coding DNA Sequence Number=SeqID_39392
WYIYLGLTENKRGYISCGSVLVEGTSTRFKENKGGYIPCGSLLVKGFFTRLKEISRTAGRLGTGGRHRKCFPTANDPHINITAEISSFQQLIAAVLKIEKQFAL

SEQ ID NO: 156171 - protein, 108 aa, Glycine max
  Coding DNA Sequence Number=SeqID_39393
MDKEQGSKNEKSYSKKSKGRKRVKRGEEDDYRKPIVRYFKLSREIEMACFIGTSYLPPFKDPEVFDYLYFEEEEDLAIGLATTLVEHRDKAPITDFFFMISRRLKQTD

SEQ ID NO: 156172 - protein, 308 aa, Glycine max
  Coding DNA Sequence Number=SeqID_39394
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2MCJ6; Match level="QueryCoverage=93%, HitCoverage=42%, E-value=1e-116, Identity=72%"; Hit description =Xylan 1,4-beta-xylosidase
  Pfam annotation: Domain name=Glyco_hydro_3_C; Domain location=124 -306; Score=126.8; E_value=6e-35; Accession=PF01915.12; Description =Glycosyl hydrolase family 3 C terminal domain
MLINSLISKNHRDRYMVSDCDSVEVLYKYQHYTKTPEEAAAISILAGLDLNCGRFLGQYTEGAVKQGLIDESINNAVSNNFATLMRLGFFDGDPRKQPYGNLGPKDVCTPANQELAREAARQGIVSLKNSPASLPLNAKAIKSLAVIGPNANATRVMIGNYEGIPCKYISPLQGLTAFVPTSYAAGCLDVRCPNPVLDDAKKISASGDATVIVVGASLAIEAESLDRVNILLPGQQQLLVTEVANASKGPVILVIMSGGGMDVSFAKDNNKITSILWVGYPGEAGGAAIADVIFGFHNPVSHLKTLFG

SEQ ID NO: 156173 - protein, 259 aa, Glycine max
  Coding DNA Sequence Number=SeqID_39395
  Gene Ontology: Mol. function=DNA binding; Cellular component=nucleus; Biological process=regulation of transcription, DNA-dependent
  Homolog annotation: Hit_ID=Q6QAD8; Match level="QueryCoverage=95%, HitCoverage=94%, E-value=1e-67, Identity=53%"; Hit description=MYB transcription factor
  Pfam annotation: Domain name=Myb_DNA-binding; Domain location=17-64; Score=48.2; E_value=2.8e-11; Accession=PF00249.21; Description=Myb -like DNA-binding domain
  Pfam annotation: Domain name=Myb_DNA-binding; Domain location=70-115; Score=50.9; E_value=4.2e-12; Accession=PF00249.21; Description=Myb -like DNA-binding domain
  Pfam module annotation: Pfam domain module=Myb_DNA-binding::Myb_DNA -binding; Domain location=17-64::70-115
MAGHVGRGVLEEEVWRKGPWTAEEDRLLVEYVRLHCEGRWNSVARLAGLKRNGKSCRLRWVNYLRPDLKRGQITPQEESIILELHARWGNRWSTIARSLPGRTDNEIKNYWRTHFKKKAKSPSDAAEKARNRLMRKQQFHQQQQQQQQLQQQHRAQQQQMQFNFDMKGIMAMLEDDIHRTPYKSQSRQEMINMHQNTTEEQGYLYSMLNDNSSASSAPETSAEEVLWDGLWNIDDVHGNFSVASAASRFGLYNLVAPFC

SEQ ID NO: 156174 - protein, 65 aa, Glycine max
  Coding DNA Sequence Number=SeqID_39396
MITSFSSEGNDEEDHHEHWNGSMSRSQSKHPNQQASPLPTKLPAGAHLPSCARPGMMPIADCMNK

SEQ ID NO: 156175 - protein, 130 aa, Glycine max
  Coding DNA Sequence Number=SeqID_39397
MGKKTKEPIGSKEELDPCPSIPVKLEEFKEWCIPWMNLLIVKVMGKKVNYQMMMNRLNRDWARKGSIGIIDMPNEYYLKWRPFFSVEAKEARKLLLGFVFQDSLLSCIRKTSFGEHKQTQCTPNMGVQKA

SEQ ID NO: 156176 - protein, 73 aa, Glycine max
  Coding DNA Sequence Number=SeqID_39398
  Gene Ontology: Mol. function=hydrolase activity, acting on carbon -nitrogen (but not peptide) bonds; Biological process=nitrogen compound metabolic process
  Homolog annotation: Hit_ID=Q8VYF5-2; Match level="QueryCoverage=55%, HitCoverage=13%, E-value=2e-13, Identity=82%"; Hit description =Isoform 2 of Q8VYF5
MVETTKFSANWEWPSGLKQTNKFNEERNSTVKDQWFPEAARAMVLQDDEILFYPTAIGSEPHDGSIDSRDHWK

SEQ ID NO: 156177 - protein, 56 aa, Glycine max
  Coding DNA Sequence Number=SeqID_39399
METVPMCVTFNYWHMRQPLSGSHVSGVLDLDTEVGPPASLIFICRIADTHVSVTVS

SEQ ID NO: 156178 - protein, 131 aa, Glycine max
  Coding DNA Sequence Number=SeqID_39400
  Subcellular localization annotation: CTP_CleavageSite=73; ConfidenceScore=5.24e-01
MTKVSFVASGQNKRHMLAGHAYFWSKRIHREIPFLPLVQRFVRSKRRVVLTFRTLSTVGVVCLSWISGNRSCRGALVSTTSNKYFGGVICCGNGGFTTVVMTIDIRVATTRENYNGARFGMMAQASASASA

SEQ ID NO: 156179 - protein, 210 aa, Glycine max
  Coding DNA Sequence Number=SeqID_39401
MERSNSKKKSLKSRLSNENVPPLQIDSEERRGRYLQPTAMSPRFQPYAENIDAGSPLTRHLFAGSPLSGKVAGDGEAFISPKFGARTAKALQYCGTSSGGSSSFCSRGWLTSSPLSSLENMEIAPLRSPPVYRTPSTGDDDVIVMDAILVRPVSGGTSGRSSSSSSRGSSSSSTAKSVFKTEICKAREESGNSRYNSKSQVRAITILLRI

SEQ ID NO: 156180 - protein, 639 aa, Glycine max
  Coding DNA Sequence Number=SeqID_39402
  Gene Ontology: Mol. function=protein serine/threonine kinase activity; Cellular component=membrane; Biological process=regulation of transcription, DNA-dependent
  Homolog annotation: Hit_ID=Q69JW8; Match level="QueryCoverage=98%, HitCoverage=96%, E-value=1e-179, Identity=51%"; Hit description =Loricrin-like protein
MDLNMKSLLSPHDTELRKDDNFGDTKLCLNGIGFGETNKTSYTCTRSNLGMKFSNASDDGCRLVLGLGPTPMAYVDDYNNLGFNMKKNSANLFTQHVPSECESILQLGLSGVTNEASSVLDCSGSTETDVNMSCFSSQTSSENYYSRIPVVDEGSTSAKKSGGYIPSLLLAPRMDNTESSVQTQELIVGSKPQLCPEPSNAVNYSLGTVSGPQDTGITPENRTCNPKRCRFFGCTKGARGASGLCIGHGGGQRCQKPGCNKGAESRTAYCKAHGGGKRCQHLGCTKSAEGKTDYCIAHGGGRRCGYPDGCTKAARGKSGLCIRHGGGKRCRIEGCTRSAEGQAGLCISHGGGRRCQYQECSKGAQGSTMYCKAHGGGKRCSFAGCTKGAEGSTPLCKAHGGGKRCLFNGGSICPKSVHGGTNFCVAHGGGKRCAVAGCTKSARGRTDCCVRHGGGKRCKFEGCGKSAQGSTDFCKAHGGGKRCSWGDGKCEKFARGKSGLCAAHSSLVQEREMNKGSLIAPGLFRGLVPSASTACSSFENNSSSGVSVLSDSYDSVETPAKRQHLIPKEVLVPLSMKSPSYSNFLAAKKPDQDRNCQSSAAGCSSAQKGLDFNLPEGRVHGGDLMLYFGGNLKNALGSI

SEQ ID NO: 156181 - protein, 476 aa, Glycine max
  Coding DNA Sequence Number=SeqID_39403
  Gene Ontology: Mol. function=oxidoreductase activity; Biological process=electron transport
  Homolog annotation: Hit_ID=Q9SF45; Match level="QueryCoverage=85%, HitCoverage=86%, E-value=1e-148, Identity=64%"; Hit description =Putative oxidoreductase
  Pfam annotation: Domain name=Amino_oxidase; Domain location=58-468; Score=159.7; E_value=7.4e-45; Accession=PF01593.14; Description =Flavin containing amine oxidoreductase
  Subcellular localization annotation: CTP_CleavageSite=78; ConfidenceScore=5.88e-01
MTTITLSLPCTNPYFLSSSPKRFRFNTQSAQLSPSSSSPLQSPPLPKTTGVIVIGAGLAGLAAATHLNSQNIPFLLLEASDAVGGRVRTDIVDGFLLDRGFQIFITAYPEAQKLLNYQSLNLQKFYSGARIFYDGQFHTVADPLRHFWDSARSLTNPIGSPLDKLLIGSTRIRALVKSDEEILTAEEVPTIELLKKLGFSDSIIRRFFRPFFGGIFFDPDLETTSRLFNFIFKCLALGDNTLPARGISAIPEQLAARLPSGSILLNSKAVSVDLDNSDSPLVRLQNGDVLKSELGVIVAVEEPAAVHLLSGRTGPVPKKPVRSTVCLYFTANRDQIPVPDPVLFLNGSGKGIVNNMFFVTNVAPSFGPPDKGLVSVSLIGLFEGVSDEELVGKVVNELSGWFGEKMVSKWNHLRTYRIGFAQPNQCPPTDLKKDPRVESGLYVCGDHLTSATFDGALVSGRRAAESLLKDRALTAA

SEQ ID NO: 156182 - protein, 710 aa, Glycine max
  Coding DNA Sequence Number=SeqID_39404
  Gene Ontology: Mol. function=GTPase activity; Biological process =catabolic process
  Homolog annotation: Hit_ID=Q84N64; Match level="QueryCoverage=85%, HitCoverage=63%, E-value=1e-139, Identity=72%"; Hit description =Dynamin-like protein
MAAFLVILRSSHQCLLEELGVEVVIAIAPMMSSNREIEDVASLEEKLGRALSKQERSRIGVSKLRLFLEELLQKRYISNVPLIIPLLEKEYWTVTRKLSDINQELSTLDEAKLKEKGRAFHDMFLTKLSLLLKGTVVAPPDKFGETLQDERINGGAFIGADGVQFPHKLIPNLVKQTYDDTGLKPTVTKVYVGRVKRSNAPRRENGSTNCLVGSRWEGVCGGKGGRGEGRLEFGIGTLARLSLLNFLRIVFLLAATETLLYTVYTHIQNAGMRLYGGAQYHRAMGEFRFVVGGIKCPPITREEIVNACGVEDIHDGTNYSRTACVIAVAKARDTFEPFLHQLGSRLLYILKRLLPISVFLLQKDCEYLSGHEVFLRRAASAFNNFAESTEKSCREKCMEDLVSTTRYVSWPLHNKSRAGLRLFLDSFGGTEHSNACNNPTSTVLSQTSAHEKEDTKSQPDVKLCHVASGTDSSSSIQTTETKLADLLDSTLWNRRLAPSSERIVYGLVQQIFHGIREYFLVSTELKVSDVSFLFIYAFLWLFNCFLLMPIVDKLPALLREDLESAFQDDLDNVFDITNMQHSFGQQKRETEIELKRDECKALCTKFWVLGNNGKHKGSAKGCNNGFVFARFEWQRRWIECMAKDFCGIFYQGKYAVWPHIRSSIYFLACLLKPMLHKIDIRGYKAQERVKNNHKDAKCMHCYVCEVGFGC

SEQ ID NO: 156183 - protein, 292 aa, Glycine max
  Coding DNA Sequence Number=SeqID_39405
  Gene Ontology: Mol. function=binding; Cellular component=integral to membrane; Biological process=transport
  Pfam annotation: Domain name=Mito_carr; Domain location=83-238; Score= 45.8; E_value=1.4e-10; Accession=PF00153.17; Description =Mitochondrial carrier protein
MEMNELSQKQTLVVHGIAGAGSVALATAFTYPLDTMKVLIQVGSSTGKELDHTHVLTRLLSVSGNAGFLVWEHDLGFMKSCLPFIKALLAGVVAGAIEAVISSPFELIKLRMQVSSASYVPSSNFALEKGARTPLIARLLHGCYPDRRALDQYIGLISTLKAKNTNLTSALLEYPWTMTGSGSPPSVSNVRRPSDIISLEGWSTLWRGLRSGIVRDSVFGGVFFSTWQFLHQAMLDWKAAGMNPPPRLNEEVGPLSPLTVSLTAGFSASVAAAASHSFDTTRSRSQCTVLPK

SEQ ID NO: 156184 - protein, 129 aa, Glycine max
  Coding DNA Sequence Number=SeqID_39406
MARPARSIVLPLLVGILVVILLLESRYVKAMGEVAAMDDSAALMNTSSSGANWDAHSKHRRNMGVNGRVFCCYDNHIGSCNPGSEKDDHYCNYICKKHHCYKGVSKAKEKGKKKLSLISQTVTLVDLDI

SEQ ID NO: 156185 - protein, 585 aa, Glycine max
  Coding DNA Sequence Number=SeqID_39407
  Gene Ontology: Mol. function=phospholipid binding; Cellular component= coated pit; Biological process=endocytosis
  Homolog annotation: Hit_ID=Q8GX47; Match level="QueryCoverage=99%, HitCoverage=99%, E-value=1e-156, Identity=51%"; Hit description =Putative clathrin assembly protein At4g02650
  Pfam annotation: Domain name=ANTH; Domain location=30-327; Score =355.5; E_value=8.6e-104; Accession=PF07651.6; Description=ANTH domain
  Pfam annotation: Domain name=ENTH; Domain location=30-151; Score= -7.6; E_value=0.00013; Accession=PF01417.11; Description=ENTH domain
  Pfam module annotation: Pfam domain module=ANTH::ENTH; Domain location=30-327::30-151
MSPSTLRRAIGAVKDQTSIGLAMVGNSTSLADLDVAIVKATRHDEYPAEEKHLKEILSLTCYSRAFISACVNTLSRRLSKTSSWTVALKTLILIQRLLSDGDPAYEQEIFFSTRRGTRLLNMSDFRGNSKYNSWDFCAFVRTYALYLDERLEYMMQNKRGKRSRFAIDEEEEETMERESRYSREREKNREILKVTPLCEMKTEELFSKMQHLQLLVERFLACRPTGRAKTHRIVIVALYPIVKESFQIYDNITEILCIFIDRFIGMELPDCIKVYDIFCRVGKQYDELDLFYSWSKSVGIARSTEYPEIERVTTKKLEVMDQYIRDKAQHKKLYIQEENNEEEEPEEDMNAIKALPAPEYFNEEPEEVKEETKEEDIKEEKLVQTEGDLLNLGDDMVTSQEHGDSLALALFDGALPTSATQALPWHAFDDAADWETALVQSSSNLSNQKPSLGGGFDTLLLDGMYRQAATNMQRQSHGMNGSASSVALGSAGRPAMLALPAPPTSGSGSSLDSADPFAASLAVAPPAYVQMSEIEKKQRLLMEEQEMWQQYARSGMQGNVAFTKLQPNNTYHMGQYPQNYGHYYH

SEQ ID NO: 156186 - protein, 58 aa, Glycine max
  Coding DNA Sequence Number=SeqID_39408
  Homolog annotation: Hit_ID=Q6Q2Z9; Match level="QueryCoverage=56%, HitCoverage=3%, E-value=2e-10, Identity=97%"; Hit description =Phosphoenolpyruvate carboxylase
FSFSSTFLQQLCGSGVLADGRLADLIRRVATFGMVLMKLDLRQLWPETSSVTGIRQTC

SEQ ID NO: 156187 - protein, 300 aa, Glycine max
  Coding DNA Sequence Number=SeqID_39409
  Homolog annotation: Hit_ID=Q01FF9; Match level="QueryCoverage=12%, HitCoverage=13%, E-value=8e-09, Identity=84%"; Hit description=[B] KOG3467 Histone H4
MGVYEGILRLRVDQVLTMNGCERIDERPQGMFYRGPMTLHVNIGRRAFDKIGDLQNKGLQCGARLLRARRPCSYSRTDKEGGHVSECHVGCHVDFIGPGRYNHHQPESRPASNLSEAWLIPTSVYGSLSAQPSTTTHICTYPQIPSLLFHHLPSSYEDPAQSQGIDFASTQNRLLGLCDTMETLDPPSPSSHPKLETNIHVEVADSSGEAHVDEGDDSLRGVLLPEPHSSITIAPTTTTTKTIESSDLPLESINNIHSGNRLPPSVLGVSNSIANNVPEKVTTSRITFPRKFLRTLRVFS

SEQ ID NO: 156188 - protein, 589 aa, Glycine max
  Coding DNA Sequence Number=SeqID_39410
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=76%, HitCoverage=43%, E-value=0.0, Identity=85%"; Hit description =Phosphoenolpyruvate carboxylase
  Pfam annotation: Domain name=Chromo; Domain location=51-101; Score =21.7; E_value=0.0027; Accession=PF00385.14; Description='chromo' (CHRromatin Organisation MOdifier
  Pfam annotation: Domain name=PEPcase; Domain location=1-589; Score =18.4; E_value=0.026; Accession=PF00311.8; Description=Phosphoenolpyru vate carboxylase
  Pfam module annotation: Pfam domain module=Chromo::PEPcase; Domain location=51-101::1-589
MYWPSCLSSRITGILTNSSVFHVSLLKLHQGPLASQPAHLPPTNVDHHPVVEPLSVLDWKWDNSVSPPTKLVLVQWSGLAPEDTTWESYDALHESYNLVDKVILPGEGDVSNTNPPHTSRPKRCTRRPTYLDDYNYSRGNQVAPDVREVLDTFRTAAELGSDSFGAYVISMASNASDVLAVELLQKDARLAVSGELGRACPGGTLRVVPLFETVKDLRGAGSVIRKLLSIDWYRQHIIKNHNGHQEVMVGYSDSGKDAGRFTAAWELYKAQEDVVAACNEYDIKVTLFHGRGGSIGRGGGPTYMAIQSQPPGSVMGTLRSTEQGEMVQAKFGLPQTAVRQLEIYTTAVLLATLRPPQPPREEKWRNLMEDISKISCQCYRNVVYENPEFLSYFQEATPQSELGFLNIGSRPTRRKSSTGIGHLRAIPWVFAWTQTRFVLPAWLGVGAGLKDACEKGQTEELKAMYREWPFFQSTIDLIEMVLGKADIPIAKHYDEVLVSQKRQELGKQLRNELISTGKFVLAVSGQEKPQQNNRSLRKLIESRLPFLNPMNMLQVEILKRLRCDDDNLKARDALLITINGIAAGMRNTG

SEQ ID NO: 156189 - protein, 116 aa, Glycine max
  Coding DNA Sequence Number=SeqID_39411
MPTTNLQGKETTQGGEEAQERKKLEHTTKKMKRHREETAYGMQEQCTGLSTVVITAAHSFFIFVFFVIIDRAAVGVDHPSQVDGGVAASARRHCRGKHPCAEFADIVCSRGSFGSS

SEQ ID NO: 156190 - protein, 260 aa, Glycine max
  Coding DNA Sequence Number=SeqID_39412
  Homolog annotation: Hit_ID=Q1SL15; Match level="QueryCoverage=98%, HitCoverage=40%, E-value=3e-19, Identity=37%"; Hit description =Ovarian tumour, otubain
MNNMITLQDTEIKASFETSTYVVGHVFKVTLYKRLLGMVSMYALNQIAVEYERVHYTGKNPSHCGCVMRTTHGLPCALILKNKLREIVYPDQNSMCPPPEKAIPRRTMLMLDQFHPFIHDLIDNIVDVKADSNCGYRAIAALLGMGEDSWSLVCNHLLKELGKWLDEYINFFGGIDRFEELRRSLLVDGLSMVTMDKWMDITEIGYVIASRYDVILVSLFLQQSMAFFPLRSQPPIDSFMHRIICIGHVYGNHFVQVNSR

SEQ ID NO: 156191 - protein, 199 aa, Glycine max
  Coding DNA Sequence Number=SeqID_39413
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=6e-19, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHALAFRGLHVLAFRGLHALGLQRTTRPHLQRATCPQLHRATRPYFQRARRPPLQRTTRPRHQRATHPHLYRTTHPRLQRSTCPRLQRTARPHLQRTIHLEDYTSSLTEDYTSSPLEGYTPSPSEDNTATHPYLQRATRPPLQRTTRPCHQRAARPHLQRATRPHLQRATWTHLPRNTRPCLQRATHPHL

SEQ ID NO: 156192 - protein, 128 aa, Glycine max
  Coding DNA Sequence Number=SeqID_39414
MKAMPSKPTRKGRKWYLNPTYQGNPCGVYPDLSSFTGSGVYQDLSSFTGSGVYPNLSSFIGSGVYPNLSSFTGSGVIQNLRSLYQTIRYKSGSHQSRSPVVFRGNSTAVVMKPIEHFLIDIIRKLLRD

SEQ ID NO: 156193 - protein, 192 aa, Glycine max
  Coding DNA Sequence Number=SeqID_39415
  Homolog annotation: Hit_ID=P07931; Match level="QueryCoverage=25%, HitCoverage=11%, E-value=6e-20, Identity=97%"; Hit description =Capsid protein
MSNIQTGAERMPHDLSHLGFLAGQIGRLITISTTPVIAGDSFEMDAVGALRLSPLRRGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKWRGPRQS

SEQ ID NO: 156194 - protein, 337 aa, Glycine max
  Coding DNA Sequence Number=SeqID_39416
  Gene Ontology: Mol. function=methyltransferase activity; Cellular component=chromatin silencing complex; Biological process=methylation
  Homolog annotation: Hit_ID=Q9LIN4; Match level="QueryCoverage=92%, HitCoverage=61%, E-value=1e-125, Identity=70%"; Hit description =Arabidopsis thaliana genomic DNA, chromosome 3, BAC clone:F20C19
  Pfam annotation: Domain name=UPF0020; Domain location=213-337; Score=- 44.8; E_value=0.0025; Accession=PF01170.9; Description=Putative RNA methylase family UPF0020
MWYLCVFFHRLLDYRKPEVESLAQLFGATEDPKNGDVPSQMQWKLPIHYHPDSPFHFVNLPSEKLARDIATRSILVKGMYELWGEGSSYEELKESVLSYPDERKLPYLDSDSTFKITVDSFGKVISLEDQKELIQGLSYIPFKVGYVVQQNLVSVCWGRVKLKNPDHNFWLIEVDNYGGNNGLPPIVQKRVFFGREVGGADRKLLPTYQLKSRTYLGPTAMDAEIAFLMANQALATSGKLVYDPFVGTGSILVAAAHFGAITMGADIDIRVVRDGRGPNCNVWSNFKQYGLPMPVGLLRADNNLPPWRSTLKEESIQLASRLNNFSNISNFTGVFAI

SEQ ID NO: 156195 - protein, 175 aa, Glycine max
  Coding DNA Sequence Number=SeqID_39417
  Gene Ontology: Mol. function=magnesium ion binding; Cellular component=chloroplast; Biological process=metabolic process
  Homolog annotation: Hit_ID=Q6Q3H3; Match level="QueryCoverage=94%, HitCoverage=30%, E-value=4e-35, Identity=46%"; Hit description =Terpene synthase
  Pfam annotation: Domain name=Terpene_synth_C; Domain location=1-116; Score=-45.7; E_value=0.0077; Accession=PF03936.6; Description =Terpene synthase family, metal binding domain
MAEAKWCHEGYIPTYDEYKVNGILTSCFPLFITSFIGLGEFANKDVFDWIFSDPNIIKVVSIIGRVLDDMGSHKFEQQRVHVASAVECCMKQYNISQAEAYHLIHNDVEDGWKVINEECLKSNDIPKSVLDCVVNLARMSMVSYENHQDKFTNGELLKGYVSSLLMDPMCLELHQ

SEQ ID NO: 156196 - protein, 352 aa, Glycine max
  Coding DNA Sequence Number=SeqID_39418
  Gene Ontology: Mol. function=magnesium ion binding; Cellular component=chloroplast; Biological process=metabolic process
  Homolog annotation: Hit_ID=Q5UB05; Match level="QueryCoverage=94%, HitCoverage=56%, E-value=6e-83, Identity=45%"; Hit description=Wound- inducible putative cytosolic terpene synthase 2
  Pfam annotation: Domain name=Terpene_synth; Domain location=31-250; Score=194.7; E_value=2.3e-55; Accession=PF01397.11; Description =Terpene synthase, N-terminal domain
  Pfam annotation: Domain name=Terpene_synth_C; Domain location=255 -352; Score=-16.0; E_value=0.00014; Accession=PF03936.6; Description =Terpene synthase family, metal binding domain
  Pfam module annotation: Pfam domain module=Terpene_synth::Terpene _synth_C; Domain location=31-250::255-352
MSLPASTLASIQHAVSDQLKRPCVSFAPCIWGDTFLEYASQFEEREDKRMRKRQCALSNVEGVNDDEKQQAQTLRNEVQTMFQSSIDQNIIQKLNLIDSVQRFGVSYHFQQEINQALEQIHNSFTKNNTISDDGNHHSLALLFRLLRQQGYQISSSAFNKFKNDQGNFSETLANDIQGLCSLYEAAHLRTPEDDILEEACDFSNTHMKSLANQLSPSLAAQINHCLRLPLNKSLIRFEARCHMNLYEKDASHNKTLLTFAKVDFNILQKLHQKEISTITKWWKKSNFETKVPYARGRLVEAYLWSLAMSYKPEHSLARMFVGKLIAVVCLLDDTYDAYGTIQELELFTEAIQ

SEQ ID NO: 156197 - protein, 87 aa, Glycine max
  Coding DNA Sequence Number=SeqID_39419
MNIFHNKITQNQNQAISTALPYDFRKEIDKAGGTDNNVDGNGKYALRSYGAYFKRSRPHVRELPQNIPRFFYSHLYAGQATTYLARE

SEQ ID NO: 156198 - protein, 191 aa, Glycine max
  Coding DNA Sequence Number=SeqID_39420
VVLSNLQAPLADLNRDCFLDHYPPSLIFGVGGMSFGWVESQFWWGLVMLGNGVGGFGRLGDATILGGGGGATTLGLMETQAGVVVMVDIEEEGIVVMCSAECKLQRARGIGEKKIMCSGCGNLKSDTSEPNLEVEENANLGPNSGFTIPLSMAGIVFDESNLPPHKSNNVKKAMDRSCSTHQDLPNNVPQS

SEQ ID NO: 156199 - protein, 223 aa, Glycine max
  Coding DNA Sequence Number=SeqID_39421
  Gene Ontology: Mol. function=transition metal ion binding; Cellular component=integral to membrane; Biological process=nitrogen fixation
  Homolog annotation: Hit_ID=P16313; Match level="QueryCoverage=79%, HitCoverage=87%, E-value=2e-61, Identity=71%"; Hit description =Nodulin 21
  Pfam annotation: Domain name=DUF125; Domain location=43-214; Score =203.9; E_value=3.7e-58; Accession=PF01988.9; Description=Integral membrane protein DUF125
MATSTLSHAEEVLPNPAKNTDQKQIQVTEDHTNNIDYVQRAQWLRAAVLGANDGLVSVSSLMMGVGAVKKDERAMLLAGFAGLVAGTCGMAIGEFVAVCTQYEVEVGQMKREMNNEEKDLEMGMEKRGLPNPLQATLASAVSFSIGALVPLLSAAFIENYRTRVIVVVAMVSLALVVFGRVVAQLGKTHKMKSCVRFLLGGWIAMAITFGLTKLLGAKALDKE

SEQ ID NO: 156200 - protein, 204 aa, Glycine max
  Coding DNA Sequence Number=SeqID_39422
  Gene Ontology: Biological process=nitrogen fixation
  Homolog annotation: Hit_ID=Q9M2C0; Match level="QueryCoverage=85%, HitCoverage=93%, E-value=4e-41, Identity=48%"; Hit description =Nodulin-like protein
  Pfam annotation: Domain name=DUF125; Domain location=44-198; Score =119.2; E_value=1.2e-32; Accession=PF01988.9; Description=Integral membrane protein DUF125
MANLGARTNGISSTNQVEIPMHVYGVEPTQSEESHIDYSQRAQWLRAAVLGANDGLVSVSSLMMGVGAVKKDISAMILAGFAGLYDIEKTQLKREREANNNRGVNEEARRGKLPNPFQAALASAFAFSVGALVPMLAAVFIRSHKVRMGVVAAAVSVASLMFGGAGAVLGKTPVTRSCIRVLVGGWMAMAITFGLTKLIGSSDL

SEQ ID NO: 156201 - protein, 229 aa, Glycine max
  Coding DNA Sequence Number=SeqID_39423
  Gene Ontology: Biological process=nitrogen fixation
  Homolog annotation: Hit_ID=Q9LSF6; Match level="QueryCoverage=82%, HitCoverage=88%, E-value=7e-48, Identity=53%"; Hit description =Nodulin-lile protein
  Pfam annotation: Domain name=DUF125; Domain location=51-223; Score =211.7; E_value=1.7e-60; Accession=PF01988.9; Description=Integral membrane protein DUF125
MANLGARTNGISTNHVEIPIHISNGIELKPIYQEVALEESSSIDFSQRAQWLRAAVLGANDGLVSVASLMMGVGAVKKDISAMILAGFAGLVAGACSMAIGEFVSVYTQYDIEKTQLKREREADNNRGVNEEARREKLPNPFHAALASALAFSVGALVPMLAAVFIRSHKVRMGVVAAAVSLALLVFGGAGAVLGKTPVTRSCIRVLVGGWMAMAITFGLTKLIGSADL

SEQ ID NO: 156202 - protein, 172 aa, Glycine max
  Coding DNA Sequence Number=SeqID_39424
  Gene Ontology: Biological process=nitrogen fixation
  Homolog annotation: Hit_ID=Q9M2C0; Match level="QueryCoverage=70%, HitCoverage=73%, E-value=3e-21, Identity=41%"; Hit description =Nodulin-like protein
  Pfam annotation: Domain name=DUF125; Domain location=46-157; Score= -1.9; E_value=0.00046; Accession=PF01988.9; Description=Integral membrane protein DUF125
MAFLGTSSNEMPIGHIEILIHSNDIEAKRSQDIAENNIDYSQRAQWLREAVFGAKNGLVLINLLMVGVEALNEDIIIMLLAGFAGLVVGACSMAIEEFVYTQLVRHGASAIGFSIGAVVSMLAAVFVWDYKIRLLVFAVPILALLVFGGVGIVLGKSKTPVRRTYDRDSADW

SEQ ID NO: 156203 - protein, 86 aa, Glycine max
  Coding DNA Sequence Number=SeqID_39425
MKRTFHADQENNLTRKNISRNGVMTTIKELEKLRGFLPLLMVMEVCLWGFYGGWIFELQWGPLIVIFHHGDAAEDKGKEVRGGAIH

SEQ ID NO: 156204 - protein, 127 aa, Glycine max
  Coding DNA Sequence Number=SeqID_39426
  Homolog annotation: Hit_ID=Q8VYN6; Match level="QueryCoverage=34%, HitCoverage=8%, E-value=2e-09, Identity=59%"; Hit description =Putative pyrophosphate-fructose-6-phosphate 1-phosphotransferase
  Subcellular localization annotation: CTP_CleavageSite=36; ConfidenceScore=5.69e-01
MSHMITLHGLTASSTRCSYAFNDSNSRFKALAVPTRVASVFAKVKSKSSTSSESNNSAIDFSDPDWKTKFKDDFEDRFRLPHVTDIFPDAVSMPSTFSPNMRLRNTTQSIWTNNFKTIIIWTGDPDV

SEQ ID NO: 156205 - protein, 76 aa, Glycine max
  Coding DNA Sequence Number=SeqID_39427
  Homolog annotation: Hit_ID=Q9FLK2; Match level="QueryCoverage=46%, HitCoverage=56%, E-value=3e-08, Identity=72%"; Hit description =Probable cytochrome c oxidase polypeptide Vc-3
  Pfam annotation: Domain name=COX5C; Domain location=2-44; Score=34.9; E_value=2.8e-07; Accession=PF05799.2; Description=Cytochrome c oxidase subunit Vc (COX5C)
MDGPRIAHATLKGPSVVKDIIIGITLGLAASGVWKISTSVVLITDVECYIGYYNGRCRMMTFYIGFQDNRYRNLAF

SEQ ID NO: 156206 - protein, 119 aa, Glycine max
  Coding DNA Sequence Number=SeqID_39428
TAGAFRALSAPCRFRPRFDPFVDCPRERRAASSAVSFASPAGGGNGDAGTDDGCGSGSESGDANLKLVGDVGQELFRLSPDVIILDVSESGLRHALDGPDSMGFDSLISIENERSLMER

SEQ ID NO: 156207 - protein, 347 aa, Glycine max
  Coding DNA Sequence Number=SeqID_39429
  Gene Ontology: Mol. function=cyclin-dependent protein kinase regulator activity; Cellular component=nucleus; Biological process =regulation of progression through cell cycle
  Homolog annotation: Hit_ID=Q9ZRX9; Match level="QueryCoverage=86%, HitCoverage=84%, E-value=2e-82, Identity=57%"; Hit description =Cyclin D2.1 protein
  Pfam annotation: Domain name=Cyclin_C; Domain location=202-328; Score= 7.9; E_value=0.0093; Accession=PF02984.9; Description=Cyclin, C -terminal domain
  Pfam annotation: Domain name=Cyclin_N; Domain location=68-200; Score =152.7; E_value=9.9e-43; Accession=PF00134.13; Description=Cyclin, N -terminal domain
  Pfam module annotation: Pfam domain module=Cyclin_C::Cyclin_N; Domain location=202-328::68-200
MAHNSDSATSNLLLCSENSSTCFDDDLECCDAADGSNSRISHQFWDHHEGGGGGGSELLACFVAQSEETVRAMVEREREHLPRDDYLMRLRSGELDLGVRREAIDWICKAHSYFGFGPLSFCLAVNYLDRFLSVFDLPRGVTWTVQLLAVACLSIAAKMEEIKVPQSVDLQVGEPKFVFEARTIQKMELLVLSTLGWKMCAITPCSFIDYFLGKITCEQHPAKSSVSISVQLILGIIMGIDYLEFRPSEIAAAVAVSVLKELQAIEIDKAIIDLLVVEKWRVLKCVELIRDLSLINVAASLGSKSDYRNSYKYLGHAIGGENFDETMLRWHKHRMSQYECNIWRGEP

SEQ ID NO: 156208 - protein, 77 aa, Glycine max
  Coding DNA Sequence Number=SeqID_39430
MKYTWKGVQELKPAMLMVLAQVAAASVNVLYKLSLTDGMSFRKEQAKVNMEGALDVIILRHIWVWLNSSVFNPLPWP

SEQ ID NO: 156209 - protein, 73 aa, Glycine max
  Coding DNA Sequence Number=SeqID_39431
MPTQRILILRHYKEDLTRRKSGHFASSIGTSECKSFHVDGSYEMEGWSRTMKLKSFDYVQQLISIGAAHQAWS

SEQ ID NO: 156210 - protein, 103 aa, Glycine max
  Coding DNA Sequence Number=SeqID_39432
  Gene Ontology: Mol. function=DNA binding; Cellular component=plasma membrane; Biological process=cell-cell signaling
  Homolog annotation: Hit_ID=Q1T3L8; Match level="QueryCoverage=54%, HitCoverage=42%, E-value=5e-13, Identity=64%"; Hit description =Remorin, C-terminal region
  Pfam annotation: Domain name=Remorin_C; Domain location=2-81; Score= -6.3; E_value=0.0044; Accession=PF03763.4; Description=Remorin, C -terminal region
MALLEHVPLSVILHIICAANKLCKEQIERKKTEYGERIKNKISSVHKEAEEKRAMVQAKNDEEVLKQEEMARKHCATANRNHSKEDTSVFCFLGPNAEVIVNI

SEQ ID NO: 156211 - protein, 63 aa, Glycine max
  Coding DNA Sequence Number=SeqID_39433
MEHRERHCSKTSLHNLFPLLKGYKVPASWPKSREKVVNGQQREERPKRKTKAPTYVEDYVGIG

SEQ ID NO: 156212 - protein, 397 aa, Glycine max
  Coding DNA Sequence Number=SeqID_39434
  Gene Ontology: Mol. function=DNA binding; Cellular component=nucleus; Biological process=regulation of transcription, DNA-dependent
  Homolog annotation: Hit_ID=Q4VPE6; Match level="QueryCoverage=86%, HitCoverage=96%, E-value=1e-166, Identity=85%"; Hit description =Phantastica transcription factor a
  Pfam annotation: Domain name=Myb_DNA-binding; Domain location=4-53; Score=44.9; E_value=2.8e-10; Accession=PF00249.21; Description=Myb -like DNA-binding domain
  Pfam annotation: Domain name=Myb_DNA-binding; Domain location=59-104; Score=39.8; E_value=9.3e-09; Accession=PF00249.21; Description=Myb -like DNA-binding domain
  Pfam module annotation: Pfam domain module=Myb_DNA-binding::Myb_DNA -binding; Domain location=4-53::59-104
MKDRQRWRAEEDALLRAYVKQYGPREWNLVSQRMNTPLNRDAKSCLERWKNYLKPGIKKGSLTEEEQRLVINLQATHGNKWKKIAAQVPGRTAKRLGKWWEVFKEKQQRETKGNSCTIDPISDSKYEHILESFAEKLVKERPSPSFVMATSNSSFLHADAPAPPPALLPSWLSNSNGTAPVRPPSPSVTLSLSPSTVAAPPPWLQPPVRGPDNAAPLVLGNVAPHGAVLAFGENMVMSELVECCKELDEVHHALAGHKKEAAWRLSRVELQLESEKAGRRREKMEEIEAKIKALREEQTAALDRIEAEYREQLAGLRRDAESKEQKLAEQWAAKHLRLTKFLEQVEKESVGEKLGDSTKHEESVGYNFGDNDTKRMGYGKEKWHKRIVRVFYKKKSP

SEQ ID NO: 156213 - protein, 118 aa, Glycine max
  Coding DNA Sequence Number=SeqID_39435
  Gene Ontology: Mol. function=transferase activity; Biological process= electron transport
  Homolog annotation: Hit_ID=Q1SQB1; Match level="QueryCoverage=60%, HitCoverage=18%, E-value=1e-10, Identity=45%"; Hit description =Polynucleotidyl transferase, Ribonuclease H fold
MDSANSCYQAIDAAGMLLCNEALLLGWLAAKEFKHKSYQQQMKASQIKWTKPHQGFLKCNVDASFDNSGNYTSYGLGIRDDIGGFMMEKTEWSVSCIPVLEEKALGLLKALKWGWSWI

SEQ ID NO: 156214 - protein, 162 aa, Glycine max
  Coding DNA Sequence Number=SeqID_39436
  Pfam annotation: Domain name=LRR_1; Domain location=124-145; Score =8.1; E_value=8.8; Accession=PF00560.23; Description=Leucine Rich Repeat
  Pfam annotation: Domain name=LRR_1; Domain location=35-56; Score=2.4; E_value=1e+02; Accession=PF00560.23; Description=Leucine Rich Repeat
  Pfam annotation: Domain name=LRR_1; Domain location=98-122; Score =13.6; E_value=0.71; Accession=PF00560.23; Description=Leucine Rich Repeat
  Pfam module annotation: Pfam domain module=LRR_1::LRR_1::LRR_1; Domain location=124-145::35-56::98-122
MGLGFRASLRSSMTHLSKNNYLTEEVPPSLMSLPSLKNVSLDYNKLDGLVPSIGKGDDPCQDQGQYYRSFIVCSKRKVITVNLANQNLTRIISLAFANLRNLYLNDNNLVGPILGSSSLTNLSHLWVLDVSNNNISSDVPKFSSKVKFTTSSNVLLGCSKWW

SEQ ID NO: 156215 - protein, 50 aa, Glycine max
  Coding DNA Sequence Number=SeqID_39437
KRPFGAREARPGELVSYSLRYQLAQASWLHKDEGIPWLRQARCWPGQAQA

SEQ ID NO: 156216 - protein, 149 aa, Glycine max
  Coding DNA Sequence Number=SeqID_39438
  Pfam annotation: Domain name=GRP; Domain location=1-72; Score=-23.7; E_value=0.02; Accession=PF07172.2; Description=Glycine rich protein family
MSSKYIFMCLLVILGMVLFATTSLADHHLLSTAESPMSEVVHRYSYDHDYNPNHYYDHYHNHNHHHHHHHNHHHDFDDHDHNCGDDNQDHNDNHGYDHQIQNPHDGKHWPSTTQNEPSKVENKKPQEEHSVSFDQFGFVEGIKMRMLHA

SEQ ID NO: 156217 - protein, 337 aa, Glycine max
  Coding DNA Sequence Number=SeqID_39439
  Gene Ontology: Mol. function=RNA-directed DNA polymerase activity; Cellular component=chromatin; Biological process=RNA-dependent DNA replication
MAFRTQYGHYEYVVMPFGITNVPAIFMDYMNRIVYSFLDNFVVVFIDNILIYSCSHKEHKEHLRIMLGILKEKQLYAKLIKCEFWLDDIQFLSHVILVGGIVVDLSKVEIVLQWELPKTTTEIRIFVGLVGYYQRRLLGEFPRVEAKVDHFSSYASHQLKVHEKNCPTHDLELATMVFALKIWRHYLYGAKFDVFSDHKSLKYMFDQKEFLKDYDFKLMYHLGKANVVADALSKKMMQMLALMINELELLEKFNDLNLCVELVHDHISCGMMTITGGFLEMVKDKQLLDPSLCKTIEMLETNKVMDFNMGDDGILKFKGRVCVPQYPKLKRHVLTHS

SEQ ID NO: 156218 - protein, 43 aa, Glycine max
  Coding DNA Sequence Number=SeqID_39440
MFICDIPRKPPKIQQERLSKAKVTPKTLADVKCDTLISYKGSV

SEQ ID NO: 156219 - protein, 1716 aa, Glycine max
  Coding DNA Sequence Number=SeqID_39441
  Gene Ontology: Mol. function=ubiquitin-protein ligase activity; Biological process=ubiquitin cycle
  Homolog annotation: Hit_ID=Q9LZ95; Match level="QueryCoverage=63%, HitCoverage=98%, E-value=1e-180, Identity=46%"; Hit description =Ubiquitin-protein ligase E3-alpha-like protein
  Pfam annotation: Domain name=zf-B_box; Domain location=289-336; Score= 9.9; E_value=0.011; Accession=PF00643.14; Description=B-box zinc finger
  Pfam annotation: Domain name=zf-C3HC4; Domain location=1482-1536; Score=6.7; E_value=0.032; Accession=PF00097.15; Description=Zinc finger, C3HC4 type (RING finger)
  Pfam annotation: Domain name=zf-UBR; Domain location=292-361; Score =80.7; E_value=4.6e-21; Accession=PF02207.10; Description=Putative zinc finger in N-recognin (U
  Pfam module annotation: Pfam domain module=zf-B_box::zf-C3HC4::zf -UBR; Domain location=289-336::1482-1536::292-361
MTLPSFLTNLHNVFHVSQLRKYISDPTHVLELDTVQVHKDLTYETQLTRIKDKRIKQLRGKIINLLKSLNLVLEVVVVTNSEKAYRMDEWTNPYIDDWARDVGEGPRVLMSLRHNLGLSGNPIRDFNGSSLRSVLVSSRNHKTENNQTWGVKVQASILAPCAVASFGSGAPSWPITWKSIFPPIPSRSSLAIELFGLAQFGVPEEQLDQPGLVAFVKDKRALIPELVSVILPTDAEVADAWEAKFSSKKTAVGVIMKKRFNESMVWLQWLMFEGDPGGALRRLSKMSVGQRGVCGSVWGNSDIAYRCRTCEHDPTCAICVPCFENGNHKGHDYFVIYTGGGCCDCGDVTAWKREGFCLMHKGAEQIQPLPEEFANSVDPVLGSLFNCWKVKLTLASESVTEKKHVANELTYAVVDMLLEFCKHSESLLSFVARLLFSSNGLIYMLVRAERFLTEVSMWVGLYETTIRVIEDIRFVMSHVVVPKYVTNDQQDISRTWMRLLSFVQGMGPQKRETGQHIEDENENVHLPFILGHSIANIHSLLVDGAFSDASKGEMDGEIVWSSSKNDSDDGDNLRHAKVGRRSEESSACNVTSRNSALASRKLHEIKADASSQLPLPLSVSWLIYECLRAIENWLRVENTPGAIPNAPSPNSGAVCDGNFSAFKRTISKFGRGRYTFGRLVSSSEDHGKQCSENNEIDSENTCMRPTFDDNAMEEDFPVESDGPRFLSLPDWPQIAYDVSSQDISVHIPLHRLLSMLLQKAMKRYFCESEGSDVTHVSSANSLPTSYNDFFEQALRGSHPYGFSAYIMEHPLRIRVFCAEVHAGMWRKNGDAALLSCELYRSVRWSEQGLELDLFLLQCCAALAPEDLFVSRILERFGLSNYLCLNVERSSEYEPVLVQEMLTLIIQIVKERRFSGLTTAECLKRELIYKLSIGDATHSQLVKSLPRDLSKFEQLQDILNTVAVYSNPSGFNQGMYSLRWPFWKELDLYHPRWNSKDLQVAEERYMHFCSVSALTTQLPQWTKIHPPLRGIARVATCKVVLHIIRAVLFYAAFTFKSSESCAPDSVLLPALHLLSLSLDICFQQKESRENTCHDVSHLPIIAFSGEIIESSFGEQSLLSLLVLLMEMHRKENVDNFVEAGGCSLYTLIESLLKKFAEIDNRCMTMLQKLAPEVVSYISEYVPTRDSSVSSSASDSEKRKAKARERQAAIMEKMRTQQSKFLASIDSTVDDSSQLGHEGDLDTEQDAEEFDSKQVVCSLCHDHNSKHPISFLILLQVYGSSIPAKSRLVSSVHRGPPSWAQLCRSDKDHTPIINTKETDTLPMNCNSVSSGSTSSSHLSQFVQNAAKELASCGKPGEALTFLQYVKNKFPALSNFQLPDTYYDEKENTPYTFETLEQGMYFSICAEMHDLLLSSNLMNEDEKVSIAGGSSNLIIDTGSVLLGKYTADLLQEMSEISSVSESASNETASVESTSQHPAYDGFGPTDCDGVHLSSCGHAVHQACLDRYLSSLKERSVRRIVFEGGHIVDPDQGEFLCPVCRRLANCVLPTLPGELQKPFKQSTILSTDSINTAPPLAELSELTYSLRLHLGLKLLQSAANAVGKDKFLNAIPLHHIDRTRTNLENFIRWLSKMYSPCKEEKLSRFSRLNHSMLMWDTLKYSLTSMEIAARCGKTSLTPNFALSALYEELKSSSGFILSLMLKLVQKTRSNNSLHVLQRFR

SEQ ID NO: 156220 - protein, 319 aa, Glycine max
  Coding DNA Sequence Number=SeqID_39442
  Gene Ontology: Mol. function=hydrolase activity; Cellular component =nucleus; Biological process=protein amino acid dephosphorylation
  Homolog annotation: Hit_ID=Q1T5K1; Match level="QueryCoverage=97%, HitCoverage=96%, E-value=1e-165, Identity=88%"; Hit description =Serine/threonine-specific protein phosphatase and bis(5-nucleosyl)- tetraphosphatase
  Pfam annotation: Domain name=Metallophos; Domain location=53-248; Score=155.1; E_value=1.9e-43; Accession=PF00149.18; Description =Calcineurin-like phosphoesterase
MERGVLDGIISRLLQVRVRPGKQVQLSEAEIRQLCAVSRDIFLKQPNLLELEPPIKICGDIHGQYSDLLRLFEHGGLPPRSNYLFLGDYVDRGKQSLETICLLLAYKIKYPENFFLLRGNHECASINRVYGFYDECKRRFNVRLWKIFADCFNCMPVAAIIEEKIFCMHGGLSPELHNLSQISSLPRPTEVPESGLLCDLLWSDPSKDIEGWGDNERGVSYTFGASRVTEFLGKHDLDLICRAHQVVEDGYEFFSNRQLVTIFSAPNYCGEFDNAGAMMTVDETLMCSFQILRPVEHRKPKFGFGSKTTFKASTSNKIL

SEQ ID NO: 156221 - protein, 231 aa, Glycine max
  Coding DNA Sequence Number=SeqID_39443
  Homolog annotation: Hit_ID=Q1SJP8; Match level="QueryCoverage=16%, HitCoverage=2%, E-value=6e-07, Identity=65%"; Hit description=D -galactoside/L-rhamnose binding SUEL lectin; Integrase, catalytic region; ...
  Homolog annotation: Hit description=Galactose-binding like; Peptidase aspartic, catalytic
MSHKKPIKEHWLVLRMNTYKIKTKRKFGYGIGDWDIPLLVIYKSPYSPQQNGADKRKNRHILEVTKSLLIDGNAPSHLLGEAGGNESELHNHNVSMFDILDIKLYCEDKLSCEDHSTGSEPILKMDTSFLDNTMSSHHNQLAQSSPQVRLDSSEVPSDPISDNTNADEIDHEIVSLNPTLDNTNLDEIDHEIDPCLCETTSTPNIESTTVQYNLPPRSNCGQPPAKYEPDL

SEQ ID NO: 156222 - protein, 395 aa, Glycine max
  Coding DNA Sequence Number=SeqID_39444
  Gene Ontology: Mol. function=DNA binding; Cellular component=nucleus; Biological process=regulation of transcription
  Homolog annotation: Hit_ID=Q2LMF2; Match level="QueryCoverage=97%, HitCoverage=64%, E-value=1e-117, Identity=59%"; Hit description=MYB4
  Pfam annotation: Domain name=Myb_DNA-binding; Domain location=30-76; Score=59.8; E_value=8.8e-15; Accession=PF00249.21; Description=Myb -like DNA-binding domain
  Pfam annotation: Domain name=Myb_DNA-binding; Domain location=82-117; Score=12.3; E_value=0.29; Accession=PF00249.21; Description=Myb-like DNA-binding domain
  Pfam module annotation: Pfam domain module=Myb_DNA-binding::Myb_DNA -binding; Domain location=30-76::82-117
MWNAAEFFPDRSEVQCLHRWQKVLNPELVKGPWTQEEDDKIVELVSKYGPTKWSLIAKSLPGRIGKQCRERWHNHLNPDIKKDAWTLEEELSLMNAHRIHGNKWAEIAKGKAAYNIPPPYLRIAKSLWTMGTDNAIKNHWNSSLKKKLDFYLATGRLPPIPKNSPQVPVKDTIRRSASKSILGCSNKELNAAVETSSETTSISKLDDRGRNQFESSGTVREVGDCSSVPANESADSDCVECKPGSSNIDLSCSNSEQLSRANFGTTFGLISENSGINGNSNFEHCTNNGDMSSTRLIGTSSQESPTCGSLCYEPPQLDGSVPIDSLYLNYICQQNEYCPSPTMSPIGFFTPPRVKGSQLCTETPESILKKAANTFPNTPSILRRRKTGAQTLTSP

SEQ ID NO: 156223 - protein, 164 aa, Glycine max
  Coding DNA Sequence Number=SeqID_39445
  Gene Ontology: Mol. function=RNA-directed DNA polymerase activity; Biological process=RNA-dependent DNA replication
MVNLEFDKPFGESTYRIHQGQTLDSPHEVAGLKGSWLNLCIVSSCCSELSNFFPDPGHVLDFVCCLEFYPHVFFILLMLEQQPPCQWFLDFNGDHGVCVICESGPKDDSIGCLFLAIGLGMFNRGVLVDDNGVWEAIPAYEMFPCELMTLLATKKYGSSDTPSL

SEQ ID NO: 156224 - protein, 224 aa, Glycine max
  Coding DNA Sequence Number=SeqID_39446
MVANRVCPRLLVWDARKKKGFELYYKEEMPTRKMKLDCVDGLSKTFGYDGSDNVVHYNVIRVLCPGKKYHYDDACIFFTKDVDNYSVIQCLLKLPTIQYKGTYNLKKISEEQMLAEAFTKVVDDTIVRGVIIDLTNTIPRKERKKVFSLVFLDPSSPRLTFGSPGPPNDYKVKKPARLGELMTLGLSHSSLVRATIALSDPFPINGCARGAKKGFQHGVVKEIE

SEQ ID NO: 156225 - protein, 96 aa, Glycine max
  Coding DNA Sequence Number=SeqID_39447
MYFQGQWRQVPRLHDHTSGIEANLDNCTTISEMHSPTNLLEVQKLNDLEIPMGLQVKSKFDLQEAKDSIDEEDPRPTSSTWSYINSYGKRPGNKPS

SEQ ID NO: 156226 - protein, 640 aa, Glycine max
  Coding DNA Sequence Number=SeqID_39448
MDECCLVLRVVTSIGVRIAGCFYQVVRGGHAFGFASEVYRVRQDTRHGASNNESSSLERLGFHIVLVEALLASTGGRNLLLLPRARKSDDGDVRASLRVQRSHSVGSPSFLPVIASFEWVKDDVLKYNSSITFAASVTTLQCQVKFVNHENFCKIVVQACRSDEFPFLRAASDMFLYFFQMKLTGKIGWVSLNNVSKKMFEFDSNVFRNFKDRFFKVLATDIVADASLDARAILLLPSMSDALVAMDNKCIMGDFAWRPLVKQVGPIGGAVPSSIVTPTAGERGQPAVEVGLVASVVVIAPDTLSFVLAKRKRDEALGQVVGLTPPPSIEVSTPAVVVVVVPIVAFVSSPPPPSVTPAKENALAAEVRALATSTDTIMATVSTIVAPLLSASVTTTSAHVMSPFLSLGPLVPPSSVLASTSTSTSFTSMFPWTTSTPPTMLIPCEGVACHKFCQGVSSTKFGNCGGEWTTAPRGFMQSGVLGGEGRQIEASAIVAFAEAMKLNHQSSSKVGSVLAKLLRTGLDGDELFKHCKNLHKEKKDLAGMVEGIAAEKDELAKAKESELRATMERKANRELEEELIMYKEAMEHHEKDFQKSVRQAGFFAKDFDLTFFYPFNDVKDDVLLNEEDIVAEEDADDANV

SEQ ID NO: 156227 - protein, 114 aa, Glycine max
  Coding DNA Sequence Number=SeqID_39449
  Gene Ontology: Mol. function=DNA binding; Cellular component=nucleus; Biological process=regulation of transcription
  Homolog annotation: Hit_ID=Q0PJD3; Match level="QueryCoverage=74%, HitCoverage=40%, E-value=4e-33, Identity=81%"; Hit description=MYB transcription factor MYB65
MAEVVKSEECCQENKQSTAASCSSVSEGSGSAIHKSPAICSPASTSPSHRRTTGPIRRAKGGWTAQEDETLRNAVAVFKGKSWKKIGWIEFSCGAGAAQPLGDDMRELSLSGHM

SEQ ID NO: 156228 - protein, 91 aa, Glycine max
  Coding DNA Sequence Number=SeqID_39450
MEVEKMVMKMEEVVVLEPRALAFGKGLQGLANHILDLIMSDSGNLPFDERLQKDWARAAKEGPGVFMNLKLSSSFSRNLLKEASQGGELSY

SEQ ID NO: 156229 - protein, 77 aa, Glycine max
  Coding DNA Sequence Number=SeqID_39451
MVSSIPLGAIHMFWWRLSFSDQGLSKPKISINEEMESISKRFQELDVCGKITLKSKLREIAYLDVNSMSAPSEKVKT

SEQ ID NO: 156230 - protein, 303 aa, Glycine max
  Coding DNA Sequence Number=SeqID_39452
  Gene Ontology: Mol. function=transporter activity; Cellular component= membrane; Biological process=transport
  Homolog annotation: Hit_ID=UPI000067E833; Match level="QueryCoverage =76%, HitCoverage=69%, E-value=5e-59, Identity=50%"; Hit description =ABC transporter permease protein
LQPFLQQQEGQRPGDRADHCAQSAQRHHHDQFAGGGPGQVRRRYVQRQVGQQHARHAAYHRRQHVGRQAIAQRREAQRAHAPLVGLAAAQDHAERRLHQAAQRGQRQQQHAERGVVQRQRRIQPEQAEVAAGEQRHAVVAAETFQPGGQEIEHLRERQRDHDEGDAGRAHDHVAAHQADGRAGAQRGQQVQPAVLDAVVVQHADRIGPQAQVQRVAEADHAAVAQQQVQRQRGDAVHQHAAEQRQQEGFALPLRIQRHQRQEQQQRAGGERAGRESKHVLASLGASRAARETGPAAAAPAPAP

SEQ ID NO: 156231 - protein, 89 aa, Glycine max
  Coding DNA Sequence Number=SeqID_39453
MEHAFRESRVALPSKGRLRQVVLVISLIWYGIVSPPLELECRGMVMFLVSLGWGEESDREILYLLFVLYIERLFHLIQIEVEANKWKPI

SEQ ID NO: 156232 - protein, 164 aa, Glycine max
  Coding DNA Sequence Number=SeqID_39454
  Homolog annotation: Hit_ID=Q8TGM5; Match level="QueryCoverage=23%, HitCoverage=58%, E-value=7e-08, Identity=74%"; Hit description =Uncharacterized protein ART3
MGPELTGSHVIGLERGSSTIYHGEVGMNPDFNQPRGGCSREVSIHPAQQHCYMFALGKRCVTPRQACPRPNGFGRNLRSKTRWFTGFCNSHQVSHFATFFIDARAEISVAESHCSVDFSQRRGQRTAHVAAIRTLHRTIQSVGATGGVYKGQGRSQRELMTRAY

SEQ ID NO: 156233 - protein, 238 aa, Glycine max
  Coding DNA Sequence Number=SeqID_39455
  Gene Ontology: Mol. function=RNA-directed DNA polymerase activity; Cellular component=intracellular; Biological process=RNA-dependent DNA replication
MNGPGTKKEIGQPSGTGKDADHDEILKLIQKSEYKVVDQLLQTPSKISILSLLLNSEAHREALMKVLDQAFVEKDVTVNQLDSIVGNITACNNLSFSDEELPEEGRNHNLALHISVNYKSDALSNILVDTCSALNVMAKTTLDQLSYQGPSMRRSGVVVKAFDGSRKSVIGEVDLPIIIGPSVFQITFQVMDIRATYSCLLGRPWIHEAGAVTSTLHQKLKFVRNGRLVIMSGEEALL

SEQ ID NO: 156234 - protein, 214 aa, Glycine max
  Coding DNA Sequence Number=SeqID_39456
  Homolog annotation: Hit_ID=UPI000067F12D; Match level="QueryCoverage =26%, HitCoverage=17%, E-value=3e-22, Identity=82%"; Hit description =calcineurin-like phosphoesterase
  Subcellular localization annotation: CTP_CleavageSite=44; ConfidenceScore=5.13e-01
MPSPHRRDSRRARQPPAAAQPFRRPRQRRGAGHAVPVAGPYSRRAAAGWRGRGHGTVHPRPDAGTGAAAAAVGRCAGAGPRRAGGTAPRRARQVVAGQPPRPERAGRARSIAARGDGPAALARRRRAAGAGRAGRGPGLNGGKARCAATPPAPPTARRAGSRPVRPSWRSPADWPPRGSRPSRSPADSAGGRASRRPPTVAGRPAHCRSRPCPA

SEQ ID NO: 156235 - protein, 46 aa, Glycine max
  Coding DNA Sequence Number=SeqID_39457
MDMIMEIGTYSSFELNSSGARTSSVERQGIAATPFGEEVGVTHAEE

SEQ ID NO: 156236 - protein, 270 aa, Glycine max
  Coding DNA Sequence Number=SeqID_39458
  Gene Ontology: Mol. function=4 iron, 4 sulfur cluster binding; Biological process=pyrroloquinoline quinone biosynthetic process
  Homolog annotation: Hit_ID=Q0XBA0; Match level="QueryCoverage=100%, HitCoverage=30%, E-value=1e-143, Identity=90%"; Hit description =Radical SAM
  Pfam annotation: Domain name=Radical_SAM; Domain location=17-180; Score=59.1; E_value=1.5e-14; Accession=PF04055.11; Description =Radical SAM superfamily
MLNPRHRLWSDGRWNKLTVAHGCYWKKCSFCDVSLDYIGRYEGASATVLADRIEAIVQETGQTGFHFVDEAAPPKSLKALATELIDRNAGISWWGNIRFEKTFTPELCELLADSGCIAVSGGLEVASDRLLNLMKKGVSVDQVARVTRAFTDAGILVHAYLMYGFPTQTVQDTVDALEYVRQLFENGCIQSGFFHRFACTVHSPVGLNPEEYGVTLRPLPDVTFAKNDIGFDDPTGVDHDALGRALKKAIYNYMHGIGLDEDVRSWFPFK

SEQ ID NO: 156237 - protein, 273 aa, Glycine max
  Coding DNA Sequence Number=SeqID_39459
  Gene Ontology: Mol. function=nucleic acid binding; Cellular component= integral to membrane; Biological process=protein ubiquitination
  Homolog annotation: Hit_ID=Q9FNZ2; Match level="QueryCoverage=98%, HitCoverage=62%, E-value=5e-92, Identity=59%"; Hit description=Zfwd1 protein
  Pfam annotation: Domain name=WD40; Domain location=113-149; Score =36.7; E_value=8.1e-08; Accession=PF00400.22; Description=WD domain, G-beta repeat
  Pfam annotation: Domain name=WD40; Domain location=153-189; Score =33.9; E_value=5.7e-07; Accession=PF00400.22; Description=WD domain, G-beta repeat
  Pfam annotation: Domain name=WD40; Domain location=196-236; Score =9.6; E_value=2.8; Accession=PF00400.22; Description=WD domain, G -beta repeat
  Pfam annotation: Domain name=WD40; Domain location=68-104; Score=8.9; E_value=3.3; Accession=PF00400.22; Description=WD domain, G-beta repeat
  Pfam module annotation: Pfam domain module=WD40::WD40::WD40::WD40; Domain location=113-149::153-189::196-236::68-104
VITGIALPVGSDKLYSGSTDGTVRIWDCHTGQCAKVINLGAEVTSLISEGLWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIKVWDMDTLQCTMTLNDHTDAVTSLICWDQYLLSSSSDCTIKVWACIEAGSLEVIYTHTEENGVVSLFGMPDAEGKPILFSSCRDNSVHMYELPSFSERGRLFAKKDVALIELGPGGLFFTGDESGLLM

SEQ ID NO: 156238 - protein, 53 aa, Glycine max
  Coding DNA Sequence Number=SeqID_39460
MKVRKEYLKFHDDNLEGSMETNGDGLRVGRVSRRFSSIVRCFASSKLSPYSKW

SEQ ID NO: 156239 - protein, 204 aa, Glycine max
  Coding DNA Sequence Number=SeqID_39461
  Homolog annotation: Hit_ID=Q8TGM5; Match level="QueryCoverage=22%, HitCoverage=68%, E-value=1e-15, Identity=89%"; Hit description =Uncharacterized protein ART3
  Subcellular localization annotation: CTP_CleavageSite=70; ConfidenceScore=5.12e-01
CIPKQLDSSKELHTGADTPSQTGFSPSLTARSRALRQGPHPKHPLQITMRTPKEPAFKFELLPLHSPLLRQSRLVSFPPLIDMLKFSGIGRGAAAAFGARPPRRGDDDPTHKPCLMGSNDARTGMPPGIPGGAMCVQRLDDSRNSAIHTSYRISLRSSSMPEPRDPLLKVLTDCDTINSDFTRSDRVRGVSGGRGPGAESPRRP

SEQ ID NO: 156240 - protein, 220 aa, Glycine max
  Coding DNA Sequence Number=SeqID_39462
  Gene Ontology: Mol. function=nucleoside-triphosphatase activity; Cellular component=chloroplast
  Homolog annotation: Hit_ID=Q2PMM5; Match level="QueryCoverage=99%, HitCoverage=9%, E-value=1e-114, Identity=94%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGM

SEQ ID NO: 156241 - protein, 78 aa, Glycine max
  Coding DNA Sequence Number=SeqID_39463
  Gene Ontology: Mol. function=ribonuclease H activity; Biological process=DNA integration
  Homolog annotation: Hit_ID=Q1SYR3; Match level="QueryCoverage=97%, HitCoverage=3%, E-value=3e-25, Identity=68%"; Hit description=RNase H, putative
MKNAFNKKVRSRKFHEGDLVLKKVSRTVKDNRGKWGPNYEGPFIVKRAFSKGALVLTNMDGEELPSPVNSDVVKRYYA

SEQ ID NO: 156242 - protein, 153 aa, Glycine max
  Coding DNA Sequence Number=SeqID_39464
  Gene Ontology: Mol. function=ribonuclease H activity; Cellular component=intracellular; Biological process=DNA integration
MEEMCEELKIQHHNSTPYRPKMNGAVEATNKNIKKIIQKMTVSYKDWHEMLPFALHGYQTSVRTSTGETPFSLRRVKNAFDKKVRSCRFSEEDLVLKKVSQALRDNRGKWSPNYEGPFVVKKAFSRGAVVLTNKDDKELPSPVNADVIKRYYA

SEQ ID NO: 156243 - protein, 174 aa, Glycine max
  Coding DNA Sequence Number=SeqID_39465
TRGLDWLSKLKIINEEIFEAPEEDEEVQALKSELGRARLAKEKFKTAATSIQKECAELREENAATAKALEQETKRARKEGNNELKLRREEKDQSRVHGMILKEELAACSRSKRSLAQHLEATEQSMLAIIGQYKEEGIDALHQEATMWMDRFTLTLNGSQDLPPLLAKAKAIAE

SEQ ID NO: 156244 - protein, 189 aa, Glycine max
  Coding DNA Sequence Number=SeqID_39466
EHYKDNCYLYSTNNSRWRQELNPYNQYEKERAFDLESVFAEFMAYHASSKANHDSIQNQEIQFGKSYFLENYQGEPELQLCYQNEAERGSNLDTLLIQVKDTIGSIQRAFRSAKIQVGKLVEEVTQVMGRREEECVEVEAQEGSPVNEHDLEEDEEKVQQREQHEDHEVPIILGQPCLSIASCVLDMGK

SEQ ID NO: 156245 - protein, 42 aa, Glycine max
  Coding DNA Sequence Number=SeqID_39467
MRIKEKRIENAGEARGWQSVIDGAVSGLRFSRSRSAWKRLNL

SEQ ID NO: 156246 - protein, 401 aa, Glycine max
  Coding DNA Sequence Number=SeqID_39468
  Gene Ontology: Mol. function=ATPase activity, coupled to transmembrane movement of substances; Cellular component=integral to membrane; Biological process=cobalt ion transport
  Homolog annotation: Hit_ID=Q7X3M9; Match level="QueryCoverage=66%, HitCoverage=49%, E-value=3e-48, Identity=40%"; Hit description =Cytochrome oxidase subunit IV
  Pfam annotation: Domain name=Cyto_ox_2; Domain location=2-113; Score=- 163.1; E_value=0.00014; Accession=PF02322.6; Description=Cytochrome oxidase subunit II
  Subcellular localization annotation: CTP_CleavageSite=61; ConfidenceScore=5.02e-01
MGREAPLLWLVIGAGALAAVTLIAAVGFSLVRRDGWAFFSGMLTVMFAVVMLFCALFPYVMPSTIDPAYSLTIANASSTPYTLQIMSWTALIAMPLVLAYQAWTYWVFRKRVTRTSIEGAPAHACREALPRGIRADRRPPDRGHDRVRLAADAGDHRSARRERRPHRIRARSARRRTRARSADRRLGRCGCAGRCEDRDAVAFRPDRRRRPTGTGVAGTAQPGGARRHRRSRAGGAGRLLRALHPAARVDGDRDAGAGGRDVVAGLAERAHRGHHPAPHPAVPDPDRHGDPHGAEAAVADVAAARGAFRRHRAGSVDAAPVRSRSTCGRPHRAHCRRLPPRDHEGAAVLVPLGLRDGAAGLHRGGPDRGVRRLPVAVRRPDPGGGSVRAAARARGLPADPP

SEQ ID NO: 156247 - protein, 1326 aa, Glycine max
  Coding DNA Sequence Number=SeqID_39469
  Homolog annotation: Hit_ID=Q6L4A9; Match level="QueryCoverage=49%, HitCoverage=97%, E-value=0.0, Identity=53%"; Hit description =Putative microtubule-associated protein, identical
  Pfam annotation: Domain name=DUF231; Domain location=383-563; Score =245.4; E_value=1.2e-70; Accession=PF03005.6; Description=Arabidopsis proteins of unknown function
  Pfam annotation: Domain name=MAP65_ASE1; Domain location=653-1250; Score=258.9; E_value=1e-74; Accession=PF03999.3; Description =Microtubule associated protein (MAP65ASE1 family)
  Pfam module annotation: Pfam domain module=DUF231::MAP65_ASE1; Domain location=383-563::653-1250
MAWTTLKGSPRMSSHPRPLSWIVVMVGALAFFLIYASWVLVSSPIGATVQGYFYSVGSSEKLDLPVSSVNGASINDGHSNVSLDLVDKKPPSEDLQSSTISTEVPSDSKTEQTDTTSNSQVDSGESTSVNLPMTKEVNSDTTVLNSGELGTLFGDRSDVANSSSPTQDNSQVDLNSKTTKPLVGTNSFNETGNIRMEEPTSVALINQSSAVTTASNETSISSGDSTSTAVPESAEKLNNTPSAGCDLYHGNWIHDPLGPLYTNNSCPVLTQMQNCQADEREDFGFHWRFSSPKPDGINAVHSVAGQKLSSCGLGAAAAAAPCHVQNKMVCCRIWSSWLVKLTSEPFDYAPAGVDKLHLDAPDEKLMEHIPNFDVVVLSSGHWFAKQSVYILNNEIVGGQLWWLDKSRKMKVDSVKAYGISVETILTAIATIPNYKGLTIVRSYSPDHYEGGAWNTGGSCTGKVRPLAPGELVKNMHTNIMHEQQVTGFNRAVERATNGSKLRLMDITEAFQYRHDGHPGPYRSPDPNKITKRGPDGRPPPQDCLHWCMPGPVDTWNELVFEIIRREYEGRDLCRNVTVCGGGGKVTHVVFLLSCFAEPFTGFILVIKNVSGRYKSPKMSKPQNDPLVQSETTCGTLLYELQIIWDEVGESESDRDRMLFELEQECLEVYRRKVDLANRSRAQLRQAIADCEAELAAICSSMGERPVHIRQTDQNAGSLKEEHARILPQLEEMQKRKIERRNQFIEIQEQIQSISIEIYGPREYIPAVEDETDLSLRKLEELHRQLHALQIEKTINGIHPSLVDSKGSKSVSNDTIQQLAVAIQELREVKLQRMQKLQDLATTMLELWNLMDTPIEEQQMFQNVTCNIAASEHEVTEPNTLSVDFINLVEVEVARLEALKSSKMKELVLKKRTELEEICRKTHLIPEIDNAVESAVEAIESGSVDPAFVLEQIELQISQVKEEALGRKEILEKVEKWLAACDEESWLEEYNRDDNRYNAGRGAHLTLKRAEKARALVNKIPAMVDGLTSKTISWEKEKGIEFTYDGIRLLSMVEEYNILRQEKEQERRRQRDLKKLQGQMIAEQEALYGSKPSPSKPQSVKKGPRMSTGGGAASRRVSLGGAMLQTPKPDSKSTHSRAMRKVDKVHQIEHLNYLDDGISGLSAAARRGLDIAGAPVKKHSFGAGTQIIESPLIRQPFSPISSNSVSSKANVANATDELSKQNEKLQRTVSLNNGPFTTPSKTVPTVVDEENRTPNIPAPATPSTVSVPMNMAMTPVPSSILKNVSLNSTPISVPYGNNDLVQELPVMDNHKSIVIGFLIVYIWRSGG

SEQ ID NO: 156248 - protein, 272 aa, Glycine max
  Coding DNA Sequence Number=SeqID_39470
  Homolog annotation: Hit_ID=Q6ZJ55; Match level="QueryCoverage=32%, HitCoverage=24%, E-value=7e-14, Identity=48%"; Hit description =Putative AT-hook protein 1
  Pfam annotation: Domain name=AT_hook; Domain location=46-58; Score =16.7; E_value=0.03; Accession=PF02178.9; Description=AT hook motif
  Pfam annotation: Domain name=AT_hook; Domain location=88-100; Score =3.5; E_value=5.7; Accession=PF02178.9; Description=AT hook motif
  Pfam annotation: Domain name=DUF296; Domain location=75-186; Score =48.8; E_value=1.9e-11; Accession=PF03479.5; Description=Domain of unknown function (DUF296)
  Pfam module annotation: Pfam domain module=AT_hook::AT_hook::DUF296; Domain location=46-58::88-100::75-186
MEGRENFGVVVGDEAPESFHVAPRIENNLDFSRATVPAPAPATEGKKKRGRPRKYGPDGKPALGAVTALSPMPISSSIPLTGEFSAWKSGRGRPVESIKKSSFKFEVESPGPGFTVTSVAKGLFEILSLSGSFMPTENGVTRSRSGGMSVSLAGPDGRVMGGGLAGLLVAAGPVQVVVASFLPGHQLEHKTKKQRVEHVSTISPSPVNLITSEEIKVSFGGVKPIMTPAAFQEENIASFNNVQDSRNSSADDKDPLPEKESNLSQSNAEAAC

SEQ ID NO: 156249 - protein, 123 aa, Glycine max
  Coding DNA Sequence Number=SeqID_39471
MLQRVTLVIQPLGKRFKLWCFEAKGVQRDLVHFPLNVGLNLYNLLLRHPLQRGRHRFVGDVHILRGIVLSTKASSNKRWSRELKSEREESEVVDGEDEGLADEEIRKGWVLVTLLGRGNLEFQ

SEQ ID NO: 156250 - protein, 388 aa, Glycine max
  Coding DNA Sequence Number=SeqID_39472
  Homolog annotation: Hit_ID=Q1RVB7; Match level="QueryCoverage=98%, HitCoverage=51%, E-value=1e-128, Identity=56%"; Hit description=Zinc finger, BED-type predicted
MVNVACQVQGFMGLIKDFSIGVPLFRVVIENCLKVANFINTESQVRSSFLRYRMQELECAALVRVPSPKCHVLKDFTSVFPMLEDILSCAAVIQMVVLEDTFKVVCMEDPLAREVAGIVQSEGFWNELEAVYSLVKLIRGVVQDIEAERPLIGRCLPLWEEIRTKVKEWCVKYSVVEEPVVEIFEKRFRKNYHPAWSAAFILDPLYLVKEASGKYLPPFNCLTREQEKDVDKLLTRLASREEAHVVLMELMKWRSEGLDPLYAQAVQMKQRDPVTGKMKVANPLSSRLVWETCLSEFKSLGKLAVRLIFLHATSFGSKSNCSFIKKISANKHSRVSLERAQKMIYIAAHAKLERRDFSNEEEKEAELLAMEGSDDGMLAEVFADAPLM

SEQ ID NO: 156251 - protein, 352 aa, Glycine max
  Coding DNA Sequence Number=SeqID_39473
  Gene Ontology: Cellular component=cellulose and pectin-containing cell wall
  Homolog annotation: Hit_ID=Q9SII5; Match level="QueryCoverage=91%, HitCoverage=89%, E-value=1e-124, Identity=65%"; Hit description =Expressed protein
  Pfam annotation: Domain name=Phi_1; Domain location=68-349; Score =583.3; E_value=2.2e-172; Accession=PF04674.3; Description=Phosphate -induced protein 1 conserved region
  Subcellular localization annotation: CTP_CleavageSite=54; ConfidenceScore=5.68e-01
MVSSFNFKDVLSAAERPHPPSTPNFKPSSKLKVQTLNTNPTHFNPQVPPLRTLSSSKRFEGSSEFVKLKYHMGPVLSSPINIYLIWYGKWPQSQKLLIKDFLNSISDHRAAPSPSVSDWWRTVSLYTDQTGANISRSVSIAGEYSDLRYSHGTHLTRLSVQEVIATAVQAKPFPVDHRNGIYLILTAEDVTMEDFCRAVCGFHYFTFPSKVGYTLPYAWVGNSGKQCPEVCAYPFAVPGYMGGGGPGHLTPPNGDVGVDGMVSVIGHELAELSSNPLVNAWYAGEDPTAPTEIGDLCEGLYGTGGGGGYIGSVMKDGEGRTFNLNGRNGRKFLVQWIWSPVLKACAGPNALD

SEQ ID NO: 156252 - protein, 187 aa, Glycine max
  Coding DNA Sequence Number=SeqID_39474
QIMRPLSFRNNKVGGKCAKTDFVPFIIQEQQPELVNAQRHILHPLSFRNNKLGGKCAETNYAHSLHLFAIQRRSCPMARRDKLWSFCVSPPRLNRVQQNAETNYGHSASCINQEEHTSRRFMSCSYVVAPRKHAHHEYSNCIHHVYMLESVSNIYRGLFGELHNEVYWSPYHEPRISPDPEKKRNSK

SEQ ID NO: 156253 - protein, 400 aa, Glycine max
  Coding DNA Sequence Number=SeqID_39475
  Gene Ontology: Mol. function=pyruvate kinase activity; Cellular component=chloroplast; Biological process=glycolysis
  Homolog annotation: Hit_ID=Q43117; Match level="QueryCoverage=88%, HitCoverage=52%, E-value=1e-139, Identity=74%"; Hit description =Pyruvate kinase isozyme A, chloroplast precursor
  Pfam annotation: Domain name=PK; Domain location=1-273; Score=-48.3; E_value=4.2e-14; Accession=PF00224.11; Description=Pyruvate kinase, barrel domain
  Pfam annotation: Domain name=PK_C; Domain location=290-398; Score =41.0; E_value=4.1e-09; Accession=PF02887.6; Description=Pyruvate kinase, alphabeta domain
  Pfam module annotation: Pfam domain module=PK::PK_C; Domain location =1-273::290-398
MKHKVEEYFALTRTLKAERLPRAIKALRGRAFNWKLRWKLSNPQATLFEFDWLDIDFGISEGVDFIAISFVKSAEVITHLKSYIAARSRDRGSNPPGASCPVHLACFLNLLTRLPFCLEYHINFTEVQCLSPYLNPKNIRCDISVIAKIESIDSLKNLEEIVLAADGAMVARGDLGAQIPLEQVPSAQQRIVQVCRQLNKPVIVASQLLESMIEYPTPTRAEVADVSEAVRQRADALMLSGESAMGQYPDKALTVLRSVSLRIERWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVIAVSDMLQSIQVMNVP

SEQ ID NO: 156254 - protein, 107 aa, Glycine max
  Coding DNA Sequence Number=SeqID_39476
MATMVGQTCIAHRKRREFRRNVHFPGEIPVAGGESRCKAWVGLVFIAKRQSCWHGCICHVGSDVAWVIIVRGEEITVVTSALGGISGRCPWCSGVMAERAAIVAIMH

SEQ ID NO: 156255 - protein, 206 aa, Glycine max
  Coding DNA Sequence Number=SeqID_39477
  Homolog annotation: Hit_ID=Q9LIJ8; Match level="QueryCoverage=98%, HitCoverage=52%, E-value=6e-39, Identity=49%"; Hit description =Arabidopsis thaliana genomic DNA, chromosome 3, BAC clone:F5N5
  Pfam annotation: Domain name=DUF506; Domain location=80-206; Score =3.5; E_value=4.2e-09; Accession=PF04720.3; Description=Protein of unknown function (DUF506)
  Subcellular localization annotation: CTP_CleavageSite=57; ConfidenceScore=5.35e-01
MPPMKIQPIDVDSQKLAVVRNDPVKPVLKSRLKRLFVFDRQFSNVLKTSSFSSEKPAAGEAPQSNTKDGAAEFEPSSVCLDKMVQSFMEESNEKPAPATAKCGRNRCNCFNGNSNDSSDEELDIFGDSISSGSFSDASDALKSLIPCASVVERNLLADTSKIVDKNSKVYKRKGDLRKIVTESLSSLGYDSSICTSKWDKTPTYPA

SEQ ID NO: 156256 - protein, 59 aa, Glycine max
  Coding DNA Sequence Number=SeqID_39478
MESGGPESASPMTHRVQSLSSADTRGKHRIHAELKRLEQEARFLERQMLSVNLMTLPTN

SEQ ID NO: 156257 - protein, 95 aa, Glycine max
  Coding DNA Sequence Number=SeqID_39479
MGYENSKDMKTLSCLFFEARCDRVQEGDGRHRIQVKQLAQDSILGSSACRLNSVVFDENVWEEELEQLERMEKASTSCKIMLINVETKPDPLLPS

SEQ ID NO: 156258 - protein, 106 aa, Glycine max
  Coding DNA Sequence Number=SeqID_39480
MVGVQGQWSLVEVVVTNFNGGSMLSICDYGGFGGGWHYLMDDEFQLWMSFSLKLLSKLVGWRCKIFNEEGLFCMEVAIAIGDEGGIAIAVGEKEDDMDVPPMVMTS

SEQ ID NO: 156259 - protein, 103 aa, Glycine max
  Coding DNA Sequence Number=SeqID_39481
MELKAEAEGWVQKTIEQDLSVLKTQRQRQVTRALCLVNKEYKRERLRGVWSLKSVLRVGAENGGEKENLFQVLKSKLSFLGAVVGIRTQHQSWCWVVDYLKLP

SEQ ID NO: 156260 - protein, 354 aa, Glycine max
  Coding DNA Sequence Number=SeqID_39482
  Gene Ontology: Mol. function=pyruvate kinase activity; Cellular component=chloroplast; Biological process=glycolysis
  Homolog annotation: Hit_ID=Q43117; Match level="QueryCoverage=56%, HitCoverage=34%, E-value=1e-104, Identity=92%"; Hit description =Pyruvate kinase isozyme A, chloroplast precursor
  Pfam annotation: Domain name=PK; Domain location=151-351; Score= -129.7; E_value=2e-09; Accession=PF00224.11; Description=Pyruvate kinase, barrel domain
MDPRQHSTLKERRQSWHLVVSAVGFRDNCNSVNNNTQNPNALRFLFSTFELAPHFPLYLSATRHHVSLTLPPPPPLHPSPHRHSHPPPTPYFLLPRSAAHRRLPSLRASSSPEILVSDNNGAPSPPPSDPSSIEVDAVTEAELKENGFRSTRRTKLVCTVGPATCGFDQLEALAVGGMNVARINMCHGTREWHKEVIDRVRRLNHEKGFAVAIMMDTEGSEIHMGDLGGASSAKADDGEIWTFSVRAFDSALPQRTINVNYEGFAEDVKVGDELLVDGGMVRFEVIQKIGPDVKCRCTDPGLLLPRANLTFWRNGSLVRERNAMLPTISSKVANSSFAFCFLALHLFIAIFFGV

SEQ ID NO: 156261 - protein, 108 aa, Glycine max
  Coding DNA Sequence Number=SeqID_39483
  Homolog annotation: Hit_ID=Q3LBH1; Match level="QueryCoverage=51%, HitCoverage=58%, E-value=3e-07, Identity=58%"; Hit description =PAM492 homologue
MSVKMRTTCTWTERPYEASLFPGIGFGLILRSLGGGQRRPPSGGARAIRPTGRGTVSGRQFIWGVGLPKGNGGVQRFPRARRRLALECKGRRELDCKTHPSSRDESRP

SEQ ID NO: 156262 - protein, 288 aa, Glycine max
  Coding DNA Sequence Number=SeqID_39484
  Gene Ontology: Mol. function=chitin binding; Cellular component =extracellular region; Biological process=chitin metabolic process
  Homolog annotation: Hit_ID=UPI00006A17C9; Match level="QueryCoverage =58%, HitCoverage=100%, E-value=7e-23, Identity=32%"; Hit description= UPI00006A17C9 related cluster
LHTLTFRGLHVLASRGLRALTFRGLHALSFRGLHVLAFRGLRALAFVGLHALTFKGLYVLTFRGLHILVFRGLHVLIFRGLHVLAFRGLHVLTFKGLHVLTFRGLHSLAFRGLYVLAFRGLYVLTFRGLHVLTFRGLHSLAFKGLHVLVFRGLHVLTFRGLHVLTFGGLHTPPPLEGYASSALKCLTETRAPGEFQQGPGVSSSGYGPLSILQGARSPQQGHPVDPKKSNRVLGYPAMITSLCQFYRVSVTPNKAGRGRDTTTAWGWPATGKKCTDATSRAPQLIHRK

SEQ ID NO: 156263 - protein, 117 aa, Glycine max
  Coding DNA Sequence Number=SeqID_39485
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=61%, HitCoverage=19%, E-value=2e-11, Identity=49%"; Hit description =Matrix metalloproteinase MMP2
  Pfam annotation: Domain name=PG_binding_1; Domain location=61-116; Score=2.2; E_value=0.083; Accession=PF01471.9; Description=Putative peptidoglycan binding domain
MKSYLSAFLLFLLLLKLVDKSISARVPPSSTKVIFKKIGENSLDNVKQKFSPQQPNSPPKQIEGLSFFKGYLSNFGYLQSSEPFNDYLDEETITAIKTYQQYFNPQPTVDINNETLH

SEQ ID NO: 156264 - protein, 329 aa, Glycine max
  Coding DNA Sequence Number=SeqID_39486
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=80%, HitCoverage=73%, E-value=2e-76, Identity=58%"; Hit description =Matrix metalloproteinase MMP2
  Pfam annotation: Domain name=PG_binding_1; Domain location=61-123; Score=45.9; E_value=1.3e-10; Accession=PF01471.9; Description =Putative peptidoglycan binding domain
  Pfam annotation: Domain name=Peptidase_M10; Domain location=153-312; Score=63.3; E_value=8.1e-16; Accession=PF00413.14; Description =Matrixin
  Pfam module annotation: Pfam domain module=PG_binding_1::Peptidase _M10; Domain location=61-123::153-312
MKSYLSAFLLFLLLLKLVDKSISSRVPPSSTKVIFKKIGENSLDNAKQKFSPQQPNSPPKQIEGLSFLKDYLSNFGYLQSSEPFNDYLDEETITAIKTYQQYFNLQPTGNINNETLHQILLPRCAVPDMNFYYNFTDLKSWPKAGNQWFPMGKSLLTYGFQPMNEMTAEMKKVFTDAFTRWVRATAGVLKLTETTYDNADIKVGFYRFDGRFKNLLFGGSVIRYQPDSNVTTGEIRLDLTDLWALPREEDMLSQDGVLDLESAAMHQIGHLLGLDHSNKEDSVMYPYMLPSQKRKVELSVSDKDNILQQLLGTSTCLDFVLVFQTQFGA

SEQ ID NO: 156265 - protein, 166 aa, Glycine max
  Coding DNA Sequence Number=SeqID_39487
MREEKKLDREKEKHGEDEGWKQVTNGSRYNTNATQSSEVMRVLFETRDYNVVPTTTEEQELGEIWLREIYKSTRLRMVGEGTGQHFYRFMKLHVNFPRFQRSRKFEDHRAIGSQRSHHEVGTRQTNEYAEGKEMRQHSSYSHMEIKVNQYNMEWQGFVISAWFQLF

SEQ ID NO: 156266 - protein, 94 aa, Glycine max
  Coding DNA Sequence Number=SeqID_39488
  Gene Ontology: Mol. function=nucleic acid binding
  Homolog annotation: Hit_ID=Q1SAT5; Match level="QueryCoverage=76%, HitCoverage=13%, E-value=1e-21, Identity=63%"; Hit description=Zinc finger, CCHC-type
MEHGAAGGGELEGGLIIVKAGALPLKGTVVGRDGADEGREQVDGAVEVVEEGPGDSVGENGENIVDSEGEFKGATAESGYGAGGDSRTHVECTG

SEQ ID NO: 156267 - protein, 367 aa, Glycine max
  Coding DNA Sequence Number=SeqID_39489
  Homolog annotation: Hit_ID=Q9FFU3; Match level="QueryCoverage=99%, HitCoverage=64%, E-value=1e-141, Identity=62%"; Hit description =Genomic DNA, chromosome 5, P1 clone:MBG8
MWSSNFGKNANLDFLKKHMGATFEKRNQPWRATIDPADVHSGDFLAVSKIRGRWGGFETLEKWVTGAFAGHTAVCLKDEIGNLWVGESGHENEKGEEIIVVIPWHEWWTLALKDNSNPQIALLPLHPELRARFNSTAAWEYARSMSGKPYGYHNMIFSWIDTVADNYPPPLDAHLRLYLEYACITRRLLYYFILRGFWFQEQWKSVSEWHVPAYAANMWNEALNKRLGTEDLDLHDILIETEKRGIAFDQLLTIPEQDEWVYSDGKSTTCVAFILSMYKAAGIFGPISSSIQVTEFTIRDAYMLRIFEDNQTRLPRWCNNENDRLPFCQILGEYRMELPGYNTLDPYANMNEHCPSLPPTYDRPLKC

SEQ ID NO: 156268 - protein, 89 aa, Glycine max
  Coding DNA Sequence Number=SeqID_39490
MAAERTVEIPKKRIKGFSFGEQFSVNSTNLNQRMNKLSKPNVDHYSIKHKAMIAPTIHDSKSLVKKTKKQWRCDLCPIATREKGFNDHL

SEQ ID NO: 156269 - protein, 118 aa, Glycine max
  Coding DNA Sequence Number=SeqID_39491
  Gene Ontology: Mol. function=chitin binding; Cellular component =extracellular region; Biological process=chitin metabolic process
  Homolog annotation: Hit_ID=UPI000069F178; Match level="QueryCoverage =97%, HitCoverage=54%, E-value=7e-15, Identity=35%"; Hit description =UPI000069F178 related cluster
PLKARTCSPLEVRACSPLMVRTCSPLKVHDPLKARTCSPLKGEALLVVRTCSPLKARTCSPLTVRARTCSPSGVPKVRACSPLKARTCSPLKVRACSPLMVRTCSPLKARTCSPLNGE

SEQ ID NO: 156270 - protein, 87 aa, Glycine max
  Coding DNA Sequence Number=SeqID_39492
MHENKWHGVCLLFAPTIHNSHGCFLEWSRQLSQRALHGRARARLTGALPKGGKMRGVATNVYLWKTSGKPKETGKKENSKFGSCIYA

SEQ ID NO: 156271 - protein, 239 aa, Glycine max
  Coding DNA Sequence Number=SeqID_39493
MPLKGKQLVVYPYKTLWRALNFAPKSQPLHSAAGKIPPVMAKMRKLDHLEERLRAIEEGKDYAFADIEELFLAPNMVIPPKFKVLKFDKYTTTTCPKNHLKMYYRKMGVYAKDEKLLMHLFQESLIGAVVTWYTNLEPSRVHSWKDLMVSFVRQYQYNSKYNSDLDFASKKIEVDLKRGKFNHPAWTNEKTGANKEGEDEGETHAMTAIPVRPSFPPTQQCHYSTLLLTHHPVIHKGHP

SEQ ID NO: 156272 - protein, 278 aa, Glycine max
  Coding DNA Sequence Number=SeqID_39494
  Subcellular localization annotation: CTP_CleavageSite=41; ConfidenceScore=5.89e-01
MGSPPASTTPPPSPPSPPSPPPPPPTSDASASTSAVKQTRKASRLRSLSTRPPGVERPVVHVDPATGKTDGPHKKKLITYLGIVARDKVDITYENWKEAEFDIPEAFDSRMKRKLLQTVGERWRQFKSDLTRKWALAADQDDVEDTVCDKYGISKEKWAQFCQTHIDPSWEDARIKAQAIQKHNTASHVLSRGGYDYLEQKLLAEKTKKKMQEAAQSGSVDGIIDPPSPVRRHVKWKMARTKKTGEMTTEAAKEIAEKIDSFEEQATQGLFVPHGRQD

SEQ ID NO: 156273 - protein, 77 aa, Glycine max
  Coding DNA Sequence Number=SeqID_39495
  Gene Ontology: Mol. function=electron transporter, transferring electrons within the cyclic electron transport pathway of photosynthesis activity; Cellular component=integral to membrane; Biological process=...
  Gene Ontology: Biological process=photosynthetic electron transport in cytochrome b6/f
  Homolog annotation: Hit_ID=Q6EW21; Match level="QueryCoverage=98%, HitCoverage=59%, E-value=9e-30, Identity=74%"; Hit description =Cytochrome b6-f complex subunit 4
  Subcellular localization annotation: CTP_CleavageSite=39; ConfidenceScore=5.20e-01
MVVATGRRNGFWNLLTFSKKGTVNNPKYHSGNISKGVANGSAGSPIMDGSRTAKPTLQAIVPRITTGKIYKDRWAMQ

SEQ ID NO: 156274 - protein, 198 aa, Glycine max
  Coding DNA Sequence Number=SeqID_39496
  Homolog annotation: Hit_ID=Q6CQF2; Match level="QueryCoverage=20%, HitCoverage=49%, E-value=4e-09, Identity=72%"; Hit description =Kluyveromyces lactis strain NRRL Y-1140 chromosome D of strain NRRL Y- 1140 of Kluyveromyces lactis
ARLGVPRHLRAPSVGLWAPHSARLETRTKESDMCASQRASKPHTCRDPKDGELCLSGAKPEKTLVEARSDTDVQIVRLIWDGCGCSVEPRHGIESSKLGYGAHLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 156275 - protein, 93 aa, Glycine max
  Coding DNA Sequence Number=SeqID_39497
CSTTFAARGFGTRPYAAGGGSGGEAVVVSPRAGVDSLIADTLVIDMDETDLPNALHHHYTIDRYIGSGNTGRTFPSGNNGREPLTCLTKGEEE

SEQ ID NO: 156276 - protein, 237 aa, Glycine max
  Coding DNA Sequence Number=SeqID_39498
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=9e-31, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TLTFRGLYILGIRRLHALTFRGLHVLAFRGLHALTFRGLHVLAIRGLRVLAIRGLHALTFRGLHVLAFRGSCTFTFRGLHVLAFRGLHALTFWGLHVLTFRGLHVLAIRGLHALTFRGLHVLAFRGSCTFTFRGLYVLPLRGLHVLAIRGLHVPTFRGLHAFAFRGLHVPLSKGLHALALRGRYALTFRGLHVLAIIGLHSLAFKRRHILNFRGLHALAFRGLRVLTFSGLHIHTLR

SEQ ID NO: 156277 - protein, 178 aa, Glycine max
  Coding DNA Sequence Number=SeqID_39499
MGEVEEVQKQMKADMEAMKEQMTTMMEAMMSMKKIMEANAVAVAATSVVAKVNLMPSSGLNQMNHLTSAMVGKDLGISPTTTPLTSTAIKNPHAMAEMGKLDHLEERLRVIEGGEDYAFVNLEELFLAPNIITPPKFKVPDFDKYKGTSCPKNHLKIYCRKMGAYAKDEELLIHFFQE

SEQ ID NO: 156278 - protein, 89 aa, Glycine max
  Coding DNA Sequence Number=SeqID_39500
MYTQALSGISLQRILALHYKGVPFTNRRRVSGKISDYKAIGMLKKGFLSMKESLAPTSRLARLSEIWLSAFLALSIKETVFSLNEMMTH

SEQ ID NO: 156279 - protein, 69 aa, Glycine max
  Coding DNA Sequence Number=SeqID_39501
MKHSSKLESGGRMNENAIQGLRKGGRMDDCLEGPHLGNDETQLQTRKWRTHERKRNSWAPKKGKNGGLP

SEQ ID NO: 156280 - protein, 65 aa, Glycine max
  Coding DNA Sequence Number=SeqID_39502
MYVCNQATAYPLGLHISKTTKIKIVTDKVQAATIQVEASTKVVDDNILGEAIIDLTSMCSMDETP

SEQ ID NO: 156281 - protein, 113 aa, Glycine max
  Coding DNA Sequence Number=SeqID_39503
  Homolog annotation: Hit_ID=Q1S8I5; Match level="QueryCoverage=89%, HitCoverage=54%, E-value=1e-15, Identity=36%"; Hit description =Probable Ta11-like non-LTR retroelement protein [imported] -Arabidopsis thaliana
MAQSGVYERGGGKILTLGSFNNKAFMATIAQIWKVGGGVEIKEAGRNIYTLRFLNEKDRAHVEEVGSWCFDRRLVVLNSMSIEENPGEVNLNHCPFWIRVYDFLVGFRTEEMA

SEQ ID NO: 156282 - protein, 119 aa, Glycine max
  Coding DNA Sequence Number=SeqID_39504
  Subcellular localization annotation: CTP_CleavageSite=23; ConfidenceScore=5.06e-01
MAEWEASKQQSRKSQTKNTHTCSSMAGLQQYNFFPTDLLYPRPQPQQASPKPTVLPLQTPNVQDHTQPQQPPRTNATPSTSAVLSSQKGHSIAAVDNKLSKFSSDPLSCLLWITDDEDF

SEQ ID NO: 156283 - protein, 347 aa, Glycine max
  Coding DNA Sequence Number=SeqID_39505
  Gene Ontology: Mol. function=oxidoreductase activity; Cellular component=integral to membrane; Biological process=response to gibberellin stimulus
  Homolog annotation: Hit_ID=Q2HRI0; Match level="QueryCoverage=90%, HitCoverage=98%, E-value=4e-92, Identity=52%"; Hit description =Immunoglobulin/major histocompatibility complex; 2OG-Fe(II) oxygenase
  Pfam annotation: Domain name=2OG-FeII_Oxy; Domain location=199-298; Score=49.6; E_value=1e-11; Accession=PF03171.10; Description=2OG -Fe(II) oxygenase superfamily
MTTHIKYKYTSFPVSESKQLFGKTREQKLGSSIMGSERECQLPLPVVDFCDENLKPGTDTWVSACDVVRGALEDHGGFLALYNKVDPLLYDSVFSAMEQLFDLPLETKMQHTTDKPIYSYAGQRPDIPLYESMAIANPLNDKDCHEYTNIMWPQGNDQFSESVNSYAKKVVELDYLVKRMVFESYELDNKKFESLLESTDYILRCYKYRTSKGGETNLGVHPHTDSGFLTILNQKLNGLEIQLKDGEWFKVDASPNMFAVLAGDAFMVWSNDRIRGCVHQVFMNSKVDRYCLGLLSYAGKVMEPEEELVDEEHPLRYKPFDHYGYLRFFLTEEAVKSASRIKAYCGI

SEQ ID NO: 156284 - protein, 236 aa, Glycine max
  Coding DNA Sequence Number=SeqID_39506
  Gene Ontology: Mol. function=oxidoreductase activity; Cellular component=cytoplasm; Biological process=response to gibberellin stimulus
  Homolog annotation: Hit_ID=Q2HRI0; Match level="QueryCoverage=99%, HitCoverage=73%, E-value=1e-104, Identity=72%"; Hit description =Immunoglobulin/major histocompatibility complex; 2OG-Fe(II) oxygenase
  Pfam annotation: Domain name=2OG-FeII_Oxy; Domain location=146-235; Score=32.2; E_value=1.9e-06; Accession=PF03171.10; Description=2OG -Fe(II) oxygenase superfamily
MKPGTDAWLSACSVVRTELENNGFFMARYDKVGKELCDSVVFAVEEFFGLPVETKAQKTSDKPFHGYLGQVSWLPLYESVGIDDPLTLQGCQKFAHIMWPEGNGRFCESINEYAKLLGELDHMAKRMVFESYGVDMQRCDSFIESNDYLLRCMKYRTPQMDENDLGLQPHSDLTITSIVHQLNNLNGLEIKLKDGEWKEIDASPSLFVVMAGDAFNVWSNGRIRPCEHRVTMNGKK

SEQ ID NO: 156285 - protein, 71 aa, Glycine max
  Coding DNA Sequence Number=SeqID_39507
MLLNSNVIHVRVVMLVRMIHTHLFAAARVKSCPGMHSRCVIASLSGCARTVGRPLISGGGPGTDKRKLLAP

SEQ ID NO: 156286 - protein, 219 aa, Glycine max
  Coding DNA Sequence Number=SeqID_39508
MAEPSKKLKGSSSRSQRHSEVQDTPIHSSISSSSLFSLEEQRIRYTNLFSSRSIIDPKFIDMDFFSDESFECIQSFQNSNLIPFMSLKLPVYSELVKAFYSNLEIQESTLISDVYGIKMVIDQSLFYDLTQLTSEGVPFEGTLDDDWKFDFSMHDARRLVCTNQADMTGRFWAHGLSMSPLIYLSSSFSRKLLKELLKEVFSKKLLKEVFLRKLLKEAT

SEQ ID NO: 156287 - protein, 127 aa, Glycine max
  Coding DNA Sequence Number=SeqID_39509
MEAMKEQMATMMEAIMSMKKIMEANAVAAAATSVVAKVNPMPLFDINQMNHPTSDIVGKDLGSTGGPLMCKFKMSTPSRHMACLPTIHHPMRHTLPMRISITPLLYPLRANNPELSCKCLLTHGGGT

SEQ ID NO: 156288 - protein, 1152 aa, Glycine max
  Coding DNA Sequence Number=SeqID_39510
  Gene Ontology: Mol. function=calmodulin binding; Biological process =protein amino acid phosphorylation
  Homolog annotation: Hit_ID=Q1T1F5; Match level="QueryCoverage=97%, HitCoverage=100%, E-value=0.0, Identity=44%"; Hit description =Calmodulin-binding, plant
  Pfam annotation: Domain name=CaM_binding; Domain location=1034-1148; Score=240.3; E_value=4.1e-69; Accession=PF07839.2; Description=Plant calmodulin-binding domain
  Pfam annotation: Domain name=CaM_binding; Domain location=524-638; Score=190.8; E_value=3.2e-54; Accession=PF07839.2; Description=Plant calmodulin-binding domain
  Pfam module annotation: Pfam domain module=CaM_binding::CaM_binding; Domain location=1034-1148::524-638
MKVEIEGSHSDYAESVSSQPENRGRLESKKKLKKVRSIRLVRLPSKRSSTRGGRPQYDPLSIDTKSLEGPTPIEMADASPNYMKATSSSHAKDSFQNTERILFTKKTLTRMSTALKLKRSLTRKISGRTEPKRKLKSSRSVRFAAVKGQKSTRKFYESSYGSDDQNWRSASDAANKPQRVMTRRLSLKPVRILTKMPTFKSNNSSMESGHQMSQSPDTSLHRATCSSALKDSHFPDHIDLPQEGSDSQGVSAVKVCPYSYCSLHGHCHANLPPLKRFVSMRRRALKSQKPTKMDRQPVTRSKQIGNAKKAAPKTQTIHGEDGRSHFENKKKMARGLWIRPHGTPASTVSEGVESTSTDGVEFSAPDTEILDGEVTNTGITSKNMEPDYEVLTMSSVQKEPTDMACGMKERDKKYAKMWQLMYKHAVLSTTGENKQQFDGKDKEGRDQDSLATNEVNKSCSDGCDTDQDMDDENKDAIELVQKAFDEILLPEPEDFFSDDQFKSEGIDSDEAHLQKSEAERERNTSTSTQSPRAQRMGTKPDQRGPKSWSNLKKLILLKRFVKALEKVRNINPQRPRHFPSDANLEMEKVFLKHQTAEEKKNAEEWMLDYALQKVVSKLAPAQRQKVALLVKAFETILPFQDAENSPRFSATMEPQANPVQPLDDSSNHREEETSFFHDSSMEMEDNDSDDPIPELHNPTMLKERCLDYPGTETVKNKPAFGATEEDLTGKQSLAGSYGNGEKISSDTDNIYLGEIKDTTSSSLNEPVEIIRSSHEEAPTDEIVNDVPEDLLSSVNTENPDMKSESPGRDVETKSLKGDNGRQFSMSKSLVLEGLVRSLRSNLIGSGAPANEAAAERKEEIENVNMGIETLEEFPTKEQSEAPTSAVVEPETPVEKQSNTGLWYLVYKHMVSNVAENNSESLIDGADEKESGLDDIRTGVTSNAYGNTPMKDQEMQFKDHVVVDPEVARQQIEAIKMVEEAIDSILPDDQDDLADKESLTDSTISDNAKQSDRTERMHSEDLNQKEEKMESGNGMIQKQEEESAPKEQNKTNQKMSRSWSNLKKVILLRRFIKSLEKVRKFNPRGTRYLPLEPDSEAEKVNLRHQDMEERKGTEEWMLDYALRQVVSKLTPARKRKVELLVEAFETVMPTIKN

SEQ ID NO: 156289 - protein, 156 aa, Glycine max
  Coding DNA Sequence Number=SeqID_39511
MARIAKVVKVSVQELDRVKQNRNGVVGIPRKNLEQKEKALVDQASSPSFLSKAHSWWRSSFFHGLFPSGWCLPSPLLLCLPLHLHGEKSPLKDLIEAQNPASIEVPQASFHHEGFTNIPLMGTRGCINYNPVLAIRQLGYPMRGAPSEESIAPFIA

SEQ ID NO: 156290 - protein, 477 aa, Glycine max
  Coding DNA Sequence Number=SeqID_39512
  Gene Ontology: Mol. function=GTP binding; Cellular component =monolayer-surrounded lipid storage body; Biological process=lipid metabolic process
  Homolog annotation: Hit_ID=Q1T1F8; Match level="QueryCoverage=99%, HitCoverage=57%, E-value=0.0, Identity=84%"; Hit description=Patatin
  Pfam annotation: Domain name=Patatin; Domain location=233-436; Score =84.1; E_value=4.4e-22; Accession=PF01734.12; Description=Patatin -like phospholipase
MDHISNEASIDRFPIGPSDILGRTIAFRVLFCKSISHFRHHIFLVLLDLFYRFRGGLASFISWLHPRNPQGILAMMTIVAFLLKRYTNVKARAEMAYRRKFWRNMMRSALTYDEWAHAAKMLDKETTKMNESDLYDVELVRNKLQELRHRRQEGSLRDIMFCMRADLIRNLGNMCNPELHKGRLQVPKLIKEYIDEVTTQLRMVCDSDSEELSLEEKLAFMHETRHAFGRTALLLSGGASLGASHVGVVKTMVEHKLMPRIIAGSSVGSIMCAVVATRTWPELQSFFEDSWHSLQFFDQMGGIFAVVKRVTTLGAVHEIRQLQMMLRHLTSNLTFQEAYDMTGRILGITVCSPRKHEPPRCLNYLTSPHVVIWSAVTASCAFPGLFEAQELMAKDRSGEIIPYHPPFNLGPEEGSTPARRWRDGSLEIDLPMMQLKELFNVNHFIVSQANPHIAPLLRLKEFVRTYGGNFAAKLILK

SEQ ID NO: 156291 - protein, 403 aa, Glycine max
  Coding DNA Sequence Number=SeqID_39513
  Gene Ontology: Mol. function=protein binding; Cellular component =membrane; Biological process=defense response
  Homolog annotation: Hit_ID=Q2QR00; Match level="QueryCoverage=83%, HitCoverage=42%, E-value=1e-59, Identity=40%"; Hit description=NB -ARC domain containing protein, expressed
  Pfam annotation: Domain name=LRR_1; Domain location=255-276; Score =2.3; E_value=1e+02; Accession=PF00560.23; Description=Leucine Rich Repeat
  Pfam annotation: Domain name=LRR_1; Domain location=278-300; Score =10.4; E_value=3.2; Accession=PF00560.23; Description=Leucine Rich Repeat
  Pfam annotation: Domain name=LRR_1; Domain location=302-324; Score =15.6; E_value=0.18; Accession=PF00560.23; Description=Leucine Rich Repeat
  Pfam annotation: Domain name=NB-ARC; Domain location=1-141; Score= -123.8; E_value=0.022; Accession=PF00931.13; Description=NB-ARC domain
  Pfam module annotation: Pfam domain module=LRR_1::LRR_1::LRR_1::NB -ARC; Domain location=255-276::278-300::302-324::1-141
MGTVASYKLQSLSPKNSLSLFVKWAFKNEGEEEKHPHLVNIGKEIVNKCKGVPLAVRTLGSLLFSKFEANEWEYVRDNEIWNLPQNKDDILPALKLSYDFLPSYLRQFFALFSLYPKDYEFDSVEVARLWEALGVLAPPRKNETPEDVAKQYLDELLSRSFLQDFIDGGTFYEFKIHDLVHDLAVFVAKEECLVVNSHIQNIPENIRHLSFAEYNCLGNSFTSKSIAVRTIMFPNGAEGGSVESLLNTCVSKFKLLRVLDLIDSTCKTLPRSIGKLKHLRYFSIQNNRNIKRLPNSICKLQNLQFLDVSGCEELEALPKGLRKLISLRYLEITTKQPVLPYSEIANLISLALLTIEVTLELLLRHGRINSQISMLGFSIVHQDYSVISWFIMLILCPYRKDSG

SEQ ID NO: 156292 - protein, 340 aa, Glycine max
  Coding DNA Sequence Number=SeqID_39514
GESISGTIDGLMKNDPNMDLAWEIKALCISHRVRGINASCRPFLCLPLSEESGNYCVEHFSEESTYIELGLVSSLNRERQGTIWNNGAKWSLQTRKREDSNSGIFQQQGFHGNNSANLEGVSGYRNQRSKKEPLHFKFLNEKDRALVEEGGDTKDIDLDDLPYGTWMKSSPMRANMETGIRNEVKIGIFRRRIYYLDKGSITRKEKETKQAIPLMMVKVILESLCLSVITDGSECVDKEKGNEKTTKNITGLVIEWKNEDNTKSLEIKEIKNTNNNGGMKWKRRAREKGGEGQNTIIWGNPWAVKAFRNLLSIEGFGKKRAGGLMVLWNNSVEIDYKVGP

SEQ ID NO: 156293 - protein, 127 aa, Glycine max
  Coding DNA Sequence Number=SeqID_39515
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=93%, HitCoverage=31%, E-value=4e-28, Identity=59%"; Hit description=DNA -directed RNA polymerase beta chain
  Pfam annotation: Domain name=RNA_pol_Rpb2_6; Domain location=1-117; Score=-107.4; E_value=1.1e-07; Accession=PF00562.18; Description=RNA polymerase Rpb2, domain 6
DGELALGKNVLVAYMPWEGYNSEDAVLINERLDMPYLQDGRPVDMVFNPLGVPSRMNVGQIFECSLGVAGGDSFKQPAIMGKPYIFEIIHQVDDKIHGLSSGHYALVTQQPLRGRAMQGGITGKLIV

SEQ ID NO: 156294 - protein, 124 aa, Glycine max
  Coding DNA Sequence Number=SeqID_39516
  Homolog annotation: Hit_ID=Q8H6Q8; Match level="QueryCoverage=41%, HitCoverage=1%, E-value=2e-07, Identity=52%"; Hit description=CTV.20
MDDLSISKIPQDTLYVPQTIKDKHNFDYVINNVENNIPLGQDIWEEFHLLSKNSIFEHNRKYKYLQIGCVQVAIKPLIDIGIDATILMCLRDIRHNKFEDSLIGIVETSLGQGPVYFNCYPNKT

SEQ ID NO: 156295 - protein, 81 aa, Glycine max
  Coding DNA Sequence Number=SeqID_39517
MLHPNCRCFLARVLSDPFQRVRTAMDDSGRNKTEAVHSYQAPHDGDGHTIVTNMRSSKTSTTQRRPDHCLGEEVAVKILNI

SEQ ID NO: 156296 - protein, 100 aa, Glycine max
  Coding DNA Sequence Number=SeqID_39518
MKQKGTLRIREWVRRRRDRRRVSGYDETGDGRKEKKEWEFKAVASCTSKLFPASFPDWSFRNKKKECILECNFTFWIDQKEGAGSNSWNSILTGPLLHWW

SEQ ID NO: 156297 - protein, 117 aa, Glycine max
  Coding DNA Sequence Number=SeqID_39519
NDGVIFEGSKKAIQIKRGISFNALKKKIGDVETMLESFKQQDQMSVLELYIEKDVASGSMFHSINSLTSCGNYLSNDETQPPTNMSNLNIDEDDDDDDYLVSNSYVEESLDEDDSVD

SEQ ID NO: 156298 - protein, 250 aa, Glycine max
  Coding DNA Sequence Number=SeqID_39520
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-42, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHSLAFRGLDVLSFRGLHDLTFRRLHALAFRVLHTLAFIGLHALPLKGLHILAFGGLHVFAFRGIHIVTIRGLHALTFRGPHVLAFRGLHALPFRGLHVLAIRGLHVLTFRGLHVLALRGLHAFAFKGLHVVAFRGLHVVAIRGLHALTFRGLHVLTFRGLLVLSLRGLHALAFRGLHVVTFRGLHALVFRGLHVLAFSGLHVLLFRGLHALSFRGLHILTFRGLHTLAFRGLHDLAFRGLHSLAFRGLD

SEQ ID NO: 156299 - protein, 307 aa, Glycine max
  Coding DNA Sequence Number=SeqID_39521
  Homolog annotation: Hit_ID=Q1SDS1; Match level="QueryCoverage=37%, HitCoverage=23%, E-value=2e-12, Identity=36%"; Hit description=IMP dehydrogenase/GMP reductase
MDWDQLLAGIGSRTISWFPRWKEGKEGVLFSCGRYPNIPLIGTRGCINYNPTLAIRQLGYPMRGAPTEESMSPFLVRDLGAQNSKTIQRIHKAWETPLRKDQELRGIRNGIIGGYHEWLKVRIRENETTARALEQETKKARKEEYGRNKFRGALWGSNNELKLRREERDQSRAHSMVLKEELVACSRSKRSLSQHLCETETNMLAIIAKYQEELGLATAHEHRIADEYAQVYTEKEARGRVIDSLHQEATMWMDQFALTLNGSQELPRLLAKAKAMANTYSTPEEIHGLLGYCQHMIDLMAHIIRNR

SEQ ID NO: 156300 - protein, 93 aa, Glycine max
  Coding DNA Sequence Number=SeqID_39522
MTVADSIKTTLPKIESAKRFIGLVGEYSQTADKSFVGTLMSTLTTMKFDGSRTMYEHVIEMTNITRFLTIQTISPNEKFIFMGYEVKAHSGNS

SEQ ID NO: 156301 - protein, 262 aa, Glycine max
  Coding DNA Sequence Number=SeqID_39523
MAKFDPYIVLEFYANAWPTKGGVRDLRSWVRGQWIPFDADALSQFLGYMLVLEEGQECEYSQRRNRADGFDEEAIAQLLCIPGMPPTRHPLDPDKSNRALGFPALITILCQSFGVPVTPSKVIRPPITRAFIEKYCTARQAQGGDPQAPDAPPPPPQADPAGSFDTERYLRHLVRQQAANHRAHVQTHDYLYQLSLSLQSQGFPPFPCPTLDQFRAEVAWPEDWPEAQAGEAPAEAPGDADEARMDEEMTNLLDFLGGSGVT

SEQ ID NO: 156302 - protein, 155 aa, Glycine max
  Coding DNA Sequence Number=SeqID_39524
  Homolog annotation: Hit_ID=Q47336; Match level="QueryCoverage=34%, HitCoverage=60%, E-value=1e-07, Identity=51%"; Hit description=LacZ -alpha peptide
GFCFYQLSLLFSYCGVVRNGKKPPGHQALASVAVPPAAAIGAGLFAITPAGERGMCCKAIKLGNARGRCSVCFALDTFSSTLGFFGHYAEILDDFGSILGMVHHHIKLIDTVDLEGGPVGKPVVPAALMNRPTRGERRFAYWALAECILGLLCWH

SEQ ID NO: 156303 - protein, 107 aa, Glycine max
  Coding DNA Sequence Number=SeqID_39525
MTINHDLPVWRPSCCSGGIFRDHHGFVLGFFSAYLGIHSALYAKCVAIILALEKKLETGKGIPVLICLLIMGLLQGHVFFFFLWDHAPSFVSESLPNRVSLPSYEFT

SEQ ID NO: 156304 - protein, 325 aa, Glycine max
  Coding DNA Sequence Number=SeqID_39526
  Gene Ontology: Mol. function=hydrolase activity, hydrolyzing O -glycosyl compounds; Cellular component=membrane; Biological process =carbohydrate metabolic process
  Homolog annotation: Hit_ID=Q8LBY4; Match level="QueryCoverage=94%, HitCoverage=64%, E-value=1e-117, Identity=66%"; Hit description=Beta- 1,3-glucanase, putative
  Pfam annotation: Domain name=Glyco_hydro_17; Domain location=23-325; Score=380.3; E_value=2.9e-111; Accession=PF00332.9; Description =Glycosyl hydrolases family 17
MSTVAIFLIFLLLLSRSKASSNIGVNYGQLGNNLPSPHRSIELLTTMKAGRVKIYDANPEILRLLSNTKLKVSIMIPNNEISGIAANQSIADEWVRNNVLPYYPNTMIRYLLMGNEVLSYNSEQGHQMWRDLVPAMRSIERSLRAQNIRDIKIGTPLAMDVLQSTFPPSSSAFRSDIRDSVMVPMLKFLDQTKSFFFIDVYPYFPWSMNSYNISLEFALFRGNSSRTRDPGSGLVYTNLLDQMLDSLIFAMAKLGYPDINLVISETGWPNSGDREELGANTINAATYNRNLIQRMTTKPPIGTPARPGVAIPTFIFSLFDENQKP

SEQ ID NO: 156305 - protein, 200 aa, Glycine max
  Coding DNA Sequence Number=SeqID_39527
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=13%, E-value=3e-58, Identity=53%"; Hit description=Zinc finger, CCHC-type; Peptidase aspartic, catalytic; Polynucleotidyl transferase, Ribonuclease H fold
TLSQFRHEPRKPHWDAALRVLRYIKGTPGQGLLFSSANDLTLKAFCDSDWGGCHATRRSVTGFCFFLGNSLISWKSKKQVVVSRSSAESEYRAMANTCLELTWLRFILQDLKVPQDAPTPLFCDNQAALHIAANPVFHERTKHIEIDCHIVREKLQAGMINPSYVPTKFQLADVFTKALGKDQFVTLRNKLGLHDIHSPT

SEQ ID NO: 156306 - protein, 596 aa, Glycine max
  Coding DNA Sequence Number=SeqID_39528
  Gene Ontology: Mol. function=N-acetyltransferase activity; Cellular component=intracellular; Biological process=metabolic process
  Homolog annotation: Hit_ID=Q2HRG1; Match level="QueryCoverage=99%, HitCoverage=99%, E-value=0.0, Identity=68%"; Hit description=BRCT
  Pfam annotation: Domain name=Acetyltransf_1; Domain location=130-208; Score=29.4; E_value=1.3e-05; Accession=PF00583.14; Description =Acetyltransferase (GNAT) family
  Pfam annotation: Domain name=BRCT; Domain location=413-489; Score =25.1; E_value=0.00024; Accession=PF00533.16; Description=BRCA1 C Terminus (BRCT) domain
  Pfam annotation: Domain name=BRCT; Domain location=497-580; Score =1.0; E_value=3.9; Accession=PF00533.16; Description=BRCA1 C Terminus (BRCT) domain
  Pfam module annotation: Pfam domain module=Acetyltransf _1::BRCT::BRCT; Domain location=130-208::413-489::497-580
MAPKRKPSSPISIGNCEITVEANRFTCNSDSNGVVISLPRSGKIKVSAAVAANRGSASEDFRSGDKEHEFVLVNPKDVDAISKSYLQEVLQMYMTELPGMNYAANTGKQSKFLERCVTNGKYRTLLIKSTSVGISGKVIAAITYQIIPADTEYAEIPLAAVNAFYQRKGFGHLLFLELRKRLQSVGVRSILCWGDKESEGFWLKQGFVEIAQVGTKGRARRLPVKADIQKSLCFLGGSTLMVCHLGKEFLADDANTVKYLPSQFHQNSFASAIAGDEQLEFSGKLHVDLKFPDKSSHRIESEFDRHNAKACCTAIAPFAKIIDNRQASAESSQDGIDANVKYSSQSTKGSKRAWEASLSSLKSKRVKGSQMVDYQPDSSCSFILETDKANPCFEEVPHDPSITKSSEKCIGDHLPSAKQSFRIMLMNIADDAKKTQLTKVIEDLGGTISHDGSMTTHVVTGKVRRTLNFCTALCSGAWVISSSWLKESFREGRFVDELPHILNDTDYLLKYKSDLKSAILRSKVSPHALFKGGNVISGLEKVNETSTKIFVACEEDTEEAMIAAQKGIWTFSSEWFMNCVMRQELDLEASQFAASL

SEQ ID NO: 156307 - protein, 303 aa, Glycine max
  Coding DNA Sequence Number=SeqID_39529
  Gene Ontology: Mol. function=GTP binding; Cellular component =intracellular; Biological process=electron transport
  Homolog annotation: Hit_ID=Q2HRG7; Match level="QueryCoverage=92%, HitCoverage=40%, E-value=1e-109, Identity=71%"; Hit description=SDL -1 protein
  Pfam annotation: Domain name=Dynamin_N; Domain location=119-297; Score=-40.4; E_value=0.032; Accession=PF00350.13; Description =Dynamin family
  Pfam annotation: Domain name=MMR_HSR1; Domain location=117-224; Score= 27.3; E_value=3.1e-06; Accession=PF01926.13; Description=GTPase of unknown function
  Pfam module annotation: Pfam domain module=Dynamin_N::MMR_HSR1; Domain location=119-297::117-224
MNPSGSGSATVVVMVVDCIDCDGSFPRTAVKSLFQALERIQDNSKRAKKLPKIVLVATKIDLLPSQVSPARLDRWVRNRARSGGAPKLNGVYMVSSKKDLGVRNLLSFVKDLAGPRGNVWVIGAQNAGKSTLINALAKKQGAKVTKLTEAPIPGTTLGILRIAGVLPAKTKMFDTPGLLHPYLMSMRLNRDEQKMVEIRKELRPRTYRIKANSDPQLCILNQVCMVGQAIQIGGLTRLDLVEASVETIYVIVWASANVSLHMGKIENADEVSRNHVGIRLQVKTRSVNRTGFVKTIRLIKLVL

SEQ ID NO: 156308 - protein, 154 aa, Glycine max
  Coding DNA Sequence Number=SeqID_39530
METGIRNEVKIGIFRRRIYYLDKGSITRKEKETKQAIPLMMVKVILESLCLSVITDGSECVDKEKGNEKTTKNITGLVIEWKNEDNTKSLELKEIKNTNNNGGMKWKRRAREKGGEGQNTIIWGWGKTRKGEQEMEVEYCTSPKKIHRHNGGGC

SEQ ID NO: 156309 - protein, 282 aa, Glycine max
  Coding DNA Sequence Number=SeqID_39531
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q2HRH2; Match level="QueryCoverage=87%, HitCoverage=70%, E-value=2e-64, Identity=69%"; Hit description=N -acetylglucosaminyl transferase component
MRRHCRLWWPKQLLSNKESSSSILLGWFVTCSPSSLDIIAAFTCSEVLLSSYSPGIQMVSGMIQCNEGIIYGTWGSMPSVLEDKSKFSVLGLCVTDPTTSNGLMNGKEDDKKKFSEYGNALQEGGTDRKNNSRSCRCFQLDGSLRKSSQYVLGRSNWVLVMFDSPEQNDVGIHRLPKLHHIHWNGLTMSQYDVPVRFMLSWGTCFPNFGLRSPPCTGNFTHFNSSLVHFTCIFITDTGISSLLAAFQIHKYFARMLFFLAYFHEVAGYFGSGRKWNPEAVVG

SEQ ID NO: 156310 - protein, 372 aa, Glycine max
  Coding DNA Sequence Number=SeqID_39532
  Gene Ontology: Mol. function=transition metal ion binding
  Homolog annotation: Hit_ID=Q7VVI0; Match level="QueryCoverage=75%, HitCoverage=85%, E-value=1e-156, Identity=93%"; Hit description =Phenylacetic acid degradation protein
MPVDLAVGRLEQGILVARAAGGNVGSPHHPDAQAFVAAGVDVAGVVDRHFGVGRVQAADVLVRQAVLAADEHFPQRPELEGRAPPGQGSGRLALGLLVGVGDQRLAHPGAVFVRLDARRQAFAVAWAIALEHGVELAPVDLAEVIVAALGVPLQFGIGNGQAQVFGLRHGLVDHLLAQLVVGEELDLPGHRLGAVGRVGIRRAEHHEGRPPPAVQRVLHHRLLFGRAVQAHLHQQVVALALVEGLLLTDAHHGAGVGAVGATAQRDLVDDGRAVDQPADHADVGPAERGVIEDAGVLGAAGVQVVDQVVARYAQGFGGAVQVEAVAGFVLHLGQQDGLALERRSAGDPVAFRQHADDFGVRVLRDLAHQVLR

SEQ ID NO: 156311 - protein, 32 aa, Glycine max
  Coding DNA Sequence Number=SeqID_39533
MAWVTGDPLGLISEFTAQTNKFILIAIYFKRK

SEQ ID NO: 156312 - protein, 130 aa, Glycine max
  Coding DNA Sequence Number=SeqID_39534
MTLPLSNILPSDHNADLPLRKYQLGSCPQDAQWTRRSPTGPWGFQVGLRASVSPTGCPSPPARSYHRDIGKDRTRKTPNGPGKVQQGLGFYEASVAPNKVIRPPINRAFIKKYCTPRQAQGETPQQPGDG

SEQ ID NO: 156313 - protein, 43 aa, Glycine max
  Coding DNA Sequence Number=SeqID_39535
MVGRACMNVLSTCANLRNQEIFMAATEWKHPCFSVLEGEAWAL

SEQ ID NO: 156314 - protein, 79 aa, Glycine max
  Coding DNA Sequence Number=SeqID_39536
MGAPPPPRQTDPTGPLGVDRYPQHLVRQQAANHRGQVQIHECLYRFSLSQQGQRSIPFACPTLEQFGAEVAWPGDWPDA

SEQ ID NO: 156315 - protein, 232 aa, Glycine max
  Coding DNA Sequence Number=SeqID_39537
  Homolog annotation: Hit_ID=O04892; Match level="QueryCoverage=40%, HitCoverage=17%, E-value=3e-28, Identity=79%"; Hit description =Cytochrome P450 like_TBP
MNRKLGYGAQLRANLDPTKGVGRLRQQDGGHGSRNPLRECSILRDGGSPSDSALCAYSERNRVKFLNGTWRLTATLGSRRRRRGPRKELSFLFNSLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 156316 - protein, 56 aa, Glycine max
  Coding DNA Sequence Number=SeqID_39538
  Subcellular localization annotation: CTP_CleavageSite=35; ConfidenceScore=5.13e-01
MAGVGRYMAPTDIFQPTLRNFFYKRWPIMTARFFRASSTEGSFRPTLACCSSHLGG

SEQ ID NO: 156317 - protein, 524 aa, Glycine max
  Coding DNA Sequence Number=SeqID_39539
  Gene Ontology: Mol. function=metalloendopeptidase activity; Cellular component=outer membrane; Biological process=proteolysis
  Homolog annotation: Hit_ID=Q8PMH2; Match level="QueryCoverage=99%, HitCoverage=71%, E-value=0.0, Identity=83%"; Hit description =Peptidyl-dipeptidase
  Pfam annotation: Domain name=Peptidase_M3; Domain location=69-524; Score=496.2; E_value=3.9e-146; Accession=PF01432.10; Description =Peptidase family M3
MNAELANLGTKFSQNVQSEVNASAITVDDVKELDGLSKEQIAAAAEAAKARGQDGKYVITLLNTTGQPPLTNLANRALRQKIYEASVSRGSRGGEFDNTALVSRIMQLRADKAKLMGFPNFAAYNLTNQTAKTPEAVNAMLGKLAPAAVANAKREAADLQAMIDKEQKAARKPTFQLEPWDWAFYSEKVRQAKYNFDESQLKPYFEMKNVLENGVFHAANLEFGLTFKQRTDLPVYHDDVTVYDVFDADGSQLAIFIFDPYARASKRGGAWMNSYVSQSKLTGFKPVVANHLNIPKPPAGQPTLLTWDEVNTTFHEFGHALHGMFSNVKYPYFSGTSVPRDFVEFPSQVNEMWADNPVILKNYAKHYQNGSAMPQALLDKVLAAAKFNQGFATTEYLGAAMLDQRWHQIGADQVPAAKDVMAFERAALEKDGIYYAPVPPRYKTPYFSHIMGGYSAGYYAYIWSEVLDANTQKWFKDNGGLSRKNGDHFRATLLSKGGSEDAMQLFRDFAGHEPQIEPMLEKRA

SEQ ID NO: 156318 - protein, 116 aa, Glycine max
  Coding DNA Sequence Number=SeqID_39540
MMYLSRRAPGSQQIKGTKTIKQGGLWWLASCEFCVICGLWPLVIDYQGLENEVRKLGELLVIDYQGDVIDYQASERNWNTVEASGNRLPACVIDYTEGWVTASGNRLPDLVIDYQR

SEQ ID NO: 156319 - protein, 485 aa, Glycine max
  Coding DNA Sequence Number=SeqID_39541
  Gene Ontology: Mol. function=cyclopropane-fatty-acyl-phospholipid synthase activity; Biological process=lipid biosynthetic process
  Homolog annotation: Hit_ID=Q605Q6; Match level="QueryCoverage=46%, HitCoverage=58%, E-value=2e-78, Identity=58%"; Hit description =Cyclopropane-fatty-acyl-phospholipid synthase
  Pfam annotation: Domain name=CMAS; Domain location=341-485; Score =59.4; E_value=4.7e-20; Accession=PF02353.10; Description =Cyclopropane-fatty-acyl-phospholipid synthase
  Pfam annotation: Domain name=Methyltransf_11; Domain location=406 -485; Score=27.2; E_value=6e-05; Accession=PF08241.2; Description =Methyltransferase domain
  Pfam annotation: Domain name=Methyltransf_12; Domain location=406 -485; Score=15.3; E_value=0.02; Accession=PF08242.2; Description =Methyltransferase domain
  Pfam module annotation: Pfam domain module=CMAS::Methyltransf _11::Methyltransf_12; Domain location=341-485::406-485::406-485
MMYKHEQGIPMKIGNNRPLHGSVLAGVVGVLLLAGCQRESEPAPVADGAPAAETTAAGETPATEAPLDLRDVIENNEREVVGISYPAGIDRYPGLARALQDYATSARSDLQQALDGLGNDKPTMPYELSLSFEKLLETPQLVVVSADGSRYTGGAHGEPLVARFVWLPAQQQMLSADKLVADARAGRRSESLRNASRMIADGTGPQADNFSQFQPLTDDKGQITALRFVFPPYQVGPYSDGTQTADVPAAVLLPHVAKDYEAGVRIGGTQPQDIQVHDPRFFARVMGQGSLGLGESYMEGWWDANVLDEFLVHLMQAHLDERVHGWREVADALKARLFNLQVGQGSYEVGRRHYDLGNDLYQAMLGQRLVYSCGYWRNADDLDTAQEAKLDLVCRKLGLRPGQRVLDIGCGWGEALKFAAERYGVSGVGVTISQEQAEFARELCAGLPIEIRLQDYRELDEPFDAIFSIGMFEHVGDKNYASFFE

SEQ ID NO: 156320 - protein, 533 aa, Glycine max
  Coding DNA Sequence Number=SeqID_39542
  Subcellular localization annotation: CTP_CleavageSite=26; ConfidenceScore=5.20e-01
METISFYKSVTCNVIGMLTNSLTKTPAGFVSSFDKNLIRSVGFQHATDSAKANVAKWRANTRTLWRVEHPKVASAIVALAEAVRSNHQLSSKVGSVLAKLLCTRLDSDELFKHCKDLQEEKKNLADKSLRRSCSQVRFFAKDLDLSLFYPFKDVKDGVQLDEDDLAGEEKATAPPLMLVRRMFDLPLVEGLANQFRSRLLDLWSFSSDASPLMVMRSKYDFHLIEGVRTKVDLGFFGTKGGPWMELSNKKVSPRVNLGFIESWTGDVFDLGFDKLVEFHRGLDFVNLADLGFCKPFGGLTRELSKLGFGRHAVAYMSLTMGGTYCRLSGVLLRTWCALAYMSLAVGGVYWRRSGMLLHTCHLLAHQGWSLGFESLGATIMDVPACCDLGWAFQVGAKLSCSGMFSGFTSDSPYEVIRLKGLWLNLGIISHHCSEFGSLLSVTMVYGRSYLHMRCFRYVRSPHGERPRGAQNMKIECWNNCKLLALSAPLGEVEGVCLECWLVVASPHHFSGKFAIKDDGAAGLPFQVASFILV

SEQ ID NO: 156321 - protein, 286 aa, Glycine max
  Coding DNA Sequence Number=SeqID_39543
  Gene Ontology: Mol. function=RNA-directed DNA polymerase activity; Cellular component=intracellular; Biological process=RNA-dependent DNA replication
MGEEWCKGVKEEVDKLLNASFIREIWAYPKDAYPLPSIDKLVDGVFGFHVLSFLDTYSRYNQIRMHAPDEEKMTFIIEDASFCYRIKWNVKVYVDDMVVKSQSIAQHVSDLEEVFEELREYDMRLNLQKCTFGAGGGKFLGFMITHRGIEANPNECNAILEMCSQTNDQEVQILNGRLASLSRFLLKFVEKVVLALITLAQRPRPYFQSHLVVVKANNPIKKVLRSLNSQEGWWLGSGTRIILKGPNNVTLEQALKLNFRASNNQAKYEALIAGLKLATGVRAEKL

SEQ ID NO: 156322 - protein, 331 aa, Glycine max
  Coding DNA Sequence Number=SeqID_39544
  Pfam annotation: Domain name=Transposase_23; Domain location=178-250; Score=-13.1; E_value=0.031; Accession=PF03017.5; Description =TNP1ENSPM transposase
MDSLLEQATQGSFVPHGRQDILNTTLGRPEHPGRVRVVGTGVTISQYFGQASRASSTSSPSINQQQLADIIGVIKDDIRKLLQDEIRKEVQDEIRKEVQQEHKQQQEDWMRAVEEKQWQNLELMKQELKKSLKVELSHIASHQSAPIKAPEIQALLARVSTKGSCAGPEGSGLLKELLSGGDDLMGLFVVVGENTVLAGLGKVFENSSTIHNVRYENDVVKVQVVRTYMPHAEVPIPTSEVHYLEQAVGTFVTWPTHFVREVTNEVVVGSDKPPSKSVGEPNRLTSVATDDPLGELVKKSYVVYTKPMELAWDGAKFGLPNASNAVDDVYE

SEQ ID NO: 156323 - protein, 218 aa, Glycine max
  Coding DNA Sequence Number=SeqID_39545
MTTLVSTCQWARLPLVDERWQITLRCLHVSSDLSSLDDEGNTKVVSVNGLVCLWLTKGVDNRKVSSRVIGLDCLQMTKDLPSLDDEGETKVVSAKVRITMRCLCVSSDLPSLDDEDLPSPDDEGETKVVSVNGPACLWLTKGANNHEVSLHAIGLDCLWIAKVWITMRCLYVSLDLPSLDDEGETKVVLVNELTYLWLTKVTDNPEVSPCVIGLAVSG

SEQ ID NO: 156324 - protein, 100 aa, Glycine max
  Coding DNA Sequence Number=SeqID_39546
  Gene Ontology: Mol. function=RNA-directed DNA polymerase activity; Cellular component=intracellular; Biological process=RNA-dependent DNA replication
MTSPVKQKLQRMKPEMSLKIKEEVKKQFDTSFLAVARYPEWVANIVPVPKKDEKMAPEDMEKTTFVTLWGTFCYGDVLWAQEHRGNLSMGYGSIVPRHDA

SEQ ID NO: 156325 - protein, 239 aa, Glycine max
  Coding DNA Sequence Number=SeqID_39547
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=3e-35, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHTLAFRGLHALAFRGLHILAFRGLHVLAFRGLHVLAFRGLHVLAFRGLHVLAFRRLHVLAFRGLGILAFRGLHVLAFKRLHALALRGLHAFAFRGLHALAFRGLHVLAFRGLHALTFRGLHVLVVRGLHVLAFRELHIFTFRGLHILALSGLHVLTFRGLHVLAFRGLHALTFIGIHVLAFRGLHVLAIRGLHVLAFRGLHILALRGLQVLVFKGLYVLAFRRLHIRKFRELKVLCP

SEQ ID NO: 156326 - protein, 61 aa, Glycine max
  Coding DNA Sequence Number=SeqID_39548
MGLNQAHAFKDRFIKSRKECTLRCLYRTHARARVMSEEEDKVQEWIKADIEALMLDRVASE

SEQ ID NO: 156327 - protein, 61 aa, Glycine max
  Coding DNA Sequence Number=SeqID_39549
MENEQFLIEQTWRSTQERMSLEVVFRIGCAVGGFVVDLGVAFVDDWVDGSLLVELLWRLDL

SEQ ID NO: 156328 - protein, 66 aa, Glycine max
  Coding DNA Sequence Number=SeqID_39550
  Gene Ontology: Mol. function=RNA-directed DNA polymerase activity; Biological process=RNA-dependent DNA replication
MACLEGQKVAFGTYTLVEEAESWWENTRQYLEAEGQDVTWDVFKRVFLEQEGDGVLGAQVGKHDCG

SEQ ID NO: 156329 - protein, 52 aa, Glycine max
  Coding DNA Sequence Number=SeqID_39551
MAITEATGLQMRSYGHEIILGRGGFSGIVVSNNKGEDERKETITLSCKGNTQ

SEQ ID NO: 156330 - protein, 45 aa, Glycine max
  Coding DNA Sequence Number=SeqID_39552
MGQDDTGAEDDVSLRLSTGFLAPDWQRGAEDDVSLCMLPDIEYDG

SEQ ID NO: 156331 - protein, 203 aa, Glycine max
  Coding DNA Sequence Number=SeqID_39553
  Gene Ontology: Mol. function=structural constituent of ribosome; Cellular component=ribonucleoprotein complex; Biological process =ribosome biogenesis and assembly
  Homolog annotation: Hit_ID=P49692; Match level="QueryCoverage=42%, HitCoverage=32%, E-value=7e-17, Identity=52%"; Hit description=60S ribosomal protein L7a-1
MGVWFGCFSVDKHMCKEEERLTSEEAHAKAAEAAQKRLPNEVERLWLLPLRPSLYITTRSSIRLGIWLFAIFFLIFILKVIFSVLKSQEKVSNLLFEKRPKKFRIGGALPPKRDLTRFMKWPKNVQIQRKKRILKQRLKVSPALDQFTKTLDKNLGYYFGDVYFVTLRHAPVSHYYSGLRREVNGFKDAKKGVPDLSEYRDVY

SEQ ID NO: 156332 - protein, 147 aa, Glycine max
  Coding DNA Sequence Number=SeqID_39554
  Subcellular localization annotation: CTP_CleavageSite=92; ConfidenceScore=5.29e-01
MAKQDIFSKFRCHMSSFDISGFSASFNPYTTSDEKRKKPNDTTSKMRSFLATSTLASQKEWFLRLHWPGVVRGRPMKMMIVKKDFTFTRLVVAVTRTPTCYSRGSWWGRDCVQGRGGDGRMKKMNRLGWWWKDEENEWGKAMGLGVD

SEQ ID NO: 156333 - protein, 130 aa, Glycine max
  Coding DNA Sequence Number=SeqID_39555
  Gene Ontology: Mol. function=hydrolase activity, hydrolyzing O -glycosyl compounds; Biological process=carbohydrate metabolic process
  Homolog annotation: Hit_ID=P26205; Match level="QueryCoverage=37%, HitCoverage=11%, E-value=5e-16, Identity=79%"; Hit description =Cyanogenic beta-glucosidase precursor
MSGAGFRALILSSVRRTIHKFFHQSALWPIQLENWSDMLASSRVSLGHEKFTQDKTDEAEGICGLDVPAIPCGSHIGIMKYIGIMKYMNLDAYRFSISWSRVLSRGKLNAGVNHEGVNYYNNLINELMAN

SEQ ID NO: 156334 - protein, 76 aa, Glycine max
  Coding DNA Sequence Number=SeqID_39556
MGKRENIGCSHVCGVKRICVSLEKVDDIHDHIGTDSHKVKTKSGKLKETYNNRGRCGGTHVAVWEFKVSHKWKELQ

SEQ ID NO: 156335 - protein, 640 aa, Glycine max
  Coding DNA Sequence Number=SeqID_39557
  Gene Ontology: Mol. function=sequence-specific DNA binding; Cellular component=microtubule associated complex; Biological process =microtubule-based movement
  Homolog annotation: Hit_ID=Q1S664; Match level="QueryCoverage=98%, HitCoverage=98%, E-value=0.0, Identity=70%"; Hit description=Kinesin, motor region; Helix-hairpin-helix DNA-binding, class 1; DNA polymerase beta, N-terminal-like
  Pfam annotation: Domain name=HHH; Domain location=567-596; Score =22.3; E_value=0.0017; Accession=PF00633.13; Description=Helix -hairpin-helix motif
  Pfam annotation: Domain name=Kinesin; Domain location=31-352; Score =383.8; E_value=2.6e-112; Accession=PF00225.13; Description=Kinesin motor domain
  Pfam module annotation: Pfam domain module=HHH::Kinesin; Domain location=567-596::31-352
  Subcellular localization annotation: CTP_CleavageSite=22; ConfidenceScore=5.52e-01
MAATQKPIKSCTPKKLPNAPISVSKVRVIVRVRPFLAHETSSRNGVVSCISVLDQDFESPQDEVTVYLKDPLTSRNECYLLDSFFGQEDNNVGQIFCGEVSPLIPGMFSGCNSTVFAYGATGSGKTYTMQGTEEQPGLMPLAMSMILSICQRTDSTAQISYYEVYMDRCYDLLEVKAKEISVWDDKDGQIHLRGLSQVPINTMSEFQDVFSCGVQRRKVAHTGLNDVSSRSHGVLVISVSTLSADGTGTVACGKLNLIDLAGNEDNRRTCNEGIRLQESAKINQSLFALSNVIYALNNNKTRVPYRESKLTRILQDSLGGTSRALMIACLNPGEYQESVHTVSLAARSRHVSNFVPSGHKQETPKVKVDMEAKLRAWLESKGKTKSAQRLGPLNSPLPKKTPSSIVTPAKRSITFNSSVKKWGKTANLDAQHTNERAFAVAFGNLLDVEGSFHSCMENAPSGVKDNDKKETEHDANKAARKSYKSLPVESLSKGVDSITIDGKDAAQSPLRKALSPININGNEKPLESQTPFLATCSTNKGAQKNDTPLGKFSTRSSTLKNCLVQEYIDFLNNASREELLELKGIGEKMAEYIIDLREESPLKSLNDLEKIGLSSKQAHNLFTKAAKTLFEDKAEDSILG

SEQ ID NO: 156336 - protein, 271 aa, Glycine max
  Coding DNA Sequence Number=SeqID_39558
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLVFRGLHVLTLRGLHALSFRELQVHTYKGLHALAFIGLHVLAGRGLHVLAFRGMHTLAFIGLHVLPFREQHVLAFRGLHVPTFRGQHALAFRGLHVPVLRGLHVLTLRGLHALSFRGLHVLTFRGLHVLAFKGLHVLTYKGLHAHVFRGQHALAFRGLHVLTFRGLHVLAFRGQHILAFGGLHALAFRGLHALIFRGLFALAFRGLHALTFRGLNALAFGGLYALAFRGLHILAFKGLHVLTFRGLHTLALSGLYVLTLKRTTRPRL

SEQ ID NO: 156337 - protein, 70 aa, Glycine max
  Coding DNA Sequence Number=SeqID_39559
MGLSLLLMEHVAALVEGQLGEVNVLQFVMRSQGSSPSSTCGGGTVTYVKAFNEQINSEYDGRVVFNKNGG

SEQ ID NO: 156338 - protein, 37 aa, Glycine max
  Coding DNA Sequence Number=SeqID_39560
MYDPAFERAGVPIDPILRLFNANSAEKPAEEVPENPN

SEQ ID NO: 156339 - protein, 199 aa, Glycine max
  Coding DNA Sequence Number=SeqID_39561
MRICLLANEVVHEVKTKKRAYLIVKFDFEKTCDMQMDWISVGCLQSSFIFVLVNGGPTKEFIAQRGLGKNCSGWILGGVVAIRVRERSGRWKLGELLGSRVVRRRLWSVVIGVRFKSSGRLLIGVVECGHGISHGDSCGYNGKYPLCNNWRRLRRVGSQRVLPGAKARCVSGAVICNDMVVVEAYEPYHLQRSTNGAKD

SEQ ID NO: 156340 - protein, 81 aa, Glycine max
  Coding DNA Sequence Number=SeqID_39562
MRKEVVITGEGGVIVGVVHTKRKVLGFAYTKNEPVLILGTAWGTQQFFKIPKMSLWVFSVTNSRLGFFISAAPFFPKIALP

SEQ ID NO: 156341 - protein, 107 aa, Glycine max
  Coding DNA Sequence Number=SeqID_39563
MTDQRLVPMVHILLYCKIQGLVKISAGPHLSQQDTWIVNHRKMLHGQREPPRRGRPRKHFEPGQTSLPPYKRRKRGNPGKTPLSGGNNTSDGVVIREDQNPRNPSSD

SEQ ID NO: 156342 - protein, 230 aa, Glycine max
  Coding DNA Sequence Number=SeqID_39564
MDKEDLDMGFDWAMVEILCNVSATLPDFPTNVWQQVNEPNVHDMVGTVVATPNMAHNTEEVNSSSMGGNPPQLSVNDSYQLPLLSPNTSAPLLDPDAESNCYIPSMVGLISEGVGSSVQAQDITIPMNYNNQYPLMQNNNLPLRPELGQVNENNTSNQLLVSNMLANQNFNEFNALFSSYPSFFKQNPVSAQAGAWSWTTNGHFMTNQTSPAFALNNRGINPPSAWNYPR

SEQ ID NO: 156343 - protein, 106 aa, Glycine max
  Coding DNA Sequence Number=SeqID_39565
MAPTKASSKEMEDTSVGKSGHSFFPCYNNPWTLAKELLMGLKEQLASKSTPPHVSSSLLEGGFETLVQKPWWFCFDFTMVACGNAMIKCIAKGNDNDSQGVIALFL

SEQ ID NO: 156344 - protein, 106 aa, Glycine max
  Coding DNA Sequence Number=SeqID_39566
MQIVLFGNDLDECDTFNCEEGANKKQVGGAEAGSQNASLGRDASSGRSNRDETCVNDGSDRSNFQWCRLFRLFLTETEEKCCPLNIIKQCGRGMTIQGRERWHVDG

SEQ ID NO: 156345 - protein, 206 aa, Glycine max
  Coding DNA Sequence Number=SeqID_39567
MGRPLVHNHTIELAATEAMVAAMREQATSTTNLINQVLRGSSGCEYNSSIAEFGSKEMDNIFEVVPTTEEQKMVYDTFMLKDEAKNWWKDTRERMMALETPVIWENFKITFLEKYFPHNQGLRSDIPNQVGILEIRSYALLVNKCLIVEDNLNKLKADQCLVLKRKSEEMTHPPTIKYKMEGFKGKKVMIFGTPKVEACPKCGKTH

SEQ ID NO: 156346 - protein, 100 aa, Glycine max
  Coding DNA Sequence Number=SeqID_39568
  Subcellular localization annotation: CTP_CleavageSite=63; ConfidenceScore=5.10e-01
MTICYDYTTTCCLLLFFFGISPNSSQKPPSLNPTDPSLPVQQFILFTLFLHPTSPAMIKLLCRVMVIDMLLFKYIMFPNVGNGHSPRCHESLHSVAWTSF

SEQ ID NO: 156347 - protein, 43 aa, Glycine max
  Coding DNA Sequence Number=SeqID_39569
MGEANFGNYMEVTFRKRQVLKKIKLPSTAENHLFINRQKPPVL

SEQ ID NO: 156348 - protein, 597 aa, Glycine max
  Coding DNA Sequence Number=SeqID_39570
  Gene Ontology: Mol. function=protein phosphatase type 2C activity; Cellular component=protein serine/threonine phosphatase complex; Biological process=protein amino acid dephosphorylation
  Homolog annotation: Hit_ID=Q1SBX2; Match level="QueryCoverage=99%, HitCoverage=100%, E-value=1e-137, Identity=51%"; Hit description =Protein phosphatase 2C, putative
  Pfam annotation: Domain name=PP2C; Domain location=261-560; Score =72.9; E_value=1e-18; Accession=PF00481.12; Description=Protein phosphatase 2C
MGNRISNLCLCSSGDASRRFENRAFFLSKQHQNSLGNSICYVRPDTCRFSVDDITLLTFRSVSGATVSANTSATPSTSLDDSLQHSVVLDSSASFESSGSFTSTLVPFQHQHARGFSVGGSTERGLYWGLRDRVVNGEGSIEKGYSEVAMKKGKRSKRNLKKVLSRAFLSIGRRSVLKKNDNTNARVSCSTGLSLQGAEGDNDNYLDGDECDVLMGCENLHWAQGRAGEDRVHIVICEDHGWVFVGIYDGFNGPDATDFLLNNLFYAVNDELKEMLCAHNKFESMAMDSDSLELEENVLLSGKGNGGVDGGCSSSEYKENYPIENEELNLECASEGEEGMNGINSQKVDLSHSDVLQALSEALRKTEDAFLKTVDEMIGHNPVLAMMGSCVLVMLMKGQDVYLMNVGDSRAVLATHTGEPLQLTMDHSTQVKEEVYRIRREHPDDPLAITKGRVKGRLSVTRAFGAGFLKQPKLNNAVLETFRVTYIGESPYITCFPSLHHHKLSTNDKFLILSSDGLYQYFTNEEAAAKVESFITMFPDRDPAQLLIEEALGRAAKKAGMEFHELLDIPQGERRNYHDDISIVIISIEGKIWRSLV

SEQ ID NO: 156349 - protein, 134 aa, Glycine max
  Coding DNA Sequence Number=SeqID_39571
MAQRSLWATKTLSKEVKVAMDVKRVMEGSKSKNVSLGIVRDAKNLILGHEKVGEESRIREGVVESNLQRSCCKEEEEEGRPVRVTLFYENAPTMWDQHRLKGVLKSGVFTPNAYTLKSPSGPLPPDSSPTQKTF

SEQ ID NO: 156350 - protein, 141 aa, Glycine max
  Coding DNA Sequence Number=SeqID_39572
MLLAWDKLTVPKEVGGLGFRELHVFNLAMLGKQGSVKGKVAKNFLNGAPDIVLRENRAVWIAPNNGMVKCNVDIAFMKLESKTRWGIFLHDCHEHFVVAKTVAENVYHDIMQEEKLEESQEIARDAAIAAGTHVSSLRGKG

SEQ ID NO: 156351 - protein, 71 aa, Glycine max
  Coding DNA Sequence Number=SeqID_39573
MVGAFSQNIVTLTGLPMILLSESDLTNPLCGVSCYVLLSAPGWFFTDMMNRWMTMKNLMLEDTGTPRSDRM

SEQ ID NO: 156352 - protein, 70 aa, Glycine max
  Coding DNA Sequence Number=SeqID_39574
QGAESSQVTVRSQDKLAAEINQGTWGRMQVGIGSRPTKRHPFPALNKQRTSLQGSPVSFAFAVSFTIVLF

SEQ ID NO: 156353 - protein, 336 aa, Glycine max
  Coding DNA Sequence Number=SeqID_39575
  Gene Ontology: Mol. function=two-component sensor activity; Cellular component=membrane; Biological process=two-component signal transduction system (phosphorelay)
  Homolog annotation: Hit_ID=Q2XL27; Match level="QueryCoverage=98%, HitCoverage=47%, E-value=1e-93, Identity=52%"; Hit description =PAS:GGDEF
  Pfam annotation: Domain name=EAL; Domain location=247-336; Score= -98.0; E_value=0.00038; Accession=PF00563.11; Description=EAL domain
  Pfam annotation: Domain name=GGDEF; Domain location=72-233; Score =227.8; E_value=2.3e-65; Accession=PF00990.12; Description=GGDEF domain
  Pfam module annotation: Pfam domain module=EAL::GGDEF; Domain location=247-336::72-233
MSAELSDYFNSLADIALRSEGIHAREQLLLTAGGERVLHTRATTISGKDMRQNYVMLIVEDVTDQREADARIRHMAHHDNLTSLPNRILFRQKLSEALRVDQQQGQTSATLCLDLDNFKNVNDALGHQIGDDLLRVVAKRLRSVLRDQDTLARIGGDEFAIVLPNVRNADEAAIVAQRLIEAIRPPVNVEGHNLSVGLSVGIALTSQATNTPEHMLRCADMALYEAKRNGRNRYEHFTLEMDNVARSRRVIENDLREAITGRQLKLYYQPITNETGIIGYEALMRWHHPIKGLIMPNDFIPIAEETGLIHMLGAYALYEACREAQSWETEQSVSVN

SEQ ID NO: 156354 - protein, 156 aa, Glycine max
  Coding DNA Sequence Number=SeqID_39576
  Gene Ontology: Mol. function=helicase activity; Cellular component =intracellular; Biological process=metabolic process
  Homolog annotation: Hit_ID=Q9FFE3; Match level="QueryCoverage=97%, HitCoverage=64%, E-value=1e-39, Identity=38%"; Hit description=Salt -inducible protein-like
  Pfam annotation: Domain name=PPR; Domain location=23-57; Score=35.7; E_value=1.6e-07; Accession=PF01535.11; Description=PPR repeat
  Pfam annotation: Domain name=PPR; Domain location=58-92; Score=51.8; E_value=2.2e-12; Accession=PF01535.11; Description=PPR repeat
  Pfam module annotation: Pfam domain module=PPR::PPR; Domain location =23-57::58-92
EGKAVDARGVLDEQEKGEVASSLTYNTLIAGMCERGELCEAGRLWDEMAEKGRAPNAFTYNVLIKGFCKVGDVKEGIRVLEEMVKSGCLPNKSTYSILVDEISLSEGKKEEIDKVVLLAMTTGVDGELWDLFLKLVVDNLDGNAAELDRILTENLV

SEQ ID NO: 156355 - protein, 116 aa, Glycine max
  Coding DNA Sequence Number=SeqID_39577
MSPSTRDESGGMTSSTTFNYALGEQTIQVRNTSTRRSHFGLQYINYEPDIYHAHGICLFMNYLGGYGAEENKNIDKLAVVRTTRDTEVTEVRQCTLPSAEAVTVVQGRFRPTLNGG

SEQ ID NO: 156356 - protein, 142 aa, Glycine max
  Coding DNA Sequence Number=SeqID_39578
MSSGSDASAYEEPIPKIDTTSVHTEGVLQRYSNYPPRADQNLLVKGSIQNVLAGEDDAVSQFGIANKIMFKQANRKQTKRQERKSKEEAEILRKEQWTKKKHEPAPVSNVSSRRLRATTSKRSPKKQAVDGCKYQHQTQRHE

SEQ ID NO: 156357 - protein, 185 aa, Glycine max
  Coding DNA Sequence Number=SeqID_39579
MAPKRLSFTPSGMPSRSFKMPKSEMEGSKGNPGKEHHMKEMKETVTKGGVNLVPKKLDTSRPEKLFMVGNNMGTRFNFESLCPPRMINPKIVLFTAVRVMHSQMNRPRKTVWCLSPAFEADVIVEKLIDYYEKDWLIPFPYLKLAESMARLLGTIFEFEVFHGGDREFGLWNIIEPRGIPNYATR

SEQ ID NO: 156358 - protein, 139 aa, Glycine max
  Coding DNA Sequence Number=SeqID_39580
MAKANTRKVYVVLQGRVPEASKQTLRFSSNAHRGFNSFEEVEHAWIDVLTMAETSFTRVAIFISETKMNHLVVVVQKMCITWALKRFSALYVLKNTNILYIWAQVALPKPQAATESKRVVADDTDIKDTLREPWLTNDG

SEQ ID NO: 156359 - protein, 233 aa, Glycine max
  Coding DNA Sequence Number=SeqID_39581
MESMGLPCDHIIIVLISLNFIEMLESLILDRWPKDAKDAIKGSYVEGYGFWDYELMGQYVTLAHISRELCDLAHHDEEDYEAKYNTTGNSSATNNESQPSYANIQDPAQVRSKGCDSSTTNVMGTRKRTLNCGKCGGDGTISICPTLSQGVSAEDRGSGVPKFADDIVYNTQMLLSLASISLFFQAFFVSGGDVRCSGVYGEVGLLFVTGEEEPYGLSIRMVIWIVNLYGHTD

SEQ ID NO: 156360 - protein, 419 aa, Glycine max
  Coding DNA Sequence Number=SeqID_39582
  Gene Ontology: Mol. function=helicase activity; Cellular component =mitochondrion; Biological process=embryonic development ending in seed dormancy
  Homolog annotation: Hit_ID=Q9FFE3; Match level="QueryCoverage=73%, HitCoverage=87%, E-value=2e-81, Identity=36%"; Hit description=Salt -inducible protein-like
  Pfam annotation: Domain name=PPR; Domain location=218-252; Score=5.1; E_value=1.8; Accession=PF01535.11; Description=PPR repeat
  Pfam annotation: Domain name=PPR; Domain location=254-288; Score =40.4; E_value=6e-09; Accession=PF01535.11; Description=PPR repeat
  Pfam annotation: Domain name=PPR; Domain location=289-323; Score =36.5; E_value=9e-08; Accession=PF01535.11; Description=PPR repeat
  Pfam annotation: Domain name=PPR; Domain location=324-358; Score =44.1; E_value=4.8e-10; Accession=PF01535.11; Description=PPR repeat
  Pfam annotation: Domain name=PPR; Domain location=359-393; Score =44.1; E_value=4.6e-10; Accession=PF01535.11; Description=PPR repeat
  Pfam module annotation: Pfam domain module=PPR::PPR::PPR::PPR::PPR; Domain location=218-252::254-288::289-323::324-358::359-393
MRTKGKVSGELLLGSFYRNEHHIFRGWADKQTIPIEKWWFPAKRSITEIDFTVQFTHTFVVAIWYLPMLHSILSSPPRRHLHPFSTAAAAAIAANSVPAAASLPSSSFTIQPPIHPWPRRLTPHNLASLISRQHDPNLSLQIFHHAHPSLSHALQPLHALFLKLSRARLFSHLESLLTRLPTPPPEPPLTTLIRAYGVAGKPLSALRLFLKFQPLGLSSLNALLNALVQNKRHRLAHSVFKSSTEKFGLVPNVVSCNILLKALCKRNEVDVAVRVLDEMSLMGLVPNVVSYTTVLGGFVLRGDMESAMRVFGEILDKGWMPDVTSYTVLVSGFCRLGKLVDAIRVMDLMEENGVQPNEVTYGVMIEAYCKGRKPGEAVNLLEDMVTKGFVPSSVLCCKVVDLLCEEGSVERACEVWRGQ

SEQ ID NO: 156361 - protein, 227 aa, Glycine max
  Coding DNA Sequence Number=SeqID_39583
  Homolog annotation: Hit_ID=Q1T493; Match level="QueryCoverage=65%, HitCoverage=30%, E-value=8e-15, Identity=32%"; Hit description =Nucleic acid-binding, OB-fold, subgroup
MARRRDFIRDIDNTKDTLKLAVRIIDLWFVETKDTSKQAEMIIMDENVALFNFLMLLIDIAEKIHVLIRKEELKTWKLTQKENNTYMMHNFKIDLPNIPLKAYEFVNFADIFARTYRRDQLVDVIGVVHELTSHHVLSSPKRVLFTMKDLRVGVSLPIGVLTQSSSQKGCSLSQSSGSSQYLEKEKFFYKAEVKSLFEINDITMIVLLLALSKELLWRIMDGVMHHA

SEQ ID NO: 156362 - protein, 134 aa, Glycine max
  Coding DNA Sequence Number=SeqID_39584
MTFVGGDKSINVFPDPLDNLMGCTLAFKIKVQPKYRNSSVKKISDDPELMQPIMDLLPDVEQSLFATSDHNPKVTMAATLTKKVVDEVPNHDSQAEMPITPAKRGSTEVFPDDNLSKQFLYAQLSTTKKYFKNE

SEQ ID NO: 156363 - protein, 101 aa, Glycine max
  Coding DNA Sequence Number=SeqID_39585
MLRPKHVVFHFGYQFTKNSYMKMIKRTTYLKGERKCIEPMNGKEDETPQRRRRSLMREWKQGRTGNEEECVKKRKGKGHFSLFTLVVGCPSKNIGCPKQLP

SEQ ID NO: 156364 - protein, 84 aa, Glycine max
  Coding DNA Sequence Number=SeqID_39586
MASEEPIIRDNISNFGDDKQQYDVHGHGESSNKSESSSYFETISSQLSENQEYSNSYQNKGSASTNDLYEGREYRSAKYTRVGS

SEQ ID NO: 156365 - protein, 198 aa, Glycine max
  Coding DNA Sequence Number=SeqID_39587
  Homolog annotation: Hit_ID=Q94BQ7; Match level="QueryCoverage=57%, HitCoverage=9%, E-value=1e-14, Identity=40%"; Hit description =Putative RB-binding protein
MDSFRDMVKNLIEAQKWAEGIRGCVTKIELWLCHRDSNDKKVNLEFIDELLKFTPAPCNEPLYHKLKDYAEEARLLIQDIDTALSMSSNMSELELLYSKACGLPIYMKEIVVLNGLADFIPSLSPSGLWTAVASYGTPNGWAGEVEDFPTHIYVFLTRDRTHRVKVASHRPTSHPTGSPRVHPLPPPQATTTSTTVLK

SEQ ID NO: 156366 - protein, 392 aa, Glycine max
  Coding DNA Sequence Number=SeqID_39588
  Gene Ontology: Mol. function=oxidoreductase activity; Cellular component=membrane; Biological process=metabolic process
  Homolog annotation: Hit_ID=Q3M7H0; Match level="QueryCoverage=57%, HitCoverage=89%, E-value=4e-53, Identity=47%"; Hit description=Short- chain dehydrogenase/reductase SDR
  Pfam annotation: Domain name=Aldedh; Domain location=243-392; Score= -313.7; E_value=0.031; Accession=PF00171.12; Description=Aldehyde dehydrogenase family
  Pfam annotation: Domain name=KR; Domain location=1-175; Score=-72.0; E_value=0.0035; Accession=PF08659.1; Description=KR domain
  Pfam annotation: Domain name=adh_short; Domain location=1-158; Score =78.7; E_value=1.8e-20; Accession=PF00106.15; Description=short chain dehydrogenase
  Pfam module annotation: Pfam domain module=Aldedh::KR::adh_short; Domain location=243-392::1-175::1-158
GIGAAIAKRLAAEGAVVFINYSRGREDANRLVKEINEQGGVAFPLQANVGIEAEVNGLMQNIVEQYGRLDVLVNNAGVYATNSLEAFSDAEYERHFNLNVKGLIYCCKAAVAAMPESGGSIVNISSSVTSFTPANSLVYTASKAAVDSITKTLANELGGRKIRVNAVNPGLVITEGVHDSGFFDTDFKTHIESITPLGRIGTPEDIAPAVAYLASDEAGWVTAKNGTEMTLDKAYGPLINGVFELDGTDIHPVISPSSGERLADLHYCNERDVERAVLAAEAAFPAWKALGQQARARLVAQLADVLESDLERMAQIDARDVGRCISEVRRDYQTAVRHYRYFAAVVMGHEDSGRSIADGYSLAKREPLGVCGQIIPWNAPAIMAAFKLAPAL

SEQ ID NO: 156367 - protein, 103 aa, Glycine max
  Coding DNA Sequence Number=SeqID_39589
MPLYIKFLKDLLTKKGKVYQQRNCRNVPFAGERGRGSWVRFPKEERCAESPPTFICGKRRENRRKPVKMKILSSGVVFTFEEGRQKRGFCSYVPSFGEKIRPT

SEQ ID NO: 156368 - protein, 193 aa, Glycine max
  Coding DNA Sequence Number=SeqID_39590
MGEIEKVQERIKADMEAMKEQMATMIEAMMSMKKILEVNAIAVDADPTPPSSLNQINHPTSNMVGQGGKELRSTGGPHFVQVQNKHVFPPHGLPPNYTPPIVVHTPDENVNNSTPILVESQQPQADHAHVSQPMREAHEIPHHNLANFKPCLGYATKGQAVGGIPLPNTLEGPQFHPQPQPLHFVVGESLLLW

SEQ ID NO: 156369 - protein, 93 aa, Glycine max
  Coding DNA Sequence Number=SeqID_39591
MKPRAWFREISRISQQASCGFFVAIGRPEHRSHVGVVGVGLTIKKYFGLAPRTSRMSSSMAPEDLEQLMQQIRDQLEESITEKVTQRLMLSFS

SEQ ID NO: 156370 - protein, 70 aa, Glycine max
  Coding DNA Sequence Number=SeqID_39592
MRLKLSPWAQNYPKAHENPRAFSCITGSIFLESSIQCPCGVVLHHSLPLEKDLTSNPEVLETLGFFPQQL

SEQ ID NO: 156371 - protein, 98 aa, Glycine max
  Coding DNA Sequence Number=SeqID_39593
MWAFLTGRQIDWAHLVRYRMHKALRANAPLPYPQLVTLFLHHFQIPLDDEPFVQVRRSFAIGAGANYEASTPMLVNNLIPWIVALKAWIPTSLSLKRM

SEQ ID NO: 156372 - protein, 243 aa, Glycine max
  Coding DNA Sequence Number=SeqID_39594
  Gene Ontology: Mol. function=sequence-specific DNA binding; Cellular component=intracellular; Biological process=regulation of transcription, DNA-dependent
  Homolog annotation: Hit_ID=UPI00006DB9A4; Match level="QueryCoverage =53%, HitCoverage=49%, E-value=7e-21, Identity=49%"; Hit description =COG2207: AraC-type DNA-binding domain-containing proteins
  Subcellular localization annotation: CTP_CleavageSite=69; ConfidenceScore=5.40e-01
GRGVLAAISSAITPASRACAASSGWWGHRSARVVAARSSALGWKMRGVAGRPQAGLGVEVQAPAIEPVCAQQRVGQQGRYPGDVTCGQQPVQVVGGDAQQPLVCTQQLPTGMPVARCATHTALVQPGRQHHRSVGGIGQRGKRRVRVPTLEPTSTERFPMQPQDILPDHQNDVQVNGVTVRKGSVGAFLASVRDWQDPSSDPAFRATAEADLRALLPGLHALGLFQVLVARDPALQHLIDGAA

SEQ ID NO: 156373 - protein, 135 aa, Glycine max
  Coding DNA Sequence Number=SeqID_39595
  Gene Ontology: Mol. function=iron ion transporter activity; Cellular component=outer membrane-bounded periplasmic space; Biological process=iron ion transport
  Homolog annotation: Hit_ID=Q8P3V2; Match level="QueryCoverage=61%, HitCoverage=24%, E-value=2e-32, Identity=81%"; Hit description=TonB -like protein
  Pfam annotation: Domain name=TonB; Domain location=61-95; Score=51.2; E_value=3.4e-12; Accession=PF03544.4; Description=Gram-negative bacterial tonB protein
QIAAQQDAARRDNERQEAERQAAARRDAEQKQQQAAAQQASAARQAAAAAAPTLRPVSTPAPRYPAEALRSGTSGEVLVEITVGTDGSVVSARVLRATSGRTFDREALNAVKRWRFEPVNAPVTTRRTLVFAPGG

SEQ ID NO: 156374 - protein, 91 aa, Glycine max
  Coding DNA Sequence Number=SeqID_39596
MWMDQFALTLNRSQELPRLLAKAKAMADTYSAPEEIHGLLSYLRIKSLPHFISSMHCTLVSSFVTGSRKVHITFLIVHMGHCAPKCASKKR

SEQ ID NO: 156375 - protein, 295 aa, Glycine max
  Coding DNA Sequence Number=SeqID_39597
PVVAILAMYDMFDRGCEKSDARIFCCALALYVWLVSHPFLQEGRPVYPLQGHRSCVEKGKANWDQLLASMEGGCINYNLILAIRQLGYPMRGVPSDESITPFIARGFGDHNARDRELRGSSNGIIGGYHKWLRVRTQGLDWLPNLKTVRDDEVKASEESDEVQALKAELERARVVEEKFKSIAIKESSRVKGMISEEVKGIITGQRHDLEGRAKEKLNLAATHEQRLEDEYAKISVEREARERVIDSLHQEATMRMGLFALTLNRSQELPRLLAKAKAMADTYSAPKEIHGLPSY

SEQ ID NO: 156376 - protein, 84 aa, Glycine max
  Coding DNA Sequence Number=SeqID_39598
MGVIELCVEVDVASASTLNVKNSLLSCGNNIADNESKVQRFTINLDDDSYDDDYMISNSYVEDSLDEEEDIDDISDTDEKCIFN

SEQ ID NO: 156377 - protein, 110 aa, Glycine max
  Coding DNA Sequence Number=SeqID_39599
MSSSKGPRTKLGYDTRSNKDRRKSLKVYQSHTVRGEKVASAQDFVGNQRERTTLGRGFLFLVYLVKVYDKLGFWIKACRTGGHDICQGLANGSGIKGMSYIISMIHMQQC

SEQ ID NO: 156378 - protein, 163 aa, Glycine max
  Coding DNA Sequence Number=SeqID_39600
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=81%, HitCoverage=55%, E-value=2e-49, Identity=72%"; Hit description=MADS -box protein GmNMH7
  Pfam annotation: Domain name=K-box; Domain location=54-162; Score =42.8; E_value=1.1e-09; Accession=PF01486.8; Description=K-box region
  Pfam annotation: Domain name=SRF-TF; Domain location=9-45; Score =33.0; E_value=1.1e-06; Accession=PF00319.9; Description=SRF-type transcription factor (DNA-binding and dimerisation domain)
  Pfam module annotation: Pfam domain module=K-box::SRF-TF; Domain location=54-162::9-45
MARGKIQIKRIENTTKKANELTVLCDAKVSIIMFSSTGKLHKIEQSTKQFFDQYQMTLGVDIWNSHYENMQENLKKLKEVNRNLRKEFRYIYLSSLRSISLRMGDCLNELGMEDLRLLEEGMDKAAKVVRERKRCIAALTCVCGKHKGAATESLNSYVRWGMI

SEQ ID NO: 156379 - protein, 116 aa, Glycine max
  Coding DNA Sequence Number=SeqID_39601
MDEHLLLRTSVGAGVAEAIEGGVEENQAEGGIGGAPPAIAHRRRRTSDRFSCFSGKSVDHHRRVLLFPHFVDLRFLLPIVAFLYRSRRFGVYGLESGGCVVLFREYEYVLVFVADC

SEQ ID NO: 156380 - protein, 99 aa, Glycine max
  Coding DNA Sequence Number=SeqID_39602
MAQELQKSQLLEALSRAKGGLQNVLKTNMLKKLHGKRPLPCQPWGQGFKREGNVRASEFRNPIEATGHGVVKLIHKPMILQVYTKRGRKGNASRLSCHS

SEQ ID NO: 156381 - protein, 297 aa, Glycine max
  Coding DNA Sequence Number=SeqID_39603
  Gene Ontology: Mol. function=protein binding; Cellular component =cytoskeleton; Biological process=transport
  Homolog annotation: Hit_ID=Q9FNN2; Match level="QueryCoverage=97%, HitCoverage=48%, E-value=1e-102, Identity=58%"; Hit description=WD -repeat protein-like
  Pfam annotation: Domain name=WD40; Domain location=129-167; Score =3.3; E_value=15; Accession=PF00400.22; Description=WD domain, G-beta repeat
  Pfam annotation: Domain name=WD40; Domain location=172-213; Score =2.5; E_value=19; Accession=PF00400.22; Description=WD domain, G-beta repeat
  Pfam annotation: Domain name=WD40; Domain location=233-272; Score =56.7; E_value=7.8e-14; Accession=PF00400.22; Description=WD domain, G-beta repeat
  Pfam annotation: Domain name=WD40; Domain location=47-85; Score=33.0; E_value=1e-06; Accession=PF00400.22; Description=WD domain, G-beta repeat
  Pfam annotation: Domain name=WD40; Domain location=5-43; Score=30.6; E_value=5.6e-06; Accession=PF00400.22; Description=WD domain, G-beta repeat
  Pfam annotation: Domain name=WD40; Domain location=88-127; Score=1.8; E_value=23; Accession=PF00400.22; Description=WD domain, G-beta repeat
  Pfam module annotation: Pfam domain module=WD40::WD40::WD40::WD40::WD4 0::WD40; Domain location=129-167::172-213::233-272::47-85::5-43::88 -127
MNGELSVKHKLSGHQKPVSSVSWSPNDQELLTCGVEEAVRRWDVSTGTCLQVYEKNGPGLISCAWFPSGKYILSGLSDKSICMWDLDGKEVESWKGQRTLKISDLEITGDGEHMLSICKDNSILYFNKETRDERYIDEDQTITSFSLSKDSRLLLVNLLNQEIHLWNIEGDPKLVGKYRSHKRSRFVIRSCFGGLEQSFIASGSEDSQVVRFSNLDVLLCIIHAVYIWHRSSGDLIETLPGHSGAVNCVSWNPANPHMLASASDDRTIRIWGLKRLNVKYPNVRTNGVHYCNGGEFR

SEQ ID NO: 156382 - protein, 412 aa, Glycine max
  Coding DNA Sequence Number=SeqID_39604
  Homolog annotation: Hit_ID=Q9RMI4; Match level="QueryCoverage=25%, HitCoverage=27%, E-value=1e-35, Identity=64%"; Hit description=CbpD precursor
  Pfam annotation: Domain name=Chitin_bind_3; Domain location=293-412; Score=24.2; E_value=2.8e-09; Accession=PF03067.6; Description=Chitin binding domain
QEAKHGNGREIQGHAALIGRGGARILAPCGAIPPALPAPMAMRGLKTASTAAGVCAESAENQGDAHASVVPRWHRPPPVPAPVREERHRAGCAGHPASLGRRNRRTPLPDQPERSARWQRAAAVVPCAPAPALALSRLGPDLRAAWRHPLRAAAGDQRGHGRLRSAGRAVCRSCRGLRAAAQRGPRLLLMPGESRGYDADVARSPRRDRCHAEDVIASASVQSRVKPAGRASHPQSRIGISMVPHPALRLDTRRGAAESPPCSAAPAATALFRRPQGSAMSFRSTPLLLATSLAAAGLLLAGDTFAHGTMTTPISRVYACFQGNPENPTNPACAAAKAIGGSQAFYDWNGINQANANGNHQAVVPDGKLCSGNNPTFRGLDVNRSDWQTTPIHADANGKFTFVFKATAPHAT

SEQ ID NO: 156383 - protein, 111 aa, Glycine max
  Coding DNA Sequence Number=SeqID_39605
MAPADVEDTGADIPADTGAQAAEDEHEGFPGAPSDPSVLTQYADHVACSVCTGEERPELKLSFHGRKAHSLGRPVPAIEGLIARTGLSPLIVCSVDTDDRGLLSSFVEWWH

SEQ ID NO: 156384 - protein, 80 aa, Glycine max
  Coding DNA Sequence Number=SeqID_39606
MSNRSSSDNGEGTSHKDPLFRILDELSSLKLWKEKLERKEKGKERERIGYVLDLTPIGEERKESLKRLTLTSHTSMGRTM

SEQ ID NO: 156385 - protein, 67 aa, Glycine max
  Coding DNA Sequence Number=SeqID_39607
MYTQNKANERKPLIGWEEAASIQRVSAFSLAHEIPWLHLVQSITNSSCAYFYGSGTFYLYLKQLATS

SEQ ID NO: 156386 - protein, 105 aa, Glycine max
  Coding DNA Sequence Number=SeqID_39608
  Subcellular localization annotation: CTP_CleavageSite=63; ConfidenceScore=5.26e-01
SPRQAGFLTLKSFGGPSEPKASLGELGSRKTKKKTLFPSFLGIFCLPDRNTKWFLALHCNWRSASNKMEVKIRTLMSFERSCYSTGQLAKTKEVKPKKQEDIKVL

SEQ ID NO: 156387 - protein, 172 aa, Glycine max
  Coding DNA Sequence Number=SeqID_39609
MPSTICKDRVHKTPNGLEEVQQGPGVSSSGYGPLSVLPAICPPLARSRHRDIGKDRAYKTPSGPGEVQQGPRVSSSGFGPLSILPGARPPQQGIAPARHLVDSKKSNRVLGFPALITGLFQFYGVPVALNKVIRPPINRLSSRSTTPPRQAQGETPQLPGDGQQWAMHRRHL

SEQ ID NO: 156388 - protein, 548 aa, Glycine max
  Coding DNA Sequence Number=SeqID_39610
  Gene Ontology: Mol. function=protein serine/threonine kinase activity; Cellular component=membrane; Biological process=protein amino acid phosphorylation
  Homolog annotation: Hit_ID=Q5NAH9; Match level="QueryCoverage=91%, HitCoverage=65%, E-value=1e-133, Identity=51%"; Hit description =Protein kinase CDG1-like
  Pfam annotation: Domain name=Pkinase; Domain location=381-547; Score =8.9; E_value=4.3e-09; Accession=PF00069.15; Description=Protein kinase domain
  Pfam annotation: Domain name=Pkinase_Tyr; Domain location=381-547; Score=17.7; E_value=1.5e-13; Accession=PF07714.7; Description =Protein tyrosine kinase
  Pfam module annotation: Pfam domain module=Pkinase::Pkinase_Tyr; Domain location=381-547::381-547
HRPLFLVSIFDSERLRVQPLGGHQTLDCTSARLLTLGGDGPSVFKSQPPFSSPNIKDIHAPATAPSPAILPGHLDVPSPSPRISPLGSSLKKTKTPPAAYTLILPPPPPNKDCLSTTCLEPLTYTPPGSPCGCVWPLQVKLHINIAIYKFFPLVSELAKEIAASVLLNHTQVRIVGADAANQQLEKTTVLIDLVPKGVKFDDTTAFLIYKKFWYREILIDASVFGAYEVLYVHSPGLPPSPPSTPSDASGIDDGPNPGHDNNGTIMKPLGVDVPKKKKEGNNGRMIVIIVLSSVTASVVFIGLAWLCLLKCRTYVHEHKPVPDGFISSSSKQSILAGAARSLTQGIRLGSGSQSFNSGTITYTGSAKIFTLNDLEKATNNFDSSRILGEGGFGLVYKGILNDGRDVAVKILKRDDQRGGREFLAEVEMLSRLHHRNLVKLLGICTEKQTRCLVYELVPNGSVESHLHADKVTDPLDWNSRMKIALGAARGLAYLHEDSNPCVIHRDFKASNILLEYDFTPKVSDFGLARTALDERNKHISTHVMGTFG

SEQ ID NO: 156389 - protein, 37 aa, Glycine max
  Coding DNA Sequence Number=SeqID_39611
  Homolog annotation: Hit_ID=Q6Q2Z9; Match level="QueryCoverage=78%, HitCoverage=2%, E-value=2e-07, Identity=93%"; Hit description =Phosphoenolpyruvate carboxylase
MKVVFTLARDVLAVELLQKDARLAASGELGKACPGGT

SEQ ID NO: 156390 - protein, 210 aa, Glycine max
  Coding DNA Sequence Number=SeqID_39612
MGLQLIFLLIELHLVFCTQQVHEYAATKLQHSSDRSHFSIAIPPSKSSSEGHSSIAHPPSESSSGVPASIALSASKSIHKAPTIIWTHSSVDSPILHHKHHFSKRKFSNPTPVAAPTYPVQAPTYSHQGPSVFESQPPFSSPNIKDIHAPATAPSPAILPGHLDVPSPSPRISPLGSSLKKKKTPSPAYTLILPPPPPNKGNLIIILPLY

SEQ ID NO: 156391 - protein, 88 aa, Glycine max
  Coding DNA Sequence Number=SeqID_39613
  Gene Ontology: Mol. function=DNA binding; Biological process=DNA integration
  Homolog annotation: Hit_ID=Q1S6N9; Match level="QueryCoverage=95%, HitCoverage=6%, E-value=2e-30, Identity=76%"; Hit description =Integrase, catalytic region; Zinc finger, CCHC-type; Peptidase aspartic, catalytic
MVETQSGYKIQFLRSDNGKEYTLAKFNQFYEKASIEHQLIAPCTPEQNGVSERRNRIVMEMPRCMLYEMELPKTFWAETTNTTIFYNC

SEQ ID NO: 156392 - protein, 57 aa, Glycine max
  Coding DNA Sequence Number=SeqID_39614
MTDENGDFHFPVKTFTCFLTSIAAMRFFHCGKPTSAAVAVRKHCGRGTEIFGFVIQG

SEQ ID NO: 156393 - protein, 979 aa, Glycine max
  Coding DNA Sequence Number=SeqID_39615
  Gene Ontology: Mol. function=transmembrane receptor activity; Cellular component=membrane; Biological process=defense response
  Homolog annotation: Hit_ID=Q1T1A2; Match level="QueryCoverage=83%, HitCoverage=95%, E-value=0.0, Identity=56%"; Hit description=TIR; Disease resistance protein; AAA ATPase
  Pfam annotation: Domain name=LRR_1; Domain location=594-612; Score =0.5; E_value=2.3e+02; Accession=PF00560.23; Description=Leucine Rich Repeat
  Pfam annotation: Domain name=LRR_1; Domain location=616-637; Score =4.9; E_value=34; Accession=PF00560.23; Description=Leucine Rich Repeat
  Pfam annotation: Domain name=LRR_1; Domain location=662-684; Score =6.5; E_value=17; Accession=PF00560.23; Description=Leucine Rich Repeat
  Pfam annotation: Domain name=LRR_1; Domain location=686-705; Score =7.9; E_value=9.7; Accession=PF00560.23; Description=Leucine Rich Repeat
  Pfam annotation: Domain name=LRR_1; Domain location=709-730; Score =9.7; E_value=4.3; Accession=PF00560.23; Description=Leucine Rich Repeat
  Pfam annotation: Domain name=LRR_1; Domain location=782-804; Score =5.9; E_value=23; Accession=PF00560.23; Description=Leucine Rich Repeat
  Pfam annotation: Domain name=LRR_1; Domain location=806-827; Score =2.2; E_value=1.1e+02; Accession=PF00560.23; Description=Leucine Rich Repeat
  Pfam annotation: Domain name=LRR_1; Domain location=829-850; Score =1.6; E_value=1.4e+02; Accession=PF00560.23; Description=Leucine Rich Repeat
  Pfam annotation: Domain name=LRR_3; Domain location=616-635; Score =37.0; E_value=6.7e-08; Accession=PF07725.3; Description=Leucine Rich Repeat
  Pfam annotation: Domain name=NACHT; Domain location=211-364; Score= -20.4; E_value=0.0022; Accession=PF05729.3; Description=NACHT domain
  Pfam annotation: Domain name=NB-ARC; Domain location=185-465; Score =110.5; E_value=4.9e-30; Accession=PF00931.13; Description=NB-ARC domain
  Pfam annotation: Domain name=TIR; Domain location=27-148; Score =143.3; E_value=6.4e-40; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=594-612::616-637::662-684::686-705::709-730::782-804::806 -827::829-850::...
  Pfam module annotation: Domain location=616-635::211-364::185-465::27- 148
MAASNSAAVVGNASSSLSLSVTKKYDVFISFRGEDTRGDFTSHLHAALGRSSIETYIDYRIQKGEEVWVELVKAIKGSTLFLVIFSENYANSSWCLNELVELMECRKQEEEVHVIPVFYKIDPSQVRKQTGSYRAAVANQKWKDALYEAANLSGFHSHTYRTETDLIEDIIKVVLQKLNHKYTYDFRGLFISDENYTSIESLLKIDSMEVRVIGIWGKGGIGKTTLAAAIFHKVSFQYEGTCFLENVAEESKRHGLNYACNKLFSKLLREDINIDTNKVIPSNVPKRLRRKKVFIVLDDVNTPQLLENLVGAGAEWLGAGSRVIVTTRDRHVLKSRGVEKIHEVKEMNFHNSLKLFSLNAFGKTYPTEEYEELSKRVMVYAKGIPLALKVLGSFLRSKSENEWDSALTKLKKIPNQEIQTVLRLSYDGLDDGDKNIFLDIACFFKGQKGDSVTKVLNACGFSADIGIKNLLDKALITTTTDMHDSTTDSCIDMHDLIQEMGRGIVREESIDNPGQRSRLWDPEEVNDVLTNNTGTGAIQGIWLEMSQIQDIKLSSKSFRKMPNLRLLAFQSLNGNFKRINSVYLPKGLEFLPKKLRYLGWNGCPLESLPSTFCPEKLVELSMRYSNVQKLWHGVQNLPNLEKIDLFGCINLMECPNLSLAPKLKQVSISHCESLSYVDPSILSLPKLEILNVSGCTSLKSLGSNTWSQSLQHLYLEGSGLNELPPSVLHIKDLKIFASSINYGLMDLPENFSNDIVLSAPREHDRDTFFTLHKILYSSGFQSVTGLTFYNCQSLGEIPDSISLLSSLLFLSFLHSNIISLPESLKYLPRLHRLCVGECKMLRRIPALPQSIQCFLVWNCQSLQTVLSSTIEPLESPNGTFLLANCIKLDEHSFDAIIGEPPPSEVLEDAFTDNYIYQTAKLCYSLPARSGKVREWFHCHFTQSLVTVEIPPNLLGFIFYLVVSQDVNALWKPARMKGSV

SEQ ID NO: 156394 - protein, 71 aa, Glycine max
  Coding DNA Sequence Number=SeqID_39616
  Subcellular localization annotation: CTP_CleavageSite=16; ConfidenceScore=5.25e-01
MSKQSSPSMVSVAQATCQQEPASKLRRHKGNGRGGVKVLSVGRGGLWAKHCSERNFPEAKQKMLSGFSSCT

SEQ ID NO: 156395 - protein, 62 aa, Glycine max
  Coding DNA Sequence Number=SeqID_39617
MDGGAILFDWGWAGIWSARVRWRCGVGHNGVWVEVWWRLEREGEIIFVHSSFIWGPGCKSPF

SEQ ID NO: 156396 - protein, 86 aa, Glycine max
  Coding DNA Sequence Number=SeqID_39618
MMIWKQRAKLVMATARWVLKHPDYGIVILRLGIYTSRPNISKLCSFIGSMNPSILISVILENKLLATTFLKENPTRFQNFNKHYQQ

SEQ ID NO: 156397 - protein, 128 aa, Glycine max
  Coding DNA Sequence Number=SeqID_39619
  Gene Ontology: Mol. function=RNA-directed DNA polymerase activity; Biological process=DNA integration
  Homolog annotation: Hit_ID=Q1RVR8; Match level="QueryCoverage=58%, HitCoverage=4%, E-value=1e-25, Identity=73%"; Hit description =Glycoside hydrolase, family 1; Integrase, catalytic region; Zinc finger, CCHC-type
MFKNKINEEAEVVRNKAIMVSLGYNQREEIDYEEIVAPVARLEAIRILIAYGAHKDIKLYQMDVKSAFLNGFINEEKNFSKKVFNEKKDKDKSSIIAMSAKSLNTSSLSAQIWRSPRESMNNTIPRLV

SEQ ID NO: 156398 - protein, 103 aa, Glycine max
  Coding DNA Sequence Number=SeqID_39620
DGAARTNVDADGTDGIGVGAEEGGTSEDGGASDLFPLALLGPLKVTVGSSRFQQFFLIYAKLIIGLNFSWVKESEWTPRALHKAVIRAGKPSLEESCWAMSVI

SEQ ID NO: 156399 - protein, 146 aa, Glycine max
  Coding DNA Sequence Number=SeqID_39621
  Gene Ontology: Mol. function=nucleic acid binding; Biological process= DNA integration
  Homolog annotation: Hit_ID=Q1SJY4; Match level="QueryCoverage=80%, HitCoverage=24%, E-value=1e-20, Identity=44%"; Hit description=Zinc finger, CCHC-type
MAGQALTVFIPEDASTNKPSCFDGQDFYYRKGIMNLFLESKDVDLSDIIEIDEKKHESIKEMFTRFTTLVNELNVLGERYATHQRIEKILRSLPKILRQKDTSITEAKDLKNLAMNELTGSLKVHEEELMDELQLPKGKAITLKAS

SEQ ID NO: 156400 - protein, 71 aa, Glycine max
  Coding DNA Sequence Number=SeqID_39622
MDEMKLLKGKIITLKASQKTNIMHQSKALSSIEASDIENSDVEFSKEDEEELAFLTKRVKRLLRKRKGPRV

SEQ ID NO: 156401 - protein, 49 aa, Glycine max
  Coding DNA Sequence Number=SeqID_39623
MANTDEPNLINFSSVGEPSKVLMDKNFGSMRPEVCHKLRFFGPATRLME

SEQ ID NO: 156402 - protein, 144 aa, Glycine max
  Coding DNA Sequence Number=SeqID_39624
  Gene Ontology: Mol. function=catalytic activity; Cellular component =nucleus; Biological process=metabolic process
  Homolog annotation: Hit_ID=Q84ZM5; Match level="QueryCoverage=93%, HitCoverage=21%, E-value=3e-22, Identity=41%"; Hit description =Putative pentatricopeptide (PPR) repeat-containing protein
  Pfam annotation: Domain name=PPR; Domain location=110-144; Score =46.7; E_value=7.9e-11; Accession=PF01535.11; Description=PPR repeat
  Pfam annotation: Domain name=PPR; Domain location=8-42; Score=13.9; E_ value=0.17; Accession=PF01535.11; Description=PPR repeat
  Pfam module annotation: Pfam domain module=PPR::PPR; Domain location =110-144::8-42
MENPCEISLWNGLMAGYTKNYMYVEALELFEKLLHYPYLKPDSYTYPSVLKACGGLYKYVLGKMIHTCLVKTGLMMDIVVGSSLVGMYAKCNAFEKAIWLFNEMPEKDVACWNTVISCYYQSGNFKEALEYFGLMRRFGFEPNS

SEQ ID NO: 156403 - protein, 479 aa, Glycine max
  Coding DNA Sequence Number=SeqID_39625
  Gene Ontology: Mol. function=hydrolase activity; Cellular component =intracellular; Biological process=metabolic process
  Homolog annotation: Hit_ID=Q1SZI6; Match level="QueryCoverage=96%, HitCoverage=61%, E-value=1e-100, Identity=31%"; Hit description =Tetratricopeptide-like helical
  Pfam annotation: Domain name=PPR; Domain location=149-183; Score =49.7; E_value=9.6e-12; Accession=PF01535.11; Description=PPR repeat
  Pfam annotation: Domain name=PPR; Domain location=184-218; Score=7.3; E_value=1; Accession=PF01535.11; Description=PPR repeat
  Pfam annotation: Domain name=PPR; Domain location=250-284; Score =43.5; E_value=7.2e-10; Accession=PF01535.11; Description=PPR repeat
  Pfam annotation: Domain name=PPR; Domain location=285-319; Score =13.7; E_value=0.18; Accession=PF01535.11; Description=PPR repeat
  Pfam annotation: Domain name=PPR; Domain location=321-355; Score=6.7; E_value=1.2; Accession=PF01535.11; Description=PPR repeat
  Pfam annotation: Domain name=PPR; Domain location=388-422; Score =16.2; E_value=0.09; Accession=PF01535.11; Description=PPR repeat
  Pfam annotation: Domain name=PPR; Domain location=48-82; Score=39.9; E_value=8.7e-09; Accession=PF01535.11; Description=PPR repeat
  Pfam annotation: Domain name=PPR; Domain location=83-117; Score=1.5; E_value=4.9; Accession=PF01535.11; Description=PPR repeat
  Pfam module annotation: Pfam domain module=PPR::PPR::PPR::PPR::PPR::PP R::PPR::PPR; Domain location=149-183::184-218::250-284::285-319::321 -355::388-422::48-82::83-117
MEIHEELINSGFLLDSFISSALVDMYGKCGHLEMAIEVFEQMPKKTVVAWNSMISGYGLKGDSISCIQLFKRMYNEGVKPTLTTLSSLIMVCSRSARLLEGKFVHGYTIRNRIQSDVFINSSLMDLYFKCGKVELAENIFKLIPKSKVVSWNVMISGYVAEGKLFEALGLFSEMRKSYVEPDAITFTSVLTACSQLAALEKGEEIHNLIIEKKLDNNEVVMGALLDMYAKCGAVDEAFSVFKCLPKRDLVSWTSMITAYGSHGQAYVALELFAEMLQSNMKPDRVTFLAILSACGHAGLVDEGCYYFNQMVNVYGIIPRVEHYSCLIDLLGRAGRLHEAYEILQQNPEIRDDVELLSTLFSACRLHRNIDLGAEIARTLIDKDPDDSSTYILLSNMYASAHKWDEVRVVRSKMKELGLKKNPGCSWIEINQKILPFFVEDNSHLHLELVFKCLSYLSDHMEDESKPFTYHFDVETLRLY

SEQ ID NO: 156404 - protein, 78 aa, Glycine max
  Coding DNA Sequence Number=SeqID_39626
MRILKLAKYRLKAQVEKDEGPRTFGILIKFGESFSLGSLLNQSQTYQGNPCGVYPDLSSFTGSGVIQNLRSLYQAIRS

SEQ ID NO: 156405 - protein, 87 aa, Glycine max
  Coding DNA Sequence Number=SeqID_39627
MLTSSERVQMTTLASACQSNLGSPNDEVQITIRCLRMLPNSWVMIAKGGVVDKSGAFAPTYPQFVMRNSDLRSSFKSETKIVSVFFN

SEQ ID NO: 156406 - protein, 169 aa, Glycine max
  Coding DNA Sequence Number=SeqID_39628
  Gene Ontology: Mol. function=protein serine/threonine kinase activity; Biological process=protein amino acid phosphorylation
MRQDLRSHAFGDQHCELSHLDKVRRRADSVVVDFDKVVDLNQRHRLVHHRWRTKVNINRVSSTVGYVFGDEQFIVVWVSAEANEVDEAGTGDLGEDLDLVFSGTGAVAATGAFGGVVFKGASGDKFGCFDNDEELARVQGDSVDSVVVASTKEGVGGEAVGGGDDVENK

SEQ ID NO: 156407 - protein, 117 aa, Glycine max
  Coding DNA Sequence Number=SeqID_39629
  Pfam annotation: Domain name=Tryp_alpha_amyl; Domain location=32-116; Score=0.6; E_value=0.073; Accession=PF00234.12; Description=Protease inhibitorseed storageLTP f
MGQKKVLTLVMFVMAYGLAATRFSASQIPPTCNGDEALLTFCGSYLGNILPNPTSDCCKSATSAFDRAMSDSTGQGIRDLCDCLMVAGPVLNFQQTKLESLPDACGIKLSFSIFLCV

SEQ ID NO: 156408 - protein, 325 aa, Glycine max
  Coding DNA Sequence Number=SeqID_39630
  Homolog annotation: Hit_ID=Q9LRW1; Match level="QueryCoverage=33%, HitCoverage=40%, E-value=2e-42, Identity=77%"; Hit description =Putative LOB domain-containing protein 22
  Pfam annotation: Domain name=DUF260; Domain location=41-141; Score =172.2; E_value=1.3e-48; Accession=PF03195.5; Description=Protein of unknown function DUF260
  Subcellular localization annotation: CTP_CleavageSite=42; ConfidenceScore=5.68e-01
MQPKSHTPFFVPPQKAMNNNNPNNNSNRISSPRNGNSTTQACAACKYQRRKCAPDCILAPYFPHERQRQFLNAHKLFGVSNITKIIKLLSPQDKDQAMRTIIYQSDMRATDPVGGCYRYILDLQAQIEYYRAELELVLQQLAIFRAQAQQQQQQQQQQHGIYAPNNVNIAVNGDGEVLNADPMGLYDQQQHYQCLQPQQQEQYAMMHENGHGSQNSDGTAFQEQINTWAVQNTAVSLSSLSLQGQGSNVSDGYDHKPVLGIDMDSDERSELGFESEELVHRSDEAVLFKIDDAEIKAEADHCMQQAQDHDLKGAATSFTLTNCTC

SEQ ID NO: 156409 - protein, 589 aa, Glycine max
  Coding DNA Sequence Number=SeqID_39631
  Gene Ontology: Mol. function=unfolded protein binding; Cellular component=mitochondrion; Biological process=cellular protein metabolic process
  Homolog annotation: Hit_ID=Q1SK06; Match level="QueryCoverage=99%, HitCoverage=99%, E-value=0.0, Identity=79%"; Hit description=GroEL -like chaperone, ATPase
  Pfam annotation: Domain name=Cpn60_TCP1; Domain location=53-571; Score=532.9; E_value=3.5e-157; Accession=PF00118.14; Description=TCP- 1cpn60 chaperonin family
  Subcellular localization annotation: CTP_CleavageSite=43; ConfidenceScore=5.06e-01
MYRLARRVASSIASPSAKNLVYGGVLSSRNFVSKDINFGVGARAAILQGVTEVADAVKVTMGPKGHNVIIERSRGNPRITKDGVTVARSIKFKDKSKNVGADLVKQVAKATNTAAGDGTTCATVLTQAILTEGCKSIAAGINVMDLRNGINKAVDAVITELKSRTLMISTPEEITQVGTISANGERDIGELMARAMEKVGKEGVITVVDGNTLDNELEVVEGMKLTRGYISPYFITDQKTRKCELENPFILIHDKKISDMNSLLKILELAVTKKRSLLVVAEDVESDALAMLILNKHHAGLKVCAVKAPGFGDNRRASLDDLAILTGGEVITDERGLSLDKVQPEMLGTAKKVTITIDDTIILHGGGDKKVIEERCEQLRTAMEESSATFDKEKAQERLSKLSGGVAVFKVCHSSLRILMQPNIQVGGASEAEVGERKDRVTDALNATRAAVEEGIVPGGGVALLYATKVLDNLQTQNEDEKRGVQIIQNALKAPTSTIASNAGFDGALVHSKLLEQDDHNLGFDAAKGVYVDMVKAGIIDPLKVVRTALVDAASVSLLLTTTEAAVLDNPHDKNKPPSRVPDMDDLDL

SEQ ID NO: 156410 - protein, 164 aa, Glycine max
  Coding DNA Sequence Number=SeqID_39632
MVLSCHYLYYLALRAIFVGGIAAFAKIAGAMKAAGGAKMGAAAAAMTAAATAAVAGVIDIDVDKWSFFETIGILKEDFGYGDQPIRLWWKGGDGDYKEKTMGSHALELSNYVIANSCEVKSFVECTGGNEGVVDNNFSQDNSYESVKNVQLDESEEEKTIGLDN

SEQ ID NO: 156411 - protein, 61 aa, Glycine max
  Coding DNA Sequence Number=SeqID_39633
MSRSGNKRCGESICDEEIPNIGVSRGAHSDFDIYLQTRRYMYQEGSSTTSNKLSKAYLRMF

SEQ ID NO: 156412 - protein, 102 aa, Glycine max
  Coding DNA Sequence Number=SeqID_39634
MLAGLRHLDPGITPPRHPVDPEKSNKALGFPPLITGLCQFYGVSVTPTKPIRPPINRSFIEKYCMPRQAQQPGQDQQQQLAADAPLPPLQQPLSLESISSHI

SEQ ID NO: 156413 - protein, 184 aa, Glycine max
  Coding DNA Sequence Number=SeqID_39635
  Gene Ontology: Mol. function=transmembrane receptor activity; Cellular component=integral to membrane; Biological process=defense response to bacterium
  Homolog annotation: Hit_ID=Q9LIC2; Match level="QueryCoverage=97%, HitCoverage=26%, E-value=2e-62, Identity=68%"; Hit description =Multispanning membrane protein-like
MKKKMMASTAISLVFAALFLFSSVHSFYLPGVAPRDFQIIEDIELLFHVWHQGDPLFVKVNKLSSTKTQLPYDYYFLKYCKPKTILNNAENLGEVLRGDRIENSVYTFHMRKEQSCTVVCHETLDAESAKSFKEKIDDEYRVNMILDNLPVAVRRQRRDGGQSTTYEHGFRVGFKGNYQGVQLS

SEQ ID NO: 156414 - protein, 235 aa, Glycine max
  Coding DNA Sequence Number=SeqID_39636
  Homolog annotation: Hit_ID=Q9SG92; Match level="QueryCoverage=20%, HitCoverage=17%, E-value=3e-12, Identity=64%"; Hit description =Putative alpha-hydroxynitrile lyase
  Pfam annotation: Domain name=Mmp37; Domain location=1-198; Score= -187.1; E_value=0.0069; Accession=PF09139.1; Description =Mitochondrial matrix Mmp37
MTSVLKQAKESIQLLEVYTWASFIYLSHSLPVINFPDNESMIEAYFFSLCFWMCFNQFHIVVDNLDVNSTNSVNSRAAVSAALLLLPSEFTEVDLYAKVCSLSYTGVPDLSEYGDVYELGFGLGHDKPPTSALVKKEFQRKIIYPLSPHEDFSDGSAEYIELYATLLEYFNVTCYGAVADGRTESSSLVLYAYMVMVKFEAKLPTSYSIMLLGILGSMGRCMLSVAVIFGYQAID

SEQ ID NO: 156415 - protein, 87 aa, Glycine max
  Coding DNA Sequence Number=SeqID_39637
MQDMNACGWWCLVWAWPIVVVGIGLADGGGFDALGRVSEWVTVFAVLVVCGGCVGCIGGFRWLCWLGRWLGSADGGGSRRGRVLSGG

SEQ ID NO: 156416 - protein, 126 aa, Glycine max
  Coding DNA Sequence Number=SeqID_39638
MGFSIERCIVSLELDRAGLGCRMSGHGVRVCMRRSSAGELVPLDLEIETTFRRNNTERKINLLHDRTVASILEEAHFSESSSSNSPTSKESQTAEFETEVMAEEQPLRVTLEDYSSILGRRFKHRI

SEQ ID NO: 156417 - protein, 83 aa, Glycine max
  Coding DNA Sequence Number=SeqID_39639
MSRNFMDCLTMGVKYLEAVKRRLHATKQWSPDEIRAINSWDFGLNDGGCTNNARQSIRGAPDSMMEDARTALGNQFVGLWTRW

SEQ ID NO: 156418 - protein, 316 aa, Glycine max
  Coding DNA Sequence Number=SeqID_39640
  Homolog annotation: Hit_ID=Q47522; Match level="QueryCoverage=18%, HitCoverage=77%, E-value=6e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRLFGECAGIGVGTLDGLVLVGSHGVDRNDSAAPAPIHRGARLEVVCGCSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 156419 - protein, 232 aa, Glycine max
  Coding DNA Sequence Number=SeqID_39641
MADAEQSSECFDRLEVAIADLTVAQLHSIVTLDSIVSKLDAILLKRNIPIPSHHADEEVPSDAAEDLVLLGMPKLLSLTHTPIPPLSLPSPLKPTPSPTLTAAMSMPTPSPRPTFMPQHPAPLPAPLTSIRDTTGKLVARLHPTLPLESGNNIHLLSLGSSLASLSRPPYSSSSPPPPPPEPPPPPRPRLARVYASRTVMFGHQGLGHANRYSQLSLPLVASSFDHATTISL

SEQ ID NO: 156420 - protein, 100 aa, Glycine max
  Coding DNA Sequence Number=SeqID_39642
MPHLHPIPLLHANTNNQHHHQRPWCREEVAMELGWQRRVMFSISFLISTTSHLLPCTMVYPSNLPNNWYQSQVQVGDRLRRVCKYRRWPEWLAGRARTAG

SEQ ID NO: 156421 - protein, 213 aa, Glycine max
  Coding DNA Sequence Number=SeqID_39643
  Homolog annotation: Hit_ID=Q1ENZ3; Match level="QueryCoverage=92%, HitCoverage=73%, E-value=3e-31, Identity=43%"; Hit description =Remorin-related
MNNEYPTIIASTTHGSLEEQEDEHITEIREIHELTPPPPRGRAWETVHHTHRSSSLSVASEGGASSSDNFSMSREFSALVLAGSCIDHDNNNISPMNENNHNNNSNSNSLLGRIREEDLMEETNPLAIVPDNHPLQDPVPSSTSQGVRGGGGGAREEHVSVQMVKKEEVDAKISAWQNAKINNRFKREDAVINGWESEQVQKASSWMKKVEMD

SEQ ID NO: 156422 - protein, 66 aa, Glycine max
  Coding DNA Sequence Number=SeqID_39644
MASSSHPCRGGSRGNPDNLGGYVSRCFAANIGNNFSLADELMRAILGIEMAATKKCKYLWLESVTL

SEQ ID NO: 156423 - protein, 188 aa, Glycine max
  Coding DNA Sequence Number=SeqID_39645
MEHMLTSKRFILEVLHKAGMICLDEDKGESCLIHPGAPHDVETCPTAEELLQGMIDKGLIEPVPVEKPTPFPYKNGKVVPWRYATQGPNRKKDVSIIHVNGDLSSTKVTNISSTSGMTRSKRIFAAPKPPVRSKDPKGKAKASVEESDKAGPILDDEVLIGRFSKEVDDFSKKGISAEEATEFLRIIQ

SEQ ID NO: 156424 - protein, 64 aa, Glycine max
  Coding DNA Sequence Number=SeqID_39646
FLASSKSKESLAQNLKEVLQLLQQEEEEEPLKKEAESSENNDDQEDDPFYQNEDDCFGISLDDG

SEQ ID NO: 156425 - protein, 101 aa, Glycine max
  Coding DNA Sequence Number=SeqID_39647
MALIYSVPESDPRVKCYDPLNSRELPDEDMTKSKGKDPLEGLGGPMTRAIARKAKEALQQVLSILFEYKPKFQGEKSKGPIGNLGISLLGDQMVADLLAVG

SEQ ID NO: 156426 - protein, 237 aa, Glycine max
  Coding DNA Sequence Number=SeqID_39648
  Homolog annotation: Hit_ID=Q47522; Match level="QueryCoverage=21%, HitCoverage=64%, E-value=1e-23, Identity=100%"; Hit description=LacZ protein
MKHFTDTLISANIERDPIDGPMPHLETRLCMLLCIIPLVVGDLIEEEEERTPVDEKDNGPTGFWKEKKVAGKCRDDLVSSLQVLGDYQSLLTPPQPVLAAANQAAAKAMLFVSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 156427 - protein, 80 aa, Glycine max
  Coding DNA Sequence Number=SeqID_39649
MWVQAIGLFAQATCAPEFGLPRPLNKRLLVLHVGGGAVKQQGQPFPCAQESPTTRDPRSLNPFSEIRRREEEISRKRGRL

SEQ ID NO: 156428 - protein, 130 aa, Glycine max
  Coding DNA Sequence Number=SeqID_39650
MGFQTLPYFNIPNITNIYVFVLFTSVEEKSPEFQEPRDLSGVSSQLFFFSVPLPFIFQEAKESIDEEDPRQTSSNGAYIMRPYSHRREKERKPQEANISLPYGKDNVELLKIQDSKRIRLELLKKAMGFS

SEQ ID NO: 156429 - protein, 143 aa, Glycine max
  Coding DNA Sequence Number=SeqID_39651
MYPLLFLVNSPSRCTLYLYHKGCTLQCVKTKEREESKEFSDCVVLNSLTREKGDTKEFGRLVLRSFGKGRRETQKEFRRPHSTGVVPSTLYQKLKFLVGGQLIIVLGEEDILVSCPSTIPYVKAAEESLETAFQALEFVDNVM

SEQ ID NO: 156430 - protein, 125 aa, Glycine max
  Coding DNA Sequence Number=SeqID_39652
VQIAKKNESYTKQANKKRKEVVLEPGDDPGHLRANVFQEGGNDENLEIGQIQAKGPSNPCGVYPDLSSFTGSGVYPDLSSFIESGVYPDLSSLFGSGITKTSVACIKRSASPQVHITKALSKLER

SEQ ID NO: 156431 - protein, 109 aa, Glycine max
  Coding DNA Sequence Number=SeqID_39653
MAKTLNDEYEGSNEQTTTYYYQDDESTRTHLSVLHDEAIPLFDGNATMEEVDNNDIHHRVNNFPDEHFINEIDDDVIEDINEFIYDEELYNLDSSGNHHANYSRKGASS

SEQ ID NO: 156432 - protein, 97 aa, Glycine max
  Coding DNA Sequence Number=SeqID_39654
MIHEISYGPTKFGTSFNGSIVNKYRIHTKDYGLNRATMNSGFDPNNSIVDERYELFDIKHKLELQSDEPFVLAEQTQQVVDAIGFDVLMMIMMMCCN

SEQ ID NO: 156433 - protein, 84 aa, Glycine max
  Coding DNA Sequence Number=SeqID_39655
ESYEVSMTHKYGEDTSTHLVINYDLWLKATGENKKKKVCGLDPSLDLCTASISTHASSKAIPSSTTPAPLTEERTLPQMMQHAL

SEQ ID NO: 156434 - protein, 60 aa, Glycine max
  Coding DNA Sequence Number=SeqID_39656
MRKKRIRVIGGSLGRRARGGLHHQGSEGGGRVQQRRGCSSSSRWAGDACVLEKKYLKITC

SEQ ID NO: 156435 - protein, 81 aa, Glycine max
  Coding DNA Sequence Number=SeqID_39657
MTINSWGSGLDGGGRTNSTRQSIRGAPDSMAINSWGSRLDGGGCMNDNQFMGLRIRFDGGGCTNSARQSISGAPDSMVEDA

SEQ ID NO: 156436 - protein, 74 aa, Glycine max
  Coding DNA Sequence Number=SeqID_39658
MENIQNQDKSQNNKVTVSLLAGEAARAGSIATCLMLPTPKLRSCSRLKGHSNVVLGRSNPIVFHVLSLLSDYHT

SEQ ID NO: 156437 - protein, 156 aa, Glycine max
  Coding DNA Sequence Number=SeqID_39659
MKAQVEKDECPEAEALSRQFMLLKAQSNLKAQTYQGNPCGVYPDLSSFTESGVYPDLSSFIGSGVYPDLSSFTGSGVIQNLRSLYQTIRSYSGSHHHTYQGNPCGVYPDLSSFTGSGVYPDLSSFTGSGVYPDLSSFIGSGVIQTFVTCIKRSTRK

SEQ ID NO: 156438 - protein, 90 aa, Glycine max
  Coding DNA Sequence Number=SeqID_39660
MSQKHYESTSAWIFFTETNFLTNFARILKFQKGSTIYSSFFPLIIGEKREVIAAQLAQASCVASTRRHRLLLEPPGRPKWVWLLFAPPFY

SEQ ID NO: 156439 - protein, 57 aa, Glycine max
  Coding DNA Sequence Number=SeqID_39661
MIWHLQLEKNVTSISVELHPHNNQQRKNRRQDDSNNEGINNKTTSSEVADASGKACN

SEQ ID NO: 156440 - protein, 258 aa, Glycine max
  Coding DNA Sequence Number=SeqID_39662
  Gene Ontology: Mol. function=pepsin A activity; Biological process =proteolysis
  Homolog annotation: Hit_ID=Q9LTW4; Match level="QueryCoverage=67%, HitCoverage=30%, E-value=4e-15, Identity=30%"; Hit description =Chloroplast nucleoid DNA binding protein-like
MGRRMMQWNTITKASILITITLHLILPVAVNSMRLELVHRHHERFSGGGGDVDQVEAVKGFVNRDGLRRQRMNQRWGVSNYDRRRKGLETTTTTEVEMPMRAGRDDALGEYFTEVKVGSPGQRFWLAADTGSEFTWFNCVMRNATTTATTKKTRKNKTKKKHHHHSKRNRTRTTRRTKKKKAKSNPCKGVFCPHRSKSFQAVTCASQKCKIDLSQLFSLSLCPKPSDPCLYDISVSDQVGGTTLFKIDQHDERKIIRC

SEQ ID NO: 156441 - protein, 154 aa, Glycine max
  Coding DNA Sequence Number=SeqID_39663
  Subcellular localization annotation: CTP_CleavageSite=75; ConfidenceScore=5.20e-01
MNCVFVHVSSTFEFGAMRSDCLVQFSILTIFRSPMKCVFVHVFSTFEFGAMRSDCLVQFSILTIFRSPMNCVFVQVSSTFEFGVMRSDCLVQFSILTLFRSPMNCVFVHVSSTFEFGAMRGDCLVQFSIPTLFRSPMNCVFVHVSSTFEFAAMR

SEQ ID NO: 156442 - protein, 174 aa, Glycine max
  Coding DNA Sequence Number=SeqID_39664
  Subcellular localization annotation: CTP_CleavageSite=35; ConfidenceScore=5.65e-01
DHGFSTCLPSSSSSSSSSSSSSSSCSFQRIGFAVCREADTQSLRKELRTYLGIVAPGAEKPVVHVDPATGKADGPHRKKLRTYLGIVARDKVDITYENWKEAKFEIPEASDSRTKRKLLQTVGERRRQFKSDLTRKWALTADQDGVEDTVCEKYGISKEKWAQFCQTRRDPSWE

SEQ ID NO: 156443 - protein, 116 aa, Glycine max
  Coding DNA Sequence Number=SeqID_39665
MVGRGREALGSTGNPHVVQSKNSFPTYGLPPTYTLPDVAHTLDENVNNSALMPIKSQQPQSDHAHVSQPMGETHEAPRDHNLASFEPYLGYATKGQAVGDIPLLDTLGGPQYRPQP

SEQ ID NO: 156444 - protein, 156 aa, Glycine max
  Coding DNA Sequence Number=SeqID_39666
  Gene Ontology: Mol. function=carboxypeptidase activity; Cellular component=cytoplasm; Biological process=proteolysis
MICDLGQESFQQAYALMHGWSDKSFTSLLQVVQDMVLEENTLPKSYYQEKKILFLMGMEYQKIYACLNDCILYRNEFEEMPNCPGCGVSRYKVKDDDQRSSDESTKKGPPSKGVMLSSDHSKVQKTLHGMQMGEVAMECSTIRLIPFSERRLIVYI

SEQ ID NO: 156445 - protein, 516 aa, Glycine max
  Coding DNA Sequence Number=SeqID_39667
  Gene Ontology: Mol. function=protein dimerization activity; Biological process=DNA integration
  Homolog annotation: Hit_ID=Q2R1C3; Match level="QueryCoverage=89%, HitCoverage=74%, E-value=3e-95, Identity=37%"; Hit description=HAT family dimerisation domain containing protein
  Pfam annotation: Domain name=DUF659; Domain location=173-311; Score =15.4; E_value=1.3e-08; Accession=PF04937.6; Description=Protein of unknown function (DUF 659)
  Pfam annotation: Domain name=zf-C2HC_plant; Domain location=16-74; Score=0.7; E_value=0.034; Accession=PF07567.3; Description=Protein of unknown function, DUF1544
  Pfam module annotation: Pfam domain module=DUF659::zf-C2HC_plant; Domain location=173-311::16-74
MSSANEAMEQEDQIKPLWRYVTKLRKTPGGGNAMIKCNLCEISFIGSYTRVRAHLLKILREAVRPCSKVTPPKIIELKKLDNEATLKIQSSKKKCVSLPGEGKQKQDGAPPKVLGPLEKGFNLQGKDDLDARIARMFFSSGLPFHLARNPYYREALSYAANTPNLSGYKPLGYNKLRTTFLTTKRRHVVNLLQPIRNSWNQKGVTTVNDGWSDPQRSPLINFMAVTESGPMFLKAVNCFGDIKDKDFIAQHIKDSIMEVGSSNVVQIVTNNAVVCKAACMIIENEFPVIYWTPCDANLIKFFIMGHSMRLSLYNNFNSLKLLSVAPTRFASTVVMLKRFRSLKEELQKMVDYILSFTAPIYVLRKIDIDMVVLHLVYEMWDSMIEKSSTPLHCLAHSLNPRYYSHEWLSEDPSRVPSHQGVELTDERKKCFRRYFDDVDAFMMLTPLRDKGELDTKSWWLVHAIFASLQEIPQTRMWDIARDRFSLDENGILEIAHLSLDEPVLEAVFFNEGDQGL

SEQ ID NO: 156446 - protein, 277 aa, Glycine max
  Coding DNA Sequence Number=SeqID_39668
  Gene Ontology: Mol. function=oxidoreductase activity; Cellular component=endoplasmic reticulum; Biological process=metabolic process
  Homolog annotation: Hit_ID=Q8H5F0; Match level="QueryCoverage=84%, HitCoverage=39%, E-value=1e-110, Identity=77%"; Hit description =Betaine aldehyde dehydrogenase-like
  Pfam annotation: Domain name=Aldedh; Domain location=1-207; Score= -176.9; E_value=4.2e-08; Accession=PF00171.12; Description=Aldehyde dehydrogenase family
MEVQQGLSAAMACSACSDRGPVWSERGGLRVAMTCYARGAEGPPLAGKYDMGALCMHAHSEMLEALINDALDKGAEIIARGSFGPIGEDAVDQYFPPTVIVNVNHSMRLMQEEAFGPIMPIMKFSSDEEVVRLANDSKYGLGCNVFSGSQSRAREIASQIHCGLAAVNDFASTYMCQSLPFGGVKNSGFGRFGGVEGLRACCLVKSVVEDRWWPFIKTVIPKPIQYPVAENGFEFQESLVEALYGLSVWDRLQALVNVLKMLTEQNSTSGSRKKKND

SEQ ID NO: 156447 - protein, 269 aa, Glycine max
  Coding DNA Sequence Number=SeqID_39669
  Gene Ontology: Mol. function=enzyme inhibitor activity
  Homolog annotation: Hit_ID=Q1SG57; Match level="QueryCoverage=99%, HitCoverage=97%, E-value=6e-48, Identity=44%"; Hit description =Pectinesterase inhibitor
  Pfam annotation: Domain name=PMEI; Domain location=121-263; Score =109.3; E_value=1.1e-29; Accession=PF04043.6; Description=Plant invertasepectin methylesterase inhibitor
  Subcellular localization annotation: CTP_CleavageSite=59; ConfidenceScore=5.01e-01
MKNQISFLTLFSINLLLCFALGPCTRTCAFALEAEAEPPVGFSRSETPNSESPTSQPPVGFSRSEFTNSENPTSSLSEKEESESSSLGDHPYMSFSSAFADILKGTLRGHTITMPDHDPKASHHRSVKDICSHTDYPEVCVSTITPFVGNDLDLMNVLEAAIKACSFQANFTISVVAKHMKASPEMAAALEDCKEQYTSALENLHRAMEAIPSRDLGTVTVMLSAVLADVSACESGFEEQKTALSMPHSEGMVSITASICLSIASLIPY

SEQ ID NO: 156448 - protein, 50 aa, Glycine max
  Coding DNA Sequence Number=SeqID_39670
MPLFRLPLLMGNRNFLLSFPNGTELALEFQATYPVCNLVKRDRDDGDLKR

SEQ ID NO: 156449 - protein, 398 aa, Glycine max
  Coding DNA Sequence Number=SeqID_39671
  Gene Ontology: Mol. function=N-acetyltransferase activity; Biological process=metabolic process
  Homolog annotation: Hit_ID=Q1T0F6; Match level="QueryCoverage=69%, HitCoverage=95%, E-value=2e-95, Identity=64%"; Hit description=GCN5 -related N-acetyltransferase
  Pfam annotation: Domain name=Acetyltransf_1; Domain location=63-151; Score=51.4; E_value=3e-12; Accession=PF00583.14; Description =Acetyltransferase (GNAT) family
MVDRTKSKVLIREYNEDKDAKMVRKLERNCEGGTKKVVSIFTNMTGDPLSRIRFFPLHVMLVAELLDTRELVGVVRGIIKNMGTLSGSFLKMGCILGLRVSPTYRRKGVALRLVTAAEEWMVRNGAEYAFLATEKNNGASKNLFTIKCNYVNLSSLVIFVQPTSSLTKQISTDIKIEKVDIDLAISLYRRTMRTKDLYPLDMDVILKEKLSLGTWVCYYKEEGWLNLRSKVNNEDLINNNETSRSWVIFSIWNTCEAYKLQVRKSQLLRFLLTTLNHAREKVFPCLKMWVSSSDSLCRPFGFLFIYGIYGEGVNLGELMESMWRFTSRVGEAMRDCRVVITELGFGDPLANHVPQTDSMSCIDDLWYTKRLSSHGDENVDELMMNGQVRNVFVDPRDF

SEQ ID NO: 156450 - protein, 164 aa, Glycine max
  Coding DNA Sequence Number=SeqID_39672
  Gene Ontology: Mol. function=ribonuclease H activity; Cellular component=nucleus; Biological process=defense response
  Homolog annotation: Hit_ID=Q1SZM6; Match level="QueryCoverage=94%, HitCoverage=51%, E-value=3e-32, Identity=44%"; Hit description =Ribonuclease H
  Pfam annotation: Domain name=RnaseH; Domain location=9-133; Score =13.4; E_value=3.3e-06; Accession=PF00075.14; Description=RNase H
MSTLLRFKLNIDGSSIGNPGNAGFGGIIRDSFGDWHAGFYGSCGTATSLQAELLAILHGLNLSWDKGFRNIQCESDSKLALQLISEGRNSLHPYASIIQKIQDFKLLHWDLHFNHTFREGNMCADELAKTGSSLQCNLQVFNGCPPFITQLVLADRKGAQYIRH

SEQ ID NO: 156451 - protein, 176 aa, Glycine max
  Coding DNA Sequence Number=SeqID_39673
MSCSRALSSRWTDLNEELEQLLANVPQLTIEEHIEWRKMTNIMQNVATPPKAFFQTVHARDQGLIENGSMALRYFCTTNISTQHHHHASVITLVSSSLSLTSTRMQNSIPAARNSKNKFITAENVKSLVSTVVLPSISSTPLESLHRGNWVKLICGASFEDVVDIRNLSLVYTLAG

SEQ ID NO: 156452 - protein, 1094 aa, Glycine max
  Coding DNA Sequence Number=SeqID_39674
  Homolog annotation: Hit_ID=Q9FGU0; Match level="QueryCoverage=24%, HitCoverage=25%, E-value=6e-16, Identity=29%"; Hit description =Arabidopsis thaliana genomic DNA, chromosome 5, TAC clone:K21L19
  Pfam annotation: Domain name=Fip1; Domain location=179-240; Score =71.3; E_value=3e-18; Accession=PF05182.4; Description=Fip1 motif
MEGLDDDDFGELYTVDIEVPNAIPEEEEEEEEDEIDVNSNIVNLDKDMDSETVNDDCAAESDSSDDDDGLKIVLNDEDIPVGADARDEGNGDNGDDNNGSRFFHPKTGRSRGLAILNNMKANASMGMASYISSLNKGRRNGDACIQNLALSSSRVCLAANPMAVQCGYGSALPWYWGIFDVNTDTLTEKLWKVPGVDITDYFNFGFNESTWKLYCSSLEQLWRTSLQTGISVDDAANWNQEVMREQTDQVVSGNAFFPSSDCGLPKGRAIQVEDSMVERQPSIDVRRPRNRDFNVIEIKLLDSSDDCSGSGNSTVMNASLEGESMAGNKRSVLNSSGELNEMLSEDQLEDVKKAEDSSLHRRSGPIPGVDGDEHRDQADQHSEDTAEVPEGETKAEEGGGIDACSSYPCWIESELSLGDQEHSLTSYTDSDSEAMDNSVQVDNDKSFSPLKRKSLNCVTDMKESLPLCWKNSKNNSINKKAVSAAYNSRTRGQFRKEWRHRSGGYEPSSYDINKHTENDNDVSILKSSARNLSLLARRPVDYGRHKDRLQVFGSHKIRDLSCNRETKQSYYYGDEKVVDELVACRSKYYHEDQESLRENTNRHDRKNGDVEDYFFEPGPRFADSEDRERDWYHLGCEYSSDDLSPCSYRESRKFPPKHSSFPDEERYTQGKRMDGKSHFIDRNCIDDFDECEFKFLNKSYRMSTIAERELEFLDNYREEQFPHIDRDWRRSVCRGRHYDSPPLVLNNLCSGIMEVEDNCQKYTHCQTSSFKYRRQSYTDSAKNYAYGERVNGNFGGSGRDKHARDNRGSNWLCGYTDTAEDEDFPIYPVKKYQFYRSPSKFLNWTEDEIIYRHHETHATSLFAKVQSDDLPLQRHQLSMPIRDSEKYFKGSSKIMCRSKGGQALLRCRKSVDLIHGEGKSQVRSSRVLCNGRLENANQRIAKKRRRAAVGFDESNKNASKFDTPKHKSNQESKKWVQDLQDQAQKESSEIEEGQFVAEEPYMEEASEGPAVTDGVNKKRMSQNENSSEQCIGGYDSQRILDSLAKMEKRRERFKQPMTMKKEAEESLKLNDDSIVDKGEMKQHRPARKRRWVGN

SEQ ID NO: 156453 - protein, 73 aa, Glycine max
  Coding DNA Sequence Number=SeqID_39675
  Gene Ontology: Mol. function=4 iron, 4 sulfur cluster binding; Biological process=electron transport
  Homolog annotation: Hit_ID=Q7V9W0; Match level="QueryCoverage=66%, HitCoverage=14%, E-value=1e-07, Identity=55%"; Hit description=Fe-S cluster containing protein
MDYQVDCIDCAADASVLSAVNEGIEAARDIVCLRRPWVMISVNDDKDLHFRKAGLEYESNNSQVEEVYLLTMW

SEQ ID NO: 156454 - protein, 189 aa, Glycine max
  Coding DNA Sequence Number=SeqID_39676
  Gene Ontology: Mol. function=catalytic activity; Cellular component =cytosol; Biological process=metabolic process
  Homolog annotation: Hit_ID=Q9C522; Match level="QueryCoverage=92%, HitCoverage=28%, E-value=2e-84, Identity=88%"; Hit description=ATP citrate lyase, putative; 3734-7120
  Pfam annotation: Domain name=CoA_binding; Domain location=6-114; Score=-13.8; E_value=0.075; Accession=PF02629.9; Description=CoA binding domain
MATGQLFSRTTQALFYNYKQLPIQRMLDFDFLCGRETPSVAGIINPGSEGFQKLFFGQEEIAIPVHATVEAACAAHPTADVFINFASFRSAAASSMAALKQPTIRVVAIIAEGVPESDTKQLIAYARSNNKVVIGPATVGGIQAGAFKIGDTAGTIDNIIQCKLYRPGSVGFVSKSRKIPPTEANSSSK

SEQ ID NO: 156455 - protein, 720 aa, Glycine max
  Coding DNA Sequence Number=SeqID_39677
  Gene Ontology: Mol. function=protein serine/threonine kinase activity; Cellular component=membrane; Biological process=regulation of transcription, DNA-dependent
  Homolog annotation: Hit_ID=Q9C902; Match level="QueryCoverage=89%, HitCoverage=86%, E-value=0.0, Identity=56%"; Hit description=Protein kinase, putative; 19229-23534
  Pfam annotation: Domain name=PAS; Domain location=68-176; Score=52.2; E_value=1.8e-12; Accession=PF00989.14; Description=PAS domain
  Pfam annotation: Domain name=PAS_3; Domain location=90-182; Score =26.6; E_value=8.7e-05; Accession=PF08447.1; Description=PAS fold
  Pfam annotation: Domain name=PAS_4; Domain location=74-185; Score =23.4; E_value=0.0008; Accession=PF08448.1; Description=PAS fold
  Pfam annotation: Domain name=Pkinase; Domain location=447-694; Score =229.2; E_value=8.9e-66; Accession=PF00069.15; Description=Protein kinase domain
  Pfam annotation: Domain name=Pkinase_Tyr; Domain location=447-694; Score=249.3; E_value=7.9e-72; Accession=PF07714.7; Description =Protein tyrosine kinase
  Pfam module annotation: Pfam domain module=PAS::PAS_3::PAS _4::Pkinase::Pkinase_Tyr; Domain location=68-176::90-182::74-185::447- 694::447-694
MGSSTEMGIPEEEKEEELLKKIERLEAGHAHLKQEMSNFKLFQNNKSRSRFGAATCNKPSSSLHQNGNKYLNILQSMGHAVHVLDLQCRIMYWNPSAESMYGYAAEEVLGQDGIEMLVDPSDFGLANDVFNHVKRGESWRGQLPVKNKRGDRFYAVTTNTPFYDDDDGSLVGVICVSCDSRPFLETRIPLSGVENAEPDSGLNGRRRSSISDKLGLDSKQPLQAALASKISNLASKVSNKVKSRIRTGESNTNGEGGSGESHHSEPSLSDCVLADQREDGNSSGASTPRGEVLKSPFGVFSHVEEKSEGKSVRGSGEQSQGKPIHKIITSKAETWIQKKTSSWPWRANDQEGSEARNVRVAWPWSQGDQENESVNQKNISSGLKPESQAGESNRSGINEASGSWSSFFNVNSTGSTSSCGSVSSSAANIKGDVDSDCLDYEILWEDLTMGEPIGQGSCGTVYHAQWYGSDVAVKVFSKHEYTDDTILSFKQEVSVMKRLRHPNIILFMGAVTSPQHLCIVTEFLPRGSLFRLLQRNTSKIDWRRRVHMALDVARGVNYLHHCNPPIIHRDLKSSNILVDKNWTVKVGDFGLSRLKHETYLTTKTGKGTPQWMAPEVLRNELSDENFGVILWELTTEKIPWDTLNPMQVVGAVGFMNHRLEIPEDVDPQWTSIIESCWHSDPACRPAFQELLERLKELQRRYTIEFQAARSAVEEGTQKEF

SEQ ID NO: 156456 - protein, 690 aa, Glycine max
  Coding DNA Sequence Number=SeqID_39678
  Gene Ontology: Mol. function=hydrolase activity, acting on ester bonds; Biological process=lipid metabolic process
  Homolog annotation: Hit_ID=Q10MG0; Match level="QueryCoverage=64%, HitCoverage=71%, E-value=2e-91, Identity=54%"; Hit description=GDSL -like Lipase/Acylhydrolase family protein, expressed
  Pfam annotation: Domain name=Lipase_GDSL; Domain location=3-262; Score=100.3; E_value=5.6e-27; Accession=PF00657.12; Description=GDSL- like LipaseAcylhydrolase
MGIGFTPPYLAPTTVGPGVLEGVNYASGASGILNLTGKLFGDRINFDAQLDNFANTRQDIISNIGVPAALNLFKRSLFSVAMGSNDFINNYLAPAVLIYEKNLASPELFVTTLVSRFREQLIRLFNLGARKIIVTNVGPIGCIPIQRDMNPAAGDGCVTFPNQLAQSFNIQLKGLIAELNSNLKGAMFVYADVYNILEDILNNYEAYGFENPSSSCCSMAGRFGGLVPCGPTSSICWDRSKYVFWDPWHPTDAANVIIAKRLLDEVSDNEVRIKTWQGGSVSGVAFSNIHMDSIRNWALDPTTTGSVVLKGVNYASGAGGILNNSSENFGGRINFDAQIDTYANTRQEIISLIGVPAARNLFKKALFTIALGSNSRKGVGISGNICGARKIVVANVGPIGCIPYVRDFNPLAGDECVTFPNELAQFFNTQLKNLVAELRTKLEGFGKKKLSGAGEPRVRVSERCGMFHALMSLIARCWKPFGHGDDAANAAAAAGRECKDGLLWFRDIGKFAAGDFSMAVVQANQVLEDQSQIESGAFGSFVGVYDGHGGPDCSRYVCDNLFRNLQAILAESQSVVTSEAIQQAFRRTEEGFTALVSELWSSRPQIATTGTCCLVGVICRQTLFVASLGDSRAVLGRRVGNTGGMAAIQLSTEHNANFEAIRQELKELHPNDPQIVVLKHGVWRVKGIIQ

SEQ ID NO: 156457 - protein, 346 aa, Glycine max
  Coding DNA Sequence Number=SeqID_39679
  Gene Ontology: Mol. function=pectinesterase activity; Cellular component=cell wall; Biological process=cell wall modification
  Homolog annotation: Hit_ID=Q84WQ3; Match level="QueryCoverage=83%, HitCoverage=72%, E-value=6e-60, Identity=40%"; Hit description =Putative pectinesterase family protein
  Pfam annotation: Domain name=Pectinesterase; Domain location=51-339; Score=204.6; E_value=2.3e-58; Accession=PF01095.10; Description =Pectinesterase
MASPRSWLSFHVSSFIVTILIFCLSHCALCLDGQTVVDSPLLTEKLGINRTIKVDINGNGEFKSIQAAIDSIPEGNSKWVIVHVRKGIYREKVHVPQNKPYIFMRGNGRGKTAIVWSQSSEDNIDSATFKVEAHDFIAFGISFKNEAPTGIAYTSQNQSVAAFVAADKVAFYHCAFYSTHNTLFDYKGRHYYESCYIQGSIDFIFGRGRSIFHKADIFVVDDKRVTIKGSVTAQNRESEGEMSGFIFIKGKVYGIGGVYLGRAKGPYSRVIFAETYLSKTIVPEGWTNWSYDGSTKDLYHAEYECHGPGALTTGRAPWSRQLTKEEVAPFISIDYIDGKNWLPAWV

SEQ ID NO: 156458 - protein, 114 aa, Glycine max
  Coding DNA Sequence Number=SeqID_39680
MAVENKDSNGMERNRKEIEKKGNRVKQRSRERKNKKVTIHNPVGCSLDMVYIVIWFIINVVVMEWREKELAAVKINAADVDIIANELELDIKVAERTLREHKGDAVAAIRHLLH

SEQ ID NO: 156459 - protein, 258 aa, Glycine max
  Coding DNA Sequence Number=SeqID_39681
  Pfam annotation: Domain name=GRP; Domain location=1-120; Score=-4.6; E_value=0.0002; Accession=PF07172.2; Description=Glycine rich protein family
MGKLRKSIGILFVFLLLVIVIAECQKVKKDELLEGFEGGGFGNGEGFGKGGGDAGGGFGDEHGSGVGGGAGGGGGGYRGVGGGIGGGLGGGVVGGGGGGEHDGIGGGVGGVGGGGSGAGGGLGGGDGGGIGGGAGDGSGVGGGGTGGSIGGGHGGGGGGGGVGVGGGYGGGRGGSARGGAGGIGGGHGGRNGGGFGAGVASGTVGGVGGGYGDGKGGGVGGGFGGGHGGSACVGGGKGGGNGGVVGGHASGSSRGSGY

SEQ ID NO: 156460 - protein, 135 aa, Glycine max
  Coding DNA Sequence Number=SeqID_39682
MAFESRALSKSHFVSFAPSLRPLSLRLIGTLKRVTVEANSTYSMIILELLEAEDAAEDSNHVNGNQNFSRTTIITNGGGNSGGDRNRSNTPNRYGVCTINNTCTFSATSGNINRGFIRRMYLTNTPSGTTSIIYY

SEQ ID NO: 156461 - protein, 207 aa, Glycine max
  Coding DNA Sequence Number=SeqID_39683
MADSRIFRLRSRTRHNSFFRVPFLLCRQITGNNLNAAFASVSEDSVDLSPISEISYANHGEDVTFQTFLLEEPSSVTLVPSDLTPKEITDATGIISSTNSISTDKFDSSKFNSVEAEITVNFLRNVKTDVLNAAPQCRRELMDGIIEYVISDLQTYTLPEERDQFAHLLSMKNRMLFLCTFIWVIGVSVLLFFTSYTRGPYRGPTPT

SEQ ID NO: 156462 - protein, 62 aa, Glycine max
  Coding DNA Sequence Number=SeqID_39684
MGSRREEAPLLLIAMKLRHSCALSATESWRRTLMLVEEEEREGDVKMSAVSYEVGATSHMGP

SEQ ID NO: 156463 - protein, 120 aa, Glycine max
  Coding DNA Sequence Number=SeqID_39685
MPDSVEINLEHVDEAKAADKVSNSNHNKEASNGKKKGDQKINDTTKGQNSTYTNNQCNHSVNGSIYGGTINLGGSQGNQTRYENSRVINNNGTFNGNANGCFNEGGFQSHTTHYYDGRRG

SEQ ID NO: 156464 - protein, 163 aa, Glycine max
  Coding DNA Sequence Number=SeqID_39686
ASNRQVCKGLEPFNYLTTRMADSFARLMLMRLLDENPVDQPPSSLSPPPQPRPRRNPRDRAPRHNTPSSHHSPPQSFNNSGTLNMEGAINNAGCVQGNGNGGYCADFLAKLDPNSGSWFSELVIPRTELQPADARMTLNPLLLTFLATVPFLYLNMNIPTFKS

SEQ ID NO: 156465 - protein, 97 aa, Glycine max
  Coding DNA Sequence Number=SeqID_39687
MELLEAHVEGAKGSKSNSNNRYDSGSQNGSTINSGNYTNNNNSYDDSYHYGGRAIITPALSMVMTMGDILRMALTSQEGATMGYHVNYQLMDKQELG

SEQ ID NO: 156466 - protein, 97 aa, Glycine max
  Coding DNA Sequence Number=SeqID_39688
  Homolog annotation: Hit_ID=Q1SG42; Match level="QueryCoverage=55%, HitCoverage=54%, E-value=2e-11, Identity=55%"; Hit description=PsAD2
MADMMQRTLELVQADQAAKGSNYGTSNSFNQHGNRNQNFSGATINSGNDAGNRNRYHTSNHYNEHVLNNTGAFNGNGNGGHIEGGFHSSKRIYYRRR

SEQ ID NO: 156467 - protein, 103 aa, Glycine max
  Coding DNA Sequence Number=SeqID_39689
MADLMKRILLMEAEQASKWSKHVTSTINSGNHHNNGNRYDHSYHYDERPIYNRGTFNGDGNGSHIQGDFDSSERNYYGRRYELSKKGGKKRRKRGKIDFLKVV

SEQ ID NO: 156468 - protein, 92 aa, Glycine max
  Coding DNA Sequence Number=SeqID_39690
MEESKGFVGGESQKPHPEMPSISFQIPMPGRNRSGGLYPWGWRQRAIIPQHTVRNSNGASENTNLKVCCGCYVVFFIIVYYRAWVYVAQYLL

SEQ ID NO: 156469 - protein, 146 aa, Glycine max
  Coding DNA Sequence Number=SeqID_39691
  Homolog annotation: Hit_ID=Q1SG53; Match level="QueryCoverage=85%, HitCoverage=19%, E-value=7e-25, Identity=53%"; Hit description=GRAS transcription factor
MEDLYHVSFTTDDNSSSSNDILWCTEELNELRKVQFSGAEDHGEYGGIDPLYSNFGFFPDDPSEQEGYLLSTDQQKYHQQVQPSYHDYGQLDDNLQFDMVSPPLQFDAQYPTMVPLCHTTKDKPNSNSNTPLASLDILNNYGKGFK

SEQ ID NO: 156470 - protein, 326 aa, Glycine max
  Coding DNA Sequence Number=SeqID_39692
  Gene Ontology: Mol. function=transcription factor activity; Cellular component=nucleus; Biological process=regulation of transcription, DNA-dependent
  Homolog annotation: Hit_ID=Q1SG54; Match level="QueryCoverage=99%, HitCoverage=56%, E-value=1e-132, Identity=71%"; Hit description=GRAS transcription factor
  Pfam annotation: Domain name=GRAS; Domain location=2-234; Score=46.7; E_value=8e-11; Accession=PF03514.5; Description=GRAS family transcription factor
ALRQRIDRATGRVSYKDLQKGPSFDPLEATKVLNPTVVAFYEELPFCQISVFTEVQVIIEDVAEAKKIHVIDLEIRKGVQWTILMQALESRHECPIELLKITAVESGTTRHIAEDTGERLKDYAQGLNIPFSYNIVMVSDMLHLGEDVFEIDPEETIVVYSHFALRTKIQESGQLEIMMRVIRILNPSVMVVAEIEANHNSTSFVNRFIEALFFFSTFFDCLETCMKGDEGNRMIVESLYFSHGIRNIVAAEGAERDSRSVKIDVWRAFFSRFGMVEKELSKLCLFQADLVAKRFPSYSTFDKNGHCLLIGWKGTPINSVSVWKFL

SEQ ID NO: 156471 - protein, 116 aa, Glycine max
  Coding DNA Sequence Number=SeqID_39693
MRGSGEFVPFLDTTSRGSEMPQRTFLRRRHGPSVGLFTVGIETEPICNAYAKDTMRECTQSPAESPTVATYPSAGGRRVTRGMRVPRKEYARSRHQRLFEENVGKTGKDAIYELFK

SEQ ID NO: 156472 - protein, 107 aa, Glycine max
  Coding DNA Sequence Number=SeqID_39694
  Gene Ontology: Mol. function=serine esterase activity
MEEEESLRMFSPEVMIQDPNIGNANSLLPPVVFFHGSGNYSIPLDAWFVPIYKGFTFFAPLELVGLGSSSSMDSFASWKINGSGMEKEEREETPLQGEDESRRSSPP

SEQ ID NO: 156473 - protein, 91 aa, Glycine max
  Coding DNA Sequence Number=SeqID_39695
  Subcellular localization annotation: CTP_CleavageSite=38; ConfidenceScore=5.14e-01
TYQGNPCGVYPDLSSFTGSGVYPDLSSFTGSGVYPDLSSFTGSGVIQNLRSLYQAIRSYSGSHQVELERKNLADVHCKFLRQHRAKKHPLP

SEQ ID NO: 156474 - protein, 68 aa, Glycine max
  Coding DNA Sequence Number=SeqID_39696
  Subcellular localization annotation: CTP_CleavageSite=28; ConfidenceScore=5.33e-01
MGVQIATRPTWALQKIPPKGGGFWRKPPCSPGRAGKSEPRHFRNVSVGDFMKVFDRSSSFFGLQPSFS

SEQ ID NO: 156475 - protein, 212 aa, Glycine max
  Coding DNA Sequence Number=SeqID_39697
  Gene Ontology: Mol. function=anthranilate synthase activity; Biological process=aromatic amino acid family biosynthetic process
  Homolog annotation: Hit_ID=P00897; Match level="QueryCoverage=92%, HitCoverage=38%, E-value=2e-91, Identity=87%"; Hit description =Anthranilate synthase component 1
MRAFLWTEFTGTTDDEHQTTNDIAEGASQLPGRPHHHFPPAVRRPSGHPAAGIGGNQQQTESAEPAGDRQRAAHYRTGPHRQRAGAERQRRGAAAAAGRSAAARGAQSGAPQRPRAELPGDRRGAGRRRPPAFTVGVRRAAHAADPGGLPGGRARSRDAGRPVRLRFGRRFRRPAGAAPGSALPGLLLLSGGNPAGAGSPTRLGPSAGQRLQ

SEQ ID NO: 156476 - protein, 121 aa, Glycine max
  Coding DNA Sequence Number=SeqID_39698
  Gene Ontology: Mol. function=DNA binding; Biological process=DNA integration
MMSRSSYNTTRKANSACQVGVQKQAGRGNAFLNRLIQEEVYVEKPPGFESNTFPHHLMQAEFEMSVMGELEFFLGLQIKQTRYEIYIHQTKYVKELLKKFKLKDAKENEDSYASNDASWTG

SEQ ID NO: 156477 - protein, 189 aa, Glycine max
  Coding DNA Sequence Number=SeqID_39699
MHTRARFQPASARRRVWIMRTNIWMMLLPSNLLQSDHNSDLPLPKWIAPTGHSVGPEKSNRVLGFSALITSLHQFYGVPVAPSRFIRPLLIGLSSRSIAPPSRHRARHHSRGQQTHRHHLQSSPQLTHKKAGALPTTHGQPVGTQPPEQRFEAIKGWSFLRQRQGQLRDDEFPHFLGGGGAIQLGSPNL

SEQ ID NO: 156478 - protein, 118 aa, Glycine max
  Coding DNA Sequence Number=SeqID_39700
MPISPCESIGWSVSSRHRVAPRRHLVDPEEPNRALGFQALVTGLCQSYRVPVPPARSCHRDIGIAPTKTLSEPREVQQGLGVSSSGYGPLSVLQGARPPSKGSRPQDTQWTRRSPTGS

SEQ ID NO: 156479 - protein, 82 aa, Glycine max
  Coding DNA Sequence Number=SeqID_39701
MVIYPKSKLDGSSTQLTSVKPESSTQDSPKPIISKQTMADYAWSIQTLQALEEIGLTKVPMLAKKTWAEMASKSDDDSETDL

SEQ ID NO: 156480 - protein, 93 aa, Glycine max
  Coding DNA Sequence Number=SeqID_39702
MNAGDPPQQKTSQGNEKKKEDENITQVILKEVKNKIKGFPSLDLITGDPPQEERSLRIKIEEELKNITEGDPPKQKRSQGNEKKTEDDNITQG

SEQ ID NO: 156481 - protein, 162 aa, Glycine max
  Coding DNA Sequence Number=SeqID_39703
  Homolog annotation: Hit_ID=Q1STP5; Match level="QueryCoverage=86%, HitCoverage=21%, E-value=1e-10, Identity=33%"; Hit description=IMP dehydrogenase/GMP reductase
MLLAEVWVEEIVMIPMMLRSVDGLPHPHGDNVEADVFPDDPMAPADVEDTGADIPTDIGAQAAEDKHEGFPGGLSDLSVLTQYADHVACSVWTGDERLELKLSSHRRKVHSLGRPVPTIEGLVAWTGLSPLIARSVDTGDQGLLSSFVERWHRETSSFHLPV

SEQ ID NO: 156482 - protein, 121 aa, Glycine max
  Coding DNA Sequence Number=SeqID_39704
MDLIENMVASDIAIFRDRAHVPTKKSLLELTSQDALLAQNKLLSKQLEVFTETLRCAICGGAHNSGCCIPNEEPTHEVNYTGNQPRKNFNASGYSGFQHGQPYNSQQGQWRNHPGNQFNKD

SEQ ID NO: 156483 - protein, 927 aa, Glycine max
  Coding DNA Sequence Number=SeqID_39705
  Gene Ontology: Mol. function=nucleoside-triphosphatase activity; Biological process=defense response
  Homolog annotation: Hit_ID=Q1STU5; Match level="QueryCoverage=99%, HitCoverage=97%, E-value=1e-102, Identity=32%"; Hit description =Leucine-rich repeat
  Pfam annotation: Domain name=LRR_1; Domain location=179-203; Score =4.0; E_value=51; Accession=PF00560.23; Description=Leucine Rich Repeat
  Pfam annotation: Domain name=LRR_1; Domain location=237-258; Score =5.4; E_value=28; Accession=PF00560.23; Description=Leucine Rich Repeat
  Pfam annotation: Domain name=LRR_1; Domain location=261-282; Score =2.8; E_value=85; Accession=PF00560.23; Description=Leucine Rich Repeat
  Pfam annotation: Domain name=LRR_1; Domain location=433-457; Score =0.1; E_value=2.7e+02; Accession=PF00560.23; Description=Leucine Rich Repeat
  Pfam annotation: Domain name=LRR_1; Domain location=518-541; Score =1.0; E_value=1.8e+02; Accession=PF00560.23; Description=Leucine Rich Repeat
  Pfam annotation: Domain name=LRR_1; Domain location=604-626; Score =6.1; E_value=21; Accession=PF00560.23; Description=Leucine Rich Repeat
  Pfam annotation: Domain name=LRR_1; Domain location=707-731; Score =4.0; E_value=51; Accession=PF00560.23; Description=Leucine Rich Repeat
  Pfam annotation: Domain name=LRR_1; Domain location=76-98; Score=3.6; E_value=59; Accession=PF00560.23; Description=Leucine Rich Repeat
  Pfam annotation: Domain name=LRR_1; Domain location=765-786; Score =5.4; E_value=28; Accession=PF00560.23; Description=Leucine Rich Repeat
  Pfam annotation: Domain name=LRR_1; Domain location=789-810; Score =2.8; E_value=85; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=179 -203::237-258::261-282::433-457::518-541::604-626::707-731::76 -98::765-786::789-810
TLARLFPLSLARNLGKLKTLEIQICDKLVEIVGKEDVTEHGTTEMFEFPCLWKLILYKLSLLSCFYPGKHHLECPVLKCLDVSYCPKLKLFTSEFGDSPKQAVIEAPISQLQQQPLFSIEKIVPNLEELTLNEEDIMLLSDAHLPQDFLFKLTDLDLSFENDDNKKETLPFDFLQKVPSLDYLRVERCYGLKEIFPSQKFQVHDRSLPGLKQLRLYDLGELESIGLEHPWVKPYSQKLQLLKLWGCPQLEELVSCAVSFINLKELEVTNCNRMEYLLKCSTAKSLLQLESLSISECESMKEIVKKEEEDASDEITFGSLRRIMLDSLPRLVRFYSGNATLHFKCLEEATIAECQNMKTFSEGIIDAPLLEGIKTSTEDTDHLTSHHDLNTTIETLFHQQVFFEYSKHMILVDYLETAGVTHGKPAFLKNFFGSLKKLEFDGAIKREIVIPSDVLPYLNTLEELNVHSSDAVQIIFDMDDTDANTKGIVLPLKKLTLEDLSNLKCLWNKNPPGTLSFPNLQQVSVFSCRSLATLFPLSLARNLGKLQTLKIQICHKLVEIVGKEDEMEHGTTEMFEFPYLRNLLLYELSLLSCFYPGKHHLECPLLERLDVSYCPKLKLFTSEFGDSPKQAVIEAPISQLQQQPLFSIEKIVPNLKGLTLNEEDIMLLSDAHLPQDFLFKLTDLDLSFENDDNKKETLPFDFLQKVPSLDYLRVERCYGLKEIFPSQKFQVHDRSLPGLKQLRLYDLGELESIGLEHPWVKPYSQKLQLLKLWGCPQLEELVSCAVSFINLKELEVTNCNRMEYLLKCSTAKSLLQLESLSISECESMKEIVKKEEEDASDEITFGSLRRIMLDSLPRLVRFYSGNATLHFKCLEEATIAECQNMKTFSEGIIDAPLLEGIKTSTEDTDHLTSNHDLNTTIQTLFHQQ

SEQ ID NO: 156484 - protein, 206 aa, Glycine max
  Coding DNA Sequence Number=SeqID_39706
  Homolog annotation: Hit_ID=Q8LAU8; Match level="QueryCoverage=49%, HitCoverage=32%, E-value=6e-32, Identity=67%"; Hit description =Dessication-related protein, putative
MAPHISRASVVVLVAFLVLPLLFSDMARATIPESDVDLLEFPLNLEYLEAEFFLFGSLGHGLDVVAPNLTEGGPPPIGGKLAKLDNFVKDVIFQFALQEVGHLRAIKRTVKGFPRPLLDLSATSFAQSGRHRGGAPIRPIVSRITIHWPSFYNVVTGENPGVTQLNRLAAHPPFASWRNSEEARTDRPSQQLRSLNGEWTRPVAAH

SEQ ID NO: 156485 - protein, 167 aa, Glycine max
  Coding DNA Sequence Number=SeqID_39707
MSYRMSRHHASEHADYMCPYEQIKQVNNTRELFTQFGATSPTSGGSKPGRKSTLNSVSSRSNSPCLQPSHLTTTLKDTPEINSEQKRSTLHTRDQLYTLEINSTHIGPTLDVRVPSRWLTKDSSPKNSQTNSSIPDLVQNSCSLHDYIAVYDSGLQVLDAGGDLSSS

SEQ ID NO: 156486 - protein, 118 aa, Glycine max
  Coding DNA Sequence Number=SeqID_39708
MVKLLSKFLFSVLQILISLNAEPYSFWPDLFKEANYEWGLVIKEWIHGVMEYFPFIGSSSFKLSKCFTSSTFPLALILFKDPSSSSICISLTHPMGRAMRWLKGPYSTACVRWLAELL

SEQ ID NO: 156487 - protein, 50 aa, Glycine max
  Coding DNA Sequence Number=SeqID_39709
MASFLKRPNVRIYHMLTIAEETADLLGGGVGVCHSFGLCQHSGKLLTPVQ

SEQ ID NO: 156488 - protein, 141 aa, Glycine max
  Coding DNA Sequence Number=SeqID_39710
  Homolog annotation: Hit_ID=Q1S0F5; Match level="QueryCoverage=70%, HitCoverage=20%, E-value=6e-07, Identity=33%"; Hit description=IMP dehydrogenase/GMP reductase
MARIAKVVKISEQELDRVKQNRNGVVGIPRKRLEEKVEALASKGEWAAFIDVFALLVFGTVLFSNVDGLVDLVTIDAFLAYHHSKESSVIPVWADPYDTFNLRCEKSSARIVYCTPALYVWLVITCAPKRVQQIRKNSWQA

SEQ ID NO: 156489 - protein, 66 aa, Glycine max
  Coding DNA Sequence Number=SeqID_39711
  Subcellular localization annotation: CTP_CleavageSite=58; ConfidenceScore=5.31e-01
MSPPPLKTSQSLKNSFKALQDASFGLLSRLWVRMLQNSPLILCFQILYGNPVGGLSLSANLALSAH

SEQ ID NO: 156490 - protein, 44 aa, Glycine max
  Coding DNA Sequence Number=SeqID_39712
MRKLIKEMMENKVANFVGLNKVKKWWLDRNIEMAITEATGIQMR

SEQ ID NO: 156491 - protein, 82 aa, Glycine max
  Coding DNA Sequence Number=SeqID_39713
  Homolog annotation: Hit_ID=Q9CAE1; Match level="QueryCoverage=46%, HitCoverage=4%, E-value=1e-10, Identity=74%"; Hit description =Putative aminopeptidase; 4537-10989
MDKAIKEVSGENYIEQAAMRDVQKAYVFGTTYFLRIMFQGMDLYFKRHDGQAVTYEDFYVAMRDANDADFANFLLWFVFIAF

SEQ ID NO: 156492 - protein, 100 aa, Glycine max
  Coding DNA Sequence Number=SeqID_39714
MESPLDQEEGTQPKKEKNETPKDSSADREKEKKTYLVHYVTFHGDLTMASDKISTTIVVLPLSALQQPRTTGLCTSGAMDNAPPSVVAFVLAVPFFARGN

SEQ ID NO: 156493 - protein, 287 aa, Glycine max
  Coding DNA Sequence Number=SeqID_39715
  Gene Ontology: Mol. function=nucleoside-triphosphatase activity; Biological process=defense response
  Homolog annotation: Hit_ID=Q1SI90; Match level="QueryCoverage=81%, HitCoverage=24%, E-value=3e-22, Identity=30%"; Hit description =Disease resistance protein; AAA ATPase
VDPKLKELTLNEENIILLRDAHLPQDFLCKLNILDLSFDDYENKKDTLPFDFLHKVPSVECLRVQRCYGLKEIFPSQKLQVHHGILARLNQLELNKLKELESIGLEHPWVKPYSAKLEILNIRKCSRLEKVVSCAVSFISLKKLYLSDCERMEYLFTSSTAKSLVQLKILYIEKCESIKEIVRKEDESDASEEIIFGRLTKLRLESLGRLVRFYSGDGTLQFSCLEEATIAECPNMNTFSEGFVNAPMFEGIKTSTEDSDLTFHHDLNSTIKMLFHQHMCMQLLPYA

SEQ ID NO: 156494 - protein, 510 aa, Glycine max
  Coding DNA Sequence Number=SeqID_39716
  Homolog annotation: Hit_ID=Q1SR88; Match level="QueryCoverage=32%, HitCoverage=36%, E-value=9e-08, Identity=27%"; Hit description=IMP dehydrogenase/GMP reductase
  Pfam annotation: Domain name=DUF674; Domain location=1-449; Score =115.6; E_value=1.4e-31; Accession=PF05056.3; Description=Protein of unknown function (DUF674)
MASNQEITAPLRYWVDNERKRVVMAEASGHFVDVLFSFLTLPLGTIIRLGNTFGQPIEIGCINNLFKSVEALNPDVFWNDICKRMLLSPRNPLQFSYQRLKLKVDDTQPTKYFVCHICSKGSDFSLSTFDEVKCHCGNLMKRQLDMLVEPAGGNGVFVKGDAMFLIFDDLTVLRSSPSVSFKPPLQLGHKEFRKVEEKSLDVDTNKVFSILNQALTSKSALSVTLENGKSEPSSSFLPDIGPSRWKDSIKIKVIVSKSQNKILFVEADGDFVDFLVSFLTMPLGSIMYLVNGKLSLGSIDKLYTSVKNLDPSWFIASSTKSLLNPKVALHFGCGSNPINASEEDTGKYWYGTGIVKDNRGRIICEKNMISKKKDMLKDPKDIKLLDPRSSDGARKSDVGFMKRPCLFVVSDNLEVKAMTTSSSIPCPFMENDRLLDDLEEHLVEIRKSQALNLLMASLTSNEAAFTRSLSHLLWNWKCQRCIPFWGLLGRKKIRHRKKKEKEDKESEKDI

SEQ ID NO: 156495 - protein, 101 aa, Glycine max
  Coding DNA Sequence Number=SeqID_39717
MVMNSLHQWCPVSSVAKSSQTKAIRREGAIILRLKLQKDTDAFRLEREKEATKRLFDFADKYRVLTRFLSIYSIATQVTRNILWREERFKSDIESFMCSMM

SEQ ID NO: 156496 - protein, 79 aa, Glycine max
  Coding DNA Sequence Number=SeqID_39718
MGVWEEAGGCEKKRLRGVTKTDQGAPGVAPAAGAPPVAPSGRALLDAPASGALPCCSLVRRAGATCRVIHGSAWLGDAL

SEQ ID NO: 156497 - protein, 113 aa, Glycine max
  Coding DNA Sequence Number=SeqID_39719
  Gene Ontology: Mol. function=DNA binding; Biological process=DNA integration
  Homolog annotation: Hit_ID=Q1S9T9; Match level="QueryCoverage=88%, HitCoverage=8%, E-value=1e-30, Identity=64%"; Hit description =Peptidase S8 and S53, subtilisin, kexin, sedolisin; Integrase, catalytic region; Zinc finger, CCHC-type
METLRRPFICNNLRDEEKIVLILAGYLKKVVERFRMHQSKFVSTPLRHHTKLSITQAPNIEEERKKMDIVPYASRVGSIMYGMVCSRPNLAHAIHIVKRFRADSGQAHWEALK

SEQ ID NO: 156498 - protein, 1610 aa, Glycine max
  Coding DNA Sequence Number=SeqID_39720
  Gene Ontology: Mol. function=nucleoside-triphosphatase activity; Cellular component=membrane; Biological process=defense response
  Homolog annotation: Hit_ID=Q1SI90; Match level="QueryCoverage=98%, HitCoverage=99%, E-value=1e-180, Identity=29%"; Hit description =Disease resistance protein; AAA ATPase
  Pfam annotation: Domain name=AAA; Domain location=178-425; Score= -4.9; E_value=0.0005; Accession=PF00004.19; Description=ATPase family associated with various cellular activities (AAA)
  Pfam annotation: Domain name=LRR_1; Domain location=1028-1050; Score =3.4; E_value=66; Accession=PF00560.23; Description=Leucine Rich Repeat
  Pfam annotation: Domain name=LRR_1; Domain location=1053-1074; Score =0.6; E_value=2.2e+02; Accession=PF00560.23; Description=Leucine Rich Repeat
  Pfam annotation: Domain name=LRR_1; Domain location=1079-1109; Score =0.2; E_value=2.6e+02; Accession=PF00560.23; Description=Leucine Rich Repeat
  Pfam annotation: Domain name=LRR_1; Domain location=1135-1155; Score =1.2; E_value=1.7e+02; Accession=PF00560.23; Description=Leucine Rich Repeat
  Pfam annotation: Domain name=LRR_1; Domain location=1161-1182; Score =2.1; E_value=1.2e+02; Accession=PF00560.23; Description=Leucine Rich Repeat
  Pfam annotation: Domain name=LRR_1; Domain location=1220-1241; Score =2.9; E_value=81; Accession=PF00560.23; Description=Leucine Rich Repeat
  Pfam annotation: Domain name=LRR_1; Domain location=1246-1268; Score =1.5; E_value=1.5e+02; Accession=PF00560.23; Description=Leucine Rich Repeat
  Pfam annotation: Domain name=LRR_1; Domain location=1305-1327; Score =0.9; E_value=1.9e+02; Accession=PF00560.23; Description=Leucine Rich Repeat
  Pfam annotation: Domain name=LRR_1; Domain location=1392-1412; Score =5.3; E_value=29; Accession=PF00560.23; Description=Leucine Rich Repeat
  Pfam annotation: Domain name=LRR_1; Domain location=1448-1471; Score =5.0; E_value=32; Accession=PF00560.23; Description=Leucine Rich Repeat
  Pfam annotation: Domain name=LRR_1; Domain location=1472-1495; Score =2.4; E_value=1e+02; Accession=PF00560.23; Description=Leucine Rich Repeat
  Pfam annotation: Domain name=LRR_1; Domain location=593-616; Score =0.0; E_value=2.8e+02; Accession=PF00560.23; Description=Leucine Rich Repeat
  Pfam annotation: Domain name=LRR_1; Domain location=618-639; Score =8.7; E_value=6.8; Accession=PF00560.23; Description=Leucine Rich Repeat
  Pfam annotation: Domain name=LRR_1; Domain location=641-662; Score =4.9; E_value=35; Accession=PF00560.23; Description=Leucine Rich Repeat
  Pfam annotation: Domain name=LRR_1; Domain location=664-685; Score =14.7; E_value=0.33; Accession=PF00560.23; Description=Leucine Rich Repeat
  Pfam annotation: Domain name=LRR_1; Domain location=687-710; Score =10.6; E_value=3; Accession=PF00560.23; Description=Leucine Rich Repeat
  Pfam annotation: Domain name=LRR_1; Domain location=746-768; Score =4.0; E_value=52; Accession=PF00560.23; Description=Leucine Rich Repeat
  Pfam annotation: Domain name=LRR_1; Domain location=847-869; Score =0.7; E_value=2.1e+02; Accession=PF00560.23; Description=Leucine Rich Repeat
  Pfam annotation: Domain name=LRR_1; Domain location=931-952; Score =0.1; E_value=2.7e+02; Accession=PF00560.23; Description=Leucine Rich Repeat
  Pfam annotation: Domain name=NB-ARC; Domain location=139-501; Score =28.3; E_value=4.3e-12; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::NB-ARC; Domain location=178-425::...
  Pfam module annotation: Domain location=1028-1050::1053-1074::1079 -1109::1135-1155::1161-1182::1220-1241::1246-1268::1305-1327::1392 -1412::1448-1471::1472-1495::593-616::618-639::641-662::664-685::687 -710::746-768::847-869::931-952::139-501
MDPITSATAQSALQIAEHVVKRQVGYIFNYKDKFKEVEQYIERLDDTRKRVQNEVNDAEKNGEEINDEVQHWLKQVDEKIKKYECFIDDERHAQTRCSIRLIFPNNLSLRYRLGRKATKIVEEIKADGHSNKKFDKVSYRLGPSSDAALLNTGYVSFGSRNETMEKIMKALEDSTVNIVGVYGAGGVGKTTLVKEVANKAREKKLFNMVVMANVTRIPDIEKIQGQIAEMLGMRLEEESEIVRADRIRKRLMNEKENTLIILDDLWDGLNLNILGIPRSEDDDGSQQDVNDLSDFGYHKMEKEVFSADFHTMKKDKLAVDFNTMKKGKLSVDSNMIKKEKLSGDHKGCKILLTSRSKEVICNKMDVQERSTFSVGVLDENEAKSFLKKLAGIRAQSFEFDEKVIEIAKMCDGLPMALVSIGRALKNKSSFVWQDVCQRIKRQSFTEGHESIEFSVNLSFEHLKNEQLKHIFLLCARMGNDALIMDLVKFCIGLGLLQGVHTIREARNKVNMLIEELKESTLLVESLSHDRFNMHDIVRDVALSISSKEKHVFFMKNGIVDEWPHKDELERYTAICLHFCDINDGLPESIHCPRLEVLHIDSKDDFLKIPDDFFKDMIELRVLILTGVNLSCLPSSIKCLKKLRMLSLERCTLGENLSIIGELKKLRILTLSGSNIESLPLEFGQLDKLQLFDISNCSKLRVIPSNTISRMNSLEEFYMRDSLILWEAEENIQSQKAILSELRHLNQLQNLDVHIQSVSHFPQNLFLDMLDSYKIVIGEFNMLKEGEFKIPDMYDQAKFLALNLKEGIDIHSETWVKMLFKSVEYLLLGELNDVHDVFYELNVEGFPYLKHLSIVNNFGIQYIINSVERFHPLLAFPKLESMCLYKLDNLEKICGNNHLEEASFCRLKVIKIKTCDKLENIFPFFMVGLLTMLETIEVCDCDSLKEIVSIERQTHTINDDKIEFPQLRLLTLKSLPAFACLYTNDKMPCSAQSLEVQVQNRNKDIITEVEQGATSSCISLFNEKVSIPKLEWLELSSINIQKIWSDQSQHCFQNLLTLNVTDCGDLKYLLSFSMAGSLMNLQSLFVSACEMMEDIFCPEHAENIDVFPKLKKMEIIGMEKLNTIWQPHIGLHSFHSLDSLIIGECHKLVTIFPSYMGQRFQSLQSLTITNCQLVENIFDFEIIPQTGVRNETNLQNVFLKALPNLVHIWKEDSSEILKYNNLKSISINESPNLKHLFPLSVATDLEKLEILDVYNCRAMKEIVAWGNGSNENAITFKFPQLNTVSLQNSFELMSFYRGTHALEWPSLKKLSILNCFKLEGLTKDITNSQGKSIVSATEKVIYNLESMEISLKEAEWLQKYIVSVHRMHKLQRLVLYGLKNTEILFWFLHRLPNLKSLTLGSCQLKSIWAPASLISRDKIGVVMQLKELELKSLLSLEEIGFEHHPLLQRIERLVISRCMKLTNLASSIVSYNYITHLEVRNCRSLRNLMTSSTAKSLVQLTTMKVFLCEMIVEIVAENEEEKVQEIEFRQLKSLELVSLKNLTSFCSSEKCDFKFPLLESLVVSECPQMKKFSRVQSAPNLKKVHVVAGEKDKWYWEGDLNGTLQKHFTDQ

SEQ ID NO: 156499 - protein, 274 aa, Glycine max
  Coding DNA Sequence Number=SeqID_39721
  Gene Ontology: Mol. function=nucleoside-triphosphatase activity; Biological process=defense response
  Homolog annotation: Hit_ID=Q1STU5; Match level="QueryCoverage=85%, HitCoverage=95%, E-value=2e-26, Identity=32%"; Hit description =Leucine-rich repeat
MDIWPQDLLFKLRFLHLSFENDDNKIDTWPFDFLQKVPSLEHLLVQRCYGLKEIFPSQKLQVHDRSLPALKQLILYNLGELESIGLEHPWVQPYSQKLQLLHLINCSQLEKLVSCAVSFINLKELQVTCCNRMEYLLKFSTAKSLLQLETLSIEKCESMKEIVKKEEEDASDEIIFGRLRRIMLDSLPRLVRFYSGNATLHLKCLEEATIAECQNMKTFSEGIIDAPLLEGIKTSTEDTDLTSHHDLNTTIQTLFHQQVRNHYPPNSIVICLYL

SEQ ID NO: 156500 - protein, 374 aa, Glycine max
  Coding DNA Sequence Number=SeqID_39722
  Gene Ontology: Mol. function=nucleoside-triphosphatase activity; Biological process=defense response
  Homolog annotation: Hit_ID=Q1STU5; Match level="QueryCoverage=94%, HitCoverage=82%, E-value=2e-26, Identity=26%"; Hit description =Leucine-rich repeat
MILVDYLETTGVRRAKPAFLKNFFGSLKKLEFDGAIKREIVIPSHVLPYLKTLEEFNVHSSDAAQVIFDIDDTDANTKGMLLPLKKLTLESLSNLKCVWNKTSRGILSFPDLQYVDVQVCKNLVTLFPLSLARNVGKLQTLVIQNCDKLVEIIGKEDATEHATTEMFEFPFLLKLLLFKLSLLSCFYPGKHHLECPVLESLGVSYCPKLKLFTSEFHNDHKEAVTEAPISRLQQQPLFSVDKIVPNLKSLTLNEENIMLLSDARLPQDLLFKLTCLDLSFDNDGIKKDTLPFDFLQKVPSLEHLRVERCYGLKEIFPSQKLQVHDRSLPALKQLTLLDLGELESIGLEQHPWVKPYSEKLQILTLWGCPRLEQL

SEQ ID NO: 156501 - protein, 544 aa, Glycine max
  Coding DNA Sequence Number=SeqID_39723
  Gene Ontology: Mol. function=nucleoside-triphosphatase activity; Biological process=defense response
  Homolog annotation: Hit_ID=Q1STU5; Match level="QueryCoverage=95%, HitCoverage=98%, E-value=1e-53, Identity=31%"; Hit description =Leucine-rich repeat
MALKVFFEYSKHMILVDYLETTGVRHGKPAFLKNFFGGLKKLEFDGEIKREIVIPSHVLPYLKTLEELNVHSSDAVQVIFDIDDSDANTKGMVLPLKKLTLKGLSNLKCVWNKTLRRILSFPNLQVVFVTKCRSLATLFPLSLAKNLVNLETLTVWRCDKLVEIVGKEDAMELGRTEIFEFPCLSKLYLYKLSLLSCFYPGKHHLECPVLECLDVSYCPKLKLFTSEFHNSHREAVIEQPLFMVEKVDPKLKELTLNEENIILLRDAHLPQDFLCKLNILDLSFDDYENKKDTLPFDFLHKVPRVECLRVQRCYGLKEIFPSQKLQVHHGILARLNELYLFKLKELESIGLEHPWVKPYSAKLETLEIRKCSRLEKVVSCAVSFSSLKELQVSECERMEYLFTSSTAKSLVQLKMLYIEKCESIKEIVRKEDESDASEEMIFGRLTKLRLESLGRLVRFYSGDGTLQFSCLEEATIAECPNMNTFSEGFVNAPMFEGIKTSREDSDLTFHHDLNSTIKKLFHQHVRNSLSKFNCYLLIISKLVF

SEQ ID NO: 156502 - protein, 290 aa, Glycine max
  Coding DNA Sequence Number=SeqID_39724
  Gene Ontology: Mol. function=nucleoside-triphosphatase activity; Biological process=defense response
  Homolog annotation: Hit_ID=Q1STU5; Match level="QueryCoverage=95%, HitCoverage=94%, E-value=1e-36, Identity=31%"; Hit description =Leucine-rich repeat
MGAQNVEKSACDIEHLKFDDHHHLEEIWLGAVPIPSKNCFNSLKSLTVVEFESLPNVIPFYLLRFLCNLKEIEVSNCHSVKAIFDMKGAEADMKPASQISLPLKKLILNQLPNLEHIWNPNPDEILSLQEVCISNCQSLKSLFPTSVANHLAKLDVRSCATLEEIFLENEAALKGETKPFNFHCLTSLTLWELPELKYFYNGKHSLEWPMLTQLDVYHCDKLKLFTTEHHSGEVADIEYPLRASIDQQAVFSVEKVFPNLVQLSLKKEDAIGILQGQFQARTISQILLLS

SEQ ID NO: 156503 - protein, 77 aa, Glycine max
  Coding DNA Sequence Number=SeqID_39725
MEANDADLEIHVEDNINHDFNPTETITCPHHEGKNDKYMEASQRSYHFRHCQWNFPFPFLVLPSSCSESSKRRTMEL

SEQ ID NO: 156504 - protein, 191 aa, Glycine max
  Coding DNA Sequence Number=SeqID_39726
  Gene Ontology: Mol. function=polynucleotide adenylyltransferase activity; Cellular component=nucleus; Biological process=RNA polyadenylation
  Homolog annotation: Hit_ID=Q1S721; Match level="QueryCoverage=65%, HitCoverage=18%, E-value=2e-31, Identity=57%"; Hit description =Poly(A) polymerase central domain, putative
MTIELGQQTVELSTLVTRAANDKSSDLLASLTYQWTYRWQCMLQSVSPESCTGKSGGTTQMSFECIKGIRLATSTTNDANNNCKIKSSDALPRSGLRTKVADMQISEAGFVNTTHDMLKSRRVEVPNENGVVNGDKAQDLALDCLENAETECTNSLPNYEEGDIDMDQRLDKACNFIIRAGCSDYVPNANM

SEQ ID NO: 156505 - protein, 70 aa, Glycine max
  Coding DNA Sequence Number=SeqID_39727
MALKHQIVIAGPLYLTTAYDHQIAKWDNKNNSFCEGRCHNSYFKVVDLANRNSACFSSSELRIAFCCNSY

SEQ ID NO: 156506 - protein, 39 aa, Glycine max
  Coding DNA Sequence Number=SeqID_39728
METLRGKLTYSVQWQMMLGCALDNKSEHNEGVGDRQDII

SEQ ID NO: 156507 - protein, 49 aa, Glycine max
  Coding DNA Sequence Number=SeqID_39729
  Homolog annotation: Hit_ID=Q1S1P8; Match level="QueryCoverage=82%, HitCoverage=10%, E-value=5e-07, Identity=63%"; Hit description =Cyclin-like F-box
MMEYCKDVLSYLDSDTSIKILMSLDDLADLVRATCVSRSWRDIADASVS

SEQ ID NO: 156508 - protein, 254 aa, Glycine max
  Coding DNA Sequence Number=SeqID_39730
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-26, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RAARPCLQRAACPRLQRAAHLRLKRAEHRTSSPSEGYTSLPLDGYTLSSLKGCTPSPLEGYTSSPLEGFTSSPSEDCRSLPSEDCTSSPLQDYTSSPLEGDTSRPSTVARPRLQRLHALAFRGLHALAFRGLHVLAFRGLHALAFRGLPVLAFGGLHVLNIRGLHVLTFRGLHILAFRGLHLLAIRGLHVLPFRGLHALAFRGLHALSFRGLMSSPSKDYTSLASEDYTSSPSEGCTSSPSEGCTSSPSEDYMS

SEQ ID NO: 156509 - protein, 60 aa, Glycine max
  Coding DNA Sequence Number=SeqID_39731
MEQRSISINCHYLDAEVQRWWSIHVACGHENGAFVHDFEVRDSLVILFVDDSYLHLLGMQ

SEQ ID NO: 156510 - protein, 201 aa, Glycine max
  Coding DNA Sequence Number=SeqID_39732
  Gene Ontology: Cellular component=peroxisomal membrane; Biological process=peroxisome fission
  Homolog annotation: Hit_ID=Q1S1P7; Match level="QueryCoverage=80%, HitCoverage=68%, E-value=1e-68, Identity=81%"; Hit description =Peroxisomal biogenesis factor 11
  Pfam annotation: Domain name=PEX11; Domain location=1-201; Score =101.8; E_value=2e-27; Accession=PF05648.4; Description=Peroxisomal biogenesis factor 11 (PEX11)
MACLYGRILAFYHVLPSATDNTACILINSCNDHHSSLFNSQFVNDLHALISPTPQGTPLPLILLGKSKNALLSTFLFLDQFVWLGRTGIYQNKERTELIGRISLYCWLGSSVCTTLVELGELGRLSSSMKKLEKDLKNKNKYDNEQYRAKLNKSNERTLSLIKAGIDTVVAVGLLQLAPKTVTPRVTGAFGFVSSLISCYQ

SEQ ID NO: 156511 - protein, 110 aa, Glycine max
  Coding DNA Sequence Number=SeqID_39733
  Subcellular localization annotation: CTP_CleavageSite=36; ConfidenceScore=5.64e-01
MASNTMVPFQVSRLNKSNYDNWSIKMKRHLRSVTFYASSSSQFRFPFSSSSNLLFSHIPPNMSLQKGDLGLIHRWIIVKFEHQIQNSFPNILTVGNYEKVSELRKIPFAS

SEQ ID NO: 156512 - protein, 727 aa, Glycine max
  Coding DNA Sequence Number=SeqID_39734
  Gene Ontology: Mol. function=nucleoside-triphosphatase activity; Cellular component=membrane; Biological process=defense response
  Homolog annotation: Hit_ID=Q1STU9; Match level="QueryCoverage=99%, HitCoverage=57%, E-value=1e-108, Identity=35%"; Hit description=H+ -transporting two-sector ATPase, alpha/beta subunit, central region; Disease resistance protein
  Pfam annotation: Domain name=AAA; Domain location=178-413; Score= -6.7; E_value=0.00067; Accession=PF00004.19; Description=ATPase family associated with various cellular activities (AAA)
  Pfam annotation: Domain name=LRR_1; Domain location=581-604; Score =2.5; E_value=99; Accession=PF00560.23; Description=Leucine Rich Repeat
  Pfam annotation: Domain name=LRR_1; Domain location=606-627; Score =8.7; E_value=6.8; Accession=PF00560.23; Description=Leucine Rich Repeat
  Pfam annotation: Domain name=LRR_1; Domain location=629-650; Score =4.9; E_value=35; Accession=PF00560.23; Description=Leucine Rich Repeat
  Pfam annotation: Domain name=LRR_1; Domain location=652-673; Score =14.7; E_value=0.33; Accession=PF00560.23; Description=Leucine Rich Repeat
  Pfam annotation: Domain name=LRR_1; Domain location=675-698; Score =10.1; E_value=3.7; Accession=PF00560.23; Description=Leucine Rich Repeat
  Pfam annotation: Domain name=NB-ARC; Domain location=140-489; Score =59.8; E_value=9e-15; Accession=PF00931.13; Description=NB-ARC domain
  Pfam module annotation: Pfam domain module=AAA::LRR_1::LRR_1::LRR _1::LRR_1::LRR_1::NB-ARC; Domain location=178-413::581-604::606 -627::629-650::652-673::675-698::140-489
MDPITSVAAQSALEIAKQVVNRQVGYIFHYKDKLKEVEQYIERLNDTRKRVQNEVNSAEKNGEEIEDDVQHWLKKVDEKIKKYECFINDERHAQTRCSIRLIFPNNLWLRYRLGRNATKMIEEIKADGHSNKRFDKVSYRLGPSFDAALSNTGYVSFGSRNEIMKKIMKALEDSTVNIVGVYGAGGVGKTTLVKEVANKAREKKLFNMVVMANVTRIPDIQKIQEQIAEMLGMRLEEESEIVRADRIRKRLKKEKENTLIILDDLWDGLNLNILGIPRSEDDNGSQQDANDLSDFGYNNMEKEVFSADFNMMKKDKLSVDSNTIKKEKLSGDHKGCKILLTSRSKEVICNKMDVQERSTFSVGVLDENEAKTLLKKEAGIHVQSFEFDEKVIEIAKMCDGLPIALVSIGRSLKNKSSFVWQDVCQQIKRQSFTEGHESMDFSVKLSYDHLKNEQLKHIFLLCARMGNDALIMNLVKFCIGLGLLQGVHTIREARNKVNILIEELKESTLLGESYSRDRFNMHDIVRDVALSISSKEKHVFFMNNGILDECPHKDELERYTAICLHFCDINDGLPESIHCPRLEVLHIDNIDDFLKIPDNFFKDMIELRVLILTGVNLSCLPSSIKCLKKLRMLSLERCTLGENLSIIGELKKLRILTLSGSNIESLPLEFGQLDKLQLFDISNCSKLRVIPSNLISRMNSLEEFYMRDSLILWEAEENIQSQNASLS

SEQ ID NO: 156513 - protein, 269 aa, Glycine max
  Coding DNA Sequence Number=SeqID_39735
  Gene Ontology: Mol. function=RNA-directed DNA polymerase activity; Cellular component=chromatin; Biological process=RNA-dependent DNA replication
MGSKIYPKVHENPRAFFSSSSPSLLESSIQYPWGGVQVDQEKVKAIQKWPTPKNVTEGQEHAFAPLKEKLTRAPILALPNFAKSFEIECDASNVGIKVVLIQDGHPIAYFSEKLNGVVLSYSTYDKELYALQFPYVIKYKKGKSNVVADAISRRKSKLQPRGDSPFQVLSKINDNAYKIDLLGEHGVSNTFNVSDLCPFDVGDEDFNSRSNSLKEGGDDENQAKNKGIESIQRLGGPMTRACAKKSKEVLNQMVATLIEAYSHLEGLKP

SEQ ID NO: 156514 - protein, 93 aa, Glycine max
  Coding DNA Sequence Number=SeqID_39736
  Subcellular localization annotation: CTP_CleavageSite=21; ConfidenceScore=5.30e-01
MRLFFAQPGGASGALSHLLPGSSMRSANHAMPSGSCAQPEEDGSANCKNQTSPNLLILPEIEMERKSYDDHLVQLRCVFYGSLLVELLWRLDL

SEQ ID NO: 156515 - protein, 123 aa, Glycine max
  Coding DNA Sequence Number=SeqID_39737
GTSFVVQVEGTSTWVVVTENKRGYISCGSVQVKGTSTWLFKENKGRYIPCGSLLVKGAARVMDNQGIVAEHSGCEGFVNESEREDESRISSPPQKVMDKSLKVAEDEGREKERRSMKFYASNE

SEQ ID NO: 156516 - protein, 104 aa, Glycine max
  Coding DNA Sequence Number=SeqID_39738
MACGLKKILPQFISDNSKMIRIRKWISANIGCGSNDFQDYFDDAKESRVKQVPKNQASRIKSQRIKIQEQLSFKIQDSRTNKIKIQDLREVDFKIQEKKSRSNS

SEQ ID NO: 156517 - protein, 96 aa, Glycine max
  Coding DNA Sequence Number=SeqID_39739
MPGAGLLKFQQAFSSTNGRIKLVHSMEGIVKGSQQEKAVDSQGSAKKLSDHPNAVSYLVTLIKGPISDSTGVSKKILMELSEIDKENVAVVAQFGW

SEQ ID NO: 156518 - protein, 111 aa, Glycine max
  Coding DNA Sequence Number=SeqID_39740
MQMIEFGASQSQLVIIDKLNHGIREKKLDQAFANDMLEEIARAVGVPIEPSEISKALASIRQEREEAATRKERAELCTSTTCERSTIEAWFDDGNETDPETKKVVEDIDLR

SEQ ID NO: 156519 - protein, 729 aa, Glycine max
  Coding DNA Sequence Number=SeqID_39741
  Gene Ontology: Mol. function=nucleoside-triphosphatase activity; Cellular component=membrane; Biological process=defense response
  Homolog annotation: Hit_ID=Q1SI90; Match level="QueryCoverage=99%, HitCoverage=62%, E-value=2e-85, Identity=28%"; Hit description =Disease resistance protein; AAA ATPase
  Pfam annotation: Domain name=LRR_1; Domain location=261-283; Score =4.5; E_value=42; Accession=PF00560.23; Description=Leucine Rich Repeat
  Pfam annotation: Domain name=LRR_1; Domain location=286-307; Score =0.6; E_value=2.2e+02; Accession=PF00560.23; Description=Leucine Rich Repeat
  Pfam annotation: Domain name=LRR_1; Domain location=368-388; Score =0.5; E_value=2.3e+02; Accession=PF00560.23; Description=Leucine Rich Repeat
  Pfam annotation: Domain name=LRR_1; Domain location=394-415; Score =4.6; E_value=39; Accession=PF00560.23; Description=Leucine Rich Repeat
  Pfam annotation: Domain name=LRR_1; Domain location=453-474; Score =7.2; E_value=13; Accession=PF00560.23; Description=Leucine Rich Repeat
  Pfam annotation: Domain name=LRR_1; Domain location=479-502; Score =1.1; E_value=1.7e+02; Accession=PF00560.23; Description=Leucine Rich Repeat
  Pfam annotation: Domain name=LRR_1; Domain location=538-560; Score =2.1; E_value=1.1e+02; Accession=PF00560.23; Description=Leucine Rich Repeat
  Pfam annotation: Domain name=LRR_1; Domain location=625-645; Score =5.4; E_value=28; Accession=PF00560.23; Description=Leucine Rich Repeat
  Pfam annotation: Domain name=LRR_1; Domain location=656-679; Score =0.1; E_value=2.7e+02; Accession=PF00560.23; Description=Leucine Rich Repeat
  Pfam annotation: Domain name=LRR_1; Domain location=681-704; Score =3.4; E_value=66; Accession=PF00560.23; Description=Leucine Rich Repeat
  Pfam annotation: Domain name=LRR_1; Domain location=705-729; Score =0.9; E_value=2e+02; Accession=PF00560.23; Description=Leucine Rich Repeat
  Pfam annotation: Domain name=LRR_1; Domain location=80-102; Score =0.7; E_value=2.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=261-283::286-307::368-388::394-415::453-474::479-502::538 -560::625-645::...
  Pfam module annotation: Domain location=656-679::681-704::705-729::80- 102
MLDSYKIFIGEFNMLTVGEFKIPDIYEEAKFLALNLKEGIDIHSETWVKMLFKSVEYLLLGQLNDVHDVFYELNVEGFPYLKHLSIVNNFGIQYIINSVERFHPLLAFPKLESMCLYKLDNLEKLCVNNQLEEASFCRLKIIKIKTCDRLENIFPFFMVRLLTLLETIEVCDCDSLKEIVSVERQTHTINDDKIEFPQLRLLTLKSLPAFACLYTNDKIPCSAHSLEVQVQNRNKDIITEVEQGAASSCISLFNEKVSIPKLEWLKLSSINIQKIWSDQCQHCFQNLLTLNVTDCGDLKYLLSFSMAGSLMNLQSIFVSACEMMEDIFCPEHAENIDVFPKLKKMEIICMEKLNTIWQPHIGFHSFHSLDSLIIRECHKLVTIFPRYMGQRFQSLQSLIITDCKLVENIFDFENIPQTGVRNETNLQNVFLEALPNLVHIWKNDSSEILKYNNLQSIRIKGCPNLKHLFPLSVATDLEKLEILDVYNCRAMKEIVAWDNGSNENLITFKFPRLNIVSLKLSFELVSFYRGTHTLEWPSLNKLSIVDCFKLEGLTKDITNSQGKPIVLATEKVIYNLESMEMSLKEAEWLQKYIVSVHRMHKLQRLVLYELKNTEILFWFLHRLPNLKSLTLGSCHLKSIWAPASLISRDKIGVVMQLKELELKSLLSLEEIGFEHDPLLQRIERLVIYRCIKLTNLASSIVSYSYIKHLEVRNCRSMRHLMASSTAKSL

SEQ ID NO: 156520 - protein, 476 aa, Glycine max
  Coding DNA Sequence Number=SeqID_39742
  Homolog annotation: Hit_ID=Q1SR88; Match level="QueryCoverage=88%, HitCoverage=79%, E-value=1e-11, Identity=22%"; Hit description=IMP dehydrogenase/GMP reductase
  Pfam annotation: Domain name=DUF674; Domain location=1-448; Score =112.1; E_value=1.6e-30; Accession=PF05056.3; Description=Protein of unknown function (DUF674)
MASNQEVTVPCRYWVDNERKRVVMAEASGHFVDVLFSFLTLPLGTIIRLGNTLGQPIEIGCINNLFKSVEALNPDVFWNDICKRMLLSPRNPLEFSYQRLKLKVDDTQPTKYFVCHICSKGSDFSLSTFDEVKCHCGNLMKRQLDMLVEPAGGNGVFVKGDAMFLIFDDLTVLRSSPSVSFKPPLQLGHKEFRKVEEKSLDVDTNKAFSILKQALTSKSALSVTLENGKSEPSSSFLPDIGPSQRKDYIKIKVIVSKSQNKILFVEADGDFVDFLVSFLTMPLGSIMYLVNGKLSLGSIDKLYTSVKNLDPSWFIASSNKSLLNPKVAPHFGCGSNPLNASEEDTAKYWYGTGIVKDNRGRIIYEKNMISKNKDMLKDPKDIKLLDPRSSRARKSDVGFMKRPCLFVVSDNLEVKAMTTSSSIPCPFMENDRLLDDLEEHLVKIRKSQTKIYSSDRVMKKLGVDYEGVDRDGFGIG

SEQ ID NO: 156521 - protein, 1411 aa, Glycine max
  Coding DNA Sequence Number=SeqID_39743
  Gene Ontology: Mol. function=nucleoside-triphosphatase activity; Biological process=defense response
  Homolog annotation: Hit_ID=Q1STU5; Match level="QueryCoverage=99%, HitCoverage=99%, E-value=1e-118, Identity=30%"; Hit description =Leucine-rich repeat
  Pfam annotation: Domain name=LRR_1; Domain location=1102-1129; Score =4.8; E_value=36; Accession=PF00560.23; Description=Leucine Rich Repeat
  Pfam annotation: Domain name=LRR_1; Domain location=119-143; Score =2.5; E_value=98; Accession=PF00560.23; Description=Leucine Rich Repeat
  Pfam annotation: Domain name=LRR_1; Domain location=1347-1370; Score =4.1; E_value=48; Accession=PF00560.23; Description=Leucine Rich Repeat
  Pfam annotation: Domain name=LRR_1; Domain location=1371-1395; Score =2.7; E_value=90; Accession=PF00560.23; Description=Leucine Rich Repeat
  Pfam annotation: Domain name=LRR_1; Domain location=145-169; Score =2.4; E_value=1e+02; Accession=PF00560.23; Description=Leucine Rich Repeat
  Pfam annotation: Domain name=LRR_1; Domain location=205-227; Score =3.6; E_value=59; Accession=PF00560.23; Description=Leucine Rich Repeat
  Pfam annotation: Domain name=LRR_1; Domain location=308-329; Score =5.5; E_value=27; Accession=PF00560.23; Description=Leucine Rich Repeat
  Pfam annotation: Domain name=LRR_1; Domain location=366-387; Score =3.2; E_value=71; Accession=PF00560.23; Description=Leucine Rich Repeat
  Pfam annotation: Domain name=LRR_1; Domain location=390-414; Score =0.4; E_value=2.4e+02; Accession=PF00560.23; Description=Leucine Rich Repeat
  Pfam annotation: Domain name=LRR_1; Domain location=561-585; Score =0.0; E_value=2.8e+02; Accession=PF00560.23; Description=Leucine Rich Repeat
  Pfam annotation: Domain name=LRR_1; Domain location=645-668; Score =0.7; E_value=2.1e+02; Accession=PF00560.23; Description=Leucine Rich Repeat
  Pfam annotation: Domain name=LRR_1; Domain location=731-753; Score =4.5; E_value=40; Accession=PF00560.23; Description=Leucine Rich Repeat
  Pfam annotation: Domain name=LRR_1; Domain location=826-847; Score =0.7; E_value=2.1e+02; Accession=PF00560.23; Description=Leucine Rich Repeat
  Pfam annotation: Domain name=LRR_1; Domain location=884-905; Score =3.8; E_value=56; Accession=PF00560.23; Description=Leucine Rich Repeat
  Pfam annotation: Domain name=LRR_1; Domain location=908-932; Score =4.1; E_value=49; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=1102-1129::119-143::1347-1370::1371- 1395::145-169::...
  Pfam module annotation: Domain location=205-227::308-329::366 -387::390-414::561-585::645-668::731-753::826-847::884-905::908-932
VSFEYSKHKRLVDYPQTKGFRHGKPAFPENFFGCLKKLEFDGESIRQIVIPSHVLPYLKTLEELYVHNSDAAQIIFDTVDTEAKTKGIVFRLKKLTLEDLSSLKCVWNKNPPGTLSFRNLQEVVVLNCRSLSTLFPFSLARNLGKLKTLEIQNCDKLVEIVGKEDVTEHGTTEMFEFPCLWQLLLYKLSLLSCFYPGKHHLECPVLKCLDVSYCPKLKLFTSEFGDSPKQAVIEAPISQLQQQPLFSIEKIVPNLENLTLNEEDIMLLSDAHLPQDFLFKLTDLDLSFENDDNKKDTLPFDFLQKVPSLEHLRVESCYGLKEIFPSQKLQVHDRSLPALKQLTLYDLGELESIGLEHPWGKPYSQKLQLLMLWRCPQLEKLVSCAVSFINLKELEVTNCDMMEYLLKYSTAKSLLQLERLSIRECESMKEIVKKEEEDASDEIIFGSLRRIMLDSLPRLVRFYSGNATLHFTCLQVATIAECHNMQTFSEGIIDAPLFEGIKTSTDDADLTPHHDLNTTIETLFHQQVFFEYSKHMILLDYLETTGVRHGKPAFLKNFLGSLKKLEFDGAIKREIVIPSHVLPYLKTLEELNVHSSDAAQVIFDIDDTDANTKGMVLPLKNLTLKDLPNLKCVWNKNPQGLGFPNLQQVFVTKCRSLATLFPLSLAKNLGKLQTLTVLRCDKLVEIVGKEDAMELGRTEIFEFPCLLELCLYKLSLLSCFYPGKHHLECPVLKCLDVSYCPMLKLFTSEFQNSHKEAVIEQPLFMVEKVDPKLKELTLNEENIILLRDAHLPQDFLYKLNILDLSFDDYENKKDTLPFDFLHKVPSVECLRVQRCYGLKEIFPSQKLQVHHGILARLNQLELNKLKELESIGLEHPWVKPYSAKLEILNIRKCSRLEKVVSCAVSFISLKELYLSDCERMEYLFTSSTAKSLVQLKILYIEKCESIKEIVRKEDESDASEEIIFGRLTKLWLESLGRLVRFYSGDDTLQFSCLEEATITECPNMNTFSEGFVNAPMFEGIKTSREDSDLTFHHDLNSTIKKLFHQHIEVSNCQSVKAIFDMKGTKADMKPGSQFSLPLKKLILNQLPNLEHIWNPNPDEILSLQEVCISNCQSLKSLFPTSVANHLAKLDVRSCATLEEIFVENEAALKGETKLFNFHCLTSLTLWELPELKYFYNGKHSLEWPMLTQLDVYHCDKLKLFTTEHHSGEVADIEYPLRTSIDQQAVFSVEKVMPSLEHQAIACKDNMIGQGQFVANAAHLLQNLRVLKLMCYHEDDESNIFSSGLEEISSIENLEVFCSSFNEIFSSQIPSTNCTKVLSKLKKLHLKSLQQLNSIGLEHSWVEPLLKTLETLEVFSCPSIKNLVPSTVSFANLTSLNVEECHGLVYLFTSSTAKSLGQLKHIPYGIAKQYKK

SEQ ID NO: 156522 - protein, 62 aa, Glycine max
  Coding DNA Sequence Number=SeqID_39744
MWYHVSEKPRRCLRVHYKTNHTLVSQITLTRLKGTLKLGVFTLKAYTLKGLSRSLPPDSGPT

SEQ ID NO: 156523 - protein, 72 aa, Glycine max
  Coding DNA Sequence Number=SeqID_39745
MNDKHSLTTIVPLERTENVKRAKQKNKQVKLLLINKGFSESHRFSDNRSFRRCGCSDVVCGSRCSGGSRKEK

SEQ ID NO: 156524 - protein, 242 aa, Glycine max
  Coding DNA Sequence Number=SeqID_39746
ALHTFLAWPTHLVKSLSQQVVVSPPKPPPKPDPEVDDPLYLMTLTIPELFLRPYQVRWDATVFGVVNPDFPLYIKHEDLSKIAHGGQCLNISVLQLWILHLTETCMRAGNSDIYGFLEPQSIQRSGQLQFESESYIKSWMQSSQRDVYLGAYLNGPDNYLKGIINSAIKGLDDAPQPKSKAPARWIVVKCNRQKGTTECGYYVMHWMSTIILGTFRNRWKAYFNDPRPLEPERLKALRIQWA

SEQ ID NO: 156525 - protein, 1610 aa, Glycine max
  Coding DNA Sequence Number=SeqID_39747
  Gene Ontology: Mol. function=nucleoside-triphosphatase activity; Cellular component=membrane; Biological process=defense response
  Homolog annotation: Hit_ID=Q1SI90; Match level="QueryCoverage=98%, HitCoverage=99%, E-value=0.0, Identity=31%"; Hit description=Disease resistance protein; AAA ATPase
  Pfam annotation: Domain name=AAA; Domain location=178-425; Score= -7.8; E_value=0.00082; Accession=PF00004.19; Description=ATPase family associated with various cellular activities (AAA)
  Pfam annotation: Domain name=LRR_1; Domain location=1028-1050; Score =3.4; E_value=66; Accession=PF00560.23; Description=Leucine Rich Repeat
  Pfam annotation: Domain name=LRR_1; Domain location=1053-1074; Score =0.6; E_value=2.2e+02; Accession=PF00560.23; Description=Leucine Rich Repeat
  Pfam annotation: Domain name=LRR_1; Domain location=1079-1109; Score =0.2; E_value=2.6e+02; Accession=PF00560.23; Description=Leucine Rich Repeat
  Pfam annotation: Domain name=LRR_1; Domain location=1135-1155; Score =1.2; E_value=1.7e+02; Accession=PF00560.23; Description=Leucine Rich Repeat
  Pfam annotation: Domain name=LRR_1; Domain location=1161-1182; Score =5.7; E_value=24; Accession=PF00560.23; Description=Leucine Rich Repeat
  Pfam annotation: Domain name=LRR_1; Domain location=1220-1241; Score =2.9; E_value=81; Accession=PF00560.23; Description=Leucine Rich Repeat
  Pfam annotation: Domain name=LRR_1; Domain location=1246-1268; Score =1.5; E_value=1.5e+02; Accession=PF00560.23; Description=Leucine Rich Repeat
  Pfam annotation: Domain name=LRR_1; Domain location=1305-1327; Score =0.9; E_value=1.9e+02; Accession=PF00560.23; Description=Leucine Rich Repeat
  Pfam annotation: Domain name=LRR_1; Domain location=1368-1390; Score =3.6; E_value=60; Accession=PF00560.23; Description=Leucine Rich Repeat
  Pfam annotation: Domain name=LRR_1; Domain location=1392-1412; Score =5.3; E_value=29; Accession=PF00560.23; Description=Leucine Rich Repeat
  Pfam annotation: Domain name=LRR_1; Domain location=1448-1470; Score =4.9; E_value=35; Accession=PF00560.23; Description=Leucine Rich Repeat
  Pfam annotation: Domain name=LRR_1; Domain location=1472-1495; Score =2.4; E_value=1e+02; Accession=PF00560.23; Description=Leucine Rich Repeat
  Pfam annotation: Domain name=LRR_1; Domain location=1529-1550; Score =0.0; E_value=2.8e+02; Accession=PF00560.23; Description=Leucine Rich Repeat
  Pfam annotation: Domain name=LRR_1; Domain location=593-616; Score =0.0; E_value=2.8e+02; Accession=PF00560.23; Description=Leucine Rich Repeat
  Pfam annotation: Domain name=LRR_1; Domain location=618-639; Score =8.7; E_value=6.8; Accession=PF00560.23; Description=Leucine Rich Repeat
  Pfam annotation: Domain name=LRR_1; Domain location=641-662; Score =4.1; E_value=49; Accession=PF00560.23; Description=Leucine Rich Repeat
  Pfam annotation: Domain name=LRR_1; Domain location=664-685; Score =14.7; E_value=0.33; Accession=PF00560.23; Description=Leucine Rich Repeat
  Pfam annotation: Domain name=LRR_1; Domain location=687-710; Score =11.4; E_value=2.1; Accession=PF00560.23; Description=Leucine Rich Repeat
  Pfam annotation: Domain name=LRR_1; Domain location=746-768; Score =4.0; E_value=52; Accession=PF00560.23; Description=Leucine Rich Repeat
  Pfam annotation: Domain name=LRR_1; Domain location=847-869; Score =0.0; E_value=2.8e+02; Accession=PF00560.23; Description=Leucine Rich Repeat
  Pfam annotation: Domain name=LRR_1; Domain location=931-952; Score =0.1; E_value=2.7e+02; Accession=PF00560.23; Description=Leucine Rich Repeat
  Pfam annotation: Domain name=NB-ARC; Domain location=140-501; Score =38.0; E_value=1e-12; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR_1::NB- ARC; Domain location=...
  Pfam module annotation: Domain location=178-425::1028-1050::1053 -1074::1079-1109::1135-1155::1161-1182::1220-1241::1246-1268::1305 -1327::1368-1390::1392-1412::1448-1470::1472-1495::1529-1550::593 -616::618-639::641-662::...
  Pfam module annotation: Domain location=664-685::687-710::746 -768::847-869::931-952::140-501
MDPITSATAQSALQIAEHVVKRQLGYIFNYKDKFKEVEQYIERMDDNRKRVQNKVDDAEKNGEEIEDDVQHWLKQVDEKIKKYECFINDERHAQTRCSIRVIFPNNLWLRYRLGRNATKMVEEIKADGHSNKEFDKVSYRLGPSFDAALLNTGYVSFGSRNETMEKIMKALEDSTVNIVGVYGAGGVGKTTLVKEVADKAREKKLFNMVVMANVTRIPDIERIQGQIAEMLGMRLEEESEIVRADRIRKRLMKEKENTLIILDDLWDGLNLNILGIPRSEDDDGSQQDVNDLSDFGYNKMEKEVFSADFNTMKKDKLAVDFSMTKKGKLSVDSNMIKKEKLSGDHKGCKILLTSRSKEVICNKMDVQERSTFSVGVLDENEAKTLLKKLAGIRAQSSEFDEKVIEIAKMCDGLPMALVSIGRALKNKSSFVWQDVCQQIKRQSFTEGHESMEFTVKLSYDHLKNEQLKHIFLLCARMGNDALIMNLVMLCIGLGLLQGVHTIREARNKVNILIEELKESTLLGESYSRDRFNMHDIVRDVALSISSKEKHVFFMKNGILDEWPHKDELERYTAICLHFCDINDGLPESIHCPRLEVLHIDSKDDFLKIPDDFFKDMIELRVLILTGVNLSCLPSSIKCLKKLRMLSLERCTLGENLSIVGELKKLRILTLSGSNIESLPLEFGQLDKLQLFDLSNCSKLRVIPSNIISKMNSLEEFYLRDSLILWEAEENIQSQNASLSELRHLNQLQNLDVHIQSVSHFPQNLFLDMLDSYKIVIGEFNMLTEGEFKIPDMYDKAKFLALNLKEDIDIHSETWVKMLFKSVEYLLLGELNDVYDVLYELNVEGFPYLKHLSIVNNFCIQYIINSVERFHPLLAFPKLESMCLYKLDNLEKICGNNHLEEASFCRLKVIKIKTCDKLEYIFPFFMVGLLTMLETIEVCDCDSLKEIVSIERQTHTINDDKIEFPKLRVLTLKSLPAFACLYTNDKMPCSAQSLEVQVQNRNKDIITEVEQGATSSCISLFNEKVSIPKLEWLELSSINIQKIWSDQSQHCFQNLLTLNVTDCGDLKYLLSFSMAGSLMNLQSLFVSACEMMEDIFCPEHAENIDVFPKLKKMEIICMEKLNTIWQPHIGLHSFHSLDSLIIGECHKLVTIFPSYMGQRFQSLQSLTITNCQLVENIFDFENIPQTGVRNETNLQNVFLKALPNLVHIWKEDSSEILKYNNLKSISINESPNLKHLFPLSVATDLEKLEILDVYNCRAMKEIVAWGNGSNENAITFKFPQLNTVSLQNSVELVSFYRGTHALEWPSLKKLSILNCFKLEGLTKDITNSQGKPIVSATEKVIYNLESMEISLKEAEWLQKYIVSVHRMHKLQRLVLNGLENTEIPFWFLHRLPNLKSLTLGSCQLKSIWAPASLISRDKIGVVMQLKELELKSLLSLEEIGLEHDPLLQRIERLVISRCMKLTNLASSIASYNYITHLEVRNCRSLRNLMTSSTAKSLVQLTTMKVFLCEMIVEIVAENGEEKVQEIEFRQLKSLELVSLKNLTSFSSSEKCDFKFPLLESLVVSECPQMKKFSKVQSAPNLKKVHVVAGEKDKWYWEGDLNDTLQKHFTHQ

SEQ ID NO: 156526 - protein, 76 aa, Glycine max
  Coding DNA Sequence Number=SeqID_39748
  Subcellular localization annotation: CTP_CleavageSite=62; ConfidenceScore=5.38e-01
MTSLHKLGKIMKGREGQLPPDPKSPMTRPDSFSRAPGRDMSRTFTPGTSLWRGTLIFLSQSTSSTKSSRGEDNIKP

SEQ ID NO: 156527 - protein, 190 aa, Glycine max
  Coding DNA Sequence Number=SeqID_39749
MTGRLLAGSLTFDNRIMHYIIVRILLPRSSNLAQASEEDLILMWAFLTGRQIDWAHLVRYRMHKALRANAPLPYPQLVTLFLRHFQIPLDDEPFVQVKRSFAICVGAVTSFGYRKDRNSQWLKKDALPPQDERTPSPPPQRDDSALMTEVLSELRGLHTYVGMDIRLTQLEEDVGYIRQSFDLPPPPPSS

SEQ ID NO: 156528 - protein, 128 aa, Glycine max
  Coding DNA Sequence Number=SeqID_39750
  Gene Ontology: Mol. function=unfolded protein binding; Biological process=cellular protein metabolic process
  Homolog annotation: Hit_ID=Q9LFR8; Match level="QueryCoverage=50%, HitCoverage=12%, E-value=6e-16, Identity=67%"; Hit description=TCP-1 chaperonin-like protein
MHRRIKRSFKVVMGPRTRLEQKFLSDDHQGAGAFEVAARQYLMNEVKPKCAQVGLEAFADALLVVPKTLVENSGLDTQDVIIALTYKPVNATIVVDLDRTDILHERSSGSGYAQALTKNAGLGWKQSQ

SEQ ID NO: 156529 - protein, 139 aa, Glycine max
  Coding DNA Sequence Number=SeqID_39751
  Subcellular localization annotation: CTP_CleavageSite=68; ConfidenceScore=5.60e-01
MGKKKQNDSQQSSKTDTVSTSSNIFSKLFNKSQNRLPQWPPPLYFLMTTPFEENLLHFLTQRIALRTLMMEKKQKRNKDKTPAPTIDTVVSIIEASEEQKKKMKCAEAIGKRKRKRDKVEKDWEQECFPKLESVLEDEG

SEQ ID NO: 156530 - protein, 60 aa, Glycine max
  Coding DNA Sequence Number=SeqID_39752
MKHYASGCSTLSLVEDTFREGIVDKYDHDVPPISLDIANFISIGIVTLSWIVIEEPHRLW

SEQ ID NO: 156531 - protein, 102 aa, Glycine max
  Coding DNA Sequence Number=SeqID_39753
  Gene Ontology: Mol. function=RNA-directed DNA polymerase activity; Biological process=RNA-dependent DNA replication
  Homolog annotation: Hit_ID=Q1S6N2; Match level="QueryCoverage=93%, HitCoverage=34%, E-value=2e-11, Identity=37%"; Hit description=RNA -directed DNA polymerase
MEGYQNNNYFHSIEMEKEKKLLRGLNIEGRWEENPMVEIGIWRKMGEVDEVCLKSSSTSILVNGSPTSEFIACRGLRQGDPLAPFLFNVVVQGLCGMMRQAI

SEQ ID NO: 156532 - protein, 210 aa, Glycine max
  Coding DNA Sequence Number=SeqID_39754
  Gene Ontology: Mol. function=RNA-directed DNA polymerase activity; Biological process=RNA-dependent DNA replication
MRRWRGKNMGEGENYGSALHGNEDVVESNMLLLEGFYAFGILKASLYLLHLVEKDSLASKALGKKRASRVRGWEALENKIASSGTNVWALMGDFNCVRRSSEKEGVEGYEVVKGEKDEFNAFINCMELEDMPHNGWKFIWYRPNDTTRSRIDRVLVSKEWLDLWQGRSIYALDRDISDHCPLLVQDVSLIGDPNDLGSLIVGGGMEGYGD

SEQ ID NO: 156533 - protein, 154 aa, Glycine max
  Coding DNA Sequence Number=SeqID_39755
MSSHPGMHIHKVFKDTEAPPSLLLPTFVRYEIIIGMDHTCNNARKMNELGLPLVTLAMTSTYLGLPLAHFSTSECSSNDSEGGGAIHRNSGAMKVSMAGSKKYPEGKNERDIMDKVFCSASQPMGDGEKRGTLEEGSEKGIQYNEGQYFSKAKG

SEQ ID NO: 156534 - protein, 62 aa, Glycine max
  Coding DNA Sequence Number=SeqID_39756
MVVVEEEELGPRELSFTTANRPCCGSCLIIATPGINEALSLIRILVVDLKRANKATFTLVNF

SEQ ID NO: 156535 - protein, 65 aa, Glycine max
  Coding DNA Sequence Number=SeqID_39757
  Subcellular localization annotation: CTP_CleavageSite=46; ConfidenceScore=5.50e-01
MDCKSLSIKAVRHSSGQPLRHNKTPNGDSNNNSALVTVRLFSLKIRLTSDKSQTLSVVQSSSFKT

SEQ ID NO: 156536 - protein, 123 aa, Glycine max
  Coding DNA Sequence Number=SeqID_39758
MAIFSGCEVTRAGKTTSREERVFNERGEKSKVWVLLKTDVNLAMLNQYILVVEIIIIIMFTHKAKLIQNGLEASKHGLGIFSLFHTEGSYLRVRRLNLLCFISEDPSLVMAKVSFICLPLLKL

SEQ ID NO: 156537 - protein, 118 aa, Glycine max
  Coding DNA Sequence Number=SeqID_39759
MGTYFLIPAGIGGGVKDRLQSRGWEMQYPSLFHPVVMPKGGGQDKVSSDELKLKDPRCRIQCPDILLENTGIAVQCKIKIFRKKIDLLQHQELAAQNRTRLYNHGGCTSSVPSPGLKS

SEQ ID NO: 156538 - protein, 131 aa, Glycine max
  Coding DNA Sequence Number=SeqID_39760
  Gene Ontology: Mol. function=transition metal ion binding; Biological process=cytoskeleton organization and biogenesis
MSTKEKKSFCQCLWSVKVPQGYTSNIKSLVSVNDLKLVGLKSHDCHVLMQQLLPIVIRDILPDKATIVLCQLEMYFPPSFFDIMVHHVREIRLCGPIFYGGMYPVERYIDTIKTIRGFLILVYDWTMGEVK

SEQ ID NO: 156539 - protein, 129 aa, Glycine max
  Coding DNA Sequence Number=SeqID_39761
  Homolog annotation: Hit_ID=Q1SEE1; Match level="QueryCoverage=26%, HitCoverage=2%, E-value=3e-10, Identity=82%"; Hit description =Integrase, catalytic region; Zinc finger, CCHC-type; Peptidase aspartic, catalytic
EDFQQTHLQKDIGRFIDDRSRQTHTLLKNIDLGVGVGIQLRGQSVRDAFIVRVCGLSSFVPHRLVCKTCVVLVPHRLFKGISGSLLSLVEAVGAMALEEGKVKIEKFDGRDFSFWKMQIEDYLYQKKLY

SEQ ID NO: 156540 - protein, 219 aa, Glycine max
  Coding DNA Sequence Number=SeqID_39762
  Gene Ontology: Mol. function=oxidoreductase activity, acting on the CH-OH group of donors, NAD or NADP as acceptor; Cellular component =signal recognition particle, endoplasmic reticulum targeting; Biological process=malate metabolic process
  Homolog annotation: Hit_ID=Q5WEF2; Match level="QueryCoverage=99%, HitCoverage=58%, E-value=9e-63, Identity=59%"; Hit description=Malic enzyme
RPYLRLRIGRGENYGIGSHAGHHLRRNYPPAGKADEYVRPSQSLRQGLLVLPGTRIPSRSQTSRWRTPSLCNNQVTAIPAAPAPITTTFISSGRRPVSFRAFNKAAPTTMAVPCWSSWKTGMSSSSFSLSSMKKQSGAAMSSRLIPPKAGAKSFTACTTSAGSLVARQMGKASTPARVLKRTAFPSITGRAASGPIFPKPKTAVPLVTTATRFPLAVYS

SEQ ID NO: 156541 - protein, 65 aa, Glycine max
  Coding DNA Sequence Number=SeqID_39763
MDMNNEALNMSKDGGLSNSAILTSMQNIRWQIGVGKRAQVHGLPRLTRGLCGFGPRGPRVARSPY

SEQ ID NO: 156542 - protein, 171 aa, Glycine max
  Coding DNA Sequence Number=SeqID_39764
MARTKKTGEMTTEAAKEIAEKIDSFEEQATQGSFVPHGRQDVLAAAIGRPEHHGRVRAAGAGVTIKQYFGSAPRTSRNASSLQPDELQQLTQQIKDQLEESITEKVTREVMASFNHLQSQMQSQGVAVPPEPVVGPGLSGPRVSTKGSCVDPSGNDPKIGDSDSKGECGGG

SEQ ID NO: 156543 - protein, 112 aa, Glycine max
  Coding DNA Sequence Number=SeqID_39765
MQIDIFFVVAPNLQVVVIIKKGENVNHEDFDDIKKNLLEKEGDVNHASFDGVEKKSHVCHHQKGGECESLFQDSLKTKPCLKTKCFQDMQGSGNQLPGSVIDYQKTGLRNSY

SEQ ID NO: 156544 - protein, 104 aa, Glycine max
  Coding DNA Sequence Number=SeqID_39766
NIKAEDVESYENIKTKDVESYGNIKTEDVESYEKHKERGCKDFESYGNIKARTLSPMKDKGEDFESYGIIKARTLSPMKDKGEDFESYGNIKARTLSPMKDVGL

SEQ ID NO: 156545 - protein, 91 aa, Glycine max
  Coding DNA Sequence Number=SeqID_39767
MSEPYTGAMTPPCISFKQTRGQIRSSHPEPLSNWQKEQCKQHMHEVYQAIGWAIMMLRKKKQKANPPKASKAKRDKRSPNFTRKAQKCNKD

SEQ ID NO: 156546 - protein, 136 aa, Glycine max
  Coding DNA Sequence Number=SeqID_39768
  Gene Ontology: Mol. function=RNA-directed DNA polymerase activity; Cellular component=extracellular region; Biological process=RNA -dependent DNA replication
MKDDNIIFSRATEEAMKISTILKSYEAYGQKINQQKTELSCSRNVPTTKINALEMLLGVKAERETLIKSVVQAIPTYVMSCFELPMGLCQDIECMIACFFWVGGLKSKKIHWMSWGKMIRKRVLALELDDSFTGQC

SEQ ID NO: 156547 - protein, 137 aa, Glycine max
  Coding DNA Sequence Number=SeqID_39769
MTPKELEQLTQQIRDQLEESIIEKGLALPLEPEVGPSAARVNTKESCVDPSRNDPDTGNSNKCGLYIEENPPCLVALGRVYEGSKTIHDIPLLHDQVKVGVEEVKDAHAPVLVPTDELWDQQNLQIGQIMRSMIPYI

SEQ ID NO: 156548 - protein, 76 aa, Glycine max
  Coding DNA Sequence Number=SeqID_39770
  Gene Ontology: Mol. function=hydrolase activity, acting on glycosyl bonds; Cellular component=amyloplast; Biological process =carbohydrate metabolic process
  Homolog annotation: Hit_ID=Q43063; Match level="QueryCoverage=90%, HitCoverage=20%, E-value=9e-20, Identity=53%"; Hit description =Polygalacturonase
MYGTRIYRNVEATDNTCGPGHGIRFLEGVIRIKTWQGGSGSASNIQFQNIEMDNVTNPIIINQNYCDHKKRPCKTQ

SEQ ID NO: 156549 - protein, 72 aa, Glycine max
  Coding DNA Sequence Number=SeqID_39771
MRYTMNSVITVLYFNGRVYEDNDGVIFEGSKKAIQIKRGISFNALKKKIGDKENILPCKFAMKKTLKRCWKV

SEQ ID NO: 156550 - protein, 54 aa, Glycine max
  Coding DNA Sequence Number=SeqID_39772
MPSTLRRLWAQCSSPRERTRYNVHRVYPMEVTEDRGNHSNMSSEEMEEYRELLR

SEQ ID NO: 156551 - protein, 79 aa, Glycine max
  Coding DNA Sequence Number=SeqID_39773
MAVLVTILSGRGQTAIANGEFAVQRPCGSETAIRVGELMQVELVTSVGESGHGFVNRQFDWQFCFAGGVAGDAGFLCSA

SEQ ID NO: 156552 - protein, 96 aa, Glycine max
  Coding DNA Sequence Number=SeqID_39774
MGSEMQPFVETPPKVVEPNRYSHRSIETLVVVIAVITIAGVITGMIARLSGGRHFGGNGSCIDGGLPPPPPPPPPPPEEPKPAPAPEGDASHSLLL

SEQ ID NO: 156553 - protein, 401 aa, Glycine max
  Coding DNA Sequence Number=SeqID_39775
  Gene Ontology: Mol. function=hydrolase activity, acting on glycosyl bonds; Cellular component=amyloplast; Biological process =carbohydrate metabolic process
  Homolog annotation: Hit_ID=Q944B5; Match level="QueryCoverage=93%, HitCoverage=87%, E-value=1e-144, Identity=66%"; Hit description =Dehiscence-related endopolygalaturonase
  Pfam annotation: Domain name=Glyco_hydro_28; Domain location=37-380; Score=514.9; E_value=8.9e-152; Accession=PF00295.8; Description =Glycosyl hydrolases family 28
FDKRSSLKKLSVNDYGAKGNGDADDTEAFKKAWDVVCSSGEAILVVPQANYLLKPIRFSGPCEPNVEVQISGTLEASDDPSDYEDDRRHWLVFDNVKKLFVYGGGTIDGNGKIWWKNSCKRNKKRPCKDAPTALTFYNCEDLTVENLSIENAQQIHVSFQDSVNIKVSGLTVTAPEDSPNTDGIHVTNTQNIQISSSVIGTGDDCISIVHGSKDVEATDITCGPGHGISIGSLGSGKSKEFVSGIRVNRAKIFGTKNGVRIKTWQGGSGSASDIQFQNIGMDNVTNPIIINQNYCDKKKKPCKKMLSKKSAIQIKNVLYQNIRGTSASDIAVKFDCSDKFPCEEIVLQNIDLECEEGDDAEAMCNNVELSYLGNVRPRCNSKKRKAFTTITSIWKYFSWYI

SEQ ID NO: 156554 - protein, 98 aa, Glycine max
  Coding DNA Sequence Number=SeqID_39776
MLLHHLLITAIPNLQPLRCVKTLVTNTLVESLTTAVERVAGEPNLGWRGSFSDPALEPLPRGASSLASERPRLLSHHCMLPSSRSGKHKPNKQRLNGH

SEQ ID NO: 156555 - protein, 56 aa, Glycine max
  Coding DNA Sequence Number=SeqID_39777
  Homolog annotation: Hit_ID=Q6YXW5; Match level="QueryCoverage=75%, HitCoverage=4%, E-value=1e-14, Identity=83%"; Hit description=Cyclin- like protein
MSKVSGVISRQVLPACGSLCFFCPSLRARSRQPVKRYKKLIAVIFPRNKHYFIHNV

SEQ ID NO: 156556 - protein, 292 aa, Glycine max
  Coding DNA Sequence Number=SeqID_39778
  Gene Ontology: Mol. function=nucleic acid binding; Cellular component= intracellular
  Homolog annotation: Hit_ID=Q5NDD4; Match level="QueryCoverage=99%, HitCoverage=100%, E-value=1e-121, Identity=69%"; Hit description =Putative zinc finger protein
  Pfam annotation: Domain name=zf-AN1; Domain location=105-145; Score =6.9; E_value=0.01; Accession=PF01428.7; Description=AN1-like Zinc finger
  Pfam annotation: Domain name=zf-AN1; Domain location=16-55; Score =21.7; E_value=0.00015; Accession=PF01428.7; Description=AN1-like Zinc finger
  Pfam annotation: Domain name=zf-C2H2; Domain location=227-250; Score =13.1; E_value=0.4; Accession=PF00096.16; Description=Zinc finger, C2H2 type
  Pfam annotation: Domain name=zf-C2H2; Domain location=263-286; Score =14.5; E_value=0.28; Accession=PF00096.16; Description=Zinc finger, C2H2 type
  Pfam module annotation: Pfam domain module=zf-AN1::zf-AN1::zf -C2H2::zf-C2H2; Domain location=105-145::16-55::227-250::263-286
MGTPEFPDLGKHCSVSYCKQLDFLPFTCDRCNQIYCLEHRGYIKHKCTKANKHDVTVAICPLCAKGVRLIPDQDPNITWDNHVNVDCDPSNYEKITKKRKCPAPGCKEVLVFSNTIKCRDCLKDHCLKHRFGPDHKCSGPKKLETSFSFMSLLNRSRKEEPKPNLTSTAPSKWSSSFLKVASNIRASAQVSMSKLGDEINQVWQAATTRDGVGQSSGSGNRNDHQVEQCPQCGSKFSSVTALVDHVQKVHERNGNRLGVKKIDACPKCSRGFLDPVSLVEHVERDHGGGSRA

SEQ ID NO: 156557 - protein, 210 aa, Glycine max
  Coding DNA Sequence Number=SeqID_39779
  Gene Ontology: Mol. function=ATP-dependent helicase activity; Cellular component=proton-transporting two-sector ATPase complex; Biological process=ATP synthesis coupled proton transport
  Homolog annotation: Hit_ID=Q1RWC6; Match level="QueryCoverage=55%, HitCoverage=14%, E-value=5e-40, Identity=66%"; Hit description=ATP -dependent helicase HrpA
METWETSGYQIEFNSQENGKVKSNKKQKLCKPQKRKMNKLEDDKEKQLLLEKAIKTLKYDETMKEKRRRVVHLLKEGLEVSYDGNGKTTQVPQFLYEVGYGSSKGIIGVTQPRRVVVLATAKRVAYELGLHLGKEHYSVLILDEAHERRLNTNILIGMLSRVIKTRQMCHLASTRLDFWKVIPYSSTCDRSSYKAISSNNLKAAEFSQAL

SEQ ID NO: 156558 - protein, 488 aa, Glycine max
  Coding DNA Sequence Number=SeqID_39780
  Gene Ontology: Cellular component=nucleus; Biological process =regulation of progression through cell cycle
  Homolog annotation: Hit_ID=Q6YXW5; Match level="QueryCoverage=98%, HitCoverage=47%, E-value=1e-104, Identity=43%"; Hit description =Cyclin-like protein
MPKVRFMGEQSHISVEFDNIVSAVLENYEVPKKNSANLDHEEQDVMANEGQISPLLDVKRRNPSWRKVVNDKGEINVAMEDDMNPSFWSGVCLHNMANLAKEGTTIRRVMESLFRYFDNGNLWSINHGLAFSVLKDMLFLMDDSEKNTHVLLSTLIKHLDHKIVLKEPQMQLDIVEVATSLAPYAKVQPSVSIVGAVSDMMRHLRKCIHCSLDDSNLAPDVINWNKNFKKVVDRCLVQLSNKVGEADPILDVMAVMLENISTITTISRTTVYAVHRTAQIVASLPNAFPETLFHQLLLAMVHPDHETRVVSHHIFSSILVPTSVFPHPSLSASDPKASNVPRTLSRAVSVFSSSAVLFEKLRLEKRSSSEKLIQHNKGNISGEIEPVSSNVGIVNRLKSTYGRLPSVNNPPLQLELDEIAANKDNRNSLFTCIQEAAALRLTKLQINRLLSSIWAQSLSPGNMPANYEAIAYSYTLVLLVSREKVELS

SEQ ID NO: 156559 - protein, 328 aa, Glycine max
  Coding DNA Sequence Number=SeqID_39781
  Gene Ontology: Cellular component=nucleus; Biological process =regulation of progression through cell cycle
  Homolog annotation: Hit_ID=Q2L357; Match level="QueryCoverage=95%, HitCoverage=35%, E-value=2e-37, Identity=35%"; Hit description =Putative cyclin-related protein
MRPGKNKLTLLLEWPLPPSRRRSLFTLATSMIVFSSKEYNIDHLVQSAKAVLTEKVDPYLQLIEDHKLQAVSFAPDNLSINYGSKEDDDRALDMLSDLLTYIHKTRDLFASEIIKSLEMFAKAELSSIKEQLLEEFAPDAMCELGSQLTMNMAAKDASIVSNIDDDFIFEPFESQIKHSRSFSTEVPGLLTANQLLELALDTSHPAGRISVSNAFNMPYKDMADKCEVLLLEKQKMSRLMSTQQKQECSVDSLSPNHGNELKNMDSSSHVDFQKVGNPPFDENAAFDFHGPTFSPLPMVSGTEYQNQPHPFKLPAASPYDNFMKAAGC

SEQ ID NO: 156560 - protein, 71 aa, Glycine max
  Coding DNA Sequence Number=SeqID_39782
MEYDPDRNQDNLYRWCMLFAITFNLCLLLQLLDKTYINNQWIAWNAIQIFGKITPVKIVDANVLHLSASIT

SEQ ID NO: 156561 - protein, 136 aa, Glycine max
  Coding DNA Sequence Number=SeqID_39783
  Homolog annotation: Hit_ID=Q1RYJ7; Match level="QueryCoverage=78%, HitCoverage=9%, E-value=2e-28, Identity=54%"; Hit description =Timeless protein; Timeless C-terminal
MVLPHFKHSRFKDDQHCSHRIAEVLDPNGKISPAQISNMLKRLGLAVAPRRKMCDADVEGPLSTSPNQLDGDKITGATNHKSVNLEGSLLVQHLFKDHRRCSYMIANALDKDAWFVSSSEEFWRKNAPKGFAKPCH

SEQ ID NO: 156562 - protein, 888 aa, Glycine max
  Coding DNA Sequence Number=SeqID_39784
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=99%, HitCoverage=99%, E-value=0.0, Identity=71%"; Hit description =Putative receptor-like protein kinase
  Pfam annotation: Domain name=LRR_1; Domain location=112-134; Score =17.5; E_value=0.048; Accession=PF00560.23; Description=Leucine Rich Repeat
  Pfam annotation: Domain name=LRR_1; Domain location=136-158; Score =18.0; E_value=0.033; Accession=PF00560.23; Description=Leucine Rich Repeat
  Pfam annotation: Domain name=LRR_1; Domain location=160-182; Score =11.1; E_value=2.4; Accession=PF00560.23; Description=Leucine Rich Repeat
  Pfam annotation: Domain name=LRR_1; Domain location=184-206; Score =2.0; E_value=1.2e+02; Accession=PF00560.23; Description=Leucine Rich Repeat
  Pfam annotation: Domain name=LRR_1; Domain location=208-230; Score =12.1; E_value=1.5; Accession=PF00560.23; Description=Leucine Rich Repeat
  Pfam annotation: Domain name=LRR_1; Domain location=232-254; Score =14.0; E_value=0.54; Accession=PF00560.23; Description=Leucine Rich Repeat
  Pfam annotation: Domain name=LRR_1; Domain location=256-278; Score =11.1; E_value=2.4; Accession=PF00560.23; Description=Leucine Rich Repeat
  Pfam annotation: Domain name=LRR_1; Domain location=280-302; Score =7.4; E_value=12; Accession=PF00560.23; Description=Leucine Rich Repeat
  Pfam annotation: Domain name=LRR_1; Domain location=304-326; Score =17.0; E_value=0.069; Accession=PF00560.23; Description=Leucine Rich Repeat
  Pfam annotation: Domain name=LRR_1; Domain location=328-350; Score =15.3; E_value=0.23; Accession=PF00560.23; Description=Leucine Rich Repeat
  Pfam annotation: Domain name=LRR_1; Domain location=352-374; Score =14.1; E_value=0.5; Accession=PF00560.23; Description=Leucine Rich Repeat
  Pfam annotation: Domain name=LRR_1; Domain location=376-398; Score =10.7; E_value=2.8; Accession=PF00560.23; Description=Leucine Rich Repeat
  Pfam annotation: Domain name=LRR_1; Domain location=400-422; Score =8.9; E_value=6.2; Accession=PF00560.23; Description=Leucine Rich Repeat
  Pfam annotation: Domain name=LRR_1; Domain location=424-447; Score =0.0; E_value=2.8e+02; Accession=PF00560.23; Description=Leucine Rich Repeat
  Pfam annotation: Domain name=LRR_1; Domain location=449-471; Score =18.6; E_value=0.023; Accession=PF00560.23; Description=Leucine Rich Repeat
  Pfam annotation: Domain name=LRR_1; Domain location=473-494; Score =5.0; E_value=34; Accession=PF00560.23; Description=Leucine Rich Repeat
  Pfam annotation: Domain name=LRR_1; Domain location=88-110; Score =14.9; E_value=0.3; Accession=PF00560.23; Description=Leucine Rich Repeat
  Pfam annotation: Domain name=Pkinase; Domain location=607-882; Score =29.7; E_value=2.5e-10; Accession=PF00069.15; Description=Protein kinase domain
  Pfam annotation: Domain name=Pkinase_Tyr; Domain location=607-882; Score=-39.1; E_value=4.5e-10; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::Pkinase::Pkinase_Tyr; Domain location= 112-134::136-158::...
  Pfam module annotation: Domain location=160-182::184-206::208 -230::232-254::256-278::280-302::304-326::328-350::352-374::376 -398::400-422::424-447::449-471::473-494::88-110::607-882::607-882
MEFLCLLLYILVAWCLSSSELVGAELQDQDILHAINQELRVPGWGDGNNSDYCNWQGVSCGNNSMVEGLDLSHRNLRGNVTLMSELKALKRLDLSNNNFDGSIPTAFGNLSDLEVLDLTSNKFQGSIPPQLGGLTNLKSLNLSNNVLVGEIPMELQGLEKLQDFQISSNHLSGLIPSWVGNLTNLRLFTAYENRLDGRIPDDLGLISDLQILNLHSNQLEGPIPASIFVPGKLEVLVLTQNNFSGALPKEIGNCKALSSIRIGNNHLVGTIPKTIGNLSSLTYFEADNNNLSGEVVSEFAQCSNLTLLNLASNGFTGTIPQDFGQLMNLQELILSGNSLFGDIPTSILSCKSLNKLDISNNRFNGTIPNEICNISRLQYMLLDQNFITGEIPHEIGNCAKLLELQLGSNILTGGIPPEIGRIRNLQIALNLSFNHLHGPLPPELGKLDKLVSLDVSNNRLSGNIPPELKGMLSLIEVNFSNNLFGGPVPTFVPFQKSPSSSYLGNKGLCGEPLNSSCGDLYDDHKAYHHRVSYRIILAVIGSGLAVFMSVTIVVLLFMIRERQEKVAKDAGIVEDGTNDNPTIIAGTIFVDNLKQAVDLDVVVKATLKDSNKLSSGTFSTVYKAIMPSGVVLSVRRLKSVDKTIIHHQNKMIRELERLSKVCHENLVRPIGYVIYEDVALLLHHYFPNGTLAQLLHESTRKPEYQPDWPSRLSIAIGVAEGLAFLHHVAIIHLDISSGNVLLDANSKPVVAEIEISKLLDPTKGTASISAVAGSFGYIPPEYAYTMQVTAPGNVYSYGVVLLEILTTRLPVDEDFGEGVDLVKWVHSAPVRGETPEQILDAKLSTVSFGWRKEMLAALKVALLCTDNTPAKRPKMKNVVEMLREIKEN

SEQ ID NO: 156563 - protein, 104 aa, Glycine max
  Coding DNA Sequence Number=SeqID_39785
MTTKRISLEGVEARNDLIKFGVEEALVSSEGTLVLGEKSDSLFKASESLGTSVISHRREAMKAPKMIATVPKALRSPGDPFELFIICWALGAIRILIETTNMQL

SEQ ID NO: 156564 - protein, 93 aa, Glycine max
  Coding DNA Sequence Number=SeqID_39786
MGRAGPRAGTHFDGSTLYVHEEFVEADMYQQPMVAVAPNEADIDQHHLRHAVDDFAAITDRLDRLLNLRILTEVTEAYTVVEKCVGIARRYIG

SEQ ID NO: 156565 - protein, 115 aa, Glycine max
  Coding DNA Sequence Number=SeqID_39787
MIAMPKQLDKDKSSIRIRQKHGNRKLKQSITTTKKNYLNKDLKKSFDEDNYLQVQEIKLQARKLTVLITSLRREWARRRGLREEERQQRHSGGTKVWAHKTAQWIQGRKRECEEG

SEQ ID NO: 156566 - protein, 38 aa, Glycine max
  Coding DNA Sequence Number=SeqID_39788
MERLRGVIMEEEARLGNLAHPDLPHLPFHDYRAINSLI

SEQ ID NO: 156567 - protein, 325 aa, Glycine max
  Coding DNA Sequence Number=SeqID_39789
  Gene Ontology: Mol. function=binding; Cellular component=nucleus; Biological process=regulation of transcription, DNA-dependent
  Homolog annotation: Hit_ID=Q1RVV4; Match level="QueryCoverage=94%, HitCoverage=90%, E-value=3e-68, Identity=47%"; Hit description=IMP dehydrogenase/GMP reductase
  Pfam annotation: Domain name=Arm; Domain location=167-212; Score =15.2; E_value=0.15; Accession=PF00514.13; Description=Armadillobeta -catenin-like repeat
  Pfam annotation: Domain name=Arm; Domain location=213-257; Score =14.8; E_value=0.17; Accession=PF00514.13; Description=Armadillobeta -catenin-like repeat
  Pfam annotation: Domain name=Arm; Domain location=37-77; Score=29.8; E_value=9.7e-06; Accession=PF00514.13; Description=Armadillobeta -catenin-like repeat
  Pfam module annotation: Pfam domain module=Arm::Arm::Arm; Domain location=167-212::213-257::37-77
  Subcellular localization annotation: CTP_CleavageSite=45; ConfidenceScore=5.04e-01
MDTKLLTIRTLVSSLSSSSDQTRLAALRHLRRTSAEDPAARPLISAAGAVPLLASALYSPSHPIQDHAAATLLNLSISDRRPLAASHALPDALAHLLSRHATSSAASAVQSAAATLHSLLAVVSEFRPIITSKPDIIRALVGIISHSDSPTRSIKDALKACFGVALHPPSRIVLIRLGAVPALFALVAKGKDGNRRAGIIEDATAVIAQVAACEESEEAFRKVSGVSVLTMMLSSESGSCSLRTKENAVAALLNLVRCGSERVFREVRDKVGGLDGIAYVQEHGSPKGKSKAVAFFKLLLDGGSSGEVVQDLYPVDPESGSSCSG

SEQ ID NO: 156568 - protein, 49 aa, Glycine max
  Coding DNA Sequence Number=SeqID_39790
MRKGGSTGGVGCGSRSWHCSYRIETKGSNRILTRMTLPALVESSITEKE

SEQ ID NO: 156569 - protein, 245 aa, Glycine max
  Coding DNA Sequence Number=SeqID_39791
  Gene Ontology: Mol. function=nucleic acid binding; Biological process= DNA integration
MSRTFLYMSGVAFVLMKPKPHPPANIRLIEKWTFANKKNCKNHGQTTSSKEIVVVRERALASRANMVQHKPKQNQKRYDQICPNHNNNYLCVANLTFKKKRNAFTSYTLVGDREEHVYLGDSSTTPVLGKRKVLLKLTSRKTLALTNVLHVPSIRVNLVYVPLLGKVGIKVSFESDKIVMTKNKVFVAKVENQLNKKVKRVKSDEDGKYTLFNEFCENEGIIHEVTPPYSPKSYGVAERKNKTPK

SEQ ID NO: 156570 - protein, 75 aa, Glycine max
  Coding DNA Sequence Number=SeqID_39792
MHIYEALTPLLISLFVRECRAPVSYILDISQVEVSGVRSTCCFMRVKNTQLKIATPTFLENGGTSPELLEEPQHD

SEQ ID NO: 156571 - protein, 104 aa, Glycine max
  Coding DNA Sequence Number=SeqID_39793
  Gene Ontology: Mol. function=metalloendopeptidase activity; Biological process=proteolysis
  Homolog annotation: Hit_ID=Q93YG9; Match level="QueryCoverage=62%, HitCoverage=7%, E-value=5e-22, Identity=75%"; Hit description =Insulin degrading enzyme
MAVGKEDVEIVKARIDKRDYRRVVLRNSLQVLLISDPDTDKCAASMDVGVGYFSDPAGLEGLAHFLGIFSPFLTLTLLCRVSVSICVGFWSLCYESEEDSLFED

SEQ ID NO: 156572 - protein, 137 aa, Glycine max
  Coding DNA Sequence Number=SeqID_39794
EKLLPRDPKMKKRHEQSIASTLMRLVAGTSLPQRLKDLSETDEEDDRFVQVHLQKRKVAAMATPAPKRVNKVQKAPEPREHIIPSAIPRGIKTRATKANPKIGEKEATDVKIVVDRMCPQLPAWDATKKKGFKLYYN

SEQ ID NO: 156573 - protein, 97 aa, Glycine max
  Coding DNA Sequence Number=SeqID_39795
  Gene Ontology: Mol. function=metalloendopeptidase activity; Biological process=proteolysis
  Homolog annotation: Hit_ID=Q93YG9; Match level="QueryCoverage=74%, HitCoverage=7%, E-value=1e-28, Identity=83%"; Hit description =Insulin degrading enzyme
  Pfam annotation: Domain name=Peptidase_M16; Domain location=1-94; Score=14.3; E_value=2.9e-05; Accession=PF00675.10; Description =Insulinase (Peptidase family M16)
MLLVSCIFSGLPLCKHGGSTNAFTSSEHTNYFFDVNTDGFEEALDRFAQFFNKPLMSADATMREIKAVDSENQKNLLSDAWRMNQHTVVVWSGHRLL

SEQ ID NO: 156574 - protein, 269 aa, Glycine max
  Coding DNA Sequence Number=SeqID_39796
  Homolog annotation: Hit_ID=Q2SIG4; Match level="QueryCoverage=57%, HitCoverage=7%, E-value=3e-40, Identity=47%"; Hit description=RTX toxins and related Ca2+-binding protein
  Subcellular localization annotation: CTP_CleavageSite=35; ConfidenceScore=5.44e-01
TLRVTTTPAALNAPLQGASHSPFRLRNCWEGRSVRASSLLRQLAKGGCAARRLSWFLDANNQTVVATTDPAASGARFFYRTDGVEGITSLQGGTIAPKAVANVRWLIIPAAGTGGRDPQGAVYYIGAKVTYTLDGKTDTVEVAPESIVVRPQPELVLDYFLPRDVPGDDAFTPEVEPSDPFTLGVRIKNSGGGTSYKTKIDTAQPRIVENRQDQAYRYRRPRGGARYQLLFPLVRVNFELGVIMVIAVSCVKLLSAHNSTQHTSRKHKV

SEQ ID NO: 156575 - protein, 221 aa, Glycine max
  Coding DNA Sequence Number=SeqID_39797
  Gene Ontology: Mol. function=metalloendopeptidase activity; Cellular component=extracellular space; Biological process=proteolysis
  Homolog annotation: Hit_ID=Q93YG9; Match level="QueryCoverage=86%, HitCoverage=19%, E-value=6e-84, Identity=73%"; Hit description =Insulin degrading enzyme
  Pfam annotation: Domain name=Peptidase_M16_C; Domain location=42-216; Score=97.0; E_value=5.8e-26; Accession=PF05193.11; Description =Peptidase M16 inactive domain
MEYFATNFFDGTWGLPWLYFGCADSRNWDTLEVRPKAKGLDTRSELLKFYEENYSANLMHLVIYTNESLDKIQNLVEEKFQDIRNINKSCFRARVQPCKSEHLQILVRTVPIKQGHKLRIVWPVTPEIHHYTEGPCRYLGHLIGHEGEGSLYYILKKLGWATALYAGESDWGLDFSFFKVVIDLTDVGHEHIQDIIGLLFKYIELLQQSGVCKWIFEEVWI

SEQ ID NO: 156576 - protein, 170 aa, Glycine max
  Coding DNA Sequence Number=SeqID_39798
  Pfam annotation: Domain name=zf-CCHC; Domain location=65-82; Score =29.0; E_value=1.6e-05; Accession=PF00098.13; Description=Zinc knuckle
MHFNKRILCVVNQYISKEDRKESSSDEDAENLNLMVKKLGKLLKRSKDRKFFKPSKKEENNNNTFTCFKCGKQGHIKSDCSVYLKKQLCEKKGKKDGKPKKAYVAWDDNVSTSSDSTSEEEITNVCLMADSKDDSSTIEETEINSKFEEVLEAFMKCMRKHKSLLFRTIS

SEQ ID NO: 156577 - protein, 118 aa, Glycine max
  Coding DNA Sequence Number=SeqID_39799
  Gene Ontology: Mol. function=nucleic acid binding; Biological process= DNA integration
MGAFDEDVKAIYLRVFPFSLASKAKTWLKSHPNKSLNTWEEVEEKFIARFFTSSKFISAKSAIVVFSQGSDEPLCETWERFKSLLWKCPNHSFDFVAQFHIFYSGLKPQTKMILDAST

SEQ ID NO: 156578 - protein, 86 aa, Glycine max
  Coding DNA Sequence Number=SeqID_39800
METSLTPAIMGQRTLQIVADVLQVLQGRLAITDFAKYPNRKIYSRQDILSAQSYGASLAALLLVYYECSSGECLSPLGLAGLIADS

SEQ ID NO: 156579 - protein, 242 aa, Glycine max
  Coding DNA Sequence Number=SeqID_39801
  Gene Ontology: Mol. function=metalloendopeptidase activity; Cellular component=extracellular space; Biological process=proteolysis
  Homolog annotation: Hit_ID=Q93YG9; Match level="QueryCoverage=99%, HitCoverage=21%, E-value=3e-73, Identity=59%"; Hit description =Insulin degrading enzyme
VGRDDFKLNVKLQLFALVAKQPTFHQLRSVEQLGYITVLMQRNDCGIRGLQFIIQSTVKSPGNIEQRVEAFLQMFETKLHEMTIDEFKGICEHCMWPIHMQDNGVNPNWLKNHYCIRGSHQSNVNALIDVKLEKHKNLREESSFFWREINDGTLRFDRTDYEVEALRQLTLQELIDFFNEYVKVGAPRKKTLSVRVHGNRHSSEYKTEASEPHLAKIDNIFTFRRSQALYGSFKGLSGQMKL

SEQ ID NO: 156580 - protein, 114 aa, Glycine max
  Coding DNA Sequence Number=SeqID_39802
MLLKDSLNEPNLLSEAYPLCEEVSSLSEYKTLMLSQRTTRLARNQPVQRGFCLFSCLARPCLLSTQPLTLTQRDMLTKCAFVSSEAQKSLKTERGGEMKRQAAWKGRNSASYQG

SEQ ID NO: 156581 - protein, 298 aa, Glycine max
  Coding DNA Sequence Number=SeqID_39803
  Gene Ontology: Cellular component=integral to membrane
MTRGREVMSNTTHVGLCAEAQQQAPFDFFSARNTNIISNDISGRRPYIPPKGSKKYFIGILNRRNTVYKFYCQQRTKQRQTEAIYGIENYSSTGSNIASSIDGYHNLTPELSHQMSFFMFNQKGHKYLSKGESRIGRGKQKLDGNKNACIETMSKPKHVYGIKVKQVQWLLRCSLCNEECYLIASNDFAIWGCILLVFLMLWPTTQKVAQEIGQNNGQRGILLLEFQQAKIAMEELKVELERMVGYDAQYEIQAKVDNLKHCFGLLRCGVETITRQLDDFFDEIVEGRKMLLNMCSHK

SEQ ID NO: 156582 - protein, 87 aa, Glycine max
  Coding DNA Sequence Number=SeqID_39804
MLVVRIATLLRNSTGTEEEEIPVSVSIASLSSIPALRTITCCFRNTRNSGEYAVEVTGVSPKATDKDVPDFFAFSGVIENVEIIRCK

SEQ ID NO: 156583 - protein, 135 aa, Glycine max
  Coding DNA Sequence Number=SeqID_39805
MIYISPFLKQILLDIIKIFMIYILFSSFGDIQARRRTRFFFAGRGRSSSIVSQPTLWREGDARAHGCVFHGRKMRGVATNVYSRKTSKKPERRGLRTLSVKGSEVVFTHGEGNQTYVVLSKGANQAILVTWKVVI

SEQ ID NO: 156584 - protein, 38 aa, Glycine max
  Coding DNA Sequence Number=SeqID_39806
NKNEKNVIVKGGARDAICAIKVVAATAGEDNIDRIEKK

SEQ ID NO: 156585 - protein, 168 aa, Glycine max
  Coding DNA Sequence Number=SeqID_39807
  Gene Ontology: Mol. function=peptidyl-prolyl cis-trans isomerase activity; Cellular component=periplasmic space; Biological process =protein folding
  Homolog annotation: Hit_ID=Q5MG89; Match level="QueryCoverage=67%, HitCoverage=45%, E-value=3e-48, Identity=83%"; Hit description =Putative cyclophilin type peptidyl-prolyl cis-trans isomerase
  Pfam annotation: Domain name=Pro_isomerase; Domain location=33-166; Score=-25.8; E_value=5.6e-05; Accession=PF00160.11; Description =Cyclophilin type peptidyl-prolyl cis-
MWIRGFSFWIKGCFLLALVSIISGLEPELGFTRVVFQTKYGDIEFGFYPTVASKTVDHIFKLVRLGGYNTNHFFRVDKGFVAQVADVANERSTPVNEEQRREAVKTVVGEFSEVKHVRGILSMGRYDDPDSASSSFSILLGDAPHLDGKKPWAKLERPMGEEKREGGW

SEQ ID NO: 156586 - protein, 42 aa, Glycine max
  Coding DNA Sequence Number=SeqID_39808
MAAKYNPTLLGHGWKILRRGAKDANEGPKVLVSLRGDFPHRT

SEQ ID NO: 156587 - protein, 320 aa, Glycine max
  Coding DNA Sequence Number=SeqID_39809
  Pfam annotation: Domain name=Transposase_23; Domain location=167-230; Score=5.1; E_value=0.00031; Accession=PF03017.5; Description =TNP1ENSPM transposase
QKLLAEKIKKKLDEAAQSGSVDGIIDPPSPVRGHMKWKMARTKKTGEMTIEATKETVAKIDSFEDQATQGSFVPHGRQDVPVATIGRPEHPGRVRAAGAAADPANQGPARGVHHRESDAAAHGILQLEQSRIQSQMQSQGLALPPEPLVSPSDPQVSTKGSCVNPSRNDPETDPARLVALGRVYEGSTVVHNTPLFPGQVKVGVEEVTDADAPVPVPTDEVSLVGQALHTFLAWPTHLVKSLSQQVAVSPAKPPPKPDPEVDDPLYLMTLTIPELFLRPYQVTWDGTVFGVFNPDFPLYIKHEDLSEIAHGGQCLSISVL

SEQ ID NO: 156588 - protein, 388 aa, Glycine max
  Coding DNA Sequence Number=SeqID_39810
  Homolog annotation: Hit_ID=Q1XRF9; Match level="QueryCoverage=99%, HitCoverage=100%, E-value=2e-26, Identity=35%"; Hit description =Hypothetical protein precursor
  Subcellular localization annotation: CTP_CleavageSite=67; ConfidenceScore=5.84e-01
MKKLILGLAVTASSLAFAQTTSTSSSNPVTFGVKGGMNVSSLSKGADLSDSKSKIGFNAGVFANIPVASSFSIQPEVLYNDLGSKVTREYTVLGNNFKDESSRNLGYIAVPVMFQYNATPEFFLEAGPEFGFLVSAKDKFKSSTNDNTSTRTRSLDKDAFNTFNFGIGIGAGYYFTPNLGITARYTAGLTDIYKNNNGDAMRNNVFQVGLAIVAGSLTFAQTFGVKAGLNISTISGGDSKSKAGFYGGVLMNVPVAPSFSVQPEILYNGLGAKADGNNDVKVNLDYISVPVMFQYNATPQFYLEAGPQFSFLINSKFKYNSYSRDGKDFVKGFDFGVGLGAGYFFTKNIGVNARYVAGVIDIAKEVNNVQADGKNNVFQIGLTYKFNK

SEQ ID NO: 156589 - protein, 51 aa, Glycine max
  Coding DNA Sequence Number=SeqID_39811
MQSACTNNQKTSLSWVRRLKIVVDAPKGESRQQEYGIRGIRVSPTEMAEHF

SEQ ID NO: 156590 - protein, 148 aa, Glycine max
  Coding DNA Sequence Number=SeqID_39812
MLLFGSERKQLGRGQISPSGVVLQTISPDGALFKHFPAWGSFGRVLHTCSTQTARTTGEFGVGEEIAIHTGDTCMHGEGTANTTGDISIHGNRQVREVATAIGELRASCNSNWRVRAEGIVIPDGDLGPLYTRKLFQYCCVFTTILHT

SEQ ID NO: 156591 - protein, 610 aa, Glycine max
  Coding DNA Sequence Number=SeqID_39813
  Gene Ontology: Mol. function=protein serine/threonine kinase activity; Cellular component=cytoplasm; Biological process=protein amino acid phosphorylation
  Homolog annotation: Hit_ID=Q9FHY4; Match level="QueryCoverage=96%, HitCoverage=87%, E-value=1e-150, Identity=49%"; Hit description=MAP kinase
  Pfam annotation: Domain name=Pkinase; Domain location=16-265; Score =181.8; E_value=1.6e-51; Accession=PF00069.15; Description=Protein kinase domain
  Pfam annotation: Domain name=Pkinase_Tyr; Domain location=16-265; Score=27.3; E_value=3.8e-14; Accession=PF07714.7; Description =Protein tyrosine kinase
  Pfam module annotation: Pfam domain module=Pkinase::Pkinase_Tyr; Domain location=16-265::16-265
MATFHVVEKDPTSRYARYDELLGKGAFKTVYKAFDEVDGIEVAWNRIGVEDVVQTPQQLGKLYSEVHLLKSLKHDNVIKLYNSWVDDTAGTINMITELYRKKHKNVDMKAIKNWARQILRGLCFLHSQSPPIVHRDLKCDNIFVNGNSGLVKIGDLGLAIVMQQPTARSVIGTPEFMAPELYEEEYNELVDIYSFGMCILEMVTCEYPYSECKNPAQIYKKVTSGIKPAALAKVNDPEVKQFIEKCLVPASMRLSASELLKDPFLATENTKEINHDTLQLPNPHIKLVNLPKCEPHPMEIDSYSRRTSPGSSMGRIEETSQVSFFDLVRMTDNNKLMLRGEKNAESTISLTLRIPDACGGARNIHFPFYMDSDTAISIAEEMVEHLELTNEDVSVIAELINDMIAKLVPNSKPLCEKLSSETNLLYRPSSEVQNGEQFNCHWPLQSSDYDMKAMYKDLVHSRPVDGDDQEKQESVMSDISAACGITIASDSKVVEPDIFIFDEFWEGFFNSTSDIRFCGQEDGHKNQSENSVGSLINSCCCPFKNFDMSSICSLTLADKDPSEGLRLDIEAIDTYFDRRFLELEMMRQEAIKSAKRRRHYEEEHTCYVMH

SEQ ID NO: 156592 - protein, 694 aa, Glycine max
  Coding DNA Sequence Number=SeqID_39814
  Gene Ontology: Mol. function=DNA-directed RNA polymerase activity; Cellular component=nucleus; Biological process=transcription
  Homolog annotation: Hit_ID=Q1SWK4; Match level="QueryCoverage=85%, HitCoverage=93%, E-value=1e-162, Identity=48%"; Hit description=Zinc finger, PMZ-type
  Pfam annotation: Domain name=FAR1; Domain location=60-238; Score =84.0; E_value=4.7e-22; Accession=PF03101.5; Description=FAR1 family
  Pfam annotation: Domain name=SWIM; Domain location=527-558; Score =30.0; E_value=8.1e-06; Accession=PF04434.8; Description=SWIM zinc finger
  Pfam module annotation: Pfam domain module=FAR1::SWIM; Domain location=60-238::527-558
MGELYHSHAPLDINSSGSEENLISHSPEEIKLEPISFDENDACPVPRPGMVFSSEAEARFYYTKYAHQMGFGIMTRTSKKGHDGKVKYLILVCSEITRSDALRKQYCAARINLTLRKDGTYRINAATLGHSHELGSHHLLSSDIEMRGKRTLDQEVIDMGVNRISYKNECRNHLQKERHLIGENGDGEALQKYLVRMQEQDGNFFYAIDLDDFFRVRNVFWADGRSRAAYESFGDVVTVDTTCLSNRYKVPLVTFVGVNHHGQSVLFGCGLLSCEDSESFTWLFQSLLHCMSGVPPQGIITDHCCKAMQKAVETVYPSTRHRWCLSNIMEKLPQLIHGHANYKSLRNRLKNVVYDAPTTSEFEGKWKKIVEDFDLKDNKWLKELFLERHCWAPSFVRGEFWAGMSINPHSESMHAFFDGYVSRQTTLKQFVDQYDHALQYKAEKEYIADIHSSNNSQACVTKSPIERQFQSAYTHAKFLEVQHEFVGKADCNVSVASDDGSVCCYNVIEDVIIEDKPKESVVEVIYNRVDCDVKCSCRLFEFRGILCRHSLAVLSQERVKEVPCKYILDRWRKNIRRKYAYTKTSYGVQHFEPHGQRLELLCNQFNSIAAVAAEFEDTSSFVKDNLCNLKEKLETWTTLLRKSSQVDVEKSVIVAAIVNIVAAIWHSRNKAGFDNKLVQHSRAIDMVIANVNLA

SEQ ID NO: 156593 - protein, 541 aa, Glycine max
  Coding DNA Sequence Number=SeqID_39815
  Gene Ontology: Mol. function=RNA-directed DNA polymerase activity; Cellular component=chromatin; Biological process=chromatin assembly or disassembly
  Pfam annotation: Domain name=RVP_2; Domain location=384-516; Score= -25.7; E_value=0.0001; Accession=PF08284.2; Description=Retroviral aspartyl protease
  Pfam module annotation: Pfam domain module=RVP_2::Retrotrans_gag; Domain location=384-516::119-209
MEARVNALEGEISVVRSSLVSFQEEVKENHANLIAMLEKHFGKSLDDEGTGSAVSKNKETPEKKTETPKGSPADKMNEFHQSAKKVELPSFEGEDPAGWISRAEVYFRVQNTTPEVKVSLAQLCMDGPTIHFFNSLIGEDEDLTWESLKIGLLERYGGHGDGDVYEQLTELKQEGSVEDYITEFEYLIAQIPRLPEKQFQGYFLHGLQSEIRGRVCTLATMGEMSRTKLLQVTRAVEKEVKGGNGSGFGRGPKNGPYRSNSHGGNKGVSDWVMVKNKEGGVSSSMRSGLRGDKQAQGDNRHTGPRDRGFTHLSYNELMERKRKGLCFKCKKPFNPGHQCSEKHLRVLIVDDECEEDGEAKVLAVEVEGGEEDEQGEMSMLDLHHIAHENHQTMKFQGIIKGVEVLILVDSGASHNFISQKLVHHMDWPIEQTQQMKVKLGNGVQIEAQGRCKELEMYIGSHKLRPNLQLFELGGIDVVLGMEWLKTLGDTIINWKQHTLSFWEEGRWVTLGNKEGCKNPMIALQSIVGKPRPKKEGEVWTN

SEQ ID NO: 156594 - protein, 222 aa, Glycine max
  Coding DNA Sequence Number=SeqID_39816
  Gene Ontology: Mol. function=RNA-directed DNA polymerase activity; Cellular component=chromatin; Biological process=chromatin assembly or disassembly
  Pfam annotation: Domain name=Chromo; Domain location=122-176; Score =45.8; E_value=1.5e-10; Accession=PF00385.14; Description='chromo' (CHRromatin Organisation MOdifier
MDRDEALRQLKTQLLKAQERMKSQADKKRVDRSFMCGEWVFVKLRAHRQQSVVTRINAKLAAKYYGPYPIVERVGGVAYKLKLPEGSRVHPVFHVSLLKKAVGNYQEDKELPDLLEDPVEACEPEAALASRKIKQQGEEVRQFLIHWKGKTMEEATWEEELMMRSQFPNFDLEDKVNSEEGSIDRVQGNEGYPHQQLIHSTQNGVRPFLVYTRRKGRKVFGG

SEQ ID NO: 156595 - protein, 240 aa, Glycine max
  Coding DNA Sequence Number=SeqID_39817
  Homolog annotation: Hit_ID=Q2QXU5; Match level="QueryCoverage=87%, HitCoverage=83%, E-value=1e-29, Identity=40%"; Hit description=DTW domain containing protein, expressed
  Pfam annotation: Domain name=DTW; Domain location=20-219; Score =136.1; E_value=9.8e-38; Accession=PF03942.6; Description=DTW domain
MEVEAAEADFPSPEEPHRQRRSICSNCDRPSRVCLCHALPLPPIQTTTQILIIQHPHEARHKLSTTPILTKSLLRASSLTARRLRRGLSPLLDRSPPALYLFPSSASALHISSLRPSSGLVLIAFDATWQHAREMVSASEEFLSKFATRVCLGIDESSSGGSIYDSELVLRKEPSAGCVSTMEAVARALRVLEPNGVEIEARLVGVLREMVRLQAGFLKPVKPRPKLLKKKEKNEGSDQG

SEQ ID NO: 156596 - protein, 57 aa, Glycine max
  Coding DNA Sequence Number=SeqID_39818
MQWWFQSQKRCKDKLKLTRNKHRTMVTSKENERVSTENNDGLWWLMVVVGDGESAWD

SEQ ID NO: 156597 - protein, 84 aa, Glycine max
  Coding DNA Sequence Number=SeqID_39819
MCHKISKSSNTLQSNHHCYSTHDFFQAAHHNYCWYQEMVYPSGTRHESLKHVVKGLNPDECIYGENLVEREIPLMSANRSLGGY

SEQ ID NO: 156598 - protein, 58 aa, Glycine max
  Coding DNA Sequence Number=SeqID_39820
MSIYRTRLLLKIVPIPRPCDSSSKLLGSRPRGKLPGNHIINETSKRVGLLPQKETTPE

SEQ ID NO: 156599 - protein, 87 aa, Glycine max
  Coding DNA Sequence Number=SeqID_39821
MICPLQCHEEMHDVIKEYVIVIHYGHRDYQQQCITKRGKLYMRLQCHQASQRHSMTTDQPPILMAHIDSGIGPNISMCVRCVGVMCV

SEQ ID NO: 156600 - protein, 196 aa, Glycine max
  Coding DNA Sequence Number=SeqID_39822
  Subcellular localization annotation: CTP_CleavageSite=25; ConfidenceScore=5.16e-01
LRTWHNLHSVRWSSPQQQQQQPAPSFQNAAGPRRPYIPPPIQQQQQPQKQPTVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSTPAKGDDKNLPNNFCAEAAHSPSSIPSKSSFQQKNGRGRERDLGHV

SEQ ID NO: 156601 - protein, 62 aa, Glycine max
  Coding DNA Sequence Number=SeqID_39823
MTNKAKGKGKEVAGKGSAGKRKGAFDDDKTGGGRKRNKMDMPDKGQSSRPRVVPKEEMLARN

SEQ ID NO: 156602 - protein, 364 aa, Glycine max
  Coding DNA Sequence Number=SeqID_39824
  Gene Ontology: Mol. function=protein binding; Cellular component =membrane; Biological process=defense response
  Homolog annotation: Hit_ID=Q1T4B1; Match level="QueryCoverage=73%, HitCoverage=30%, E-value=2e-43, Identity=34%"; Hit description =Disease resistance protein
  Pfam annotation: Domain name=NB-ARC; Domain location=99-364; Score= -9.0; E_value=1e-09; Accession=PF00931.13; Description=NB-ARC domain
MTYQKLFQMMLDVQSIKDTLSIVKGVLFDAEEKKDHKHGLREWRKQVVKMKVGHFFSSSNSLVFRLRMARQIKHVRRRLDKIADDGNKFGLERIDVNRTLVQRRDLTYSYFDASWVIGRDNDNDKIIKLLMQPHAHGDVGIGGLGKTTLAKLVYNDQRIDELFQLKMWVCVSDDFDIRQINIKIINSDSATALALTSAPSHQENVSSLGIEQLQSRLRYNLSGKKYLLVLDDIWNDDRRKWIELKDLIKVGAMGSKIIATTRRKSIASMMSTFPSGASSSKLPTCNIPEQVRHLSVVGNASLSRALFPKSRSVRTILFPIDGEGADNEDLLITSVTRFKCLRILDLSDSCFETLPHSIAKLEHL

SEQ ID NO: 156603 - protein, 109 aa, Glycine max
  Coding DNA Sequence Number=SeqID_39825
MNTSNQLHRTTRGALIKPLISKPNHSTPIHAYRQHHGRNPCGCISPVHQAKPMATQAVCFASGDGETHLAHVIFSAGMNSGVTLMEMTISRNFFTKQTPSGICLKRDPF

SEQ ID NO: 156604 - protein, 51 aa, Glycine max
  Coding DNA Sequence Number=SeqID_39826
MYAIIAKDHQGNWVVGLAKKIGAATTFKAELLGVYEGLKFAGRNSIRCLEL

SEQ ID NO: 156605 - protein, 124 aa, Glycine max
  Coding DNA Sequence Number=SeqID_39827
MQSAITTGGKLVSLLAAAGRRRYRHWHQRYTCIAIGSSGTKAESRSMCRYSNWRDMLTKHVAIRTGGTCQRGQSHHWFALFQSEKMGRLAVGVAVCRNHSEKRWVGCSVQIGRLCSSEKLACER

SEQ ID NO: 156606 - protein, 87 aa, Glycine max
  Coding DNA Sequence Number=SeqID_39828
MTCLKLRLTRPSSIGKPESEFSGSSSVASKLSTDPFGDEAIWVEGGFGVLAPARGVEEGEGKRKTTSDEEVREERWRKRRKSRKSSS

SEQ ID NO: 156607 - protein, 83 aa, Glycine max
  Coding DNA Sequence Number=SeqID_39829
MPLAAPCSNLQHMVGLGSNLGRFGAHLHWAHVTPAIHAAVRVACDGRERRCRCCGRDGGEELHGGEDGITERLMGFCNFGVTW

SEQ ID NO: 156608 - protein, 268 aa, Glycine max
  Coding DNA Sequence Number=SeqID_39830
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=4e-34, Identity=31%"; Hit description= UPI00006A17C9 related cluster
MPSPLEDYTSSPSEGCMSLPLEDYTSSPSEGRTPSPSEDYTSSPSEDYMSSPSEDCSSSPSEDCSSSPSEDYSSSPSEGYTGLHALAFRGLHVLTFRGQHTLAFRGLCVLAYRGLHVLTFRGLHVLAFSGLHVLAFRGLHALAFRGLQVLAFRGLHTLAFRGLHALTFRGLHVLTFRGLHVLTFRELHAVTFRGLHVLAFRELHALTFTGLHVLTFRGLHVLAIRGMHAIAFRGLHVLAFKGLHILTFRGLHALAFKGIHILALRGLH

SEQ ID NO: 156609 - protein, 98 aa, Glycine max
  Coding DNA Sequence Number=SeqID_39831
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=53%, HitCoverage=21%, E-value=2e-10, Identity=66%"; Hit description=MADS -box protein GmNMH7
  Pfam annotation: Domain name=K-box; Domain location=1-87; Score=-0.3; E_value=0.00046; Accession=PF01486.8; Description=K-box region
MQENLKKLKEVNRNLRKEIRQRMGDCMNDLGLEDLKLLEEEMDKAAKVVRECKRICYSSICTYIYIEKIVEKPDTEYDSPLGKQSFALTDFIQTVKNV

SEQ ID NO: 156610 - protein, 99 aa, Glycine max
  Coding DNA Sequence Number=SeqID_39832
  Gene Ontology: Mol. function=translation elongation factor activity; Cellular component=intracellular; Biological process=translational elongation
  Homolog annotation: Hit_ID=Q43467; Match level="QueryCoverage=92%, HitCoverage=20%, E-value=5e-13, Identity=49%"; Hit description =Elongation factor Tu, chloroplast precursor
  Subcellular localization annotation: CTP_CleavageSite=30; ConfidenceScore=5.07e-01
MVLPWSTWPMVPMLTWGFLRSNLLRTVKVRRGMVVEEGVRWRKEEERGVSLWVLVVEERKGVELREEDDDEEEDDAQGNNMSLEEAVAEEIAMAGGEFG

SEQ ID NO: 156611 - protein, 66 aa, Glycine max
  Coding DNA Sequence Number=SeqID_39833
MAAPSFSPLQMAEHPSRHCKWRDPLTKQTPSVKSLQIDPDWIIIPIAFQVHPPLAASVDISWQKHS

SEQ ID NO: 156612 - protein, 272 aa, Glycine max
  Coding DNA Sequence Number=SeqID_39834
  Gene Ontology: Mol. function=DNA binding
  Homolog annotation: Hit_ID=Q1SDS1; Match level="QueryCoverage=79%, HitCoverage=40%, E-value=6e-26, Identity=35%"; Hit description=IMP dehydrogenase/GMP reductase
MDILALLIFRVVLFPNVDGLVDRAAIDAFLTFYDRKESPDVAILADLYDTFDRRCEKNNARIVCCTPTLYVWLVSHFFRQEMRHVCPLEGHRSCIEKKEANWDRLLASKEEASVNWFPRWKEGRTGILISCGKFPNVPLMGTRGCINYNCVLAIRQLGYPMRGAPSEEGLIPFIIRGFNSTNAGVFQRVHKAWEMLQRKDKELRGSSNGPIGGYCRWLKAYEQDLDWLPSLRTTKGMEIETPKEDEEVQALKTELEKTQAVKEKFKSTAVRF

SEQ ID NO: 156613 - protein, 106 aa, Glycine max
  Coding DNA Sequence Number=SeqID_39835
ENVELQVKLFQLHESAQPGVCSRHHRSLARRVERSALAAWKMVRMTKESSGAARARERMFLKRGDESGRATTTGFSSNVVSVFILITIMPPPNLQRRSFSTDVESA

SEQ ID NO: 156614 - protein, 232 aa, Glycine max
  Coding DNA Sequence Number=SeqID_39836
  Homolog annotation: Hit_ID=Q2QLK4; Match level="QueryCoverage=33%, HitCoverage=9%, E-value=5e-07, Identity=37%"; Hit description =Pentatricopeptide, putative, expressed
  Pfam annotation: Domain name=PPR; Domain location=152-186; Score =38.3; E_value=2.6e-08; Accession=PF01535.11; Description=PPR repeat
  Pfam annotation: Domain name=PPR; Domain location=187-221; Score =26.8; E_value=7.6e-05; Accession=PF01535.11; Description=PPR repeat
  Pfam module annotation: Pfam domain module=PPR::PPR; Domain location =152-186::187-221
MASTANHCLQLAGATESTRRWRISISCKKKSDKLAFKETKEGFVDYDRGQHEVSTKISGLRKDDIAARYRLRVAGNRFQMDWTVSEVAELVLSLNLSDDDDVDGLLNRWVGRFARKNFPFLIKELTQRGSIEHCNRVFRWLKNQKNYRARNDIYNMMIRLHARHNRTDQARGLFFEMQEWRCKPDVETYNAIINAHGRAGQWRWAMNIMDDMLRAALSMSGEGRGRKREHIV

SEQ ID NO: 156615 - protein, 176 aa, Glycine max
  Coding DNA Sequence Number=SeqID_39837
  Homolog annotation: Hit_ID=Q9SJX7; Match level="QueryCoverage=33%, HitCoverage=13%, E-value=4e-17, Identity=76%"; Hit description =Expressed protein
MEVVASRATRLPIYSLFDKEGNHSDLFAKGEAFSTLFNVIGIGVGSQLASTICASTQGKNPSPTLFLALCSSLLLLHRFFFAIVSTGSSACLYGLATLPSRGSLKELVCRHYRGLFGVLTLHSVWGAHSCSHGVIFSEEDNYGFVGLVFGVVGFVLGFIGFMYGFVGVVCPIEPGA

SEQ ID NO: 156616 - protein, 69 aa, Glycine max
  Coding DNA Sequence Number=SeqID_39838
  Gene Ontology: Mol. function=racemase and epimerase activity, acting on carbohydrates and derivatives; Biological process=carbohydrate metabolic process
  Homolog annotation: Hit_ID=Q9M0B6; Match level="QueryCoverage=79%, HitCoverage=13%, E-value=3e-13, Identity=75%"; Hit description =Nucleotide sugar epimerase-like protein
MEWWFERLSLDSSCFQGFVDSDSRYLSVSWGRIQWEKQVRTSARSTVKAACPSSSSAQLASSAPTSPSR

SEQ ID NO: 156617 - protein, 51 aa, Glycine max
  Coding DNA Sequence Number=SeqID_39839
MALRVTAFKGRQDQCSNLSLSSEVPENGGNSAMSELFYSAPKSAPISFLVT

SEQ ID NO: 156618 - protein, 230 aa, Glycine max
  Coding DNA Sequence Number=SeqID_39840
  Homolog annotation: Hit_ID=UPI0000E822B9; Match level="QueryCoverage =33%, HitCoverage=33%, E-value=8e-07, Identity=43%"; Hit description =PREDICTED: similar to prolin rich protein
NTPMKERKRRSIHDITLEDIHMTDTSHIDKHNWVPLPTNFAVQPHTPHIDQPNWVPPTPNFIVQPHTPSIHQHNWVPPTPNFIAQSHTPRIDQHTWVPPAPPNFAGQPRSAHIDQLNWVSPPPNFAPHTPLVDQDNWVPTPPDFAVQSHTPHIDQHNLVPPPPNFAVQPHQMQRAQHMQQFNLHDSSPQMDEYRNFNSFHPQNELDLIAQQILEYKKNKFNHKNNEGSSR

SEQ ID NO: 156619 - protein, 613 aa, Glycine max
  Coding DNA Sequence Number=SeqID_39841
  Gene Ontology: Mol. function=binding; Cellular component=membrane
  Homolog annotation: Hit_ID=O82388; Match level="QueryCoverage=85%, HitCoverage=90%, E-value=1e-110, Identity=45%"; Hit description =Expressed protein
MAVRMQYSGTTTVATGWSERKETKAIQKGQTRIHGFHSFTTLVSFYDVVMELKFMQFSQHVLPHSPSSSQTLASALSSPSSSKTRTLVCRFVNRSSLFPTTTRLLRRTKSFEHHALFTRRGSLRRACSASLEPFSDEEFAKKIEDLALKFQLSDENTNANDLDSEDFQEISLSSLNFAEEFEPPEEIFPANIERKANSVELPFSLRIIKKKLQWKEGFREAGESAYCSVKKAFSSMVFIIRELHSFTMQMREFLFYEDLQGILERVQNEMHASFVWLFQQVFSHTPTLMVYVMILLANFTVHSMGNNAAIAAVAPPPVTSVVEAHDQRGHIQSHNIDSSSIKTFSVSNGKNTAYVGGGNGGGGKVRPAGNGTDGDGRFDRSRHGTVFSDGGASSQVYKTGDKTESVSGQEEEEELNLWNAMVEEASRMEGLDRDVMKRFVSPVMARIESDDYAEYLRTELVYQTGLSQDPSNTLLLVNYAQFLYLVVHDFDSLTTPLVHEQDLSSPARDIHVHDEDDPTRNLVDFDFSAYTAEELFKRAIEVEPPDAEAYNKYAKFLWKVKNDLWAAEETYLEAISADPDNAFYAADYAHFLWNTGGEDTCFPLSSPDNSKEV

SEQ ID NO: 156620 - protein, 102 aa, Glycine max
  Coding DNA Sequence Number=SeqID_39842
MSDYYFDEEEMQELLKENDAPVSDDFFNDFAAQDSSPPADEILPADEVLDPLLVPTSHMVHTSSATAPDPAPHLIPSEETLPSSHPHHLLRQNMESNHVMLS

SEQ ID NO: 156621 - protein, 289 aa, Glycine max
  Coding DNA Sequence Number=SeqID_39843
  Gene Ontology: Mol. function=transferase activity, transferring glycosyl groups; Cellular component=cytoplasm; Biological process =nucleoside metabolic process
  Homolog annotation: Hit_ID=Q1S4Q9; Match level="QueryCoverage=91%, HitCoverage=55%, E-value=1e-138, Identity=91%"; Hit description =Phosphoribosyltransferase; AAA ATPase; Phosphoribulokinase/uridine kinase
  Pfam annotation: Domain name=PRK; Domain location=52-238; Score =194.1; E_value=3.3e-55; Accession=PF00485.8; Description =Phosphoribulokinase  Uridine kinase family
SLPMDAKSAVELMESSSEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTKQLLHVMDKLKHGEAVDIPKYDFKSYKSDDVLRRVNPSDVIILEGILVFHDPRVRELMNMKIFVDTDADVRLARRIRRDTTEKGRDIGAVLDQYSKFVKPAFDDFILPTKKYADIIIPRGGDNHVAIDLIVQHIRTKLGQHDLCKIYPNLYVIQSTFQLNHLDSCYYADTGYAYPDT

SEQ ID NO: 156622 - protein, 385 aa, Glycine max
  Coding DNA Sequence Number=SeqID_39844
  Gene Ontology: Mol. function=DNA binding; Cellular component=nucleus; Biological process=regulation of transcription, DNA-dependent
  Homolog annotation: Hit_ID=Q1T242; Match level="QueryCoverage=45%, HitCoverage=44%, E-value=5e-16, Identity=31%"; Hit description =Homeodomain-like
  Pfam annotation: Domain name=Drf_FH1; Domain location=201-349; Score=- 5.0; E_value=0.03; Accession=PF06346.3; Description=Formin Homology Region 1
  Pfam annotation: Domain name=Extensin_2; Domain location=14-361; Score=-139.3; E_value=0.074; Accession=PF04554.4; Description =Extensin-like region
  Pfam annotation: Domain name=Myb_DNA-binding; Domain location=110 -157; Score=21.1; E_value=0.0039; Accession=PF00249.21; Description =Myb-like DNA-binding domain
  Pfam module annotation: Pfam domain module=Drf_FH1::Extensin_2::Myb _DNA-binding; Domain location=201-349::14-361::110-157
MSDYYFDEEEIQELLKENDAPVSDDFFNDFAAQDSSPPADEILPADEVLDPPPVPTSHMVHSSATAPDPAPHLVPSEETLPSSHPHPLLPQNMESNHVMLSGDSSHHKKYEHWTIEEHKSFLFGLEIMKEKGWKQISEKYVPSKTASQVASHAQKYIKRKNTPSKERKRRSIHDTTLDDMDIIRIDQHNWVPSTPNFMVQPHTLSTHQHNWVPPPPPNFAVQPRTPHVDQDNWVSPPSNLAVQPPTPHIDQHNWVPSPPNFAVQPPTPHIDQHNLVPSPPNFAVQPPTPHIDQHNWVPSPPNFAPHTSLIDQDNWVPTPPDFAVQPHEMQRAQHMQQFNLHSSSPQMDEYRNFNSGHPQNELDLIAQQILEYKKNKFNHKNNEGP

SEQ ID NO: 156623 - protein, 160 aa, Glycine max
  Coding DNA Sequence Number=SeqID_39845
  Gene Ontology: Mol. function=RNA-directed DNA polymerase activity; Cellular component=chromatin; Biological process=RNA-dependent DNA replication
  Homolog annotation: Hit_ID=Q8H7X6; Match level="QueryCoverage=88%, HitCoverage=13%, E-value=1e-45, Identity=55%"; Hit description =Putative retroelement
MLCSLHLKPEIKTKDDKIPEEIEELLLSYKEIFREPTSLPPVRAHDHKIPFKDRVSTINVRPYRHSTVQKDVIELMTKELLDVGLVQPSNNPYSSPIVLVKKKDGSWRMCINYRELNKSTIKDKYPIPIIEELVDELHGSGWFSKIDLRSGYHHIQMYPT

SEQ ID NO: 156624 - protein, 319 aa, Glycine max
  Coding DNA Sequence Number=SeqID_39846
  Gene Ontology: Cellular component=integral to membrane; Biological process=steroid metabolic process
  Homolog annotation: Hit_ID=O80866; Match level="QueryCoverage=99%, HitCoverage=39%, E-value=1e-118, Identity=69%"; Hit description =Putative oxysterol-binding protein
MEALQAVKDMFPRMSNSELMAPVDNVTVSTEKLRVRLMEEGVSEAAIQDSEQIMRTEFAALQSQLVLLKQKHSALIDTLRQLETEKVDLEDTVVDESQRQWNGEEASSRLAQEKFSEGTASESEDDNERNDAAEEETDDDDNAFFDTRDILSSSSFKSNGSDYRVSSFSSDDEGFYAFESEDDIDPSIRYVGTNYPHVKRRKKLPDPVEKEKGVSLWSMIKDNIGKDLTKVCLPVYFNEPLSSLQKCFEEMEYSYLLDQAYEWGKRGNSLMRILYVAAFAISGYASTEGRVCKPFNPLLGETYEAHYPDKGLRFFSEKV

SEQ ID NO: 156625 - protein, 100 aa, Glycine max
  Coding DNA Sequence Number=SeqID_39847
MGKCGKPCCPGCHLHPACKSKDKTKGTKKHKLHLITLDDHFSNDYTEDEGNDQMIVMGKIILKWGFHFRWMKLNKKKKDEDWLLPLERINDAIFGFEEIE

SEQ ID NO: 156626 - protein, 117 aa, Glycine max
  Coding DNA Sequence Number=SeqID_39848
  Homolog annotation: Hit_ID=Q1XA87; Match level="QueryCoverage=42%, HitCoverage=38%, E-value=5e-12, Identity=66%"; Hit description=Salt tolerant protein
MDLLELWAIFGPGVAGAVFGAGWWIWLDAVVCSLVTVPFLHYLPGIFASFAALMFNCVRKEDIDYSPYDEGEWRLCKQIMNNNNNNNKTIFHYKADKQACYKKLCASGITIVSDRGM

SEQ ID NO: 156627 - protein, 1058 aa, Glycine max
  Coding DNA Sequence Number=SeqID_39849
  Gene Ontology: Mol. function=zinc ion binding
  Homolog annotation: Hit_ID=Q69T47; Match level="QueryCoverage=59%, HitCoverage=66%, E-value=1e-107, Identity=36%"; Hit description=PHD finger protein-like
  Pfam annotation: Domain name=C1_1; Domain location=612-660; Score =6.9; E_value=0.0041; Accession=PF00130.12; Description=Phorbol estersdiacylglycerol binding
  Pfam annotation: Domain name=C1_3; Domain location=620-650; Score =19.4; E_value=0.0027; Accession=PF07649.3; Description=C1-like domain
  Pfam annotation: Domain name=PHD; Domain location=621-668; Score =37.2; E_value=5.5e-08; Accession=PF00628.19; Description=PHD-finger
  Pfam annotation: Domain name=zf-C3HC4; Domain location=622-665; Score= 1.8; E_value=0.1; Accession=PF00097.15; Description=Zinc finger, C3HC4 type (RING finger)
  Pfam module annotation: Pfam domain module=C1_1::C1_3::PHD::zf-C3HC4; Domain location=612-660::620-650::621-668::622-665
MSSMWYFQEAAELLSILYVQGKLDIGWRFGQSMVELRAFCLKHSDLPENRSILPLKGSIAGTNDISEANGFPVALPVSGEQSLKDCRNGGLASDSSPDKLNHNDELPDGGLSDCRLSAHDDMLGCGAVPQQDVGVVGRANENVDASDSLSFALVLKKLIDRGKVDVKDVALEIGISPDTLTANTNEAYMAPDVQHKIVNWLKAHVYTNAFQKGLKVKFKPANASKNDSEAIDGSDTLPISDSGLLDPVAVKSVPPRRRTTSNIRILKDNKVICSSEGVIGENGMPVDMCRVGQSDCDNPTNYNEASIPNATEMNLTKSEDIFHEVQGNASGCVSAGNSTACLLNASVLSDHCLVHSASEPLDFGFIKKDAISSYIHPYINKKLLQIRDGVPLEDIICSSDEGNSSLVESFRASACSSSQNQNLTCIDISKPDEVNMEQLVRARKMGLLEFSPQDELEGELVYFQHRLLQNAVAKKRHIDNLIYSVAKSLPHEIDKAHQQRWDDVIVNQYLRDLREAKKQGRKERKHKEAQAVLAAATAAAAASTRALRKDTLDESMQQENMTFFQNLLKLDTLNGRTGACSQPMSRAKETLSRVAVTRTSSEKYSDFCMPTSDLSKEHCKSCDICRRSEFILNPILVCSGCKVSVHLDCYRSVKETTGPWYCELCEDLSSRSSGASAINFWEKPVAECALCGGTTGAFRKSSNGQWVHAFCAEWVFESTFKRGQINAVEGMETLPKGVDICCICHHKHGVCMKCCYGHCQTTFHPSCARSAGLYMNVRTTGGKAQHKAYCEKHSLEQKAKAETQKHGIEELKSIRQIRVELERLRLLCERIVKREKIKRELVLCSHDILAFKRDHVARSVLVRSPFILPDGSSESATTSLKGNTEGYRSCSEPLQRSDDVTVDSSVSAKRRVRVAISMDTDSKLDDDCSTSQSRYNHRIPDRLQFSGKKVPHRTAASRNISDEGGWISKSRNHSDRFGKELVMTSDEASMKNSMLPKGYAYVPADCLSNEKHSDEDVYASEPVEHDRFYDSRSNSERDRALDIRSTEHINYIYLTPTS

SEQ ID NO: 156628 - protein, 78 aa, Glycine max
  Coding DNA Sequence Number=SeqID_39850
MDFAGFKYASTIGLEDNVGKKFSMETYQFTPFCLPIMTYYLTLVFIPKDKILFSFEGELVPQININILNKNYYHTTVK

SEQ ID NO: 156629 - protein, 226 aa, Glycine max
  Coding DNA Sequence Number=SeqID_39851
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=8e-39, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGLHVLAIRGLHVLAIRGQDVLAIRGLHALTIRGLHVLSIRGLHALTFKGLHVLAIRGLHVLAIRGLHVLAIRGLHILAFRGLHVLALRGLHALAFSGLHILAFRGLHALAFRRLHVLAYRGLLALAFRGLHVLTFRGLHALAFRGLHALPFRGLHALAFRGLHALPFRGLHVLAFRGLHVLAFRGLLHILAFRWLHVLAFQGLHVLAFRGLHVLAFRGLHVLAF

SEQ ID NO: 156630 - protein, 230 aa, Glycine max
  Coding DNA Sequence Number=SeqID_39852
  Homolog annotation: Hit_ID=Q1T4S3; Match level="QueryCoverage=41%, HitCoverage=6%, E-value=6e-07, Identity=33%"; Hit description=Zinc finger, CCHC-type
  Pfam annotation: Domain name=zf-CCHC; Domain location=108-125; Score =6.8; E_value=0.074; Accession=PF00098.13; Description=Zinc knuckle
  Subcellular localization annotation: CTP_CleavageSite=26; ConfidenceScore=5.24e-01
MASASIPPSPPPPRNSGALLGSSAVVTTKEFSHSISQKLNNSNYLPWCQQVELVLKGHRLYHLLTKPQIPPRYLTIANCDAGVTSPEFLLWEQQDQLLLSWLQSTISGECQICHRYGHEASYCYQRHNDDYVPTQPMEYPNQYPDQNQSQTSANPNQYQSLNQNSNTYQNQQSNQYSAQHSPQAYLTGVPSAPSPKWYPDSGAYHHVTNVSQNIHQTTPFEGNLRSQTSP

SEQ ID NO: 156631 - protein, 47 aa, Glycine max
  Coding DNA Sequence Number=SeqID_39853
MAKMSSGGILFKEKSNPFCGVGGEWAALEGGVRLTMPGRGVLQRRYL

SEQ ID NO: 156632 - protein, 456 aa, Glycine max
  Coding DNA Sequence Number=SeqID_39854
  Gene Ontology: Mol. function=transcription factor activity; Cellular component=nucleus; Biological process=regulation of transcription, DNA-dependent
  Homolog annotation: Hit_ID=Q8GWK2; Match level="QueryCoverage=89%, HitCoverage=88%, E-value=1e-117, Identity=54%"; Hit description =Putative AP2 domain transcription factor
  Pfam annotation: Domain name=AP2; Domain location=60-166; Score=94.3; E_value=3.7e-25; Accession=PF00847.10; Description=AP2 domain
MASSSSDPGKSAETSEAAALAVANDQLLLYRGLKKAKKERGCTAKERISKMPPCAAGKRSSIYRGVTRHRWTGRYEAHLWDKSTWNQNQNKKGKQVYPNRVLFFPIIIIVELAGAAYFLKMMMFVVDGFWTGAYDDEEAAARAYDLAALKYWGPGTLINFPVTDYARDLEEMQNVSREEYLASLRRKSSGFSRGLAKYRGLSSRWDPTYGRMSGSDYFNSMHYGAGDDSAAESEYVSGFCLDRKIDLTSHIKWWGSNKSRHSDAGTRLSEEKKLGSAGDVCSELKQLEQKVQPMEPYQMPQLGRLHNEKKHRSSSLSALSILSQSAAYKSLQEKASKRQENSTDNDENENKNTINKLDHGKAVEKPSNHDGGNDRLNIAMGMSGTMSLQRNAYPLTPFLSAPLLTAYNTVDPLVDPVLWTSLVPMLPAGLSRTAEVTKTETSLETSSTYTMFQPEE

SEQ ID NO: 156633 - protein, 262 aa, Glycine max
  Coding DNA Sequence Number=SeqID_39855
  Subcellular localization annotation: CTP_CleavageSite=44; ConfidenceScore=5.59e-01
MCSKSIAFNIFSPSLKFHRNTPPLPITMPVLLHPSSYSRSNKISSSSRGYNPPFLHQLCNDLHTIFLNNSSISDYLFRNQTIIDSLSSIGEHVSESELVDIVLDVATLLLAHETHISRKKALASLLASINLAEAAKPNFSPNSSMQAFSSDSASTNPQAYVSQGQSSLSSNFGSSYNNYNGGNRFFNSVHGGDQNFSRGGGCGRGCYFNVQYHICHKYDLATFCHHRHDDDYVLTQPMDYPNQYSDQNQSQTSAQSVSQSES

SEQ ID NO: 156634 - protein, 140 aa, Glycine max
  Coding DNA Sequence Number=SeqID_39856
  Gene Ontology: Mol. function=kinase activity
  Homolog annotation: Hit_ID=Q1SZU4; Match level="QueryCoverage=96%, HitCoverage=20%, E-value=8e-13, Identity=32%"; Hit description =Protein kinase PKN/PRK1, effector
MESLAFALHEVSAEATETKENILHIQPESESYDAQIEDLKLVLKATNEKYNSMLDEAEWEQREVQLVSCIKKNEEEKESLEKEIKILLYLLKETEEEQNAKKEEKAQLKEKMKEVEAKAIQLQEALKETTTDNMKLIQCS

SEQ ID NO: 156635 - protein, 95 aa, Glycine max
  Coding DNA Sequence Number=SeqID_39857
MPSFLSVGNKDGLAARGCYFLLLWRALAIGSSKLAHNYSQLRALGSYREHSLQQRGPPLLLLPFAVAADKGKAVSCTLLVVYIVVKLRPIKVGIM

SEQ ID NO: 156636 - protein, 259 aa, Glycine max
  Coding DNA Sequence Number=SeqID_39858
  Gene Ontology: Mol. function=nucleic acid binding; Cellular component= mitochondrion; Biological process=DNA integration
MSDPSEQHWAAVKRILRYLAGTINFGLKYSTGPPFALHAYCDADWASDPDDRRSTSSAAVFFGSNLVSWWSKKQSVVAKSSTEAEYRSLALATAEHCCPCSQSGYALSYQAYGTGSFFVREKVMDKQLQVVHVPTIDQKADILTKALTPPNFATYRSMLRVVENFTSTLSLTCGGKEKVEIEKNRKIEERKKGDDLGGSDEGVANLEEPVLAEHDLQLPPRSSHGCGETLEADAIGVVLFTLKSQFGCSGREKKGKAVG

SEQ ID NO: 156637 - protein, 340 aa, Glycine max
  Coding DNA Sequence Number=SeqID_39859
  Gene Ontology: Mol. function=siderophore-iron transporter activity; Cellular component=outer membrane; Biological process=siderophore transport
  Homolog annotation: Hit_ID=Q87Z57; Match level="QueryCoverage=94%, HitCoverage=45%, E-value=2e-81, Identity=48%"; Hit description=TonB -dependent siderophore receptor, putative
  Pfam annotation: Domain name=Plug; Domain location=68-167; Score =79.3; E_value=1.2e-20; Accession=PF07715.5; Description=TonB -dependent Receptor Plug Domain
MQNNSPRAVKLLCHPAILAAIYGVTALSSTDSLAAEQNSTLTVTAQQQNSDDGYSATSSSVASKTPVSRLNEAQSVSVVTQQQLEDYQAASLADALRFVSGVSEGNTLAGTEDGFVRRGFGSNSDGSIYRDGVRSSQGLNFDATTERVEVLKGSASLLYGIQNPGGVINIVSKKPQYTWHTKVSGRAASEGGGAGTLDVTGPLGNGFAFRLIAEKQNQDYWRNFGSDKHTLIAPSLQWYGEQASFLISYEDYQYDIPYDRGTAFVNGKPVAIGYKDRLDDKANHAWGHNKTLNAHYDWQFNEAWSTRLTFGWNQRQYDNNEVRVTAINPTTGVVTRRGIL

SEQ ID NO: 156638 - protein, 280 aa, Glycine max
  Coding DNA Sequence Number=SeqID_39860
  Gene Ontology: Mol. function=transcription factor activity; Cellular component=phosphopyruvate hydratase complex; Biological process =regulation of transcription, DNA-dependent
  Homolog annotation: Hit_ID=Q09KH2; Match level="QueryCoverage=80%, HitCoverage=76%, E-value=4e-77, Identity=64%"; Hit description=FitR
  Pfam annotation: Domain name=HTH_6; Domain location=58-163; Score =3.1; E_value=0.0005; Accession=PF01418.8; Description=Helix-turn -helix domain, rpiR family
  Pfam annotation: Domain name=SIS; Domain location=181-277; Score= -1.1; E_value=0.032; Accession=PF01380.12; Description=SIS domain
  Pfam module annotation: Pfam domain module=HTH_6::SIS; Domain location=58-163::181-277
MRLKLAGLSQARRKWAAVAAQIFTTSRPADAVHNNAILLTGNIMAANNIKNRVDVFGERYRARVTTLSASLQTVARYIHEHREAILDATALDIAQATQTSDATVVRTVQALGFAGLRDLKTTLAAWFGPAQNSEEKMSATISELSCDINSGIDFVLGGHQRACEVLAEPVNRQAVAAAVTLLLEARQVALFGINASGILAEYSARLFRRIGLPAVTLNRAGIALAEQLITLQRGDVLIMMAQKSAHREGMTTLKEAQRLGMPVILLTHALDSAFAQQRMW

SEQ ID NO: 156639 - protein, 370 aa, Glycine max
  Coding DNA Sequence Number=SeqID_39861
  Gene Ontology: Mol. function=microtubule motor activity; Cellular component=microtubule associated complex; Biological process =microtubule-based movement
  Homolog annotation: Hit_ID=Q9C7T0; Match level="QueryCoverage=56%, HitCoverage=20%, E-value=6e-39, Identity=38%"; Hit description =Kinesin, putative; 56847-62063
MGIQMLLLSTCAFYRYNAYGHCSEGTDTHFGMSNEEANAKFMGATYMTKYRKAKKGIQFLINGSKGTEDIGMEAMLKRLKRDFDSQRKKLTKTRRELGEIKRENQQKSRECQEAWNSLKELQNKLMHKSMHGQVKDKSKWFSSLRDFKMKLKISSPKSHEDLKSKYIEGATERKHLYNKVLEFRGNIRVFCRCRPLNTDEIYAGATVTLDFESAKDGDLTVMSNGAPKRTFKFDVVFGPQDEQGIDAFMPFECLGLGEEIAKRGVNDTNGYFLYSFPMDGCHHQKGGEFTMQDKRSFDVSVKNTENTQKGGKRVILSLLLNPGSPKLAFSSHGLPNSLGVKYPAHQGELSSPRRARLLQVKATTRLGELP

SEQ ID NO: 156640 - protein, 72 aa, Glycine max
  Coding DNA Sequence Number=SeqID_39862
MEISQSPISSPDDTPWGYVKLLKACDSSVQNEPVNVVVLQHFKESTNEKSKDVTTLDWNVNLCSIIVVAYLP

SEQ ID NO: 156641 - protein, 270 aa, Glycine max
  Coding DNA Sequence Number=SeqID_39863
  Gene Ontology: Mol. function=nucleoside-triphosphatase activity; Cellular component=membrane; Biological process=transcription
  Homolog annotation: Hit_ID=Q8W010; Match level="QueryCoverage=83%, HitCoverage=60%, E-value=4e-92, Identity=64%"; Hit description=ATP -binding cassette transporter AtABCA1
  Pfam annotation: Domain name=ABC_tran; Domain location=1-133; Score =21.5; E_value=2.2e-09; Accession=PF00005.17; Description=ABC transporter
MDIHAPNPKVLDVRGCTEKNPSLTLARDSVKIEYVVMEKLTEFDLLKHANKPSFSLSGGNKRKLSVAIAMIGDPPIVILDEPSTGMDPIAKRFMWDVISRISTRRGKTAVILTTHSMNEAQALCTRIGIMVGGRLRCIGSPQHLKTRFGNHLELEVKPTEVSSADLQNLCQAIQERLLDVPSHPRSLLNDLEICIGGTDSVTSGNTSIAEISLTREMIGLIGRWLDNEERVKTLISGTPVCDGASQEQLSEQLFRDGTCESSIEGFASYH

SEQ ID NO: 156642 - protein, 95 aa, Glycine max
  Coding DNA Sequence Number=SeqID_39864
PARHLPVMQDDTYVEPDIPQYPMAAATMEEALALADACQAIAERLERLLNLRIATKGTEAYSVMEDFLRIARGVTVECICEVVTKMAYGRHMKAF

SEQ ID NO: 156643 - protein, 69 aa, Glycine max
  Coding DNA Sequence Number=SeqID_39865
MTILTTEVVVAAMVLRHGGDNNDNDKGHNNKDGDNNGDKGGDDYSGDCSSSHDGGSNHHDDCDGLNEIF

SEQ ID NO: 156644 - protein, 167 aa, Glycine max
  Coding DNA Sequence Number=SeqID_39866
  Subcellular localization annotation: CTP_CleavageSite=51; ConfidenceScore=5.60e-01
MPQQLHASSSFALCFLSCHRHPQLSLPPLRSSPRLLCRFCRQSKRLMILMVASLYGLTNLYNSYGLPNPPTTFARRQREAVLVAEDVQHVDHAVDEVYEQLEEVAVDDEVADAEGFSGGLHDTSVLTAYVDHVVVIVWNGKEHLELKLSSHGRKFRNLADLLHRWKA

SEQ ID NO: 156645 - protein, 233 aa, Glycine max
  Coding DNA Sequence Number=SeqID_39867
  Gene Ontology: Mol. function=protein binding; Biological process =defense response
  Homolog annotation: Hit_ID=Q94J89; Match level="QueryCoverage=64%, HitCoverage=11%, E-value=1e-13, Identity=31%"; Hit description =Putative NBS-LRR type resistance protein
  Pfam annotation: Domain name=NB-ARC; Domain location=2-232; Score= -131.2; E_value=0.064; Accession=PF00931.13; Description=NB-ARC domain
MAYSHVDASGLIGRDNDREEIIKLLMQPHSHGDSVGNKSICVIPIVGIGGLGKTTLSKLVFNDKRMDELFQLKMWIIIKIVNYASVPTISLAQHEIINNLDIDQLQSHSDISFLAFQWIIVYLFLSNGHLRKAKKNIQKLENIARQYIDELHSRSFLEDFEDLGHLYYFKVHDLVHDLALYVAKEELLAVNSCTRNIPEQIRHLSVVENHSLSHALFHKSRRVKNFSHPWNGN

SEQ ID NO: 156646 - protein, 228 aa, Glycine max
  Coding DNA Sequence Number=SeqID_39868
  Gene Ontology: Mol. function=DNA binding
  Homolog annotation: Hit_ID=Q1RUD8; Match level="QueryCoverage=96%, HitCoverage=44%, E-value=2e-25, Identity=33%"; Hit description=IMP dehydrogenase/GMP reductase
MGTNQTGKRFYQVKIKGLDVTSLKELGPLMRPLQMQAFRKMYGKILDLTIAKVFTETVVSLTQYYDQPLRCFTFGDFQIVPTVEEFEEILGCPLGGRRPYLFSGFLPSLSKIAVVVRDSVRELDRVKQTRNDVVGLPRKYLEGKARDMANQEECVPFADVLALLIFGVVLFPNMDGLVDLAVIDAFLAYHHSKESPVVAILADLFDTFDRKCEKSSARIICCLPALCM

SEQ ID NO: 156647 - protein, 43 aa, Glycine max
  Coding DNA Sequence Number=SeqID_39869
MEGVWNLRVIRGERRPQHHHLNKAVSGPRSPGVIGERGSRESE

SEQ ID NO: 156648 - protein, 56 aa, Glycine max
  Coding DNA Sequence Number=SeqID_39870
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=96%, HitCoverage=28%, E-value=3e-19, Identity=83%"; Hit description =Anaphase-promoting complex subunit 10
MLIVLFLVFKLDESYTPSKFSIRAGDGFHNLKEIKTVELVKATGWVYLSLSGADPR

SEQ ID NO: 156649 - protein, 170 aa, Glycine max
  Coding DNA Sequence Number=SeqID_39871
MWVSTERFLADFSWEEKENRECRRVFERASCAISTCSIIDEHVDIYIEEASSNESTQAQARSRLGLDGNTFAYAEGVLNEDSLNMWRDKIWSAFSLYLNEIDSTNLKFSEIPRYEFEDAVHLHLKYEVTWKEAESSFSQISERPLPSYSYAVQTFIYPHLYNLMEKARRP

SEQ ID NO: 156650 - protein, 134 aa, Glycine max
  Coding DNA Sequence Number=SeqID_39872
MRNNTSIPIQKIFKDETWKRVIMEMDESGVDGASHIGKRNEFLEGLCGFEEVATADGDLDEFRVELGVEEARDHVGDVGEEIRVEGVVGGEGFGGEGLRWNRCVLLRGRGRRRQSSESENEGLEEVRDGEGATK

SEQ ID NO: 156651 - protein, 152 aa, Glycine max
  Coding DNA Sequence Number=SeqID_39873
MVMGDFISRLSFPENTETFSSLTSYPELRRSEFLIGGYVGARASLLSTIPPFVAMTQELVARGDTLRLFAPLLSSRGGGPDDKQRPSFGHPAPLYHPEAAGPMIRGDTLRLFAPFCHPEAAGPMTSRDQVWSFCTLVSSRGGGPDDTRKYPS

SEQ ID NO: 156652 - protein, 104 aa, Glycine max
  Coding DNA Sequence Number=SeqID_39874
MESGVLVSSELKQDRALSNEGAERSDMVLWNLGSRGGNPEPLSGGKDCSGSDADAEGDEERVALVDEVVDVEGNGNGGEALVSGILLVPEELLGAGLAGGGGGR

SEQ ID NO: 156653 - protein, 110 aa, Glycine max
  Coding DNA Sequence Number=SeqID_39875
  Gene Ontology: Mol. function=nucleoside-triphosphatase activity; Cellular component=integral to membrane; Biological process=transport
  Homolog annotation: Hit_ID=Q8RWI9; Match level="QueryCoverage=70%, HitCoverage=11%, E-value=4e-19, Identity=61%"; Hit description=White- brown complex homolog protein 15
MDLLANVAVENKRRVCLVWEDLTVVASSVNNSPKRELLKGLSGYAEPNRIMALIGPSGSGKSTVLAALAGILPTNVSMTGNVLLNGTTRSTGCRDITNVIDVISIVVPDN

SEQ ID NO: 156654 - protein, 109 aa, Glycine max
  Coding DNA Sequence Number=SeqID_39876
  Gene Ontology: Mol. function=protein serine/threonine kinase activity; Biological process=protein amino acid phosphorylation
  Homolog annotation: Hit_ID=O23304; Match level="QueryCoverage=67%, HitCoverage=15%, E-value=3e-13, Identity=50%"; Hit description =Kinase like protein
MVASCLDQDPSKRPNADKLLKHPSFKNRKGTDFLVKNVLQGLPSVEKRYKESKGNLHEDDDDPSMQELDPVFPNDDKEVRFGGETVIQQAAGMEKVNNNVAVGKGCWRL

SEQ ID NO: 156655 - protein, 112 aa, Glycine max
  Coding DNA Sequence Number=SeqID_39877
  Homolog annotation: Hit_ID=O23304; Match level="QueryCoverage=53%, HitCoverage=18%, E-value=2e-08, Identity=45%"; Hit description =Kinase like protein
MNGITTQRMLGWERSRSMDLIATAAEFMGMQRAGFVDKGAHALANLVQELVGGRVQWVLDPFASCCFFCSVGCGHAILHRKPKSVISKPHETNLIVISSNNDILLLGKELHN

SEQ ID NO: 156656 - protein, 148 aa, Glycine max
  Coding DNA Sequence Number=SeqID_39878
  Gene Ontology: Mol. function=nucleic acid binding; Cellular component= ribonucleoprotein complex; Biological process=mRNA processing
  Homolog annotation: Hit_ID=Q10NM2; Match level="QueryCoverage=56%, HitCoverage=24%, E-value=2e-33, Identity=79%"; Hit description=RNA recognition motif family protein, expressed
  Pfam annotation: Domain name=RRM_1; Domain location=20-91; Score =81.5; E_value=2.6e-21; Accession=PF00076.12; Description=RNA recognition motif. (a.k.a. RRM, R
MESYFVWSLSRDAENPGNNLYVTGLSPRITKRELEKHFSAEGKVIDVHLVVDPWTRESRGFGFVTMETLEEADRCVKYLNRSVLEGRVITVEKLNGVLQVTLLVAPLAILLIEEAIAGLPILQTEVGVVLTLLTIGGGSQTIHITLGE

SEQ ID NO: 156657 - protein, 144 aa, Glycine max
  Coding DNA Sequence Number=SeqID_39879
MIDTGHILALALLIAGHLSASATDHTLLMTHDMTHRMITPTEGTITDLFHEVPRLMIAIIEGTITGLFLEVPHPGQGEGQGGATLGVPLLFQRGATREVCPPGQGRVIQEAPRGVANMRNTTQEARVSRLSFGLDPFKACLKTT

SEQ ID NO: 156658 - protein, 53 aa, Glycine max
  Coding DNA Sequence Number=SeqID_39880
MGLGFSKHEKLACLECTFLGKSQCNACQTVVAGSTQGQAANDRCFPNRIKWVI

SEQ ID NO: 156659 - protein, 240 aa, Glycine max
  Coding DNA Sequence Number=SeqID_39881
  Gene Ontology: Mol. function=metal ion binding; Biological process =metal ion transport
  Homolog annotation: Hit_ID=Q7XZS3; Match level="QueryCoverage=74%, HitCoverage=76%, E-value=3e-30, Identity=42%"; Hit description =Putative chloroplast-targeted copper chaperone
  Pfam annotation: Domain name=HMA; Domain location=157-216; Score =43.7; E_value=6.1e-10; Accession=PF00403.16; Description=Heavy-metal- associated domain
  Subcellular localization annotation: CTP_CleavageSite=23; ConfidenceScore=5.27e-01
MKGIDLFCSSSASTAVNSSMHHRSMVHRSTKSFDHDRRKSQLHVPCSSQLPINPKPYNYFEKHRKSSASADKQNCDVRRKSSADVNDLYTHAGADGSSRRYLLGDAPFIEWVSESNKISAMVPSQHDVKDKLVVMKRNDPPTLRSSSSARSKDKVVVLRVSLHCKACEGKVRKHISKMEGVTSFSIDMESKKVIIIGDVTPLGVLASVSKVKSAQLWPSSTSSSSLLLSSSSRPTSPWST

SEQ ID NO: 156660 - protein, 309 aa, Glycine max
  Coding DNA Sequence Number=SeqID_39882
  Gene Ontology: Mol. function=1-phosphatidylinositol-4-phosphate 5 -kinase activity; Cellular component=proton-transporting two-sector ATPase complex; Biological process=phosphatidylinositol metabolic process
  Homolog annotation: Hit_ID=Q8L796; Match level="QueryCoverage=93%, HitCoverage=38%, E-value=1e-109, Identity=63%"; Hit description =Phosphatidylinositol-4-phosphate 5-kinase 2 (EC 2.7.1.68) (AtPIP5K2) ...
  Homolog annotation: Hit description=(1-phosphatidylinositol-4 -phosphate kinase 2) (PtdIns(4)P-5-kinase 2)
  Pfam annotation: Domain name=MORN; Domain location=120-142; Score =30.2; E_value=7.5e-06; Accession=PF02493.10; Description=MORN repeat
  Pfam annotation: Domain name=MORN; Domain location=143-165; Score =32.8; E_value=1.2e-06; Accession=PF02493.10; Description=MORN repeat
  Pfam annotation: Domain name=MORN; Domain location=166-188; Score =35.0; E_value=2.5e-07; Accession=PF02493.10; Description=MORN repeat
  Pfam annotation: Domain name=MORN; Domain location=189-211; Score =39.3; E_value=1.3e-08; Accession=PF02493.10; Description=MORN repeat
  Pfam annotation: Domain name=MORN; Domain location=51-73; Score=28.1; E_value=3.1e-05; Accession=PF02493.10; Description=MORN repeat
  Pfam annotation: Domain name=MORN; Domain location=74-96; Score=38.0; E_value=3.2e-08; Accession=PF02493.10; Description=MORN repeat
  Pfam annotation: Domain name=MORN; Domain location=97-119; Score =36.1; E_value=1.3e-07; Accession=PF02493.10; Description=MORN repeat
  Pfam module annotation: Pfam domain module=MORN::MORN::MORN::MORN::MOR N::MORN::MORN; Domain location=120-142::143-165::166-188::189-211::51- 73::74-96::97-119
MPQALLLRHHTERDTYKATGWNRSQGGTRRVTPSVEEDSSLERRLPNGDVYMGSFSGNAPSGSGKYLWRDGCVYEGEWKKGKACGKGKFSWPSGATYEGEFKSGRMDGFGTFTGSDGDTYRGSWSSDKKHGYGQKRYANGDLYEGSWKRNVQEGEGRYVWKNGNEYYGEWKSGVICGRGTLIWANGNRYEGQWENGVPRGQGVFTWSDGSCYVGCWNKDLKLHQLNGTFYPGSGDNLTVSMRKRSSVDSARGSGVKSFPRICIWESEGEAGDITCDIIDNVSLLYRDSSGTGSDRGDVNPFRRNPCCFS

SEQ ID NO: 156661 - protein, 100 aa, Glycine max
  Coding DNA Sequence Number=SeqID_39883
MEESSFADVIYNYERTFFHDFLWKKFREMTRKKFTKEGSSIVVRGRRFFRKNIKKYFGNHKKLLGAPSNFQKAKIPPRLQMSWTYPQTVVVGCSSGSSKE

SEQ ID NO: 156662 - protein, 381 aa, Glycine max
  Coding DNA Sequence Number=SeqID_39884
  Gene Ontology: Mol. function=DNA binding; Cellular component =membrane; Biological process=regulation of transcription, DNA -dependent
  Homolog annotation: Hit_ID=Q94CM2; Match level="QueryCoverage=93%, HitCoverage=68%, E-value=1e-113, Identity=59%"; Hit description=CDC6 protein
  Pfam annotation: Domain name=AAA; Domain location=104-313; Score= -15.4; E_value=0.0031; Accession=PF00004.19; Description=ATPase family associated with various cellular activities (AAA)
  Subcellular localization annotation: CTP_CleavageSite=26; ConfidenceScore=5.35e-01
MPVIAAKRTLRSHPSSPPRKSPRRCTAATPNSTPTMNRFGADENRADPEAVKPKWNPKDGEQLKRVKLALHLSTAPSSVVCREEEQNVVLEFCKGCVEHQKAGSLYICGCPGTGKSLSMEKVKDKLLNWAKEAGLPQPDVLSVNCTTFTNTSDIFTKILGLNQTQGKKVSATPLQQLQNMYSQKSSNKNMTLIVADELDYLITKDRGVLHDLFMLTTFPFSRCILIGVANAIDLADRFLPRLTSLNCKPIVVNFRAYSKDQILKILEERLNELPYTVFQQQAMELCARKVAAASGDMRNALCICGRAIEMLEAEIRESACNLNTSLEEISSSRQNLATAPDFMKKREFETVRTDHMARALSKTYRSPVVDTIQSLPHHQQS

SEQ ID NO: 156663 - protein, 379 aa, Glycine max
  Coding DNA Sequence Number=SeqID_39885
  Gene Ontology: Mol. function=phosphatidylinositol phosphate kinase activity; Cellular component=plasma membrane; Biological process =phosphatidylinositol metabolic process
  Homolog annotation: Hit_ID=Q9LLS0; Match level="QueryCoverage=99%, HitCoverage=48%, E-value=1e-180, Identity=81%"; Hit description =Putative phosphatidylinositol 4-phosphate 5-kinase
  Pfam annotation: Domain name=PIP5K; Domain location=69-375; Score =547.9; E_value=1.1e-161; Accession=PF01504.9; Description =Phosphatidylinositol-4-phosphate 5-Kinase
SVGKEASISRELKPSDFDPKEKFWTRFPAEGSKITPPHQSVEFRWKDYCPMVFRQLRKLFQVDPADYMLAICGNDALRELSSPGKSGSFFYLTQDDRFMIKTVKKSEVKVLLRMLRSYYQHVSKYENSLVTKFYGVHCVKPIGGQKTRFIVMGNLFCSEYQIHRRFDLKGSSHGRTTDKTKEIDETTTLKDLDLNFVFRLQNNWFQDFIKQIERDCEFLEAEGIMDYSLLVGLHFRDDNTYEKMGLSPFLLRTGKWDSYQSEKFMRGYRFLEAELQDRDRVKSGRKSLIRLGANMPARAERMARRSDFDQYTPCCSGETYDVVLYCGIIDILQDYDISKKLEHAYKSLQVDPSSISAVDPKLYSKRFRDFVGRIFIEDW

SEQ ID NO: 156664 - protein, 64 aa, Glycine max
  Coding DNA Sequence Number=SeqID_39886
  Gene Ontology: Mol. function=threonine ammonia-lyase activity; Cellular component=chloroplast; Biological process=branched chain family amino acid biosynthetic process
  Homolog annotation: Hit_ID=Q9ZSS6; Match level="QueryCoverage=96%, HitCoverage=10%, E-value=3e-18, Identity=68%"; Hit description =Threonine dehydratase biosynthetic, chloroplast precursor
MNFDKLRVVTKLANIGRKQEVVLTTVMAEELGSFKQFYGLVGQMNVTKFKYRCNSNEKAVVLYK

SEQ ID NO: 156665 - protein, 92 aa, Glycine max
  Coding DNA Sequence Number=SeqID_39887
MVVQKMKTETGLLDEQPPSNTQLEDIGRPYGELSRFFVVRCKDQLEHTWHLLDGNGNMHSVMYNQDLVNPTILSRRQNSDISMGSQKIIKRP

SEQ ID NO: 156666 - protein, 483 aa, Glycine max
  Coding DNA Sequence Number=SeqID_39888
  Gene Ontology: Mol. function=RNA-directed DNA polymerase activity; Cellular component=exocyst; Biological process=exocytosis
  Homolog annotation: Hit_ID=Q1S1D5; Match level="QueryCoverage=99%, HitCoverage=79%, E-value=0.0, Identity=70%"; Hit description=Exo70 exocyst complex subunit
  Pfam annotation: Domain name=Exo70; Domain location=25-483; Score =432.2; E_value=7.3e-127; Accession=PF03081.6; Description=Exo70 exocyst complex subunit
MPRKGMRSIFFTSTPTASLPPPSRQRTFSDSLMDENIETAEKLITKWDDSKVTTTTQLFSGTRQEAKQYLNAVKGLQSAMQYLVAQDSTSSTLVRAQFLMQLAMKTLQKEFYQILSSNREHLDPETVSTRSSVDHRSSVSDYDDEISITEDEFRVSETERVSMLAMEDLKAIAECMISSGYGKECVKVYIVMRKSIVDEALYHLGVEKLNLSQVQKLDWEVLELKIKSWLKAVKVAVGTLFNGERILCDHVFAADSGKRIAESCFAEITKDGAVSLLGFPEMVAKCKKSPEKMFRILDLYEAISDYWPQIEFIFSFESTVNIRTQTVTSMVKLGDAVRTMLTDFETAIQKESSKKPVPGGGVHPLTRYVMNYLTFLADYSGVLVDIIADLPQSPLPESYYRSPMREENPPASELSERIAWIILVVLCKLDGKAELYKDVAHSYLFLANNMQYVVVKVRKSNLGFLLGEEWLAKHELKVREYTS

SEQ ID NO: 156667 - protein, 68 aa, Glycine max
  Coding DNA Sequence Number=SeqID_39889
MELESKERTEGKKQNESDVDRNSNSNGVVITVYTESVRTSSRKKTKQGSNMLALLLNPKTSKPRYLRK

SEQ ID NO: 156668 - protein, 452 aa, Glycine max
  Coding DNA Sequence Number=SeqID_39890
  Homolog annotation: Hit_ID=P42732; Match level="QueryCoverage=32%, HitCoverage=91%, E-value=1e-51, Identity=68%"; Hit description=30S ribosomal protein S13, chloroplast precursor
  Pfam annotation: Domain name=Ribosomal_S13; Domain location=334-438; Score=205.1; E_value=1.6e-58; Accession=PF00416.12; Description =Ribosomal protein S13S18
MANSSKAKEDAILRLTNHQLLLGESMQSLILKFEELLQSIPLVPSASPSLPTPAPALPPTPAFNHIMKLDVPRFDGTNPLGWIFKINQFFEYHGTSEHDRLTIVSFYMECSVLAWFEWMANNGFDKSDYKASSSVPPELLHLWAHPRNSARGPGTAASDSGAGDRPCTPSRRKAPGCAIDSLRAPSTHHSGPSLTFSSIACHASTSATTTTNPSSQATTNTIEAIVVPLRLPLRPPGRDPHGWRQHSQFHPRGVSDQARVLFARDNPIAGYGYDYGYGYGGKFAEIKEQKMAQTLAMPVAPSLAIISNSRLSKTLSVPVLNNPKFQGLSIKCVRVGGVEIPNNKRIEYSLQYIHGVGRTRAKQILCDIQMDNKITKELTEEELITLRDEVSKYMIEGDLRRFNAVNIKRLKDIQCYRGIRHIQGLPCRGQRTKNNCRTLKGKKVAIAGKKKK

SEQ ID NO: 156669 - protein, 367 aa, Glycine max
  Coding DNA Sequence Number=SeqID_39891
  Gene Ontology: Mol. function=nucleic acid binding; Cellular component= intracellular
  Homolog annotation: Hit_ID=Q2Z1Y7; Match level="QueryCoverage=61%, HitCoverage=63%, E-value=7e-73, Identity=59%"; Hit description=Pm27 protein
  Pfam annotation: Domain name=DUF1644; Domain location=46-210; Score =362.0; E_value=9.6e-106; Accession=PF07800.3; Description=Protein of unknown function (DUF1644)
MAKVGKLRSKAQGQRATPHLLSCARKNLKDVNVRNNSSKASEKKDWEDATCSVCMEVPHNAILLLCSSYYKGCRPYMCATSHRYSNCFEQYKKAYTKATSVQSLQPEANNSNIDLSTGESKDNTEIPELLCPLCRRQVKGWTVVEAARKSLNAKKRSCMQDDCSFVGNYKELRKHVRSKHPFARPREVDPIKEEKWKRFECERERSDVISTILSSTPGAMVLGDYVLEPNDHAFYSDEYDSDSEYLEDDFFSVRSIGLGRTGHFLPNIRYNQDRAADNFDVDHFGLQSVASTGSAAVSGRGLHRILLGRSRRRRRHRIANARSVRNTECPVFCMPLDPLLLFDFPAGPRAPWLHACGTVYDAACQTL

SEQ ID NO: 156670 - protein, 98 aa, Glycine max
  Coding DNA Sequence Number=SeqID_39892
MDHVICIPKYLFGNIKIILWNRYSRSGYLSTPKGISLFVFPKPHANTHSFTHLKMEKKQRLFFGLKDKVVHGLLSQEAPCEIGKPQARKGTPVARGRI

SEQ ID NO: 156671 - protein, 147 aa, Glycine max
  Coding DNA Sequence Number=SeqID_39893
  Gene Ontology: Mol. function=protein serine/threonine kinase activity; Cellular component=spindle pole body; Biological process =protein amino acid phosphorylation
  Homolog annotation: Hit_ID=Q7XTK4; Match level="QueryCoverage=71%, HitCoverage=17%, E-value=4e-39, Identity=71%"; Hit description =Putative mitogen-activated protein kinase 1
MQVVKGKNKGYGLPADIWSLGCTVLEMLTGQLPYCDLESMQALYRIGKGERPRIPDSLSRDAQDFILQCLQVSPNDRATAAQLLNHSFVQRPLSQSSGSSFPHIHGRKAKVKYQRPAEKVNPAFFPSNQVTGEKPIGFNSGSNSSKN

SEQ ID NO: 156672 - protein, 748 aa, Glycine max
  Coding DNA Sequence Number=SeqID_39894
MMFAYLLFGFLHGNLRFVMGCWVQLMKREDVKELSLWRWKKEYVVAIGIISGNGGVKEDDGDGGVDKVFPRGIVLCFKSRGSRDVQLIIVGEVAGWSYSLSRVEKGPKRLRAVASVEITCYYLASGRKPAAVQPYCFRGRAGEEEWLRSAGSVAGGGSSAHHFAAQSNHTDSSNVAHHTRNRSSKSTNDFDSPRSVFLERTFSSNSRRSINGSAKHAYSSFNRSHRDKDRDREKDRSNFVDNWDRDCSEPFSDIFPGRIERDTLRCSHSMVSRKQNEILTHRVAVDTKSGGNSYQKSGNDLLSGSSIGSSVQKAVFNKDFPSLGVEERQGITEIGRVSSPGLGAAASQTLPVGSSALIGGEGWTSALAEVPTIIGSSSTGSLTLQQTVSPTSGSVLTSTSSGLNMAEALAQTPSRARSAPQVSVKTQRLEELAIKQSRQLIPVTPSMPKALVNNSEKSKPKTAVRNAEMNMSVKSMPQQPSALHIVNHSVRSGNAKVDAPKTSGKFTDLKSVVWENGVSPTTPKDPSSQTNHSNIRTGNNLAVASAAASTPLKKTNNIKSPTERKPISLDQKLGSTMDKKNSISQVQSRNDFFNLIKKKTLMNSSVLPDSSPVVSSPPMDKSGEVNTEAVGSPARPQDLRNGAEVTSNGNAHVELNKPDYDQKDTILDEEEAAFLRSLGWVEDSGEDEEGLTEEEINAFYQECMKLGTTTLKLCQGMQPKLSKFFEPYATTNLHGASAELSSDSRSEA

SEQ ID NO: 156673 - protein, 340 aa, Glycine max
  Coding DNA Sequence Number=SeqID_39895
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9CA16; Match level="QueryCoverage=97%, HitCoverage=91%, E-value=4e-83, Identity=47%"; Hit description =Putative endo-1,3-beta-glucanase; 56885-55794
  Pfam annotation: Domain name=Glyco_hydro_17; Domain location=29-340; Score=427.6; E_value=1.7e-125; Accession=PF00332.9; Description =Glycosyl hydrolases family 17
MDSNVGLALFVMTTILLIQQFPLTSAQSIGVNLGLTGDNLPSPKEIVELYEKYHIKFIRIFEPRHDILEALRGKPLVLVIGTKDEDVQTIAQDQNAANTWVQTNVIPYIKDVNFRYIIIGNEVTPGPIAAYVAKGIQNMINALTNAGIHKDIKVSAVLKGTVLASSYPPSAGTFTNETTNIIKQIATILLQHGSPMMINSYPYLAYSSDPQHVSLDYALFKSTSPVVTDGSYKYYNLFDAMLDAYHAAFEKIGVSNLTLVVSETGWPSAGYEPYTSKLNSQAYNKNLVQHVRGGKGTPRRPDQSLNVFIFEMFNEDLKQAGIEHNFGVFYPNKKPVYPLF

SEQ ID NO: 156674 - protein, 618 aa, Glycine max
  Coding DNA Sequence Number=SeqID_39896
  Homolog annotation: Hit_ID=Q7XTK4; Match level="QueryCoverage=49%, HitCoverage=55%, E-value=2e-50, Identity=40%"; Hit description =Putative mitogen-activated protein kinase 1
MRLRSLPHLQCLMLLRLWCLALLPCGQGGHGNNERKCGPCAAAAEAGGFFGQLLHRDVLLQSPSPLSNPMLLPLDSGSRSSLNEVASNGPNQEGEEEGAAPSASFSSAENVKLEHSGVSVGGDAWEEYVMFCLGDSLLFMARILNGAFFDNLQSSVHDVSRAVSISDMQKDWCDLFAQGLAAPNNLAVVASVSVINAPNAPATTPIPEPLAFNNLVDAASAPAAIKPHPPFRCKVYGARGAAQEEERVTSCRSDLRGLPLWCGKLKRRAAAPIGGEASAEAGTATTGRGCQVPVVEASLVAVFLVCAAEERRKQTYTMDRKNPRRKPKLERRNALKYSSSEYDAGSSPSDDTLYTRSMEFYDRTSFRIEGVEGEFDRICRSLGLSGPEDFAIPAAAWEAIKFRYSSDILPRLKLDNLDIPEEEEGEEELKVNEDIIVNSVEEGKLSEKHGDSSSVRVRVRVRVREIDESSTGIKGTRPPMLKPPPGARVQVVDDSTCSTWDLLRDLAPQGEEGLPLNRSENESEVAREVERGAVEKEEGEVGTRESPKREEEENVAGLSESCSFSTSNEDDSSSSTTDPTSNNISPQGRIKRIITAESWQKGEFLGGGSFGSVYEGIS

SEQ ID NO: 156675 - protein, 115 aa, Glycine max
  Coding DNA Sequence Number=SeqID_39897
MAAGAEAASTRLLNASGSGIGVVAGAFGAFMTETEATTARLLGAARPCANRSETDQVKFSLVNLGSGKEQYSTMLVENYLTKEVTSWIVFFFIPNSNEGSESLMFPFLTLYTFDV

SEQ ID NO: 156676 - protein, 71 aa, Glycine max
  Coding DNA Sequence Number=SeqID_39898
MVVQQVRTTEQNSTTEGCRLEKESVSHANPKANLVANGNVSHNRMNLNLLGDSEPPDPMVEVEVETSNTPF

SEQ ID NO: 156677 - protein, 125 aa, Glycine max
  Coding DNA Sequence Number=SeqID_39899
MGWIFKISQLFDYHHTTDEEHINVASFYMDGPTLSWYQWMFRNSFITLWTSLLQALETCFTPMFYDYPKGALFKLTQTGSVNEYLHEFERLLLHLRPGAEIAPCGSGITTHFTASGYLPRQVAEG

SEQ ID NO: 156678 - protein, 122 aa, Glycine max
  Coding DNA Sequence Number=SeqID_39900
MKPKRQSASGWKCLRSALKLIWARVGSGGVGWEIMGVGGGEVVSGSGSSSSTMSKKKRALHLWHRPCSCSRAISSGVRRRIWEQLVVGGLGKGEGKGDGEGEGEGEGSRGGGGVGTAGEGGF

SEQ ID NO: 156679 - protein, 228 aa, Glycine max
  Coding DNA Sequence Number=SeqID_39901
  Gene Ontology: Mol. function=nucleoside-triphosphatase activity; Cellular component=integral to membrane; Biological process=transport
  Homolog annotation: Hit_ID=Q8RWI9; Match level="QueryCoverage=95%, HitCoverage=37%, E-value=1e-61, Identity=46%"; Hit description=White- brown complex homolog protein 15
  Pfam annotation: Domain name=ABC_tran; Domain location=1-117; Score= -24.0; E_value=2.3e-05; Accession=PF00005.17; Description=ABC transporter
MRLPSKMTKEEIDKVVEETIVEMGLEDCADTRIGNWHCRGISNGEKKRLSIGLEILTQPYVLLLDEPTTGLDSASAFYVIQSLCHNAHNGKIVICSIHQPSSETFNIFDDLLLLSSGETVYFGEANMALKLSSSNSALGAKKAEIRETLIRSYEGSRLMINARRRIQQLKANEEQEIKAKIGSSATWWKQMCTLTKRSFLNMTRDIGYYWLRIVFYILVEDYHFSLKN

SEQ ID NO: 156680 - protein, 99 aa, Glycine max
  Coding DNA Sequence Number=SeqID_39902
MTHTPHGAQRGCDSEVVEVKVLWDLPWEFSKLLRISLTRNLSVHFLLITQIPMPTIRKRCFQKNIVENVTYLQNCHCPPTTTVILSPTSKVHRRIAFLQ

SEQ ID NO: 156681 - protein, 72 aa, Glycine max
  Coding DNA Sequence Number=SeqID_39903
MVTTMFFETIVATLDGSAPLDSLIPPACGMPHAPVVMELPWGMACQAWCMVEREVWEEGRGGNINKGGGDYS

SEQ ID NO: 156682 - protein, 639 aa, Glycine max
  Coding DNA Sequence Number=SeqID_39904
  Gene Ontology: Mol. function=RNA-directed DNA polymerase activity; Cellular component=chromatin; Biological process=chromatin assembly or disassembly
  Pfam annotation: Domain name=Chromo; Domain location=534-591; Score =27.2; E_value=5.8e-05; Accession=PF00385.14; Description='chromo' (CHRromatin Organisation MOdifier
  Pfam annotation: Domain name=rve; Domain location=398-541; Score= -5.3; E_value=0.017; Accession=PF00665.16; Description=Integrase core domain
  Pfam annotation: Domain name=zf-H2C2; Domain location=339-380; Score =13.8; E_value=0.0053; Accession=PF09337.1; Description=His(2)-Cys(2) zinc finger
  Pfam module annotation: Pfam domain module=Chromo::rve::zf-H2C2; Domain location=534-591::398-541::339-380
MDYRALNSITIKDRFPIPTIDELLDEHGGARWFSKLDLLKGYHQILMASADVSKTALRTHHGHYEFLVMPFGLCNTPSSFQATMNTTFVPYLRGSCPSMADTTVSQSLTWVFRPFVLLPPLHPRLCHPGLCKALVLRLSNFSLPFVVGTDASGIGMGAILSQQHHPIAYFSKPFCPKLLHASTYVRELATIMAAIKKWRQYLLGHQFTILTDHKSLKELMAQAIQTPEQQTYLARLMGYDYTIQYCASKTNLVADAFSRRPEITSGSFLILTIPNCMFLQNLKAELSTNLVFRRYHQKIFDEPYNHSNCLFWQDLILQKGHIWLLQGAPSISTILVEFHSTPTAGHMGVMKTLTRVRENFTWANMKNGVRQYVANCISCQQSKYDHRHSPGLLCPLPIPTRPWEDLSLDFIVGLPNFQGHSTILVVVDHFSKGVHLGMLPTQYSASGVARMFMDIVGKIHSMPRSLVLDRDPPLCESFLVQAKRHEAPHGLSIPPSDRRTDRGHEPCHRAVPQSLCPLETIHMGAILDMGGVDNQPLTILDTKWEQTASGRQLLVLVQWTGLLPEDTSWEKWENLKKDYNLEDKVVLEARRDVMNEDTEQDATTEHEAEAREEGQKGKLVSPSTLRIMQQNEAKLAMIF

SEQ ID NO: 156683 - protein, 505 aa, Glycine max
  Coding DNA Sequence Number=SeqID_39905
  Gene Ontology: Mol. function=nucleoside-triphosphatase activity; Cellular component=integral to membrane; Biological process=lipid transport
  Homolog annotation: Hit_ID=Q9C8K2; Match level="QueryCoverage=99%, HitCoverage=80%, E-value=1e-133, Identity=45%"; Hit description =White-brown complex homolog protein 12
  Pfam annotation: Domain name=ABC2_membrane; Domain location=182-394; Score=105.1; E_value=2.1e-28; Accession=PF01061.14; Description=ABC -2 type transporter
  Pfam annotation: Domain name=ABC_tran; Domain location=1-111; Score= -32.6; E_value=0.00013; Accession=PF00005.17; Description=ABC transporter
  Pfam module annotation: Pfam domain module=ABC2_membrane::ABC_tran; Domain location=182-394::1-111
MTKEEINKVVENTIMEMGLEDCADTRIGNWHCRGISNGEKKRLSIGLEILTQPYVLLLDEPTTGLDSASAFYVVQSLCHIAHSGKIVICSIHQPSSEIFSLFDDLLLLSSGETVYFGEAKMALKIPTNSTIGMRTSEIRRILIQSYKSSKLMIDARKRIEQLKPNEEQEIKPYIGSSTTWRKQLYTLTERSFLNMTRDIGYYWLRIVFYILVGITIGTLFFHIGTGNNSILARGKCVSFIYGFMICLSCGGLPFFIEELKVFYGERSKGHYGEAAFVVSNIISSFPFLVLTSLSSGIIIYFMVQFHPGLSNCAFFCINLFCCLSVVECCIMIVASVVPNVLMGIGTGTGVIVFMMMPSQIFRSLPDIPKFFWRYPMSYLSFAAWAVQGQYKNDMLGVEFDPLLPGDVKVSGEQVLSLVFGVPLDHNKWWDLTALATLLLVHRLVLYLVLRFVKRAQSPKLWFYAKKSLHFAGRCFFSKKPSISSRKQAQHPLSSQEGLMSPNLAI

SEQ ID NO: 156684 - protein, 58 aa, Glycine max
  Coding DNA Sequence Number=SeqID_39906
  Homolog annotation: Hit_ID=Q9C8J8; Match level="QueryCoverage=96%, HitCoverage=7%, E-value=8e-08, Identity=53%"; Hit description=White -brown complex homolog protein 13
MVMIWEDVTVERPESFGEHNNNKKLMLNGITGFAEPARIMAVMGPSGCGKTTFLDSFT

SEQ ID NO: 156685 - protein, 298 aa, Glycine max
  Coding DNA Sequence Number=SeqID_39907
  Gene Ontology: Mol. function=transporter activity; Cellular component= membrane; Biological process=transport
  Homolog annotation: Hit_ID=Q9FM07; Match level="QueryCoverage=96%, HitCoverage=54%, E-value=1e-115, Identity=69%"; Hit description =Permease 1
  Pfam annotation: Domain name=Xan_ur_permease; Domain location=36-298; Score=-141.0; E_value=0.0073; Accession=PF00860.11; Description =Permease family
MAAAAPPPKPEELQPHPVKDQLPNVSYCITSPPPWPEAILLGFQHYLVMLGTTVLIPTTLVTQMGGGNEEKAKMVQTLLFVAGINTFFQTLFGTRLPAVIGGSCTFVPTTISIIFAGRYSDIVNPQERFERIMRGTQGALIVASTLQIVVGFSGLWRNVVRFLSPLSAVPLVALSGFGLYELGFPVVLISATRTSPYFFPTSCKMCGDWAAGNRILTSIFTVIFSVTIVWIYAHLLTVGGAYKNVPQTTQETCRTDRAGIISGAPWIRIPYPFQWGAPTFDAGEAFATMAASFVALVE

SEQ ID NO: 156686 - protein, 43 aa, Glycine max
  Coding DNA Sequence Number=SeqID_39908
  Homolog annotation: Hit_ID=Q9M4N3; Match level="QueryCoverage=90%, HitCoverage=4%, E-value=3e-10, Identity=72%"; Hit description=H+ -ATPase
KIKVLKFLGFMWNPLSWVMEAATIMAIALANGGSIISGSSRQN

SEQ ID NO: 156687 - protein, 100 aa, Glycine max
  Coding DNA Sequence Number=SeqID_39909
MGGGAAASEKETPPFFKKLHVLGRVSEWVTVFAVSVVHGGGGWRFFVGLADGGGSRRRKGAEWWLVVALGCSGALTVCIPLFLSLSLTCTVINAAFKGPN

SEQ ID NO: 156688 - protein, 221 aa, Glycine max
  Coding DNA Sequence Number=SeqID_39910
  Gene Ontology: Mol. function=transporter activity; Cellular component= membrane; Biological process=transport
  Homolog annotation: Hit_ID=Q1T039; Match level="QueryCoverage=99%, HitCoverage=42%, E-value=1e-113, Identity=89%"; Hit description =Xanthine/uracil/vitamin C permease; Thioredoxin-related
  Subcellular localization annotation: CTP_CleavageSite=80; ConfidenceScore=5.27e-01
YASATPMPPSVLSRGIGWQGVGILLSGIFGTGNGSSVSVENAGLLALTQVGSRRVVQISAGFMIFFSILGKFGAVFASIPAPIVAALYCLFFAYVGSAGLGFLQFCNLNSFRTKLILGFSIFMGFSIPQYFNEYTAFKNYGPVHTHARWFNDMINVPFSSKAFVAGSLALFLDTTLHNKDSQTRKDRGMHWWDRFSSFKTDTRSEEFYSLPFNLNKFFPSV

SEQ ID NO: 156689 - protein, 270 aa, Glycine max
  Coding DNA Sequence Number=SeqID_39911
  Gene Ontology: Mol. function=GTP binding; Cellular component =intracellular; Biological process=small GTPase mediated signal transduction
  Homolog annotation: Hit_ID=Q53KJ1; Match level="QueryCoverage=93%, HitCoverage=96%, E-value=6e-69, Identity=69%"; Hit description=Short integuments 2
  Pfam annotation: Domain name=MMR_HSR1; Domain location=137-238; Score= 8.7; E_value=0.00016; Accession=PF01926.13; Description=GTPase of unknown function
MSGLKELLKKGLGLGDMAFNAGGGAITWFPGHMAAATRAIRHRLKLADLVIEVRDARIPLSSANADLQPHLSAKRRVVALNKKDLANPNIMHKWTHYFETCNQNCVAINAHSKSSVKKLLEVVEFKLKEVICKEPTLLVMVVGVPNVGKSALINSIHQIAKSRFPVQEKMKRAAVGPLPGVTQDIAGFKDLVMQVQRALYSSLSEFNGNVEDESDLESLIDLQFSALQKALKIPHKASEARLMVSKKFLTLFRTGKLGPFILDDVPDVKP

SEQ ID NO: 156690 - protein, 350 aa, Glycine max
  Coding DNA Sequence Number=SeqID_39912
  Gene Ontology: Mol. function=microtubule motor activity; Cellular component=microtubule associated complex; Biological process =microtubule-based movement
  Homolog annotation: Hit_ID=Q9SS42; Match level="QueryCoverage=66%, HitCoverage=23%, E-value=9e-48, Identity=46%"; Hit description =Kinesin-like protein
  Pfam annotation: Domain name=CH; Domain location=23-148; Score=39.9; E_value=8.6e-09; Accession=PF00307.21; Description=Calponin homology (CH) domain
MEDGSRNRTHFNMASRKAEESAWRRYEATQWLESQVGPLGIPNQPTETELISCLRNGLILCNAINKIHPGAVPKVVVVDNQVPSQSLAWDSQPLPAYQYFENVRNFLFVMEELKLPAFEVSDLERDNLEMGSAAKLVDCILALKSFQELKQMNKQNGYNKHIKSPLPMRMHSRAAAFSFDASRHLDLSATLTLINCPCILMCTCIIAFFLLLPLLDPAEIVELLAKQLVDLMFDAKENIDGNIIASLHKEHLVADPIKVFNQIMACCNGEQPPTNFNELPLLLKDSVKEKGNLPPHSISTPTQSDALSAPDSSKHGEACLRKCKCNQVHLLDMQEKELLVGIFSSCLHLI

SEQ ID NO: 156691 - protein, 468 aa, Glycine max
  Coding DNA Sequence Number=SeqID_39913
  Gene Ontology: Mol. function=microtubule motor activity; Cellular component=microtubule associated complex; Biological process =microtubule-based movement
  Homolog annotation: Hit_ID=Q9SS42; Match level="QueryCoverage=95%, HitCoverage=44%, E-value=1e-115, Identity=54%"; Hit description =Kinesin-like protein
  Pfam annotation: Domain name=Kinesin; Domain location=1-146; Score =69.3; E_value=2.1e-18; Accession=PF00225.13; Description=Kinesin motor domain
  Subcellular localization annotation: CTP_CleavageSite=13; ConfidenceScore=5.13e-01
MTLIKLGEVNRAVSSTAMNNRSSRSHSVLTVHVNGKDTSGSSIRSCLHLVDLAGSERVDKSEVTGERLKEAQFINKSLSCLGDVITALAQKNSHIPYRNSKLTLLLQDSLGGHAKTLMFAHVSPESDSFGETMSTLKFAQRVSTVELGAARMNKESSEVMHLKEQVENLKIALAAKEAQRVTFQRIKEPHTPSEKSTLVSEKTPLRPRRLSIENCSAVKTDKPVNREDRGGVKSPLLLPRLRRLSLEGSKTIKRDSLLPKVSDNAVSKALQYERVSQQKYHPMQDPESVSKLNGHFSSGNSRSELHARTPQSPTSISYQTRLIKVNGGMQVHPLKLPKTPEPPVVDGGDAHGTKVMGSTNGKGSQIRRSLRTIGKLINGPDKRSQQNMVEVKSPVKGTGYTNHLVKSPISAVEKTKRRQSLTGIQPPLPNNSRRTSLGGKPVVAYDKDRNARTPPPSQSDSKTAKRWL

SEQ ID NO: 156692 - protein, 88 aa, Glycine max
  Coding DNA Sequence Number=SeqID_39914
MKTKTEPVSRAEALIPDDVILTRSGSLNTGYGDLDDSTSSEGRQVRVDAPRITLISLRLVQQGTQREALTKFYENAKSSFIGNKNQYL

SEQ ID NO: 156693 - protein, 60 aa, Glycine max
  Coding DNA Sequence Number=SeqID_39915
PFAKREPRAKRIFGHALSRESQALSAQPLLLRLICSAKLAKDELSQLQFNLNSAKLQLDR

SEQ ID NO: 156694 - protein, 75 aa, Glycine max
  Coding DNA Sequence Number=SeqID_39916
MGLVQLNVSYDQEAFYYREAFRGSISKGGETSNVLVKLISMKYKGKENIKEYIMEMSNLASKLKSLKLELGEDML

SEQ ID NO: 156695 - protein, 97 aa, Glycine max
  Coding DNA Sequence Number=SeqID_39917
  Gene Ontology: Mol. function=nucleic acid binding; Biological process= DNA integration
  Pfam annotation: Domain name=zf-CCHC; Domain location=60-77; Score =16.3; E_value=0.002; Accession=PF00098.13; Description=Zinc knuckle
MVWSLNKLISHYVQEEERLQRDRTKSAYLTLTYQNKKRKKIKDVVEGSSQQRKQKRVGEFTCYFCKKSKHMKKGCPDIWWMDSGATTHISMSLQGCL

SEQ ID NO: 156696 - protein, 38 aa, Glycine max
  Coding DNA Sequence Number=SeqID_39918
MFASAPGLWNKGVSRTYTEVLTAILKYRRTEQNGITMR

SEQ ID NO: 156697 - protein, 52 aa, Glycine max
  Coding DNA Sequence Number=SeqID_39919
MGTTKVEDRRMTKNERKMAENLHGITHGNVSDALRKCLALDFLHGNDFFTNF

SEQ ID NO: 156698 - protein, 127 aa, Glycine max
  Coding DNA Sequence Number=SeqID_39920
  Subcellular localization annotation: CTP_CleavageSite=74; ConfidenceScore=5.10e-01
MSLRTYNIGFKITDVKIRTKFSFNIGYLKTDVKPSAPTSAPFAHGVFSKKLERTSKVASVCKCLVLRTLMTKSRSVMKVGNKVVFNLLLATVFLPARLHDSTQGGLSMGPTIRGGECNKCETRGRRV

SEQ ID NO: 156699 - protein, 321 aa, Glycine max
  Coding DNA Sequence Number=SeqID_39921
  Gene Ontology: Mol. function=metallocarboxypeptidase activity; Cellular component=membrane; Biological process=proteolysis
  Homolog annotation: Hit_ID=UPI00005F76AD; Match level="QueryCoverage =98%, HitCoverage=63%, E-value=1e-137, Identity=76%"; Hit description= COG2317: Zn-dependent carboxypeptidase
  Pfam annotation: Domain name=Peptidase_M32; Domain location=5-321; Score=-17.2; E_value=6.5e-16; Accession=PF02074.6; Description =Carboxypeptidase Taq (M32) metallopeptidase
MTSAHSNTSAYDHLRALFSRLSRFGHLSAIAGWDMQTMMPPGGSKARSEALAELSVLQHQILTAQSTSALLDRAQQETLDEIDRANLREMRRQYEDAVLLPAALVEAKSLAGARCEHAWRAQRPANDWDGFADNLREVVKLSREEAQIRAQAAGTSRYDALLNLYEPGMRSSDLDRIFGDLKTWLPDLLQRVVAKQANEPCQAPQGPFNVDTQRQLSLSVMKLLGFNFDNGRVDASAHPFCGGVPEDVRITTRYNEKEFLTALLGIVHETGHARYEQNLPRDLLGQPVALARSTAIHESQSLLFEMQLARGNEFLKILRPL

SEQ ID NO: 156700 - protein, 144 aa, Glycine max
  Coding DNA Sequence Number=SeqID_39922
MAPRKFPTKRSRKDKAAEGTTAATEYDSHHFRSAEHQQRFEAIKGCQFLGYSLVLEECMECEYGQRRNRADGFDEEAIAQLLCIPGQDFARTAAGRRVRIMRTNMTTLTQTWMTLLLSNILPSDHNSDLPLPKCQLVCHLPGTL

SEQ ID NO: 156701 - protein, 147 aa, Glycine max
  Coding DNA Sequence Number=SeqID_39923
  Gene Ontology: Mol. function=protein serine/threonine kinase activity; Cellular component=cytoplasm; Biological process=protein amino acid phosphorylation
  Homolog annotation: Hit_ID=Q75PK5; Match level="QueryCoverage=89%, HitCoverage=22%, E-value=7e-37, Identity=64%"; Hit description =Mitogen-activated kinase kinase kinase alpha
MAIVFLLIYGVWDAQFLKWQHQSLLGISMKGRDMPEIPDHLLSEAKNFIQLCLQRDPSARPTAQKLIEHPFIRDQSARKATNVRITRDAFPYMFDGSRTPPRVPNDFANAGKSGIWMDWIRRLKVALGAARGLAYFHELADPPIITY

SEQ ID NO: 156702 - protein, 141 aa, Glycine max
  Coding DNA Sequence Number=SeqID_39924
MSVEQFIEKVAWPGARPSFVGDTESFTTKAPQQRLETRYNEAAHPRPVPASADAPFPGVDPSSPQYAADSSTPVLEIHEGQTILVLPLDTFPPATPRESDEKRKIDLIIVGDNFVEDEGDGSATDKGKEIPIEVRRYSGRR

SEQ ID NO: 156703 - protein, 146 aa, Glycine max
  Coding DNA Sequence Number=SeqID_39925
MNGGNGTTPTMVSPPSPHSSCRSTEPNQEDNNNNNNDDDNNNNNNGDNDNNHNNNDDDNNNIIILNNNNNHNNNNNNNNNNNGDNNNNTNNNNNNNNNGDNNNNHHHPEAPSLVLVGCPQCLMYLMISEDNLKCPKCKSINLIHFT

SEQ ID NO: 156704 - protein, 147 aa, Glycine max
  Coding DNA Sequence Number=SeqID_39926
MDPSTYIFPSSTKEPKKKDKNKHNDHKLKDFEPSGHASLKKMKQQMLYFSTAYRLANILAMTNGGSFTNEFVLSHLIDLKLISDHGRCVLNKSDDNANWVTFWAFQAQAPTIAQHLKGSSMVNKLKVDLNDDEDDEVHGADRCDEDH

SEQ ID NO: 156705 - protein, 174 aa, Glycine max
  Coding DNA Sequence Number=SeqID_39927
MSRNFAYCATKGAKYLEAVKQRGLKSARKRAVFSAFSRKRDELTKRACCAKQVHQYSFYMASKKHKSSDSRPQDQNDNRRFQSEEAWNRYIDNILDRRILSKMNNWRRNLHKRLTKLHEGSIDVAVVKEFYANFYSPADQAPKCARIRGHLIKIDADSLNEFLQTSVLLEEGES

SEQ ID NO: 156706 - protein, 162 aa, Glycine max
  Coding DNA Sequence Number=SeqID_39928
MGSSEGCSRESEESGFSVRDPTKEVFEVSSDSDSLGSYSTNFSTFLDSLSEQVVDNITHIVDSVFGNTTTIVDVAFGSSRNMKRIPQEKRRVETDQRAFAEKEYPPITLPRFAWVDGEVGTFFSRYNDNSAIENLLSWLTIFSIKKELCLITLRTRWIDVDA

SEQ ID NO: 156707 - protein, 157 aa, Glycine max
  Coding DNA Sequence Number=SeqID_39929
  Gene Ontology: Biological process=steroid metabolic process
  Homolog annotation: Hit_ID=O80866; Match level="QueryCoverage=63%, HitCoverage=13%, E-value=6e-38, Identity=72%"; Hit description =Putative oxysterol-binding protein
MKRGIDLEMDFADGLAAMVDVSGIAVARNHARGFVADHFRSLLGFGVDDDLVGTVNLVVGENAVLEHEPARPPSLPVVHPLVQNPRDSVPDEVVDSDIHRRRRSEARAAALAAVGEAEVELGGTGGGVRSRGGGGGERGHGGGGIVGDGGDAAEGMH

SEQ ID NO: 156708 - protein, 164 aa, Glycine max
  Coding DNA Sequence Number=SeqID_39930
  Gene Ontology: Biological process=steroid metabolic process
  Homolog annotation: Hit_ID=O80866; Match level="QueryCoverage=72%, HitCoverage=15%, E-value=1e-39, Identity=73%"; Hit description =Putative oxysterol-binding protein
MVLLGSSRIASCLGYVSTIRESRSDDKRFSIFTGTKRLHLRADTREDRVAWMEALQAVKDMFPRISNSELMAPVDNVAISTEKLRHRLVEEGVSEAAIQDSEQIMRNEYAALQNQLLLLKQKQVTLIDTLRQLEVHLMKSRKLHANQTGYSWWISTIAQKAGNS

SEQ ID NO: 156709 - protein, 523 aa, Glycine max
  Coding DNA Sequence Number=SeqID_39931
  Gene Ontology: Mol. function=protein binding; Cellular component =cytoplasm; Biological process=steroid metabolic process
  Homolog annotation: Hit_ID=Q8LN57; Match level="QueryCoverage=95%, HitCoverage=64%, E-value=0.0, Identity=65%"; Hit description =Putative oxysterol binding protein
  Pfam annotation: Domain name=Oxysterol_BP; Domain location=129-500; Score=198.7; E_value=1.4e-56; Accession=PF01237.9; Description =Oxysterol-binding protein
MYRLKGDTSEIIFLGCIYLSVLLQKFSTSLKAKRAKTEKVDLENTVVDESQRQLNDQEASSRLRQEKSSEASASESEDDNERNDAVEEETDEDDTAFFDTRDFLSSSNSFKSNGSDIRVSSFSSDDDGLYTVESEEDVDPSIRSVVTNYPYVKRRRKLPNPVEKEKGVSLWSMIKDNIGKDLTKVCLPVYFNEPLSSLQKCCEEMEYSYLLDRAYEWGRRGNSLMRILNVAAFAISAYASTEGRICKPFNPLLGETYEADFPDKGFRFLSEKVSHHPMIVACHCEGTGWKFWGDSNLKSKFWGRSIQLDPVGILTLEFDDGEVCQWSKGNQDYSCKLKFKEQSIIDRNPHQVHGIVQDRNGKILSTLLGKWDDSMYYINGDYSGKGKGYESMSDAHLLWKRSKPPKFPTRYNFTRFAITLNELTPGLKEKLPPTDSRLRPDQRHLENGEYDMANSEKLRLEQRQRQARKMQESGWEPRWFGRDKSGTYRYLGGYWEARKQGNWNSCPDIFGHIHSDHISDEGQ

SEQ ID NO: 156710 - protein, 74 aa, Glycine max
  Coding DNA Sequence Number=SeqID_39932
  Homolog annotation: Hit_ID=Q1SL48; Match level="QueryCoverage=72%, HitCoverage=43%, E-value=1e-07, Identity=48%"; Hit description=Zinc finger, GRF-type
  Pfam annotation: Domain name=zf-GRF; Domain location=24-66; Score =4.0; E_value=0.01; Accession=PF06839.3; Description=GRF zinc finger
MSILIERSGASSNIPSSGLQRFGVLCHCNLDAPLMTLWIEDNPSRRFFDCGLYKVSRRKRCDFFNGSILRLMIM

SEQ ID NO: 156711 - protein, 149 aa, Glycine max
  Coding DNA Sequence Number=SeqID_39933
  Subcellular localization annotation: CTP_CleavageSite=64; ConfidenceScore=5.13e-01
MGAKARDPLTPFLFIIVTKALKGLINKVVELGRFKARASAFLNCFVASLPFKFLGILVGRSPTRVYKFGVYKEVWNRHNTLFWSDRWLGGGRLMEEFPQSYQILMWNRVFGWLGVSIVQHNEVQSHYMQHDLIFKGAPCQDVYLMQTSA

SEQ ID NO: 156712 - protein, 81 aa, Glycine max
  Coding DNA Sequence Number=SeqID_39934
  Subcellular localization annotation: CTP_CleavageSite=67; ConfidenceScore=5.44e-01
MAGGVFSHKRKSRAANIGRKMDEPFYCLRPSGTSVASAPFTPIAESSVNVPTPTVESRARIQSRTTRSSAHVGTTSSTTHS

SEQ ID NO: 156713 - protein, 61 aa, Glycine max
  Coding DNA Sequence Number=SeqID_39935
MKVFTSTPATLAQPEGEDGALSELAFAQRLYTAHPSSRIVHALSHQMGRLADDAFSQMMSG

SEQ ID NO: 156714 - protein, 101 aa, Glycine max
  Coding DNA Sequence Number=SeqID_39936
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=54%, HitCoverage=29%, E-value=1e-19, Identity=83%"; Hit description =Anaphase-promoting complex subunit 10
  Pfam annotation: Domain name=APC10; Domain location=11-101; Score= -68.8; E_value=0.0023; Accession=PF03256.7; Description=Anaphase -promoting complex, subunit 10 (APC10)
MNLTASWARRTSDNKLVMEKACDNELMTGPPRCRGCSKLSTLPVNKLIVLYVVFKLDESYTSSKVSIRAGDGFHNLKEIKTVELVKPTRWVYLSLSGVDPR

SEQ ID NO: 156715 - protein, 157 aa, Glycine max
  Coding DNA Sequence Number=SeqID_39937
MQSPCIGDLHLQGSSPIISPTPYAPYLLLTYSLAISRIVAPPSPHHNHITIITTYHFHTALPPYPISSMSCITANPCRSKLHDESRLIQRSFDDNKGDDKKLKESKNKFKMLKIESRTLQGSRGNLISRIKNQDSRFKLPRIKIKIQDSRFKHQEKN

SEQ ID NO: 156716 - protein, 150 aa, Glycine max
  Coding DNA Sequence Number=SeqID_39938
  Gene Ontology: Mol. function=monooxygenase activity; Cellular component=integral to membrane; Biological process=electron transport
  Homolog annotation: Hit_ID=O81973; Match level="QueryCoverage=49%, HitCoverage=13%, E-value=7e-17, Identity=58%"; Hit description =Cytochrome P450 93A3
MDQEAEIPIKALVGLKEFDGHEELHSEFSGDDVCLDIPLTAYGNFVLDLQQNIHEDDPLEFRPERFLSNDHESGKMGQVGVRGQHYQLFPFGSGIRGCPGASLALKVAHTTLATMIQCFELKAEEKGGYYGHFLIKLGELEKSVLIIMRR

SEQ ID NO: 156717 - protein, 78 aa, Glycine max
  Coding DNA Sequence Number=SeqID_39939
MVVIESDAEVLGHYGFTMALLVDHDPHELTTIMQDEVCLGKLACFLQNAIDVFVMVVSHFDEGPNDTVIDDGVVVKPF

SEQ ID NO: 156718 - protein, 165 aa, Glycine max
  Coding DNA Sequence Number=SeqID_39940
MTRTKRVQEDFEKKEDSSPRAIDGVLNEKDQALKKVKGCLTLLRVLTNKDLDLELDPEVKEILSFLHFHHNPKSSNFESLEWGNGLKPKSFVEKPLELELKPLLSNLKYVFLNPPSFLPIMITTCLHETKEEKLSGSKGQQGSLWVERSWHKEFGPYYLHPQNQH

SEQ ID NO: 156719 - protein, 224 aa, Glycine max
  Coding DNA Sequence Number=SeqID_39941
  Gene Ontology: Mol. function=DNA binding; Cellular component =intracellular; Biological process=regulation of transcription
  Homolog annotation: Hit_ID=Q69XV5; Match level="QueryCoverage=85%, HitCoverage=39%, E-value=1e-30, Identity=41%"; Hit description=DNA -binding protein-like
MGDTTSRDQGFQSILHSHDNGIPEISIQDSRVSEALLDYERHTTKGGELNVPITPLAEPINIENQALKFPPLVAYALGFASGTVIAILICVLQSLLPVQSVQGSASSGRARRDAAARAMQGWHSQRLLSNGEFSDPIIKCLLWPFGSFADLPVSVGMSGWARSDTSVVDIGPPADWKDCFEVYALVPGLLREEVRVQSDPAGRLVISGEPEHSDNPWGVTPFKK

SEQ ID NO: 156720 - protein, 145 aa, Glycine max
  Coding DNA Sequence Number=SeqID_39942
MEEQASQDSFVAHGQHPGRVRAAGANVTIKQYFGPTPRTSHTSSSMAPKDMEQLTQKIRDQLEESITEKVTRQVLALPPEPVDGRSATHVSTKENVVIWFCSLHNRLDFLKGIIIRKKGSTACEYYIMHRMSTIILGSFKNNWKM

SEQ ID NO: 156721 - protein, 876 aa, Glycine max
  Coding DNA Sequence Number=SeqID_39943
  Gene Ontology: Mol. function=DNA binding; Cellular component =chromatin; Biological process=DNA integration
  Pfam module annotation: Pfam domain module=RVT_2::Retrotrans_gag; Domain location=513-742::88-180
MAHTASVSNGALSFNTMIHMLNICLTPSNFMLWRRQLLLLLQGQALYGHIDGSTPALPSMLTSVDGSSSSTVNPAFTFGKQQDQRLVSLLLASLTEETLAEVLHCETSQQIWTALESLFGGDFKHRDIAIRDQLLHLKKDSSSVRDFSKSFRALYDQLRLMGRPIDDLDKLHWFLRGLGPTFTNFGASQLAMCPLPTFRDLVFVAESFEFYINAMEVVPSEAAFYSTTHHPSHFSHPHSSSGDRSSSGEGHYATFCPQRYNGAPPSSANIAESFVASCNISFPNNSDWYLDTDASAHMTPSSSTLDAMEPYSGNHKVLVRNGNILPISHIGSRRLNSTLQLLDILVVPGLQKNLISISKLTHDFTVDAIFTNNSFLLQKKDTKEILAQGRREHNLYVLEHGQVAFLVVVSLSAPSKPSSQLSMPLLSRPYGSCPSEDTSPVVLAPPYEPQSDVVHTVPAGHSMVTRAKTGIYKPRHFVDITTYRPSSLLHALLTTYEPKGFKSAAKHPGWLAAMNDELMALHSNKTWELVPQPPNTNIGFTQTPDLDYDHTFNPMVKASTVRAILTLAVMQHWPLHELDVNNAFLNELLSNPVYMEQPPGFIDPRFPHHVCRLRKALYGLKQAPLAWFQRFNSFLLHLGFIDKKADPSLFIYHHNTATLYLRVYVDDIILTGSNHFAIQTILAKIQAEFAIMDLGRLSYFLGLEVDYGANGIFLSQAKYAHDILDRAKLLDAQPIATPFASGIQLTNTGDPFHDPTLYRSLAPTTDHFQAIKRILCYVKGTLSFGLFFTRGSFLLVLGYSNANWACCVETRHSTYGYSIFLGAAELMWLTHLLRDLNVYSAPPTLLCDNKSAIFLSQNPVAHKCAKHIDINYHFVC

SEQ ID NO: 156722 - protein, 137 aa, Glycine max
  Coding DNA Sequence Number=SeqID_39944
  Gene Ontology: Mol. function=catalytic activity; Biological process =cellular metabolic process
  Homolog annotation: Hit_ID=Q9SDZ2; Match level="QueryCoverage=85%, HitCoverage=52%, E-value=2e-32, Identity=44%"; Hit description=2' -hydroxy isoflavone/dihydroflavonol reductase homolog
MDNISPILCNNVLMYLAGRKRDVSFLTNLPGASKKLKVFNVDLSNPESFREAIEGCIGSKEEEVIDEIYWSDENLLRDLKPFAWSYSISKTLAEKAILEFGEHHGLDVVTLIPTFVLGPFICPKLPGSVYTSLAFLF

SEQ ID NO: 156723 - protein, 61 aa, Glycine max
  Coding DNA Sequence Number=SeqID_39945
MDHPGRTQANLEDNTESIVRLVILNTSNLVSIETSGIASLEELHKSLVSSGRQVRAHTNWV

SEQ ID NO: 156724 - protein, 47 aa, Glycine max
  Coding DNA Sequence Number=SeqID_39946
MMDTSEPYTEPYTGTMRGTVHEPQANLGADQNFSPVDVFKQKKGDKP

SEQ ID NO: 156725 - protein, 84 aa, Glycine max
  Coding DNA Sequence Number=SeqID_39947
MSYRMSRHHASEHADYMCPYEQIKQVNNTRELFTQFGATSPTSGGSKPGRKSTLNSVSSSLRVYIAICVSGLQRLDAGGDLSSS

SEQ ID NO: 156726 - protein, 115 aa, Glycine max
  Coding DNA Sequence Number=SeqID_39948
  Gene Ontology: Cellular component=integral to membrane
  Homolog annotation: Hit_ID=UPI0000162E4C; Match level="QueryCoverage =97%, HitCoverage=29%, E-value=6e-34, Identity=55%"; Hit description =auxin:hydrogen symporter
MTLVVGANLLNGLKKSGISIFLIIGIMVVRFIISPILGILIVKAAYYWGFIGSYSLYQFVLMLQYALPPATIVGTVAQMLGNGESECSLIMIWTYFIATFSLTLWCTFFMWMLEV

SEQ ID NO: 156727 - protein, 58 aa, Glycine max
  Coding DNA Sequence Number=SeqID_39949
MASDVSKVRTEMPLFLHRVAVTVATDPHEHPPWILHDLPLKLVVARLGVIATYRYIVH

SEQ ID NO: 156728 - protein, 623 aa, Glycine max
  Coding DNA Sequence Number=SeqID_39950
  Gene Ontology: Mol. function=binding; Cellular component =intracellular; Biological process=protein kinase C activation
  Homolog annotation: Hit_ID=Q9FJY7; Match level="QueryCoverage=96%, HitCoverage=97%, E-value=1e-142, Identity=43%"; Hit description =Selenium-binding protein-like
  Pfam annotation: Domain name=PPR; Domain location=214-248; Score =42.2; E_value=1.8e-09; Accession=PF01535.11; Description=PPR repeat
  Pfam annotation: Domain name=PPR; Domain location=316-350; Score =42.6; E_value=1.4e-09; Accession=PF01535.11; Description=PPR repeat
  Pfam annotation: Domain name=PPR; Domain location=351-385; Score=7.9; E_value=0.87; Accession=PF01535.11; Description=PPR repeat
  Pfam annotation: Domain name=PPR; Domain location=387-421; Score =11.1; E_value=0.37; Accession=PF01535.11; Description=PPR repeat
  Pfam module annotation: Pfam domain module=PPR::PPR::PPR::PPR; Domain location=214-248::316-350::351-385::387-421
MMRFYTTSAKPFHSDHYSRLVSLIDSCKSMQQIKQTHAQLITTALISHPVSANKLLKLAACASLSYAHKLFDQIPQPDLFIYNTMIKAHSLSPHSCHNSLIVFRSLTQDLGLFPNRYSFVFAFSACGNGLGVQEGEQVRIHAVKVGLENNVFVVNALIGMYGKWGLVGESQKVFQWAVDRDLYSWNTLIAAYVGSGNMSLAKELFDGMRERDVVSWSTIIAGYVQVGCFMEALDFFHKMLQIGPKPNEYTLVSALAACSNLVALDQGKWIHAYIGKGEIKMNERLLASIIDMYAKCGEIESASRVFFEHKVKQKVWLWNAMIGGFAMHGMPNEAINVFEQMKVEKISPNKVTFIALLNACSHGYMVEEGKLYFRLMVSDYAITPEIEHYGCMVDLLSRSGLLKEAEDMISSMPMAPDVAIWGALLNACRIYKDMERGYRIGRIIKGMDPNHIGCHVLLSNIYSTSGRWNEARILREKNEISRDRKKIPGCSSIELKGTFHQFLVGDQSHPQSREIYSFLDEMTTKLKSAGYVPELGELLHDIDDEEDKETALSVHSEKLAIAFGLMNTANGTPIRIVKNLRVCGDCHQATKFISKVYNRVIIVRDRTRYHHFEDGICSCKDYW

SEQ ID NO: 156729 - protein, 82 aa, Glycine max
  Coding DNA Sequence Number=SeqID_39951
MVSVKMFYLAPFQTIHHQGYFGKLWGGLTTVHMVDGVDVDIELMLKLVASDMTDEGATTCLEMKLDRKGSIYCCSGDEQNYC

SEQ ID NO: 156730 - protein, 73 aa, Glycine max
  Coding DNA Sequence Number=SeqID_39952
MESGYPCQGVSWSKESEAWKKVETRSVASKKRKRVRPVGMRRYMIWLRGLLKYAASMFHGIIGTMNRLKGFWW

SEQ ID NO: 156731 - protein, 710 aa, Glycine max
  Coding DNA Sequence Number=SeqID_39953
  Homolog annotation: Hit_ID=Q1RVB7; Match level="QueryCoverage=99%, HitCoverage=94%, E-value=0.0, Identity=54%"; Hit description=Zinc finger, BED-type predicted
  Subcellular localization annotation: CTP_CleavageSite=77; ConfidenceScore=5.04e-01
MKGKGAWYWAHLEPILVPHPDTGLPKSVKLKCSLCDSLFSSSNPSRTASEHFKRGTCSNFTSSLRPPSPLPISSITPAPRKRPSPATSPPSYQNHSLPILHSSHFQISHANTAHSHNHHHHHQHLMLSGGKDDLCALAMFEDSVKKLKSPKTSPGPALSKDQVNSALDLLFDWFYENSVSLSMIEHRKFQAFLSQVGLPNKLGREISGERLDARFVEAKAESEARIRDAMFFQLASDGWKCGDWFNLDFCCGGDCGGVGGGESLVKFVVNLPNGSSVFQKAVFNGGVENSKYAEEVMGDGYGGYRECGPEAKALRNLEVQHHWMVNTACQLQGLTSLIKDFNCELPLFRVVIENCLKVANFIDNELHVRSVFLKYRMQEMDCGGLIRVPSPKCDPLKNFGVAFPTLEDTLSCARVIQRVVMEDGFKVMCMEDPLAREVAGMVQNEGFWNELEAVYSLVRLVKGMVQDVETERPLIGRCLSLWEELRSKVKEWCGKYNIVEGHAEKIVEKRFRKNYHPAWAAAFILDPLYLVKDASGKYLPPYKCLTREQEKDVDKLLTRLASREEAHVVLMELMKWRSEGLDPLYAQAVQMKQKDPVTGKMKVANPLSSRLVWETCLSEFKSLGKIAVRLIFLHATSSGFKSNSSFTRKVSANKHSRVTLERAQKIIYIAAHAKLERRDFSNGEEKDAELFVMSNSEDDMLEVYADAPLV

SEQ ID NO: 156732 - protein, 126 aa, Glycine max
  Coding DNA Sequence Number=SeqID_39954
MALLWTINLLRGYYTFFGDNLISWKSKKERVVARFSAKAEYKTMAYTNWNLGNMLLIIVPAVCEQSSSIFGDSSTCSTYGQAYAAFSTGLLIKHKANMLVEGVFTIYQMTCYAFITRLFQYVREFE

SEQ ID NO: 156733 - protein, 205 aa, Glycine max
  Coding DNA Sequence Number=SeqID_39955
MANWHMLFIFRLSFTTANWPCCGSCLIIETPASAARVNTKESSVNPLGNDPDTGDSDKYGLYIEENPPCMVALGRVYEGSTTTDNIHLLHDQVKVGAEEVKDTDAPVPVPTDKVNLVGHALNTFLAWSTHLVKRLSEQMITKDDDKGDDKKLKGQSKNEFKMFKIESRTLQDSRGKLNSRMKKGYSRIKKKPNQDKYEKVFSKTE

SEQ ID NO: 156734 - protein, 94 aa, Glycine max
  Coding DNA Sequence Number=SeqID_39956
  Gene Ontology: Cellular component=integral to membrane
  Homolog annotation: Hit_ID=UPI0000162E4C; Match level="QueryCoverage =74%, HitCoverage=18%, E-value=7e-20, Identity=53%"; Hit description =auxin:hydrogen symporter
MTVYKCNCGHIHICDNNLVFYIFTPALLVADLAETITFNRLVEMWFLLVNIFLTLVVGSILGWMLNKIAKTPKHLRGLVNGCCTAGWYLSNLTK

SEQ ID NO: 156735 - protein, 105 aa, Glycine max
  Coding DNA Sequence Number=SeqID_39957
MGTEFGGNKHRPFCLVTPSPTLLSIDLHDGSDRDLIGTQCSLMCPSFARQTTFGHPTVLAHPAIFHAFLSSDRKVVGSKMSERFDEDGNEMMRGGVAIEEVSVDD

SEQ ID NO: 156736 - protein, 155 aa, Glycine max
  Coding DNA Sequence Number=SeqID_39958
ALWGSSNELKLRREEMDQSRVDGLILKDELRVYLRSKRSLSQWLSETETHMLAIISKYQEELNLATAHEHKVADEYARVYAKKEARGRVIDSLHQEASMWMDRFALTLNGSQEFPRLLAKAKAMADTCSAPEEIHGLLRYCQHMIDLMAHIIRSR

SEQ ID NO: 156737 - protein, 65 aa, Glycine max
  Coding DNA Sequence Number=SeqID_39959
MTKPMLDQFHPRIHNSIENIVDVKVYGNYGYHAIVALLGMDGDSWSLVRNHLLKELEKWLPWISG

SEQ ID NO: 156738 - protein, 361 aa, Glycine max
  Coding DNA Sequence Number=SeqID_39960
  Gene Ontology: Mol. function=transferase activity; Cellular component= membrane; Biological process=DNA integration
  Homolog annotation: Hit_ID=Q1RU49; Match level="QueryCoverage=99%, HitCoverage=60%, E-value=6e-95, Identity=42%"; Hit description =Polynucleotidyl transferase, Ribonuclease H fold
MSNHTWDLVDLPKGSKPIRCKWIFRKKLRTDGTIDKFKARLVVVGYTQKKEIDYFDTYSPVTKISTIRSLVALAAIHGLIVHQMDVKTALLNGDLREEIYVEQPEGYVIQGQENKVLEKTKLFLSSHFDMKDLGEADVILGVKMRKSDNGFSLCQSHYIEKILKKFNCYDELPVRTPYDPSIHLKKNNGSSVSQTEYAKIIGSVMFLMNCTRPDIAYAVSRLSRYTHNPGGGAISWKSSKQTCIARSTMESEFIALDLAGQEAEWLRNLLADVPLWGKRSIPVSLHCDSEAAIGIAKNSVYNGKRRHIRIRHSSVRELLKNGVISLQFVRSENNLADPFTKGLTKKVVLESSRGMGLKPLC

SEQ ID NO: 156739 - protein, 48 aa, Glycine max
  Coding DNA Sequence Number=SeqID_39961
MASELSTDTTKTSTSSNSSSATSKMLEKTRSQKYKTEKYNTDWRFVVP

SEQ ID NO: 156740 - protein, 156 aa, Glycine max
  Coding DNA Sequence Number=SeqID_39962
  Homolog annotation: Hit_ID=Q9AR47; Match level="QueryCoverage=38%, HitCoverage=47%, E-value=2e-11, Identity=56%"; Hit description=VIP3 protein
  Subcellular localization annotation: CTP_CleavageSite=43; ConfidenceScore=5.32e-01
MLQNNPSSLSFTQPPLCFFFIILHLLLPSPSLPCPISFLHLLLGTTTAPNSAFVLRPHSPVFPSKTLTPKKPKPPLPSSSGIAILSSPASPPAALYKVFAHVPKDEVENRIEQINKVTSQKLEKLEEEKESILAQMAELKKILYAKFNDSINLEED

SEQ ID NO: 156741 - protein, 205 aa, Glycine max
  Coding DNA Sequence Number=SeqID_39963
MTRTKKTGQMTPEVAKEIADKIASQGSFVAYGHHDVLTVAIGQPEHLGRARAAGAGVTIKQYFGPAPRTSPISTFMALEDLEQGLTLPPKPEVAPSVAHVSTKESCVDPSGNDPDTEENSPRLVALGRLYEGSTTVHNIPLGNYQVKVMWDAIVIGVYNDNFPLYIKQEDLSEIAHSGQYLSISIIQLWIMHMTETSMRAGNADV

SEQ ID NO: 156742 - protein, 559 aa, Glycine max
  Coding DNA Sequence Number=SeqID_39964
  Gene Ontology: Mol. function=nucleic acid binding; Cellular component= intracellular; Biological process=DNA integration
MAGSLSKIIPDMSKIEPLDGSNYRRWSQKQLILFEALEVDYVLFEDPPADVNASESSTPETPATPVVTPLPAETKKADEEAKKKYEKDNKTARGHLLTHMADNLFDLFINQKSAKTIWDTLLKCYGDDDAGRKKYVVGNWLRFQMMDDKPIMEQIHEYENLVGDILNEGMKMCEILQANVLLEKFPPSWSDYRNQLKHKKRDLSLQELINHMKTEEANRLKDKHVLHSVNSVNANVVEFADQHRSKGKEKRFQKKGQKKTHTNINKGHKAYECKLRKGQQSNNSKPAAPHAPQAHLAENEEVIVAVVVEANMVDNKVDWILDTGVSKHLCANKELFHQIEDADDGECVFMGNSATAGVLGKGKILLKLTSGKTLSLSDVLYVPSLRRNLISGSCLNRAGLKMVFEADKVVITKNGNFVGKGYLADGLFVLNTIPNTSNVISSVGSVYIVEYVNLWHGRLGHVNVNSIKKLRNMNLINVLDINNFSKCPICVEAKYAKKPFKPVKNRTTELLELIHTDLADFKNTVSRGGKTYFITFIDDFSRYAKVYLLRTKDEAEECF

SEQ ID NO: 156743 - protein, 136 aa, Glycine max
  Coding DNA Sequence Number=SeqID_39965
  Gene Ontology: Mol. function=transition metal ion binding
MGAEDECRVGGSGGAEKKWIDNNIGVRTDDLGFMLVGLKKLAYQNDPFIMTEQAKQVFYVQDPCDQKWSVVLHGKTIDVNVEDDDSLIDTYVSPLSIQILPNIVGEEEIDDKMATPPNSPLPYPTDSATHFPSTLK

SEQ ID NO: 156744 - protein, 68 aa, Glycine max
  Coding DNA Sequence Number=SeqID_39966
  Subcellular localization annotation: CTP_CleavageSite=28; ConfidenceScore=5.57e-01
MKSSSPSWSAIPNRSTMSPNRTHPVHVPAQYRKQGKTPSRRPLIQEVNASIVFCTTSITKGSGRANVL

SEQ ID NO: 156745 - protein, 74 aa, Glycine max
  Coding DNA Sequence Number=SeqID_39967
MSFMIVIMFWNSTPHIRRPFCAKCFRSASIDGNAENVNGYLERCKKFGAFVKNGVFGSFRLGFKWVQREGSKAD

SEQ ID NO: 156746 - protein, 83 aa, Glycine max
  Coding DNA Sequence Number=SeqID_39968
  Gene Ontology: Mol. function=hydrolase activity, acting on glycosyl bonds; Biological process=carbohydrate metabolic process
  Homolog annotation: Hit_ID=Q944B5; Match level="QueryCoverage=94%, HitCoverage=18%, E-value=5e-38, Identity=98%"; Hit description =Dehiscence-related endopolygalaturonase
MALQRHHLSLLFIMFSFVACHSTVLLDGGGTFKDFIKQKSTDVMSIRKFGKLGDISSSLKTVNVNDYGARGDGKTDDTQVKLE

SEQ ID NO: 156747 - protein, 49 aa, Glycine max
  Coding DNA Sequence Number=SeqID_39969
MALRFRSEHRGRRLQSGGGEETKTKSIATTCGDDEVEDTNKNTKDRKRY

SEQ ID NO: 156748 - protein, 306 aa, Glycine max
  Coding DNA Sequence Number=SeqID_39970
  Homolog annotation: Hit_ID=P0ADI9; Match level="QueryCoverage=38%, HitCoverage=57%, E-value=2e-43, Identity=72%"; Hit description =Hypothetical protein yhhN
GDAKKRSAERRPADDGLAAAARVYFGVFELLVWMKKFKAQCRPALPLRCKPFESRPFVAQRSFLSHRQLVVLLRLQAEGHLEAARFRLKARFIAHCCARRRHLLLARAAVIERFFAFVRHHYALLHQRCGIVIRLLAALLHEAERGGNDDNRHHDNEKQRHLAHSTIPSDYAEFRIPRLPRHCQTPARLPGSRRAVRVPDWRCLNSAPASASAVCRWGVFPVASAVYHLLRQPDDALLLLAAAAGAAGDWRTADSGDLVASGRDAFAGLYIYRHDAGDGVARWRALVLPPDVSGDVCVLRRSTALT

SEQ ID NO: 156749 - protein, 52 aa, Glycine max
  Coding DNA Sequence Number=SeqID_39971
MSRNFTDYATIPSSASGIVVNTVVYQEELAEYERKEGNMGNYHYVLLGRDTE

SEQ ID NO: 156750 - protein, 77 aa, Glycine max
  Coding DNA Sequence Number=SeqID_39972
  Gene Ontology: Mol. function=triacylglycerol lipase activity; Biological process=lipid metabolic process
  Homolog annotation: Hit_ID=Q6Z307; Match level="QueryCoverage=95%, HitCoverage=15%, E-value=3e-15, Identity=49%"; Hit description =Lipase class 3-like
KMITPERSSATFLSVVGYSDTRVDLDKSIKEKDTKYKGFLSMMASKLAYENEEFVSNAVRNHWDMDFLGSHSFWNGT

SEQ ID NO: 156751 - protein, 121 aa, Glycine max
  Coding DNA Sequence Number=SeqID_39973
MEPHGSYYGRISLYSPRRGMARLIYGLVMKMDMGLGNFISGQITQIAQSNTSRLGFPMLILVLCDAQGVVSDTLTFESLSLVINLAYIKKNCWNPTDSSITFQGPHCAQARAATPDAPPLA

SEQ ID NO: 156752 - protein, 128 aa, Glycine max
  Coding DNA Sequence Number=SeqID_39974
MGTTKGEELATQLAQASQVASSRSNYLLEEHPCRPKWACMSQNFTYCATKGAKYLKAVKQRLHALKQWFCRSKLHDDESRLIQDSRIKFQESRIKNNQDQDSRLKIQESRKDSIKISTKKFFKTLSST

SEQ ID NO: 156753 - protein, 100 aa, Glycine max
  Coding DNA Sequence Number=SeqID_39975
MLVATPRVFLSWNTHPRVMRRPPTEGLKQELGNMQIHQAWPKSNIKHGQKLYLPMKHTPHTYSQNNSKAPKFLKGKEGINKNQAKAIVQAINGAKQTKRL

SEQ ID NO: 156754 - protein, 124 aa, Glycine max
  Coding DNA Sequence Number=SeqID_39976
MRPDEVVLLEPIVPVIHEVVEAGESQLRQEAATPERTPQTPEDSLSPGMDLSFAQQVEDPPTLVHERQPNPPTPIIEMLEDSTTPILRLSSTPPATPVLHLTDEEDMQDQDTQGTQDQTSQVKG

SEQ ID NO: 156755 - protein, 294 aa, Glycine max
  Coding DNA Sequence Number=SeqID_39977
  Gene Ontology: Mol. function=GPI anchor binding; Cellular component =anchored to membrane; Biological process=cell adhesion
  Homolog annotation: Hit_ID=Q40315; Match level="QueryCoverage=99%, HitCoverage=95%, E-value=2e-42, Identity=38%"; Hit description =Putative surface protein
  Pfam annotation: Domain name=Fasciclin; Domain location=23-161; Score= -5.7; E_value=0.011; Accession=PF02469.12; Description=Fasciclin domain
LLLACSSAIHAFDITQLLGQYPEFSTFNKYLTETKLADEINSRNTITVLAVEDSAMNSIAAKSPEAIKAIISTHVILDFFDEKKLMEAQANSQQLTTLFQASGIAVNQQGFLKVALVGEGEIAFGSAVSGAPVDATELMRTVTSEPYNISILQVTKPILVPGVDSQTPASSSGAQSSQGANAPVAAQGAKAPMSSLQGAKAPIPTPVAKSPVPAQSAKAPVPSKTAAASPPTGESVAESPEVAAEAPATSPTGAEAPGPMADDVTPADVPSSASTTKMGLVGAVMAFASLFIVL

SEQ ID NO: 156756 - protein, 231 aa, Glycine max
  Coding DNA Sequence Number=SeqID_39978
  Homolog annotation: Hit_ID=Q2HUV6; Match level="QueryCoverage=99%, HitCoverage=85%, E-value=4e-91, Identity=71%"; Hit description =Cytochrome cd1-nitrite reductase-like, C-terminal haem d1
MASFPPLGSLTLCEVNRDLITVDALSDDRANQTYGKILGLVFSPVPFHNLENDASDQDGATTTATTAGESVRRKSPVALLQGFMNSYLGRLFYPDDVHLLPEVDLQGVSWHPNKHIIAFISAPTQVLVRDYQESEGKDPSILTNESQRDARVLEWRPNGGKMLAVGCKGGICMWAASYPGNAASVRSGAASFLGGLSRSSGNRYILVDFLRSPYDEHVSALTWSPDGRYPY

SEQ ID NO: 156757 - protein, 335 aa, Glycine max
  Coding DNA Sequence Number=SeqID_39979
  Gene Ontology: Mol. function=protein kinase activity; Biological process=protein amino acid phosphorylation
  Homolog annotation: Hit_ID=Q9FK64; Match level="QueryCoverage=77%, HitCoverage=67%, E-value=6e-60, Identity=47%"; Hit description =Tyrosine-specific protein phosphatase-like protein
  Pfam annotation: Domain name=DUF860; Domain location=41-305; Score =108.7; E_value=1.7e-29; Accession=PF05898.4; Description=Plant specific of unknown function (DUF860)
MTLSCILRHKIFPPPRSPFNLFIQRRWKKPTVSAQTRLVDRVREPHFDKLASHLKRLDLVLKTHPQSHARAQARSFHLSHPPLPLAKHPRTHRPRGPIPPQIPPRLPRNGTEAVKRVKKLLMMSVNGTLRLHALRLIKRELGLPEDFRDSIIGRYDRDFRLVDLEVVALVDWDAEFAVARVEEWRVREYTEKWLSEFETKFAFPVSFPTGFMFERGFKERLRNWQRLPYTMPYKRNEVVRVRTCGGIEWYEKRAVAVLHELLSLTVEKMVEVDRLAHFGGTLVSKLMKTRQLLACDDESNKEESNAVVCEVNEEGERQGDWVIPFLENCEENRSP

SEQ ID NO: 156758 - protein, 264 aa, Glycine max
  Coding DNA Sequence Number=SeqID_39980
MAENLDDDEFWLSPQFLADDDVVVFPIPFEAKFSPLSNNAVLFPYSSPVDSTVGGSSETESNEEEQLVAELTRHLTRSSLQPDTEAVGQFVSGSPQSTLCAFGSECSYGKGSSHGSPDGVCKLSSVKTTWDLLHAATGEVERMRLKQEGVSPLALAKPSPRHCHVAAGIARLLVSSIASAAGIRTVRASATATATAATWAASAEAVVGEGGEEGEGGFEGRGGVVEVERKGLRVERSESLKLLKASGVLTAMVEGNGQEKEFVR

SEQ ID NO: 156759 - protein, 153 aa, Glycine max
  Coding DNA Sequence Number=SeqID_39981
  Gene Ontology: Mol. function=protein binding; Cellular component =integral to membrane
  Homolog annotation: Hit_ID=Q2RB03; Match level="QueryCoverage=92%, HitCoverage=65%, E-value=1e-47, Identity=55%"; Hit description =Mpv17/PMP22 family protein, expressed
  Pfam annotation: Domain name=Mpv17_PMP22; Domain location=93-151; Score=-15.9; E_value=0.015; Accession=PF04117.3; Description=Mpv17 PMP22 family
MSQIELTVQKYLALLGKHPVAVKALTSAILNLIGDLLCELVIDKVPSLDFKRTFVFTFLGFALVGPTLHFWRYLYMSKLVTLPGASGALLRLVLDQFLFSPIFSGVFLSTLVTLEGSPSQVVPKLKQVLAANVIALMWNIILSFMAHKEVLTK

SEQ ID NO: 156760 - protein, 145 aa, Glycine max
  Coding DNA Sequence Number=SeqID_39982
  Gene Ontology: Mol. function=metalloendopeptidase activity; Cellular component=mitochondrial inner membrane; Biological process =proteolysis
  Homolog annotation: Hit_ID=Q9AXQ2; Match level="QueryCoverage=81%, HitCoverage=22%, E-value=4e-59, Identity=93%"; Hit description =Mitochondrial processing peptidase beta subunit
MALDTVLNKLREREGRENLLNTYSHSPDSLDDLSYAIMYETTKLAYRVSEDDVTRARNQLKSSLLLHIDGTSPVAEDIGRQLLTYGRRIPFAELFARIDAVDASTIKRVANRFIYDKDVVIAAMGPIQRLPDYNWFRRRTYWNRY

SEQ ID NO: 156761 - protein, 141 aa, Glycine max
  Coding DNA Sequence Number=SeqID_39983
  Subcellular localization annotation: CTP_CleavageSite=42; ConfidenceScore=5.68e-01
MTPPTRRATHRVSSPATTLPAGATSSSTWSNPAPPLRDRALYAAVRGGAGLRSRLVRQGRGGAETHRFDGVRRGEEVLQEQGILVPPVRKNQFMQTKWFGPCRRTANDVLMEMNGVSCRVVGFDDVVLEAGRSGGVVVRTR

SEQ ID NO: 156762 - protein, 370 aa, Glycine max
  Coding DNA Sequence Number=SeqID_39984
  Gene Ontology: Mol. function=alpha-N-arabinofuranosidase activity; Cellular component=nucleus; Biological process=L-arabinose metabolic process
  Homolog annotation: Hit_ID=Q1SJT6; Match level="QueryCoverage=99%, HitCoverage=55%, E-value=0.0, Identity=82%"; Hit description =Galactose-binding like; Alpha-L-arabinofuranosidase, C-terminal
VALRLEVSCDSEGDNICPADGVGVHNPGYWGMNIEQGKKYKVVFYVRSTESLNLTVSLTGSNGVGNLASSVITGSALDFSNWTKVEKILVAKATDHNSRLQLTTTTKGVIWLDQVSAMPLDTYKGHGFRTDLVEMLTALKPRFIRFPGEWLRNAFRWKASVGPWEERPGHFGDVWMYWTDDGLGYYEFLQQLAEDLGTAPIWVFNNGVSHNDQVDTSAVLPLVQEALDGLEFARGDRTSKWGSLRAAMGHPAPFDLRYVAVGNEDCGKKNYRGNYLKFYSAIKSAYPDIQIISNCDGSSRPLDHPADMYDYHVYTNANDMFSRANAFDHTSRNGPKAFVSEYAVTGKDAGTGSLLAALAEAGFLIGLEKN

SEQ ID NO: 156763 - protein, 101 aa, Glycine max
  Coding DNA Sequence Number=SeqID_39985
  Homolog annotation: Hit_ID=Q9XFS0; Match level="QueryCoverage=50%, HitCoverage=5%, E-value=2e-16, Identity=82%"; Hit description=Gamma -adaptin 2
MLWMVLIAWDSVLLFPQRMRGPSWNVYDMKRAQEGSCIVATKTESNKVAGNAILYECVQTIMSIEDNGGLRVLAINILGGFLPNRDNNIRECFRNPWHPGS

SEQ ID NO: 156764 - protein, 78 aa, Glycine max
  Coding DNA Sequence Number=SeqID_39986
MSADKGNTYTLLMFNTAVSLFSIVLLCITAAQGRKTLHLNNEWLTSFPDINDIDGICKTLVETQGYSCEEHQELNTIS

SEQ ID NO: 156765 - protein, 54 aa, Glycine max
  Coding DNA Sequence Number=SeqID_39987
MVESVDNQKVANHLDHMVSTLGRNPLKVLVQVNTSGEECFLTPFGCEANSCLRH

SEQ ID NO: 156766 - protein, 297 aa, Glycine max
  Coding DNA Sequence Number=SeqID_39988
  Gene Ontology: Mol. function=RNA-directed DNA polymerase activity; Cellular component=chromatin; Biological process=chromatin assembly or disassembly
  Pfam annotation: Domain name=RVP_2; Domain location=129-242; Score= -55.9; E_value=0.023; Accession=PF08284.2; Description=Retroviral aspartyl protease
MEGRALAWFQWMTGNGQFTSWPIFLQALQTRFAPSQYEDPTRALFKLTQQGAPTVDVGTSRRPGTPLGGEAPGRPSPTVDARSTPPPLKRLSPDEIASSWECGLYFNCDKKFHKCHRFASRVFLLIVEEDESHAPHIVMNDPPPDPPDHVDPIDPSTHNFIQQELVTQLNLPCRDTSFPLRVMVGNDQHLQCTSVCEEILIDIQFAQFTVDLHVLPISSTNVVLGVQWLKSLGLVLTDYNTICMQFFHDCRVVELKVLLVKKHDGSWRFCVDYHALNAITIRDHFPIPTIDELGGAR

SEQ ID NO: 156767 - protein, 207 aa, Glycine max
  Coding DNA Sequence Number=SeqID_39989
  Gene Ontology: Mol. function=carboxylic ester hydrolase activity; Cellular component=lysosome; Biological process=lipid metabolic process
  Homolog annotation: Hit_ID=Q1XBG1; Match level="QueryCoverage=94%, HitCoverage=47%, E-value=3e-47, Identity=45%"; Hit description=Lipase
MPAGRSGEKADKPPVLLQHGIFSDASTWLVNSPDESLGFILADNEYDVWLANVRGTKYSSGHTSLIPNDTAYWDWSWDELASNDLPAFVQYVYNYTGQRIHHASHSLGTLMALAAFSQGQVLSMLRSASLLCPIAYMNQIPSIPTKLAADTFIANDLYWLGIREFNPNGGGAASKFVEYICNKLKLNCSNLVSLVTGAINATGMTRN

SEQ ID NO: 156768 - protein, 140 aa, Glycine max
  Coding DNA Sequence Number=SeqID_39990
  Gene Ontology: Mol. function=alpha-N-arabinofuranosidase activity; Biological process=L-arabinose metabolic process
  Homolog annotation: Hit_ID=Q1SJT2; Match level="QueryCoverage=100%, HitCoverage=21%, E-value=2e-54, Identity=73%"; Hit description =Galactose-binding like; Alpha-L-arabinofuranosidase, C-terminal
MIFSKSCSFLGLYLVIVACLVLQCCAYANQTSTTLVVDASKSGRQIPDTLFGIFFEEINHAGAGGLWAELVNNRGFEAGGTQVPSNIAPWTIVGQESAILLQTELSSCFERNKVALRMDVLCDNCPSDGVGVSNPGFWGM

SEQ ID NO: 156769 - protein, 134 aa, Glycine max
  Coding DNA Sequence Number=SeqID_39991
MLQASDNKARLRKGGHLSIKEKHLLSRTFTQMLPTLTIIYQTLGLQPACFKPLTHSLTHVYHFPHHGRVLPPLFSLLTFHDNSLVYQSNADPDLLAAFETGDAELLYEIRLLSASQRVAAARFLVENRCDGKVA

SEQ ID NO: 156770 - protein, 53 aa, Glycine max
  Coding DNA Sequence Number=SeqID_39992
  Homolog annotation: Hit_ID=Q1SJS8; Match level="QueryCoverage=96%, HitCoverage=7%, E-value=4e-18, Identity=86%"; Hit description =Galactose-binding like; Alpha-L-arabinofuranosidase, C-terminal
MFNNAHVFDKTPRNGPKAFVSEYALIGDIQAKHGTLLGAVSEAGFLIGLERNR

SEQ ID NO: 156771 - protein, 228 aa, Glycine max
  Coding DNA Sequence Number=SeqID_39993
  Gene Ontology: Mol. function=alpha-N-arabinofuranosidase activity; Cellular component=nucleus; Biological process=L-arabinose metabolic process
  Homolog annotation: Hit_ID=Q1SJS8; Match level="QueryCoverage=98%, HitCoverage=34%, E-value=7e-85, Identity=65%"; Hit description =Galactose-binding like; Alpha-L-arabinofuranosidase, C-terminal
MTVSFRKTEGGGILASSNIDASESEVSKWKRIETTLVADTSSSNSSLYLTTTKKGVILLDQVSAMPLDTYKGHGFRGDLVNMLLELKPTFFRFPGQTLRNAFRWKDSVGPWEERPGHFGDVWSYWTDEGFGYFEGLQLAEDIGARPLWVFNNGISHTDQVDTSVITPFVKEALDGIEFARGEATSKWGSLRASMGHPKPFDLKYVAIGNEDCGKTNYQGMLSFFFFLF

SEQ ID NO: 156772 - protein, 75 aa, Glycine max
  Coding DNA Sequence Number=SeqID_39994
  Gene Ontology: Mol. function=alpha-N-arabinofuranosidase activity; Biological process=L-arabinose metabolic process
  Homolog annotation: Hit_ID=Q1SJT5; Match level="QueryCoverage=96%, HitCoverage=10%, E-value=1e-17, Identity=56%"; Hit description =Galactose-binding like; Alpha-L-arabinofuranosidase, C-terminal
  Subcellular localization annotation: CTP_CleavageSite=55; ConfidenceScore=5.26e-01
VANVGSNQINFKISLNGFESSNATKATKTVLTSKNALDENSLANPTNIVPKRSPLQSANNEINDILPPVSLTITV

SEQ ID NO: 156773 - protein, 136 aa, Glycine max
  Coding DNA Sequence Number=SeqID_39995
  Gene Ontology: Mol. function=zinc ion binding; Cellular component =proton-transporting two-sector ATPase complex; Biological process =ATP synthesis coupled proton transport
  Homolog annotation: Hit_ID=Q1SJS5; Match level="QueryCoverage=75%, HitCoverage=35%, E-value=1e-41, Identity=80%"; Hit description=Zinc finger, RING-type; RINGv
MPNNDNAQHMYQRMEMIVPGAGGRQLRLTVVFLAFDVFFIIFCIGMACIVFFALFCIIPIIALAYAMRIREGASEEDILSLPMYRFSQSNSLVMVDDNKKQLIKGRVDSCNGSHMSALSLHPDDSVSADCVLISPM

SEQ ID NO: 156774 - protein, 125 aa, Glycine max
  Coding DNA Sequence Number=SeqID_39996
  Homolog annotation: Hit_ID=Q2HUV0; Match level="QueryCoverage=42%, HitCoverage=17%, E-value=7e-25, Identity=86%"; Hit description=Zinc finger, RING-type; RINGv
MFWLSKVKFVLSDNAPHRCSIFISESSNQCITSKDIKFAERASCFCLKPTADAFAMKMVRTGKAIQFCSFNIRTKADTAFLQHNPKQFSYLSAVARCISTVCKATKNQGKLQPSSLSKESITKNP

SEQ ID NO: 156775 - protein, 141 aa, Glycine max
  Coding DNA Sequence Number=SeqID_39997
MVIDKRNTRSNDVQNILPRKVRQKCVIGQVGKIPRHMARRFERYPRQIKEWFLMRQKGKGKYEVGQSSKAEDHVEDKKCNIELVLKGLKKMEWTSTKDDPIGVASGFASIVVVLDEEKAFTEAMRLHLNLRGEFVKDNMNA

SEQ ID NO: 156776 - protein, 253 aa, Glycine max
  Coding DNA Sequence Number=SeqID_39998
  Gene Ontology: Mol. function=metalloendopeptidase activity; Cellular component=mitochondrion; Biological process=proteolysis
  Homolog annotation: Hit_ID=Q9AXQ2; Match level="QueryCoverage=68%, HitCoverage=32%, E-value=3e-84, Identity=88%"; Hit description =Mitochondrial processing peptidase beta subunit
GLWYLLHLPENDFALAADAVFLESGVLEDVGEDVKGLGDILVGDLGIIGGLLPGGVGVEVSSHVLDLFLELTRVAPLGALEDHVLEEVRGAVSLLGLEPRPGVDPDADGGGAGAEGGLGGDAEAVGERGHARLGGGEDARVVREGRPGGPVLEEAGVGVLEQPELGLHGLGSAVIDHGGGGRRGGRGGGGGGHGGGGGEGSEGGEGGGPPVGAAGRGKEAVEGHGLAPRSQSGLGFHGGREIANIYEVERRER

SEQ ID NO: 156777 - protein, 87 aa, Glycine max
  Coding DNA Sequence Number=SeqID_39999
MATNNIQFQQNVSATIQDLHTQIGQLATTVNRLLMRRVFKEIRLRTFIWLGFVHCGAVHMAWICPLRCSSQGRDAIEIVVAIPYAIR

SEQ ID NO: 156778 - protein, 138 aa, Glycine max
  Coding DNA Sequence Number=SeqID_40000
MVPSRRASRIPSRGKFLSTSSPRLEIPSWNNFNKDKGGPSIRPPNQGLNLYERTTKLEDSLTQFMQNLYVQVGQLAKQLAKTSTRSLVANTEKNSKEECKVIFTRSQMRENTEREKRDEGVLEDVSNEEGEKMRARRE

SEQ ID NO: 156779 - protein, 95 aa, Glycine max
  Coding DNA Sequence Number=SeqID_40001
MDRARLIFGLVSRLDMNIGALISGQMTSIAQSTPLDLVLSPIINLAYIRKNCWNPEDLTVSIQGTRRARARLAELPYTSAAPTPASTSVAPSVPT

SEQ ID NO: 156780 - protein, 183 aa, Glycine max
  Coding DNA Sequence Number=SeqID_40002
  Homolog annotation: Hit_ID=Q10EV2; Match level="QueryCoverage=63%, HitCoverage=66%, E-value=8e-26, Identity=44%"; Hit description =Expressed protein
  Pfam annotation: Domain name=DUF538; Domain location=12-151; Score =127.6; E_value=3.4e-35; Accession=PF04398.3; Description=Protein of unknown function, DUF538
MATIPPSRSSSHAFVAMATFTTLLLCTAAAKESVYEILPKYGLPSGLLPDTVTDYKLDEDGQFVVVLPKPCYIQFDYLVYYESKISGKLSYGSITNLKGIQVQRLFIWFNVDEIRVDLPPSDSIYFQVGIINKKLDVDQFKTVRSCRKSLSCPPFLPRPIQFHERSLARSINQYEDYCKFTNT

SEQ ID NO: 156781 - protein, 292 aa, Glycine max
  Coding DNA Sequence Number=SeqID_40003
  Homolog annotation: Hit_ID=Q10R96; Match level="QueryCoverage=34%, HitCoverage=54%, E-value=6e-31, Identity=58%"; Hit description =Protease inhibitor/seed storage/LTP family protein, expressed
  Pfam annotation: Domain name=Tryp_alpha_amyl; Domain location=8-85; Score=33.4; E_value=7.6e-07; Accession=PF00234.12; Description =Protease inhibitorseed storageLTP f
INQDKAECTDKLLGLAGCLPYVGGEAKVPAMDCCSGIREVIDKSKRCLCILIKDRDDPNLGLKINVTLALSLPDACQTPTNITQCVDLLHLAPNSTEAKVFEGFKNALTNKTSPSSVPGANNATANGTSTSANNNSSSGWGKSSRKVTNASVPWTSLPSSIAKLGRGFAAGTNGFELVNVEFLVDDADLEVDAVGGWQIDPDLVDVEPDEEALDLNALEIGDGAIAELAGDLALSVTVSGNRPLGSPYLGSISYTLSFAAAVHNNRVVKVAMATNACDDDRLGGIVAMAERV

SEQ ID NO: 156782 - protein, 556 aa, Glycine max
  Coding DNA Sequence Number=SeqID_40004
  Gene Ontology: Mol. function=hydrolase activity, hydrolyzing O -glycosyl compounds; Cellular component=membrane; Biological process =carbohydrate metabolic process
  Homolog annotation: Hit_ID=Q1RZ23; Match level="QueryCoverage=78%, HitCoverage=88%, E-value=0.0, Identity=88%"; Hit description =Glycoside hydrolase, family 17; Virulence factor, pectin lyase fold
  Pfam annotation: Domain name=Glyco_hydro_17; Domain location=140-461; Score=303.8; E_value=3.2e-88; Accession=PF00332.9; Description =Glycosyl hydrolases family 17
  Pfam annotation: Domain name=X8; Domain location=474-556; Score =156.0; E_value=1e-43; Accession=PF07983.3; Description=X8 domain
  Pfam module annotation: Pfam domain module=Glyco_hydro_17::X8; Domain location=140-461::474-556
  Subcellular localization annotation: CTP_CleavageSite=56; ConfidenceScore=5.66e-01
MFGTLLLPLPFFANSFPFLPSPNKNEFVRFITTPSHCNLKISQFNGFRFCYVFLFCAFHLSQLVSIVATTQALTAVLRNIRCTMYYLLGKVVEYGTVLTRFDFCEHQFYVILDVMKLKTWLASVLLLTIAVLTNTLGAFVGVNIGTDVSDLPSASNIVGILQANQITHARLYDANAHLLQALSNTSIEVIVGVTNEEVLRIGESPSAAAAWINKNVVAYVPSTNITGIAVGSEVLSTIPNVAPVLVPAMNSLHKALVAANLNFRVKVSTPQSMDIIPKPFPPSTATFNSSWNSTIYQLLQFLKNTNSSYMLNAYPYYGYTKGDGIFPIEYALFRPLPSVKQIVDPNTLFHYNSMFDAMVDATYYSIEALNFNNIPIVVTETGWPSFGGANEPDATEENAELYINNMIQRVMNDSGPPSQPNIAINTYIYELFNEDKRNGPVSEKSWGIFYTNGSTVYPLNFGASDLITGNSSGVFCVAKDGADTDKLQSGLSWACGQGGANCAAIQPGQPCYVPNNVKSHASYAYNDYYQRKHSSGGTCDFDGTATITTKDPSKSI

SEQ ID NO: 156783 - protein, 75 aa, Glycine max
  Coding DNA Sequence Number=SeqID_40005
  Subcellular localization annotation: CTP_CleavageSite=34; ConfidenceScore=5.31e-01
MEGGNRKGYAWPVSAGFNAARAAISVKLPLHQVSLKALSSLQATVTNFATNFISSGLAGFVFFHESLSFQRRSNP

SEQ ID NO: 156784 - protein, 160 aa, Glycine max
  Coding DNA Sequence Number=SeqID_40006
  Gene Ontology: Mol. function=oxidoreductase activity; Cellular component=chloroplast; Biological process=electron transport
  Homolog annotation: Hit_ID=Q1S3K4; Match level="QueryCoverage=91%, HitCoverage=27%, E-value=1e-61, Identity=74%"; Hit description =Rieske [2Fe-2S] region
MCFRFYDRISLRKEHKLKDIGPNNWHKACFVPTKSDALVIGYRTWLRKYAGGQVDWRGKYSGALPPTPPREQLLDRYWSHVVNCKSCNSAYKSLNAVEVMLQIISVASIGIVAVMKHGTMSVAKRNSMVALAVLSFALSRWLAHFIYKNFRYHDYEHAFR

SEQ ID NO: 156785 - protein, 42 aa, Glycine max
  Coding DNA Sequence Number=SeqID_40007
MMKFVKAGVSLSKARALSESLWAKQGKSDRTGLDDCIARHRV

SEQ ID NO: 156786 - protein, 405 aa, Glycine max
  Coding DNA Sequence Number=SeqID_40008
  Gene Ontology: Mol. function=nucleic acid binding; Cellular component= intracellular
  Homolog annotation: Hit_ID=Q1RVK2; Match level="QueryCoverage=71%, HitCoverage=93%, E-value=3e-61, Identity=41%"; Hit description=TRAF -like
  Pfam annotation: Domain name=DUF1644; Domain location=45-217; Score =265.4; E_value=1.2e-76; Accession=PF07800.3; Description=Protein of unknown function (DUF1644)
MPKVRRLKSPSTDCNRPYPYPSNSKNIELHKPMNLLGSADEMKEWEQARCPICMETPHNGVLLKCSSYEKGCLPYMCNTSYRHSNCLDQFCKSFASHLSSEVLQEIPVTGRVSHSREIQSESRHPTQCGSQLQPKLICPLCRGEIYGYMVLEPARRYMNSKLRSCSSETCEFQGTYPELRKHARSEHPSVRPSEVDPSRQCDWIRMEQERGLEDLFSSIHASSDADYSRDTILTGGLADLMSSFLYEIFISIEDVNRMASLLTNSRHRVPLYDRRSGTTHRVSNDTQTNQSARWRSNLPSMHQLERIARSRERTNFPYLSSRDLELEANRTARWRTNMSSFRMPRNEHQFYRDLSAEVTSSTRMPRASQGAQTNPQSNISSSGSGRFPGRQLRWRDQRWSTNNHQ

SEQ ID NO: 156787 - protein, 367 aa, Glycine max
  Coding DNA Sequence Number=SeqID_40009
  Gene Ontology: Mol. function=oxidoreductase activity; Cellular component=chloroplast; Biological process=electron transport
  Homolog annotation: Hit_ID=Q1S3K4; Match level="QueryCoverage=98%, HitCoverage=62%, E-value=1e-149, Identity=69%"; Hit description =Rieske [2Fe-2S] region
  Pfam annotation: Domain name=Rieske; Domain location=85-184; Score =82.6; E_value=1.3e-21; Accession=PF00355.16; Description=Rieske [2Fe- 2S] domain
  Subcellular localization annotation: CTP_CleavageSite=44; ConfidenceScore=5.56e-01
MEAVCAFSVGTLHIPTAHETSNSFRKSIFLSNQVASPVSLVFLRGSSKSKLLTALSPPPLTESSNQPEAEPEFESHAEKFDWYSQWYPLMPICDLDKRKPHGKRVLGIDVVVWWDRNEGAWQVHDDACPHRLAPLSDGRIDQWGRLQCVYHGWCFNGKGECQLIPQALPDGPPVRSYYVDAWNISSGLFCDPYETQEVHTSKKACVAAYPSTVQNDILWFWPNTDPQYKDIITRKRPPFIPEIDDPSYTKSMGNRDIPYGYEVLIENLMDPAHVPYAHYGLMRTPQPKGRHISLITVKADREGGRPLDMSIEKLDINGFSANQAWGKSKFMPPCIFYAYTPDQPASSGETKKSSAKKKMCLIFVCVP

SEQ ID NO: 156788 - protein, 98 aa, Glycine max
  Coding DNA Sequence Number=SeqID_40010
  Homolog annotation: Hit_ID=Q5VNG4; Match level="QueryCoverage=53%, HitCoverage=10%, E-value=7e-09, Identity=74%"; Hit description =Putative auxin-independent growth promoter
MCRGKDNAKCSEGVPKIGKHQYSRQYAFDFVLCQNKSRRKRCWRHPTFSSSKIIIPTWQHWITSELDRDIFLLTYDGKMAKVVEGHRRYGSARNYINL

SEQ ID NO: 156789 - protein, 498 aa, Glycine max
  Coding DNA Sequence Number=SeqID_40011
  Homolog annotation: Hit_ID=Q2R9D1; Match level="QueryCoverage=68%, HitCoverage=52%, E-value=1e-63, Identity=39%"; Hit description =Expressed protein
  Pfam annotation: Domain name=DUF616; Domain location=136-444; Score =616.7; E_value=2e-182; Accession=PF04765.4; Description=Protein of unknown function (DUF616)
MEGDLQRSLSLRLNRRGDRSNQNPAKDFEVGFFSSGRVPQDYPMKIVWKKGFVRLVLVAGILWMLLILLALLFHIWSCQTSVSFLSAMCNKDSKVYNMLGNMGLVSKPHRCPIPLSNDPDKIVIPTRRTPNEILKNLSYVMEDEVPHSEAQSSPLFGGHPSWKQREESFKLKSNMKVHCGFIQGGGAEMNRVDIKYVKKCKFVVASGIFDGYDLPHQPSNISLRSKELFCFLMVVDEVSLKFMRENGTVKEDGAGGKWVGIWRLVLLKHPPYDEPRRNGKVPKILTHRLFPQAQYSIWIDGKMELIVDPLLILERYLWRGRHTFAIAQHKHHRSIYEEADSNKRRKRYARPLIDLHIKIYYYEGMKPWSSNKKTNSDVPEGAIIIREHTAINNLFSCLWFNEVHLFTPRDQLSFGYVAYRLGDAFKFFMFPNCEYNSLFVLHPHTREHSSPIEWVKQLDELKKGNLRESRGGLGLFTPYPGDLDSVVLPNVTRTSKAG

SEQ ID NO: 156790 - protein, 666 aa, Glycine max
  Coding DNA Sequence Number=SeqID_40012
  Gene Ontology: Mol. function=nucleic acid binding
  Homolog annotation: Hit_ID=Q1S3K9; Match level="QueryCoverage=99%, HitCoverage=100%, E-value=0.0, Identity=72%"; Hit description=IQ calmodulin-binding region
MGISFSCPFAKYNDVEDGLDSVVVKSINFGNDEIKTPMRSVSFKNEDLEPTILKSLGSGKMTIEASVSFKRKDIDNIISTNTLSFDKEENMPISRTSKKSKEMDDLPFKSECQLETIQSALLNPNSPKHIAALKLQKVYKSFRTRRKLADCAILVEQSWWKLLDFAELKRSSISFFEIEKHETAVSRWSRARTRAAKVGKGLSKDDKAQKLALQHWLEAIDPRHRYGHNLHFYYDRWLQSQSREPFFYWLDIGEGKEVNLEKCPRSKLQQQCIKYLGPMERLAYEVVVEDGKFFYKQTGELLNTGEDAHAKWIFVLSTSKTLYVGKKTKGSFQHSSFLAGGATSSAGRLVIENGVLKKIEFVVSFQQAVWPHSGHYRPTEENFKEFISFLQENNVSLSDVKMDPVDEADDLLSLRSSGHLRSHSSEEDFTENMNGLEIVETIIEGSVAAEKANLIETERSSVLMAPCTRRFQILGRELSNLEIPKRGHVFEGLENEIEGSEQSCVSIQMESQETTQAFVPELDHTNSDENLSDDNDVETIPQESILKRINSHKEMKSYQLGKQLSCKWTTGAGPRIGCVRDYPCELQFRALEQVNLSPRSGSRSKSSFAPRSTTLLSSSLSNVASLCGNLTIEPLHMPQRGESNSSGSKCSPLIRGSSVIPVIHSS

SEQ ID NO: 156791 - protein, 53 aa, Glycine max
  Coding DNA Sequence Number=SeqID_40013
MSSKRSRKKLRGCWRLNLSTLLGEFLDFFINHKGAEIDQNKTKVILETSPPQE

SEQ ID NO: 156792 - protein, 93 aa, Glycine max
  Coding DNA Sequence Number=SeqID_40014
  Gene Ontology: Mol. function=aminoacyl-tRNA hydrolase activity; Cellular component=ribonucleoprotein complex; Biological process =mRNA processing
  Homolog annotation: Hit_ID=Q10LI6; Match level="QueryCoverage=94%, HitCoverage=47%, E-value=1e-28, Identity=70%"; Hit description =Peptidyl-tRNA hydrolase, putative, expressed
  Pfam annotation: Domain name=Pept_tRNA_hydro; Domain location=1-92; Score=-33.7; E_value=7.4e-06; Accession=PF01195.10; Description =Peptidyl-tRNA hydrolase
MIDAFAESQGIPMDTVHSKAISGKGFVGEVPVFLAKPQTYMNLSGESTGPLAAYYKLPLNQVLVFHDDMNLPCGVLRLHDKGGHGSHKGYNTK

SEQ ID NO: 156793 - protein, 62 aa, Glycine max
  Coding DNA Sequence Number=SeqID_40015
MDPGHPATSSTINIHVYWYRKLPLPKVENLLENAEATTDVPYNVIQYLKKAYDDLEEPFVKK

SEQ ID NO: 156794 - protein, 76 aa, Glycine max
  Coding DNA Sequence Number=SeqID_40016
MPKIKKKQAYAIRENSVMGVQIAIRPAWAFQILPPEGCCFWRKQPCSPGEKGFSLLGTSYSLEIAEENHLREEIQA

SEQ ID NO: 156795 - protein, 238 aa, Glycine max
  Coding DNA Sequence Number=SeqID_40017
MPGTDMQTIFLAGKSFRKGMEVERRNWHKELTNFSEGSIDVAIVKEFYANLYDPEDKSLKQVRVRGNLIKFDVDALNTILKTPVVIEEGESLPAYSRFANQRPVPEELAAHLCLPGRGFELNADGLPLKILRKNLTTLAQTWSVLSFSNLATTSHTSDITLDMAKLICGLVMKMDIKLGSLISELRAFLVYAAKPASGPTPNHAEFARCGLAAASYECRGVSSGGGLAKSPAFSFGRG

SEQ ID NO: 156796 - protein, 263 aa, Glycine max
  Coding DNA Sequence Number=SeqID_40018
  Gene Ontology: Mol. function=transferase activity, transferring nitrogenous groups; Cellular component=cellular_component; Biological process=amino acid and derivative metabolic process
  Homolog annotation: Hit_ID=Q4ZJF7; Match level="QueryCoverage=81%, HitCoverage=50%, E-value=1e-95, Identity=79%"; Hit description =Tyrosine aminotransferase
  Pfam annotation: Domain name=Aminotran_1_2; Domain location=5-247; Score=-90.7; E_value=0.0078; Accession=PF00155.11; Description =Aminotransferase class I and II
MLAKTSLTDVNQNSLGNNDKKISLVNVDKNSHDPRQSKNSPANIAETAKRVGTIVIADEVYGHLAFAGKPFVPMGVFGSIVPVLTLGSFSKRWIVPGWRLGWFVTNDPSGTFRNPKVDERFKKYFDLLGGPATFIQAAVPQIIEHTEKVFFKKTIDNLRHVADICCKELKDIPYIICPYKPEGSMAMMVKLNLSLLEDISDDIDFCFKLAKEESVIILPGTAVGLNNWLRIIFATDPVALVEGLKRVKSFCERHARKWSMTTE

SEQ ID NO: 156797 - protein, 359 aa, Glycine max
  Coding DNA Sequence Number=SeqID_40019
  Gene Ontology: Mol. function=binding; Cellular component=nuclear pore; Biological process=protein import into nucleus, docking
  Homolog annotation: Hit_ID=Q2HVN9; Match level="QueryCoverage=86%, HitCoverage=27%, E-value=1e-124, Identity=72%"; Hit description =Armadillo-like helical
  Pfam annotation: Domain name=HEAT; Domain location=161-197; Score =32.3; E_value=1.6e-06; Accession=PF02985.12; Description=HEAT repeat
  Pfam annotation: Domain name=HEAT; Domain location=206-244; Score =0.8; E_value=34; Accession=PF02985.12; Description=HEAT repeat
  Pfam module annotation: Pfam domain module=HEAT::HEAT; Domain location=161-197::206-244
MQKIGVPSCEGDCICSFTLAQPFMMSPYIISLGGPSKEILISGMLLDESQVRSIVDEIKQVITASSSRKRERAERTRAEDFDAEEGELIKEENEQEEEVFDQVGEILGTLIKTFKANFLPFFDELSSYLTPMWGRDKTPEERRIAICIFDDVAEQCREAAVKYYDTYLPFLLEACNDETPDVRQAAVYGLGVCAEFGGSVFKPLVGEALSRLNAVIQHPNALHSDNVMAYDNAVSALGKICQFHRDSIDSAQVVPAWLNCLPIKGDLIEAKVVHDQLCSMAERSDSELLGPNNQYLPKIVSVFAEVLCAGKDLATEQTAGRMVNLLRQLQQTLPPSTLASTWSSLQPQQQLALQSILST

SEQ ID NO: 156798 - protein, 113 aa, Glycine max
  Coding DNA Sequence Number=SeqID_40020
  Homolog annotation: Hit_ID=Q1S8V6; Match level="QueryCoverage=45%, HitCoverage=8%, E-value=8e-15, Identity=75%"; Hit description =Helicase, C-terminal
MFGLWYFNYFELCQQALTLVFVETKKGADSLEHWLCLNGFPATTIHGDRSQQCRVPRRRCTRHANGYDSGATRCPLPPPSPDMVGRRKRAIGRGPPRGHARLDAAQQDISLFI

SEQ ID NO: 156799 - protein, 635 aa, Glycine max
  Coding DNA Sequence Number=SeqID_40021
  Homolog annotation: Hit_ID=Q1RZ38; Match level="QueryCoverage=61%, HitCoverage=88%, E-value=0.0, Identity=90%"; Hit description=Cyclin -like F-box; Serine/threonine protein phosphatase, BSU1
  Pfam annotation: Domain name=F-box; Domain location=65-112; Score =34.5; E_value=3.7e-07; Accession=PF00646.23; Description=F-box domain
  Pfam annotation: Domain name=Kelch_1; Domain location=156-202; Score =35.2; E_value=2.3e-07; Accession=PF01344.15; Description=Kelch motif
  Pfam annotation: Domain name=Kelch_1; Domain location=204-251; Score =53.4; E_value=7.4e-13; Accession=PF01344.15; Description=Kelch motif
  Pfam annotation: Domain name=Kelch_2; Domain location=156-202; Score =9.0; E_value=2.5; Accession=PF07646.5; Description=Kelch motif
  Pfam annotation: Domain name=Kelch_2; Domain location=204-251; Score =17.9; E_value=0.038; Accession=PF07646.5; Description=Kelch motif
  Pfam module annotation: Pfam domain module=F-box::Kelch_1::Kelch _1::Kelch_2::Kelch_2; Domain location=65-112::156-202::204-251::156 -202::204-251
MAFVQHFHQEVDSVSCYCKVDSGLKTVVGARKFVPGSKLCIQPDINPNAHRSKNSRRERTRVQPPLLPGLPDDLAIACLIRVPRVEHSKLRLVCKRWYRLLSGNFFYSLRRSLGMAEEWVYVIKRDRDGRISLHAFDPIYQLWQSLPPVPGEYSEALGFGCAVLSGCHLYLFGGRDPLKGSMRRVIFYNARTNKWHRAPDMLRKRHLFGSCVINNCLYVAGGECEGIQRTLRSAEVYDPNRNRWSFISEMTTAMVPFIGVVHNGTWFLKGLGSNRNVICESYSQETDTWTPVSNGMVNGWRNPSISLNGQLYALDCQDGCKLKVYDRATDSWKKFIDSKLHLGSSHALDAAALVPLNGKLCIIRNNMSISLVDVLSSNRRVESNPQLWENIAGKGHVRFFKPEIQTPLMIILAIQLGKLLVFWENQIETGLSTFLCGKEIVLHCKDELFAAVVDECISHFVDVIFLILINYLSAHQWLLPIVTFIAAPLVGAAATATEKPQIQIHFPELGLVAEQCIEMSWIDSVLFWDNYPVGTSVDVLLQRHNTQEKYLKKKSDYVQQPISKTGLEGIWNKMMELEKPVLALNPYGGKMGEISEVETPFPPRAGVNGPGNANHAEARVWGKKYFKRNFDRLVE

SEQ ID NO: 156800 - protein, 60 aa, Glycine max
  Coding DNA Sequence Number=SeqID_40022
MNKNYNNPIQEKKNQTLRGTRLEKGVKDYGQEEELFNSRGNREEEEDDDKKEYAKRLDRF

SEQ ID NO: 156801 - protein, 204 aa, Glycine max
  Coding DNA Sequence Number=SeqID_40023
  Gene Ontology: Mol. function=sugar porter activity; Cellular component=integral to membrane; Biological process=carbohydrate transport
  Homolog annotation: Hit_ID=Q945E5; Match level="QueryCoverage=81%, HitCoverage=28%, E-value=5e-31, Identity=42%"; Hit description =Putative sugar transporter
MAYEASWNDVVMYYILEVYKEVGIKVEKQLFGVTIVIGISKTCFILISTLFLDQDGRRPMLLLGSCSMAISLFVLGLGCTLLKLCGDNKDQWVIALWVVAVYVAVSCFCIGRGLTTWVYSSKIFPLRLMAQGSNLAIFVNRLISGIVSMTFLSVLEAITFGGMLFVLGGVMTPKAKGKRRLKRCLKIKCIESESKVYIKAFIFL

SEQ ID NO: 156802 - protein, 56 aa, Glycine max
  Coding DNA Sequence Number=SeqID_40024
LPASAFLFITFSSVKNITSQVTASHDSTEILWHILGPLPTLPPHFLTLEFGRERKY

SEQ ID NO: 156803 - protein, 101 aa, Glycine max
  Coding DNA Sequence Number=SeqID_40025
  Homolog annotation: Hit_ID=Q1SDN9; Match level="QueryCoverage=57%, HitCoverage=50%, E-value=3e-07, Identity=37%"; Hit description =Polynucleotidyl transferase, Ribonuclease H fold
MVLRMNGTCSLDVIMQFLFGNYLDFGIKVSRRFIKARAQWSIGEPSPTEVEAWALLQGLTWVQQLRYQNIIIELDCKAVVDDLMYCNGNKTYEIIFIRKLR

SEQ ID NO: 156804 - protein, 399 aa, Glycine max
  Coding DNA Sequence Number=SeqID_40026
  Gene Ontology: Mol. function=protein serine/threonine kinase activity; Cellular component=nucleus; Biological process=protein amino acid phosphorylation
  Homolog annotation: Hit_ID=Q9XF95; Match level="QueryCoverage=92%, HitCoverage=100%, E-value=0.0, Identity=88%"; Hit description =Putative mitogen-activated protein kinase MAPK
  Pfam annotation: Domain name=Pkinase; Domain location=63-350; Score =322.0; E_value=1e-93; Accession=PF00069.15; Description=Protein kinase domain
  Pfam annotation: Domain name=Pkinase_Tyr; Domain location=63-345; Score=11.1; E_value=3.8e-13; Accession=PF07714.7; Description =Protein tyrosine kinase
  Pfam module annotation: Pfam domain module=Pkinase::Pkinase_Tyr; Domain location=63-350::63-345
MSKKMGLVRIGSKKRQGDIKRSKPRCRNSKEMATLVEPPNRIKPKGKHYYTIWQTLFEIDTKYVPIKPIGRGAYGVVCSSINRETNEKVAIKKIGNIFENSIDALRTLRELKLLRHIRHENVIALKDVMMPIHRTSFKDVYLVYELMDTDLHQIIKSSQPLSNDHCKYFLFQLLRGLKYLHSANILHRDLKPGNLLVNANCDLKICDFGLARTNGVDGQFMTEYVVTRWYRAPELLLCCDNYGTSIDVWSVGCIFAEILGRKPIFPGTECLNQLKLIISVLGSQHESHLEFIDNAKARRFIKSLPCTRGRHFSQLYPQADPLAIDLLQKMLLFDPTKRITVLEALQHPYMAGLYDPRCNPPAQVPISLDIDEHWGEPMIREMMWNEMLHYHPEAASTNA

SEQ ID NO: 156805 - protein, 596 aa, Glycine max
  Coding DNA Sequence Number=SeqID_40027
  Gene Ontology: Mol. function=binding; Cellular component =intracellular; Biological process=protein kinase C activation
  Homolog annotation: Hit_ID=Q9FFG8; Match level="QueryCoverage=96%, HitCoverage=91%, E-value=0.0, Identity=46%"; Hit description =Selenium-binding protein-like
  Pfam annotation: Domain name=PPR; Domain location=125-159; Score =13.6; E_value=0.18; Accession=PF01535.11; Description=PPR repeat
  Pfam annotation: Domain name=PPR; Domain location=187-221; Score =38.2; E_value=2.9e-08; Accession=PF01535.11; Description=PPR repeat
  Pfam annotation: Domain name=PPR; Domain location=290-324; Score =40.4; E_value=6.1e-09; Accession=PF01535.11; Description=PPR repeat
  Pfam annotation: Domain name=PPR; Domain location=325-359; Score =11.0; E_value=0.37; Accession=PF01535.11; Description=PPR repeat
  Pfam annotation: Domain name=PPR; Domain location=361-395; Score=1.8; E_value=4.6; Accession=PF01535.11; Description=PPR repeat
  Pfam annotation: Domain name=PPR; Domain location=427-461; Score=7.5; E_value=0.96; Accession=PF01535.11; Description=PPR repeat
  Pfam module annotation: Pfam domain module=PPR::PPR::PPR::PPR::PPR::PP R; Domain location=125-159::187-221::290-324::325-359::361-395::427 -461
HGCAKGFGVGSGENPGEMQQPESGERSPRPNLHKEPPAIFLRTHQAPPPRHRPPPRPPPLLPSPSLLTAPHPKPLRLDRSHSRLRSPRTPLPSPELLLLHAETTRQSHLLHAQTLLLGGFSSDLYVNNAVIDMYVKCGSLRCARMVFDEMPERDVISWTGLIVAYTRIGDMRAARDLFDGLPVKDMVTWTAMVTGYAQNAMPMDALEVFRRLRDEGVEIDEVTLVGVISACAQLGASKYANWIRDIAESSGFGVGDNVLVGSALIDMYSKCGNVEEAYDVFKGMRERNVFSYSSMIVGFAIHGRARAAIKLFYDMLETGVKPNHVTFVGVLTACSHAGLVDQGQQLFASMEKCYGVAPTAELYACMTDLLSRAGYLEKALQLVETMPMESDGAVWGALLGASHVHGNPDVAEIASKRLFELEPDNIGNYLLLSNTYASAGRWDDVSKVRKLLREKNLKKNPGWSWVEAKNGMIHKFVAGDVSHPKINEIKKELNDLLERLKGIGYQPNLSSLPYGINDREKRLLLMAHSEKLALAFGLLSTDVGSTIKIMKNLRICEDCHIVMCGASKVTGRKIVVRDNTRFHHFLNGACSCSNFW

SEQ ID NO: 156806 - protein, 198 aa, Glycine max
  Coding DNA Sequence Number=SeqID_40028
  Gene Ontology: Mol. function=transcription factor activity; Cellular component=nucleus; Biological process=regulation of transcription, DNA-dependent
  Homolog annotation: Hit_ID=O23112; Match level="QueryCoverage=50%, HitCoverage=38%, E-value=1e-19, Identity=52%"; Hit description=AP2 domain containing protein RAP2.11
  Pfam annotation: Domain name=AP2; Domain location=22-86; Score=129.7; E_value=7.9e-36; Accession=PF00847.10; Description=AP2 domain
MEYQNQRAKEGRFCEKLKIKNRPKFVGVRQRASGKWAAEIKDTSKKIRLWLGTYQTAEEAARAYDEAACLLRGSNTRTNFSTQGCGVATNSPISLKLRNLLDRKAMSNQSQSQIQRQSSMISSTFQGADTSASPNVSAINKIMVMENYSACSSEGISNKIFGTMVLCPECNNSFQLLKVNPLDILQARDHLQSHPISV

SEQ ID NO: 156807 - protein, 319 aa, Glycine max
  Coding DNA Sequence Number=SeqID_40029
  Gene Ontology: Mol. function=binding; Cellular component=membrane; Biological process=transport
  Homolog annotation: Hit_ID=Q1S3Z5; Match level="QueryCoverage=65%, HitCoverage=70%, E-value=1e-103, Identity=90%"; Hit description =Mitochondrial carrier protein
  Pfam annotation: Domain name=Mito_carr; Domain location=166-261; Score=108.2; E_value=2.3e-29; Accession=PF00153.17; Description =Mitochondrial carrier protein
  Pfam annotation: Domain name=Mito_carr; Domain location=75-160; Score= 69.2; E_value=1.3e-17; Accession=PF00153.17; Description =Mitochondrial carrier protein
  Pfam module annotation: Pfam domain module=Mito_carr::Mito_carr; Domain location=166-261::75-160
  Subcellular localization annotation: CTP_CleavageSite=69; ConfidenceScore=5.50e-01
MTNMDLIGFRKLQECQAKVSPNTYSPLPRARTTTIALLPRSPSFSSSSLNPFFYLTNTTMGDEKKGKPAASGVWSTIKPFVNGGASGMLATCVIQPIDMIKVRIQLGQGSAAQVTSTMLKNEGFAAFYKGLSAGLLRQATYTTARLGSFKILTAKAIEANDGKPLPLYQKALCGLTAGAIGATVGSPADLALIRMQADATLPAAQRRNYTNAFHALYRITADEGVLALWKGAGPTVVRAMALNMGMLASYDQSVEFFRDSVGLGEAATVLVVYAPIDPLVDLTTLKQNDLVKPYNSWVVFHIHCHYFICQKLNSCQQIQ

SEQ ID NO: 156808 - protein, 458 aa, Glycine max
  Coding DNA Sequence Number=SeqID_40030
  Gene Ontology: Mol. function=catalytic activity; Cellular component =cytoplasm; Biological process=metabolic process
  Homolog annotation: Hit_ID=Q1RZ28; Match level="QueryCoverage=93%, HitCoverage=71%, E-value=0.0, Identity=84%"; Hit description=AMP -dependent synthetase and ligase
  Pfam annotation: Domain name=AMP-binding; Domain location=3-374; Score=-4.0; E_value=2e-07; Accession=PF00501.18; Description=AMP -binding enzyme
METKLIYCGARCTKDLWLFFKHIDHVSPCSRVIEAATCKVIVLPVMGEDVGVQLREQDLSWKGFLSSANQTQNPRSDHYSPSYQSVDSVTNILFSSGTTGDPKAIPWTQLAPIRSAADGWAAIDIKPGDVYCWPTNLGWVIGPTVLYHCFLTGATLALYHGSPQGRDFGKFVQDAGVTILGTVPSLVKAWKSTQCMEGLDWTKIKTFCSSGETSNVDDDLWLSSKAYYSPIVELCGGTELASSYIAGSPLQPQAFGAFSTASMTTGFVILDENGVPYPDDVACVGEVGLFPLSLGASDRLLNADHEKVYFKGMPIYKEKILRRHGDIIKRTVDGYIVVQGRADDTMNLGGIKTSSVEIERVCDGADECILETAAVGVAIANRGPEQLVIFVVLKEGYNSSAETLKMKFTKAIQSNLNPLFKVSLVKIVPDFPRTSSNKILRRVMRDQMKLQLSVQSRL

SEQ ID NO: 156809 - protein, 311 aa, Glycine max
  Coding DNA Sequence Number=SeqID_40031
  Gene Ontology: Mol. function=catalytic activity; Biological process =metabolic process
  Homolog annotation: Hit_ID=Q9C8A3; Match level="QueryCoverage=95%, HitCoverage=11%, E-value=1e-102, Identity=61%"; Hit description =Acetyl-CoA synthetase, putative; 45051-31547
MGKSVGELGVEELVNAGGLRVEEGNELYHALRDILSEFQSPSHIWRQIVTRRLLKPSYPHSLHQLLYYSVYHSQHSSLPLYCFPSLDQSKRSNLGRLMEKHGPELLGPSYKDPITSYPLFHKFSVQHPQLYWSLVLKELSVSFVEPPKCILDTSDPSKHGGTWLPGSVLNIADCCLQPSSHPHKTDDTLAIVWRDEGFDDSEVNHITLKQLRHQVMLVAKAIDATFSRGDAIAIDMQMTANAVIIYLAIVLAGCAVVSIADSFAPKEIATRLRVSKAKGIFTQDFIARGGRKFPLYSIPSNPFLSHLPNPA

SEQ ID NO: 156810 - protein, 58 aa, Glycine max
  Coding DNA Sequence Number=SeqID_40032
  Gene Ontology: Mol. function=drug transporter activity; Cellular component=membrane; Biological process=multidrug transport
  Homolog annotation: Hit_ID=Q1SD91; Match level="QueryCoverage=98%, HitCoverage=14%, E-value=3e-16, Identity=60%"; Hit description=Multi antimicrobial extrusion protein MatE
MAPNEMESLEAGQRSLNAKKEKPFHVSGHQSHYAKIVEIIALGIPYLNCMVNSQERDT

SEQ ID NO: 156811 - protein, 1027 aa, Glycine max
  Coding DNA Sequence Number=SeqID_40033
  Gene Ontology: Mol. function=actin binding; Cellular component =cytoskeleton
  Homolog annotation: Hit_ID=Q5QNA6; Match level="QueryCoverage=74%, HitCoverage=60%, E-value=2e-44, Identity=25%"; Hit description=SCAR -like protein 2
RNRAQTDDIDSEPDNYVDALNTIESESENDIDYITKREVQQLSSRVTCGMIENGVSEAPPNLMDNNLSDVVFQTDYTVLLNEEQGHLADSLQENHVLDLLSKPNASNLGYVSPSDDLDRENMTRDTASLNKEPFRDLPDSLQDIPPLTSEPHVSNLGPVSPSDVLYSEEMTRDTICFNKEMFGNLPDSLQEISPLTSEPHASNLGLGNPSDVPYGEEMTRDTVFFNKETFGNLPNLQEIPPPTVEPHTSNLGPVNPSNSPHSEEMTTDTVSLNKEMLANLPNSLQETPALTLEPLASNLAFVSPSDISVSKEIAKNIADSHPSKTPACEQVPRPSENSVLDNSVCTDSYIGSSTVNDTVSAPIETDISFSGSKNSNLPDEEAGKINNNICKSEETHRESLADHSVRFWTNGGLLGLEPSKPPDFNKSTSLGQGSLSTKSETDGGSHHNSMQKSNGYKEEWESSEEVAEQILKEPNSRFLTSGHNDDQACVSEKATGNSQQSNGFGQTERDNLGEIRVIAPGSILPSTPDTKDSTEPNQGNGENSSRVFGLSRRLLINSFQRKVSFDEKSEHYNSLKSVILDQSGQNGIVGPSLPETTSSKEKVGSGYPIKSLPPSPPLEHMKISFHPVSGLETSKLKLRFPDGSNHHESVNDMFPSFQLVPEASLPLDGSVSHSDDDDTFCRSSPYISDDGQSPRSDYNSDQWESDETPESSDQGVHDSPCRRSSTESVSNDDTNAKSGHGTCTMNGVEHSLSRPLLDFPSYDNVNPALEKESKKHSKCNNAVMSHSHAEPAQPPPPPPLPPTQWRVSKPQLDMTSGTQYCMSEDAEHIGDHSLPDSTILQQPRVTQVEQIQINHDDHESYDNIIYKLKDKLDQQKLKGQKEANQLRMGKEIDEREDFLYQIRTKAFNLRPTVSGKSNDTTGSTANVKVTAILEKANAIRQVVASDDGEDDDNWSYPTNCCPPKASAIGKSNLNSEIRVEFAAQAEFQKYIYVKVEDPQLAPKNQVVHHVSSRRFVASAAAPLCPRG

SEQ ID NO: 156812 - protein, 79 aa, Glycine max
  Coding DNA Sequence Number=SeqID_40034
  Subcellular localization annotation: CTP_CleavageSite=52; ConfidenceScore=5.14e-01
MSSVRVPFMSKVRSHRKKATVWSHLTDPNQSFYHTTLSGHTMISVQEWLAKLAMSLFSLTSPIRTLNLLSHSSSLLFGS

SEQ ID NO: 156813 - protein, 197 aa, Glycine max
  Coding DNA Sequence Number=SeqID_40035
  Gene Ontology: Mol. function=actin binding; Cellular component =cytoskeleton
  Homolog annotation: Hit_ID=Q9LP46; Match level="QueryCoverage=54%, HitCoverage=10%, E-value=2e-40, Identity=66%"; Hit description =Protein SCAR3
MTTASRSHRLMVQVQNIEASLPALEKAVLAQTSHIHLAYTAGCEWHPRMKAARNHFIYNDLPHFIMDSYEECRDPPRVHLLDKFDTGGPGSCFRRYSDPTFFKRVSADSDESYSGKTEKARKSHKSKKKRSRRNGDILRSEQRHSTSGRYYIYICLFNLGILVHSKSTLTYYIDYPECNLFLLLSVGKPLPHKQPPP

SEQ ID NO: 156814 - protein, 67 aa, Glycine max
  Coding DNA Sequence Number=SeqID_40036
MAVIKSLKTGARVEDLVLDREVTFKLFEKAICPCKVAQVVVIRTRVGIFPKTQIIVFDLPSGKCFAP

SEQ ID NO: 156815 - protein, 188 aa, Glycine max
  Coding DNA Sequence Number=SeqID_40037
SPSVVKRTRKALHLQSLSTRPPGADRPVVHVDPTTGKADDPHRKKLRTYLGIVARDKVDVTYENWKEVLTAQKDLIWKDIHVEFEIPEASDSRTKKKLLQTVGERWRQFKSDLTRKWALAADQDGVDDTDVRKKAQAIQKQNTAPHVSSNTLDWLHGRPVALPPCLLKNYNSRPSKSGTSYRSPSQKT

SEQ ID NO: 156816 - protein, 98 aa, Glycine max
  Coding DNA Sequence Number=SeqID_40038
MSRGSGDLGDVRWGAIAQNQAWLIPTQPGHSQSVRTCDVPKQASSWQSTNKRTKSTKQGGLCGDWPAMYLGWYLRISLWALVIDYQMGVIDYTVLPAT

SEQ ID NO: 156817 - protein, 245 aa, Glycine max
  Coding DNA Sequence Number=SeqID_40039
  Homolog annotation: Hit_ID=Q3GTM9; Match level="QueryCoverage=48%, HitCoverage=45%, E-value=2e-23, Identity=46%"; Hit description=Short- chain dehydrogenase/reductase SDR
  Subcellular localization annotation: CTP_CleavageSite=52; ConfidenceScore=5.39e-01
MWGLSSKPDGCDSSRDRPQSHGRRSRRTPFAPGTAGRWGVGQRVLRRGDDRRAGRVRALRGGQGRSRCAHQGARHRSRGAAGQGRRSRPWHDRHGGSRRGHQLRAFRRRQLRVRDHDPRGRRGVAAGARPGESARPLEPTASVFSRAASAAVPSSGSRGRSTSHRRLRHCPALGNARVRVAVTRPRRRSSSIRAPCGERACPRRVGVPAGVRGSARSRPRTRPGPLEPCPRRPGAGVRRCRRRQR

SEQ ID NO: 156818 - protein, 122 aa, Glycine max
  Coding DNA Sequence Number=SeqID_40040
MINANYPQESLHPISNGNLRIDFHKRFCKYNFEERTCRSDGTEWRSLKWLELQQERSEQKSPETTVPVELTEASGETVVSGNCVSEERNWKEAVVFLFLDMECWLEEGCSMAAIVREQRIHT

SEQ ID NO: 156819 - protein, 139 aa, Glycine max
  Coding DNA Sequence Number=SeqID_40041
  Gene Ontology: Mol. function=amino acid transporter activity; Cellular component=integral to membrane; Biological process=amino acid transport
  Homolog annotation: Hit_ID=Q7N104; Match level="QueryCoverage=100%, HitCoverage=27%, E-value=9e-52, Identity=71%"; Hit description =Aminobenzoyl-glutamate transport protein
  Pfam annotation: Domain name=ABG_transport; Domain location=1-139; Score=-261.7; E_value=1.5e-09; Accession=PF03806.4; Description=AbgT putative transporter family
MALLVVPEHAPLRNPKTGGIIPSPFIQGIVPIIILFFFVVAIAYGAVTQQIRRADDIPRLLVDPMKSMAGFIVMVFPLSQFVAFFNWSNMGKFMAIGLTDMLESAGISGAPAFLGLMFLSAFLCMFIASGSAIWSILAP

SEQ ID NO: 156820 - protein, 180 aa, Glycine max
  Coding DNA Sequence Number=SeqID_40042
  Gene Ontology: Mol. function=amino acid transporter activity; Cellular component=integral to membrane; Biological process=amino acid transport
  Homolog annotation: Hit_ID=Q7N104; Match level="QueryCoverage=100%, HitCoverage=35%, E-value=6e-74, Identity=78%"; Hit description =Aminobenzoyl-glutamate transport protein
MAAVPDGQARFDKFIGQQRAGHGQYDDRAGHEEPVIDHADMDRVADRFGGLCTDAGEQYVGGDDQQIRGKTRCDAGNRRQQARDRMTPDGKEDQRAERRHHHQCGIGRDMAEERDKQHHIAGVATADARRHFHHQRLQQPDFFRQPGPDHQRQNGAQWGEAAEVFDDVGQDPLNARHAEQ

SEQ ID NO: 156821 - protein, 129 aa, Glycine max
  Coding DNA Sequence Number=SeqID_40043
MKKRYRGHQSVSLENKTGDSSVVKMSEKNNNVDAGDCMILDEHEGEEHCCGKGTNARSVSFLPRSQEKIGDLAKVVIKQDMKGGEHKYGFNNNKREKPEKVRVVDDETGDKHELYEVLRMPSRCVFFKI

SEQ ID NO: 156822 - protein, 94 aa, Glycine max
  Coding DNA Sequence Number=SeqID_40044
RKDGSQNIAIVTVSGLRETGLDAYRTKIVSIYAQTIHIGGKLEASIVPRGTLECYDGVFQALYVPPLAFSSPGPLLDQGKIPKKCAEQNSSIML

SEQ ID NO: 156823 - protein, 123 aa, Glycine max
  Coding DNA Sequence Number=SeqID_40045
  Gene Ontology: Mol. function=structural constituent of ribosome; Cellular component=ribonucleoprotein complex; Biological process =translation
  Homolog annotation: Hit_ID=Q2MI98; Match level="QueryCoverage=98%, HitCoverage=72%, E-value=4e-52, Identity=73%"; Hit description =Chloroplast 30S ribosomal protein S4
  Pfam annotation: Domain name=Ribosomal_S4; Domain location=2-65; Score=43.2; E_value=8.8e-10; Accession=PF00163.9; Description =Ribosomal protein S4S9 N-terminal domain
  Pfam annotation: Domain name=S4; Domain location=66-113; Score=91.3; E_value=2.9e-24; Accession=PF01479.15; Description=S4 domain
  Pfam module annotation: Pfam domain module=Ribosomal_S4::S4; Domain location=2-65::66-113
  Subcellular localization annotation: CTP_CleavageSite=47; ConfidenceScore=5.01e-01
MSRYRGPRFKKIRRLGSLPGLTSKRPTVKSELRNQSRSKRQLLKYVRIAGKAKGSTGQVLLQLLEMRLDNILFRLGMAATIPQARQLINHRHVLVNGHIVDIPSYRCKPQDIITAKDEQKSKL

SEQ ID NO: 156824 - protein, 158 aa, Glycine max
  Coding DNA Sequence Number=SeqID_40046
MMVSSPPTLTYYQTTSVPLTLYSCITKTGPRMTDVVVVDIQRHLEQRRCGARRRYRFSTDNKAFEVVLLAVPENDEKWGEKIVARVSSKSLAEITEHYQKLVNNVVLIESSEGSEKTTQEKHHGNLVTREHNATQKSQEMAQEIMLKLMMQNSVVANK

SEQ ID NO: 156825 - protein, 110 aa, Glycine max
  Coding DNA Sequence Number=SeqID_40047
  Homolog annotation: Hit_ID=Q681X6; Match level="QueryCoverage=94%, HitCoverage=31%, E-value=4e-10, Identity=33%"; Hit description=MRNA, complete cds, clone: RAFL21-92-C23
MTADTTTESYWLNWRVLVCAILVLFSAIISSLIVLKYEVSRKKARNGDKEGLNLKETSSTLYEDEIWRPCLKGIHPVWLLGFRVFAFVVLLVLLILTATEDGGSIFYFYT

SEQ ID NO: 156826 - protein, 104 aa, Glycine max
  Coding DNA Sequence Number=SeqID_40048
  Subcellular localization annotation: CTP_CleavageSite=49; ConfidenceScore=5.62e-01
MLPPSSVAVSMRSTKSTTKAKTLNPSNQTGWIPFKQGLQISSSHNGLPRAFGRASHKPHFVLLQILSVRKTEKRDQGQGTFVFGFCIGMLRAKMLHVFQEWFFA

SEQ ID NO: 156827 - protein, 1316 aa, Glycine max
  Coding DNA Sequence Number=SeqID_40049
  Gene Ontology: Mol. function=calcium ion binding; Cellular component =extracellular region; Biological process=pathogenesis
  Homolog annotation: Hit_ID=Q8XQP2; Match level="QueryCoverage=86%, HitCoverage=97%, E-value=0.0, Identity=42%"; Hit description =Probable hemagglutinin/hemolysin-related protein
  Pfam annotation: Domain name=HYR; Domain location=1219-1291; Score= -7.9; E_value=0.099; Accession=PF02494.7; Description=HYR domain
MDAIKLITARDIDKMNNISVTPKGGTIATEVSGNQVNLTAPSVVKLNLNQADIKSFTRNGSDLVVTTKSGEVVVIHKFYDANGDSDLVLQDDKGALWWVEDPGTEGFQFVSIDSTEGLLAENVTGDGTLTAFGIAGAALAGIGALIAGNNGGGGGGGGDNGGGDNGGGGDTTAPAAVSDLLITDNAGSVQGAITGGTSTDDNTPTLSGTAEAGTIVSIYDGTTLLGTVTVGADGRWSFTTPALGEGKHSLTVTVTDAAGNTSPATSPVDFTVDTQPPAVATDVSLTNNSGGSTTPVPNGSSSDDNTPTLSGRGEAGAVVSVYDGQTLLGTALVGANGNWSFTTPALSNGSHSLTVTLTDAAGNVSAASSPFVVTIQAGLPSTSSSLQITDDSDATLRTLSDGASTKDSTPVLSGLASANAVITLYNGTTLLGSTIADGSGQWRFTPATLADGTYAFRAVATDAAGNVTTSVTLTVTIDTVAPGAAGDLLLTGDSNGSVTPIAAGGSSNDNTLVLSGTAEAGSTVTVRDGNVVLGTAIVASNGSWSFTTPALSDGNHSLTTTVTDSAGNTGPASAAIVVTVDTTAPAAIGDLQVIDNVGASQGPLTSGATTDDNTPTLSGSGEAGALISIYDGSTLLGNTLVGANGSWSFTTPALSNGSHSLTVTQTDAAGNVSSATAEFVVNVDAALPPASASIELVGDSGNTLVSLQNGAVTNDDSPILAGLTRAGSLVRIFDGGDLLGSTTADGNGQWSFALSNLSEGGHAFSATITDVDGNVIDTVTLNITVDTTPPAAASDLALLNDAGSTAQPVTGGSAINDATPLLSGTAEAGSIVTIRDGNTVLGSVSVGSNGSWSFTTPALGEGNHSLSTTVTDAAGNVSPASTPIAFSVDTIAPAAVSGLQVTDNAGSATGALASGQTTDDRTPTLSGSAEAGAVVRIYDGTTLLGSVTAGSNGSWSFTPDALTNGQHSLTTTVTDAAGNVSPASPVFTVNIEAGVPATSSLLIVTDDNGSTLVELANNDSTTDSTPILSGQAGAGDLVTLYNGSTVLGSVVAGSNGQWSFTPAALADGTYAFRASADNGSGTVTDSPVITITIDTVAPAAPTGIQLTNDDGDPLGTGSTNVSAPTLSGSGEAGGVVIISDGGTVIGSTTVGNDGNWSFTTPSLSDGSHSLTSTVTDAAGNTGPASTPVTVTVDTQAPAAAGNLQLSNGDGTPIAAGGSTNDTTPTLSGTAEPGSTVTVSDGDTVLGTATAGSDGSWSFTPTDPLSEGQHNLTSTVTDTAGNTGPGSTAVIVIVDTSAPLWPASCCSANDQSGHTGC

SEQ ID NO: 156828 - protein, 95 aa, Glycine max
  Coding DNA Sequence Number=SeqID_40050
MKKLPDFAATAPDGNFLILLILPQQVTVRLTELSRRSCRDNYRSAENFDERKEQNWKWKGVPARQNGAVNRRERKCGSLFLSPPAPANSMRKRSG

SEQ ID NO: 156829 - protein, 548 aa, Glycine max
  Coding DNA Sequence Number=SeqID_40051
  Gene Ontology: Cellular component=peroxisome
  Homolog annotation: Hit_ID=Q9FXT6; Match level="QueryCoverage=72%, HitCoverage=74%, E-value=1e-64, Identity=39%"; Hit description=PEX14 protein
  Pfam annotation: Domain name=Pex14_N; Domain location=74-206; Score =38.5; E_value=2.2e-08; Accession=PF04695.4; Description=Peroxisomal membrane anchor protein (Pex14p) conserved region
MGASIPIYTNKGDIQNCTNFRGVKLMSHTLKLWDRVIVSGSEVVQATNVDQQNAREEPAKQSSTTSVFVNSQPMREEQIQNAVKFLSHPKVRGSPVMYRRSFLEKKGLTKEEIDEAFQRVPDSAPTVQTGGVNQDGQLKSSSNIQQQAQQQTLQPGLPASTGVNTSSGTLSRSRFHWSHALIAVGLLAASGAGTAIIIKNSVLPRLKSWIRKVVLDSDDEQLKKTDNKPTPMEEAVQAAKSAAAAAADVAKASQEMLASKGEERRYFVEVVSLLDKQVQEMKSMTNAIRRLEVLAEYLFLTNCGQNIPSNGVSVSGQEDLRISQTSSKQLIVNGKADYDMSSGCHVVRSSSPPTSVEPSSGLHPKAYAEIMAMVQRGEKSSNIKHREVSQVQSTSTQMLQSQVNGEDLNTKALDAPLLNGDDPLPWWQRKNVRIREIDNENESNGVPNGAASSQQPIQQPVQRVWVPPQPPPIAMPEAAEAIRRPKPAAQKEQMSDNQSVAHSLDGSDDVHMDPKLLESEGAVEGSSVSSVPTSSEIQEEHEVKYDEK

SEQ ID NO: 156830 - protein, 41 aa, Glycine max
  Coding DNA Sequence Number=SeqID_40052
MGELKGKSDPTLTNHVIQKYWDSTWGLEDGKCELLKLLRGQ

SEQ ID NO: 156831 - protein, 660 aa, Glycine max
  Coding DNA Sequence Number=SeqID_40053
  Gene Ontology: Mol. function=binding; Cellular component=kinesin complex; Biological process=defense response
  Homolog annotation: Hit_ID=Q8S3S1; Match level="QueryCoverage=99%, HitCoverage=90%, E-value=1e-180, Identity=52%"; Hit description =Putative kinesin light chain gene
  Pfam annotation: Domain name=TPR_1; Domain location=312-345; Score =19.7; E_value=0.01; Accession=PF00515.18; Description=Tetratricopepti de repeat
  Pfam annotation: Domain name=TPR_1; Domain location=354-387; Score =5.7; E_value=1.1; Accession=PF00515.18; Description=Tetratricopeptide repeat
  Pfam annotation: Domain name=TPR_1; Domain location=436-469; Score =26.7; E_value=8.2e-05; Accession=PF00515.18; Description =Tetratricopeptide repeat
  Pfam annotation: Domain name=TPR_1; Domain location=478-511; Score =4.7; E_value=1.5; Accession=PF00515.18; Description=Tetratricopeptide repeat
  Pfam annotation: Domain name=TPR_1; Domain location=521-554; Score =11.5; E_value=0.23; Accession=PF00515.18; Description=Tetratricopepti de repeat
  Pfam annotation: Domain name=TPR_1; Domain location=562-595; Score =2.5; E_value=2.7; Accession=PF00515.18; Description=Tetratricopeptide repeat
  Pfam annotation: Domain name=TPR_1; Domain location=604-637; Score =13.0; E_value=0.15; Accession=PF00515.18; Description=Tetratricopepti de repeat
  Pfam annotation: Domain name=TPR_2; Domain location=269-301; Score =2.3; E_value=18; Accession=PF07719.7; Description=Tetratricopeptide repeat
  Pfam annotation: Domain name=TPR_2; Domain location=312-345; Score =24.2; E_value=0.00047; Accession=PF07719.7; Description =Tetratricopeptide repeat
  Pfam annotation: Domain name=TPR_2; Domain location=354-387; Score =12.7; E_value=1.1; Accession=PF07719.7; Description=Tetratricopeptide repeat
  Pfam annotation: Domain name=TPR_2; Domain location=396-429; Score =3.0; E_value=15; Accession=PF07719.7; Description=Tetratricopeptide repeat
  Pfam annotation: Domain name=TPR_2; Domain location=436-469; Score =20.7; E_value=0.0052; Accession=PF07719.7; Description =Tetratricopeptide repeat
  Pfam annotation: Domain name=TPR_2; Domain location=478-511; Score =11.9; E_value=1.4; Accession=PF07719.7; Description=Tetratricopeptide repeat
  Pfam annotation: Domain name=TPR_2; Domain location=521-554; Score =17.6; E_value=0.044; Accession=PF07719.7; Description=Tetratricopepti de repeat
  Pfam annotation: Domain name=TPR_2; Domain location=562-595; Score =3.5; E_value=13; Accession=PF07719.7; Description=Tetratricopeptide repeat
  Pfam annotation: Domain name=TPR_2; Domain location=604-637; Score =14.2; E_value=0.47; Accession=PF07719.7; Description=Tetratricopeptid e repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_2::TPR_2; Domain location=312-345::354-387::436 -469::478-511::521-554::...
  Pfam module annotation: Domain location=562-595::604-637::269 -301::312-345::354-387::396-429::436-469::478-511::521-554::562 -595::604-637
MPEIVTNGVNDERRVNEMNEIGNISPLRETPSPIKNLRSSLSPQRRQSVGPNFPVNRVIDTSSIDRLHGNVCDKQSSSQSPSRQSFGSDGNESKTDSELHNLVKEGVKKKTKGDSRSEASSKMGSLSNDKKLDRIRPATASGVVSQKLKKASQSQLALEFPSRSRPKGKSPPPKPPVDRKNDNNPLGKQNTRVIRVKKTVGGRSLSQSHIENFTGSALDRPDLGLALLNQARNMISSGDNPMKALELSLQAMKLFERAAAYGKPSLDLAMCLHVTAAIYCSLGHFSEAIPIIERSIEIPTIEEDHQHAIAKFAGHMHLGDIYAMLGHLEKSIKCYTEGLKVQRKALGETDPKVGETCRYVAEANFQALQFDEAERLCQIALDIHRANGSPSSLEEAADRRLMGLICEANGKHEAALEHLVLASMAMVANGQHVEVASVDCNIGDTYLSLARYDEAIFAYQRALAVYRTHKGENHPSVGSVFVRLADLYCRTWKIRESKSYCESALKIYENPMPGVPPEEVASGFMNVSAIYESMNELEQALKLLHKALEILNEASGQQNTIAGIEAQMGVMYYVLENYTESYNTFKNAVSKLRATGEKKSAFFGTVLNQMGLACVQLHALDEAVELFEEARVILEQENGPYHPETLGVYGNLAGTYDAIG

SEQ ID NO: 156832 - protein, 230 aa, Glycine max
  Coding DNA Sequence Number=SeqID_40054
  Homolog annotation: Hit_ID=Q9FM13; Match level="QueryCoverage=82%, HitCoverage=78%, E-value=4e-19, Identity=35%"; Hit description =Arabidopsis thaliana genomic DNA, chromosome 5, P1 clone:MQB2
  Pfam annotation: Domain name=DUF588; Domain location=99-213; Score =104.4; E_value=3.3e-28; Accession=PF04535.3; Description=Domain of unknown function (DUF588)
  Pfam annotation: Domain name=MARVEL; Domain location=101-226; Score= -14.9; E_value=0.085; Accession=PF01284.13; Description=Membrane -associating domain
  Pfam module annotation: Pfam domain module=DUF588::MARVEL; Domain location=99-213::101-226
APLTSPFLPLSDNGDPFHSPENSPQNDLRDNSRAIVIVETTSTQFAQAAPPAPESEHRNPPPETFITRPVRPDTRSPGVVGRTRPRAVAPPRPMVPKREVMAKKVAFCFRLSEVVLCLISFSVMAADKTRGWSGDSFDRYKEYRYCLSVNVIAFVYAAFQAGDLAYQVLAYLLISAASSAATRVDDWQSNWGKDEFTEMASASIALAFLAFVAFAISSLFSGYNLCTLFS
